United States Patent 12,258,632 (METHODS AND COMPOSITIONS FOR DETECTING ESOPHAGEAL NEOPLASIAS AND/OR METAPLASIAS IN THE ESOPHAGUS) - sequence listing, part 2

SEQ ID NO: 6103 - DNA, 896 bp, Artificial Sequence
  Description of Artificial Sequence: Synthetic polynucleotide
aygaggattaaaggtaygaatttgtttttaygttayggttygggatttagggtgyggggattaygyggagygtagtagagtttagggtaggagtygggaggtygygtaggtagagttygggtagggyggaggggaggtygyggagggtygggtggaggtttttatygttagttttaaggtttgtagtatttttttttggtttttgtttttagggtygatgtgttttygagygaagtygtygtgtttgggtagaaggygttttaggaggygygaggttttagtygyggygttgttttygtygttattgttgttgtttyggtttygyggygtttagtayggtttygattttttagttaggyggyggtygttttygatttygyggtttaggygtagtttttaygttttggtataggattgtatggtygyggttatygttttttgtttyggttygtaagggttagtygygtttttggttttttttttggtttyggtttttygggtggyggttgygttyggtttggagtttttttygttggatagtyggtyggatagatggatggaygttygygggtaatgaatgggygttgygtttaattaagatattygygtaaagttgtggttttatttaaggtatttgtttygtatattttaagyggygttttggaggygggaggtgggttggggttaggaagtttttggttaatgaaagtagatagagggggagggggyggaatagttttygttttygttttttttttttattttttttttagttttttygtggagtttygttttttttggatyggaggttgttatttttagttttatttatttygaygttggttggtgtygggggtygggaygtttygtaygtygttygttagggtgtggagtyg

SEQ ID NO: 6104 - DNA, 1494 bp, Artificial Sequence
  Description of Artificial Sequence: Synthetic polynucleotide
tyggggtttttttaagyggagtattttaaaagtygtatygygtagtagaggtttttaggggtttttattygtttttagtgattayggagyggtttttatttttygtyggygtttggttattttttttttttygtagttttygtttgatttttatgtgattgtaggtaagaatagtttagtttttgtgtttttgtaaagaaygtaaataaaaatgtatattattattatttaataaaygygtaatttygtaagatataaagygttttttaaatatygtttttttggtaatattyggtattttggggttgttaaatygtagataaagaygtttattagygyggggggtgaggagattaagggagagataagattaaygtgtttttattaaygggagyggyggttaaaagggygtyggtgttaggggtgagggayggggtatyggtattaattagyggttygtttyggggttttygyggttaaggygagaaygtaggattaggagtattgttgtttattttttatygtaattygtatatttygggattaygtaayggyggatggggygttygggagyggtttttgtaggggagagtaataggttttygygttttggaggtttggtttgygtttygggtttttaggttaatattttatttttagtttttygatattaagattgtgtttttttgggttaaggaaaaggaaaaatttttaaattttttagttagygagagtaaaagaaaggggtggygggggtgttgaaaggtttaggattatttatygyggggttggggggagtggagatttgygagtagtaaaggaaatttttagattttatttttttaaaaaagttatagtagyggttttygygaagygtygggtygygyggggtggggtaagygtatygttttatygttttayggttygtygttatttttatttttatttttatttttatttttattttygtttttatttttatttttaagygtygagtttagggygttygygtatttttttygtyggygygygygtagggygygggggygygtttyggtttttgggtyggggtttaagygtygtttattyggttygyggygttygtttagggtygygaygygagggggyggaggattggggagtaggggtygtyggggtttttggatgtttygtttygtttaygtttattgtttttttttttgaagtaaygattyggygaggagtttyggattaaaaygtatagatatttaygygtgattgagaaatttaatttygyggtggttygaygttagtttagygtttygtygygtttttttttttagygygygtygtatttgygtygatyggggttgtygyggaggyggtggyggggtttaggttgttggggttgtygtgaygtttgygatyggyggggyggygggygygttttggttaattaggggaygyggtygagtaggtttgtgyggggttttaaattygtttttgggtygttyg

SEQ ID NO: 6105 - DNA, 828 bp, Artificial Sequence
  Description of Artificial Sequence: Synthetic polynucleotide
tygygattttatyggggaaatatygyggatagtygggttagtagygttyggagtttattttaggtttttaaatttgtagtattttttagagygygygygttyggagygggatttgtttgttttagtgtaygtygyggagygaattatygggttggygggggtggaggggtgtaggygtgggggttgygggtygttygggttttgggttttttttgtygtygtygtygtttttygttttyggttaggagtygygygtgaygyggttygtygtaggagtttygaaggygyggygtyggygagttttttttyggtaggygygtgggtggtagyggttaatttgatagtttttygggtygggyggttagygyggaggygttaygttygggtygggggygggttgaygtygtygtygtygygggaggagggataaaggggtgggttttygygggtyggtatttyggyggttgggttgygggttagagtattgttyggtggtgtttaggaggagtaggagtaggagtagaagtagaagyggggttyggagttgygygtttaygygggatttgtgttygaaatgtyggtgygaggagatygygggtttttatttyggygggagttgttaggttggtttygygtaagtgtttttttgtgtygygyggttgggaggagggtygtgagygtgagygtgggagygttgggggttttgttygygtgttgttttgaagttgtttttygatgygtygtaggaagttgggatttttttattyggaygtgggaygtaggggaggggtaggttttatygttygggttgatgattygtggttttyg

SEQ ID NO: 6106 - DNA, 2705 bp, Artificial Sequence
  Description of Artificial Sequence: Synthetic polynucleotide
tygtgtttggtggttygggtggggygtagttgygggaaatgtattyggagttgtgttttttttyggygaatagtttgygttattygtygtatygggaggtggttgggggttgtygagygagtggtgaaygygatgggtggagagygttygaaaygaggtggaaaagggggygggggygaggtayggygtttttttgttttttttttagttatagaygyggyggyggyggttgagttttttagtttyggttatgtgatagtttygaagygttagttgygggggtttyggygtttyggggattattataaaaygtagttaggagagygygtygttgttattgtygtygttttttttttttaagataagttygggagaaaggyggtagttgyggygyggayggttgagttttttyggttagtatttatttagtattygtagaygttttttttagttygtygttygtttttagagttttgygttttatattttttagtagaatttgygggygttgtygttttagaaattattaaagttttttttttttagygatagtttagggttgygygttttttttaatttyggygaygttgygagtttyggagaaaagagaggygttttagaagttaattttttttttttttattttgattttttattttaggaaaaggagaattttagygyggtttggttaagtgtttggttaggggtttgygtttagggtattggaagttttgttgttattggtttttaggatagtaggygtaaatttagatttaaagggttagagtttttattgtttagattttttttttagttattttggtttgggtttttttyggatttagaaaaagtaaagaggtygggaggaaatayggttttttgttatttttttttgtagttagttttagtatttagtttttggttattygggggaagaygtagagaaggyggyggtaaatttggtgtatttygttygygattgtgygygttagtyggtaatygtyggggttagaagttgttagttttygagagttgagtaggttygaaaggttaaggtyggagatattaggtaattyggagaaggtaggagagagaagtagagagggtttggagggygagagggtaaagtggygggattggaggggtygagtgggaattagtgggggtagttaggttttaggaayggagtgyggagagattttgtggtttagtgygggtyggagggyggtggaggagtygggggygatgtygyggtyggggaagagttygtatagygattaaaaatygttttatttttatatttygttgatygttatggtaatttagtattyggtygagaagatgttgtygttgagygatatttataagtttattatggagygttttttttattatygygagtatatatagygttggtagaatagtttgygttataattttttttttaaygattgttttattaagatttygyggaggttygattagtttggtaagggtagtttttgggygttgtatttygattgyggggatatgttygagaayggtagttttttgyggygtygtaagygttttaaggtgttgygygtygattatatttatttgtaygygggaagtattaagagygygtygggygtyggttygggagggtatttttatttttattattattattatttttattattattattattattaygttgtygtatattattattattattattatttattttagtygtygtygtygtygttttygtygtygtygtatatggtatattatttttattagtaatygtttattgtttygtagtygttttygtatttttygttatagttttygtagtaatygttttagtagtygtagttttagtagtygttttatttyggtaagatgtaggaggyggyggtygtggyggyggyggyggyggyggtygyggtagtygyggtgggtagygtgggaygtttgttttagtttttattttaygggttgggttyggtygtygtygttgtygtygyggtygtggygtttaygttaggttttaagtatttttttgttattgagaatattattggtygggattataagggygtgttgtaggttggagggttgtttttggygttygttatgtattatttgggttatttygtgttyggttagtttggtaaygtygttagtttygtgtggtygtaygttggygttatggattyggtggtygtygtygyggtygtygtagtygtagtyggagtttttgtaggttyggagtatggggttttyggggtttyggttaagtttttgtgttattyggtaagttagagtttgtttgttatgtyggtgtttattaagtttaygtttgygttgtygttygtgttygygttgtagtyggggtttattgttttygyggtttygtagtagttttyggygttatttatygtgtgtttygyggtygyggtttygttygttgtttttttgttggagtttatagtttttatttyggtygaaagtaagggyggttttttgtattyggtgttagtgtatttttaggggattyggygggygtggggagattagyggggtgagagaygtygggttyggaatygtttaaattattygayggggagagggygttttggttaggtygggtagagttggygagttttagtttttgttggaayggaaggtatttaaatagaygaataatttyg

SEQ ID NO: 6107 - DNA, 704 bp, Artificial Sequence
  Description of Artificial Sequence: Synthetic polynucleotide
gyggaatgtgggyggggygtagttggggagtttgyggggaatgtgggyggggygtagtggtgggagggygtaggagtgtgggyggggygtagttgggggagggtgtagagatttgagggtttgaggttgtttggttggtttygtttttagaggygggtgtygygttgtygtttaggtatttggggtttttggtgtttgagtgttttattgtyggygygaatataattgttttagttataggygaggtttggttaaggtgtgggygtatttggggtaggttttgagaggtttagygttyggtggtgyggatagaggyggggtatygyggygttygtygtygttttttygtaggtgattatttttttgtaggtgttttygggttttaggtggttgygtgtttgygttatggttgatattttgggygagyggtatttggtgatttgtaagggygygayggtggaggtygaggyggygttgtagaataaggtggtggtattgtatttygyggyggttyggtgygygtygagtygygattttaygtygttgttttgygatttttatayggygttggtggtygaggygyggyggttygygtttttygaagtggttttygtgttagtygayggtagtttttaggagatgttggattttatgygygagttgtatggygtttggttggygttgtttttttaygatttttatyg

SEQ ID NO: 6108 - DNA, 950 bp, Artificial Sequence
  Description of Artificial Sequence: Synthetic polynucleotide
tygggayggagygggttattygagtggtaaatttttttttaatggatgygggaaaagygtatttgtagttttttttttatygttgttaagygagttgattgttaaggagtgygtatttgtttgtttttaaygtgatagtygygggagygtttygtatttygggttttagggaatgaaggagtttgtttygaattggttttagaatttttagtttttagggyggttygygttygtatttattttgattaygtaggtgatttygggttttagtatttggtygttggygtgyggygtttttygagggggtttgggtagyggttygtygtygggtyggttttttttggyggygtttatggtyggggygyggggygtygagggygtattgtygttyggggyggttaggttgggygygttgtagttgttygagagtygygygttygttygttttygggyggtygaygataggtygyggaggttygagttggagagttttaggtgggatattttgtggagtaggtggtttaggttgtygggtttatygtygggygttttgygtagygtttygtyggatattaagtagggagtygtygtyggggtygygygygtygtygaaattttgttttygtygtygtttatygataggttgtggagaaggttatygatygatgttatygagttatttttgaagyggttatatttggtgygtggaagtatgttttttygtgggttygttgtattygttygggygttgttggtgtyggtttyggygygggttgtygygtatagtaggygagttattgttttyggagygggayggagagtgggggtttygggatagttttttggagaaygagagtagagtaagaggatggtgtttttttatygttaaaagttagtatagyggyggtygygtagtttyggttygggagatygttgtttggggttgtayg

SEQ ID NO: 6109 - DNA, 4861 bp, Artificial Sequence
  Description of Artificial Sequence: Synthetic polynucleotide
gygtygtygttttgagtattttgyggaaaatgtgagaattttggggagttattgttgttgtaaggattygygggygggttatygygttggtgggggggttttgtttaaattttgygttttygattttttattygttttataaagggttggtgaagattattttaaggatygtaygaattggttttttaagttttaggaaatygaaataataatygaggyggttttttgttygggttattttyggagygagttttgyggyggatttttggttttygtttttttgggtattygyggtgyggttagatygtttttgttagygattttttggttggtaagggagaggaggtggagtttagattggttttttaygtttagagtggaagygatttttaggattttgtagttatygagtygttygtygtgtttagttygggtttgatggtgaagagtatagttgttttygatagagtyggaggaaaggaagtttaagaagtaattgttygygtttygtttattttgtygagtttatttttatttttatttttattttttgyggatttagaagttgttttatygagttygattgtgttataaaatattttattggaaaaaaagttatygttttygtaagagggggtaggggttttagygatatyggggattyggtttttaggtygagtygaygggttgtttyggggtaattttaggtygttgtggtttgagtttaatygttgggttttygaygtttagaagygggtgtgtgtttggaggtttttyggtygggagggtaggttttagayggggtgggggtgtaggygaggagyggggygtgaataygygtggagygttttgygttayggagtttagggtagagattgtagttttygtygggttggatgygagttttttaggttagagtttagaagygygttgggatttgggtttggtttttgggtttgtgttttttttygtttggttttaattgttygtatttaagattataataaaaaggtttaggaagtaaattttttggaygyggaagggtyggttygygggttttygtygagtgagggggttgygggtggygygggtattttaggtttygtatygtatatygtttttagttttygyggtttttgtygttgggttygttyggtattttygtyggtttttttgtatttttggygygtttttgtttagtaagttgttygttygttggaattgagttttttttgggtygttttttgggtttggtgggagattttaggtygtygttttgtagtatttgtaygggggatygttagtatttgggtgagttagtaygtggattggggattttygaggagatttgaatttaggtaggattaaggagtgtagggtttatatgaggaaatggtggggaaatgtttygggaaatggyggttatttgtttaaatgtygtttggggagyggttyggtttggggagtataagattgttaggaggtttgaaggtgtygygggaaaggaygaaatgttggtttatttaaggggtagaaaaaattgagaggatttyggtgygtattaggtatygagggaatyggggggttgggtagagttttagtggggagaaagaggagagtagttttgtatgtatyggggtatggtttaggaagttgaggggtgggaagttattaggtatatttattatttttttttattttatttttygattttggtattaygtttttatttgtaattggtttaggtttagggatttagtaagatttattttggaaagagtagggygtatttttagtaaggtaagtgattatatttttatagttygttggttttagttttgtatygttttatttgttyggygtggaaaggtatttttgtttttygaagygtttttttaggtttattagttgtagttyggtgaatatagtgyggtttygaygtttttttttggttttggtgtttggttttttagggtttgtygtttttagtttttygyggagttgtaattygagyggtaggtgtggygtattygyggygtygggtagttygggttttgtygttagtaaygtagagtttagttttgaatagtttagyggygttagtgggaatttgaatatygtygtttgttyggtttttagtayggttgygaagaaagagaatgaggattygggtgagttayggtygygtttttttgttttagggattgtygtattaygtgtygygggggtgttygygtttggttagtgttttttagygtaaaatttttaygttttgtyggtyggygtyggtggygtagatggagattttttttaaygttgtygttttttagatttgggagggagtattttttygattttgttygtgttttgttttggagttttttaggttttagttgtttttgagatttyggggtttttgatgaatatgtttgtagttgygagaaattyggagtgtgttttgtttttyggggaaagtagaaattaaaaagaaaayggtagttggttttaagaagatggygtttgttttaattaaattagttttgttgygttagaaaaagaatatgtayggagygtgtatatttgttttttygtgygtggtataatagttatgyggtggttaggagttatttgggtyggagttgggtgtttttyggaaattttaaagtattttgagaatttggaaattattgtttaygttttttatttttagaygtttttttatgtagatgtttttattttttttagttttaaaatgattgtgtgttygttttaaaygaattagtagtaatagagtagatggagaygaaaggtagtygaatggtygagttttagttggatttagaaggagygygttggttttgtygtttttaggttagggagtatygattaggaggtgggggggtgtagggaaggygatttgaagggttggggtttyggttatagygtaggagtttttttttttygataggtttgttattgaggtgygagttttagtttggttggagtyggaaagggtagggtaaggygtaggtaaatgtggggtagaggattygtagggaaaaggtgggagatgggaggtaggtygattttaatgagagaagygagggaggtygatyggtagayggttggaaagygagatagggaaagataagaygagggtggagtgygatggagatagtattattagggtagagtaggtttygttaaattagaagaaagggtagaagttgaaaaggtttgygtaggtygtttaagttttgtagaggtttagtygatttgaaattagaagggatagttaggtagttgtttatagttaggtttttggttttaaggtaaggtygaagtaggttygtattgyggttaaggtygygtttttygttygttggagttttyggggatttygggtyggtttgggttygygttagtatttagttttygggagygtaggttttttttttagaggttygatttttttgggttgggtagtygyggttattttyggttatttttttgyggygaagtttaggygttygtggtttgaggtygtttttatttaygagagttygtagtttggtagtgygtttgtattggggatgtttattyggggttttygggttggaggtygaagggaagtagtgaaggaaagagygaatatttttttygggyggttygygggtaygaggtttggtttttgtgaggtttggagtttgtatttttygtttttygtttggagggtttygagagayggttttagaatttgygtttttagagtagtttttyggggttgtttygatgtyggaggaggttyggggygttttygyggtttagttygttgtttttygttaagttyggttygygatttygyggtygttataygtatttaggtggttgtggaagggtygygtygttagtagygtttgtaygtygaattttagtagttygttygtygyggtagyggyggttgygggygyggygtttttgggttygggtggtttygtgaggatttttttaattatgaagttgygatagyggtgyggtyggtggttygygtagttttygggygggtygaagygygyggygttyggttttttyggtygttgtatygyggygtttattgttgygttygyggtttggyggyggyggyggygayggtttggtttyggygyggggttygygyggggttttaggtyggttygtagttyggggyggygygygggygtyggtttatgttttttttttygtyggtyggtygggyggaggygtagggygygggyggggygygyggggttyggtyggtygaattygggattgygttttttttttaygtygtygygttttttgttyggttagtttygygttatygtttygtttygtttygtttygygtygttgtttttaatttttaggttgagtyggagggagggatttagaagggagggaggyggaagggaggttaaaaaggagggggttaygtgaaagaggtyggtygatygagatygagggagattgagyggagygtaygttttggaaggagagagtyggagagttygggaggtaagatttttagagaygagagtyggagggattaaaygatataggtgagagaaggggtagaggtagayggygtgggttaaataagattttagatagtgatgtgagggtattagagaygttatygagatgtgygtagagagattaaaagaggygtgagagttagygggttgtgaygtgayggagggtatagaggtaggyggggtagaggaagggggyggtaaagaaatgggaatagttagaaaatyggyggtttgatyggtttttaggtagtttyggaaaggtygggaggaggaggggtaaaggtygyg

SEQ ID NO: 6110 - DNA, 999 bp, Artificial Sequence
  Description of Artificial Sequence: Synthetic polynucleotide
gygtaayggtttgtttgygttttttgyggttatagtygatataygttygtagaygtaygtayggatatttygttttttattagygtaygaagaygggaygygygtttatagttttagggttyggttttgtattaygagttaaygygyggtttttagggaggtggygtagaaggtatggygtttttgtttayggygtttyggttttggtagtttttatagagattttygttgatggtttaggtttaaaaggttttttttttygagtttgygtttttttagttttttygttgggttagggtttattattttttttygtyggygagygtgggtttttttggaggygggggtggttttgtagaggtagttttaggtgygygttggagaggtyggttygtygygygggagatattttttttaaagtggaagygttgygtgggtagtagygygggtygggttttyggattttagtttttgttgttttygagattttygtttygygtygtatttttygagtttagygttttygggttgygttgggygtagtggttttyggttagggygtagtyggtttgggygttagagttttttttagttttyggtttagggyggggaagygttagttttygtagtttttgtgaaaggttttttgtgttttttgtttaggtgygygttgtggtatttttggttagaagtatttttggyggtttgttgggtttttygtagtttttggttgagattttgtygtyggygttaaygggttgygttygygttttygttttgttttygttygggtttygggtttygygtgtatattattttttggttttttttattaaaattttttgatttttagttygatgttgtygtygyggttttyggaattgttgtttttagayggygagtyggggttgggagyggtttttayggggayggatttttttyggaggyggaggtggtttttttgaygygaaaggtaggggygygtttyggtttttagyg

SEQ ID NO: 6111 - DNA, 1750 bp, Artificial Sequence
  Description of Artificial Sequence: Synthetic polynucleotide
tygyggttttagggttyggygatttttaaggttttygttttaggygttgygggtaaatagggtttgggggtttttttttatygygggttgagttttygttatttgttttttttgtygygggtatttaagtttyggaatttgygagttaggtagygttttattttygyggygtygtttttgatggttattttgtggatttttygtagtttttagttttygatgtggtattttygattygygtatttttggtttatggagtttaggagygtttggtttaggygtttttygaaattgaagagtttttttatggtggygattttttagaygttaattattygttattgagtygtygyggtttttygtggtttttttatttygattaagttttaaattygygatttttttttttatttygttatttatttttaaatttaagatttattattaaattagtaatttatttttaaatttaagatttatttttaatttygygatgtagtttagaattygygatttagttyggtttattatagtttttagtagygatattygtagttttygattttttagatygagtgagtttaattaagtygttattygygtgttagtagttgggygtttygattttttagatygygtgagtttagtaaagyggttaggygygygtttgtagttyggygttagttyggatttygggagtygttttygagttygygtggayggtagagggyggttgtagttygggygtaggygtygttggtttgygggtttttttgggttygygtaggatatttyggaatygtaggygygtattttttttygtttgagggttygtttggtygtgattttygttttttttttttttygaagagagatggggtygttggtaggggtttttygtagttatyggggatggggttgagggtyggtttttgtttyggtgtagtygtygygggtagatygtttggtttggtygtagttatagygatatttagtttyggttttgygaggttgggygygttagttagtttgggagttgtttggygtttgtagttgggygtttaggtggtggagtatggtttgggyggtttttggatygygagtgtttttggtttgagagttygttagattttgtttttattyggttttttttttgttagagttygagatttttagttaggggttttttgtaattatyggggatggggttgagggtyggttttygtttttgtgtagttgttgtaggatagatygtttggtttggtygtagttatagggatatttggttttggttttgagatgtggggagtgygggygggttygagagttgtttggaggttgttgtttgtatatagaaggyggttgtagtttgggtgtttaggygggttggaggtgtatggtttggtyggtttygggatygttagygygtttagtttgagggtttttaggtygtgtttttygtttatttttttatttgagggggattggggtygttggtatgggtattyggtagttatttygtgtggggttgagyggygggttttyggttttgtttttgtgtagtygtygttgggtagaatgtttggtttggttgtagttattgggatatttggttttggttttgygatgttgggagygygagygggttyggaggttgttaggtagttgttgtttgtatatagagggygattgtagtttgggygtttaggyggyggagtatggtttgggtggtttttggaatgygtgygyg

SEQ ID NO: 6112 - DNA, 391 bp, Artificial Sequence
  Description of Artificial Sequence: Synthetic polynucleotide
gygtaggtygtagaattttttygygaaggtgtygtaggaggagtygtggygyggtatygtttygtyggygttygtgttttttygygygygttttyggggttttyggtttttygggttygtatygtygttygyggggttggttgygtaggyggygggtttygttagtagtagtaggagtagygaygtttagattttygggtgttgtyggggyggtygygttattygtgygtatagatttygtagttaggtygttygggtygtagygggggygtygygggygygggtygggattgagttttygtygaggttattagtaygygttygygtagtygyggagtttttygtattttygtttttttgtttyggtttgygtattttygttttagtatyg

SEQ ID NO: 6113 - DNA, 817 bp, Artificial Sequence
  Description of Artificial Sequence: Synthetic polynucleotide
tygggatagagaygggtaggtagyggtgggtygaagggttyggggattagggttygggtygggaggggygggygttttatygyggtttgttggaaggygtttttggtgtaggtgtygttatttyggtaggagatggtagggattttttggaggagtagygygtatttgtgttggygygygyggygggtggagatgtaatygaygygyggtattaygtagtttttggaygagaaggttaygatggttaygygygtggtygtgggtattayggggaagtyggatagtagtttgyggaygaatatgagttygttgyggaagttgatttygtttaygttggaygaattatttattaggaagataagttttaggygttygttgagttttygtagtagtygtaygygtygtyggaaygtttggtttagtygttttattttgtttttygtygtttygtygttaggagygggyggygyggggatattttygggggtttygggygyggtttyggggaagaggyggaagttgaaattgygygayggggatatttgttgaaaggtygtttagttygaaaygagygttagattttagtaataaaaggttaggygaggttatatygygttggagatagagyggttgtttyggagygtaggyggyggttygggygggaagaggygttgggyggtyggattygtagaggggygtgygyggagttgggygyggggtagyggttaagagttttagygtttttttatttgatattggggatagatataatttagattttttagtagttygggaatttyggagggaayggygygyg

SEQ ID NO: 6114 - DNA, 814 bp, Artificial Sequence
  Description of Artificial Sequence: Synthetic polynucleotide
gygaagaaagtygaggygtygaggtttttaaagttggtagtttygggtggyggtgtaggggygaagggggggyggggggaatygtyggatatgyggttttggagttgggtgttgtatttggggttgttgagygtygygttgggttgygggttggtygagygttttygtygggttyggagagattygygggtyggtygattttygygtttygtygtyggttyggttatttgygttattygggyggttygyggtygtygygtttygtygtygtygtygtygtygtygggyggtgtttgggaagtygtgygygtttttyggyggyggtagtagygggaggygaggggygttatygaggagtygagttygtygagtygggygttttattttagygggygaggygagtagttgygttttygggtygatttygagttgtttygggaygygtttaygttgtaagtgtggttgygagyggaggggggttagaggttttyggtagtgattataggtaggtgagggygtttyggygggygttgtatygtttttgyggttttagaggttygygggtgtttgggygygggtggygggygggtygggggtttgygggygtgtttgtgygagagttgtttygygagyggygtagagatattygggygagttgagagttttattttgttttatyggtggaatgggtatattyggaaggygtagttgttttatttttgggaggaatttggggagtttttttggyggtttygyggattttyggttagtgagggttggttttyggagtttagggtaygtaattygtgtttyg

SEQ ID NO: 6115 - DNA, 1429 bp, Artificial Sequence
  Description of Artificial Sequence: Synthetic polynucleotide
gygygtataatgaagtagttgtttgtagygttaattagttggygattttgaggttattgygtggttttgttttggtygtttttaataaygggatagagygtygggtatygygtattgattaattatttttttttygyggtygttyggtttttttttttttttttygtygggtttggttttatttttttygggyggtttgygtttttttttttygyggtttyggtttygtggygtyggtagtttygggagtttygggaagtttgygygyggtagtttygtagtyggtagtygggagtttygtagttttyggggagygtyggggttggtggtttttttgttggaggaggygtggagggagygtttttgttttgagttagttayggtggtyggttggaggttgttattttattatgygtygggtttgtttgtttgygaggaagtagatggtggggaggtaggtagyggygagagtggttagatttgaatttygtttatttgttattttttataaaaggtaggttygggggatttaggtattygttgttattttttgggggagggggaggtygaggggtygtygttttyggygtttgygaaggtttygtatttgtyggtgttygttttttttattttttgttttttttttggttgtagtttttygtatygygtaaatgttatttaygtgttaggatgtgtgtttatagtttgtttttttgtttgtttagtttyggyggatagggtttagyggttgygygaygtttttygtygttgggggagattagtaaagttattygtttttggatttyggggtttgggtttttagatttygtttygyggygggagatgygtttgagttttttatagayggagygygttttagtttgaygtagagggatgaatagataagygtatygggygggaatttygattgtttgtgtatttggggtyggtttagygttggaygtgggttgttggttygagaggtggygayggaatygygtgtttatatgtatgggggagtggaaagtygtagggtgtgtttttaygttttttgagtagttygyggtaagagttgttgagtattttatttttygtttttagattttaaggtagtttttygagttttttaaaygtattgtatttagttttttygagagtggagttgtattaaggataaatattttagygttattataaattttttttgttttttgggygatttttagatgaattttggtgatttttagattggatttttattttttattttttttgaaagaaagtgttttagatgygttaataaaatatgtttatgtattygtgtaggygttygtatgtttgygygtyggtygtgtgtaggygtygaagtataygtttgtgtgaatataygggtaygygygtttttgggtttagtggtttttttttygyg

SEQ ID NO: 6116 - DNA, 7708 bp, Artificial Sequence
  Description of Artificial Sequence: Synthetic polynucleotide
tygggaagagygagaagttataygttgggttgtagattgggttttagygggtttggagygtggatatgttggttggttttttttttygggagttatagttttygtyggtttygttatttaggttttgtygggtatttaggaggtttgtayggtygtttgtagttygttgtgtagagttygggtygaaggyggagttygatgggaaayggtyggtygaaggtttttgtaattttgttataggtttgttttttygggttttttaggygggtgtttgaggtygyggttttaggtygaggggagatygtagtgagaygagtatttttttgttgygtttttttaggatagagggtttaatttttttttttgaagatatygtaggaagttgttygtattttaaaaattttaaatttygygtttttttttttttttgttttttttttattttygttttttagtttygtttattagtttttattatttygatttttttttgttttttttgtttttttttttttttttgggtttttygttttttyggagtaygygttgttagggtttggggygtygagyggttaatggtayggyggtaggaygtgatgttaggygyggttgtagaaaaggygyggaggtttgygttggygyggattgtagagtyggggttgggttaggygygygtttggagagtattgygygyggttgggttygyggtyggyggtttttttttttattttgtttttttttttttttttttttttttattttttttttygtttttttttttttttttttttttttttttttaattttttyggtggttygattyggttygtaggtttyggagaaatttttattttagtygtygatttagygtttaagagggtygttttgggttgggggygtattttagggaggggaggggtttaggtagttgggtygtygyggatatttagyggttttagggtgaatttygatygtagtygtygtygtttygggtagagtttgygtttttgttttgygtttygggygttgaagtygggygggygatgttygyggygtgaaagygttygyggygggygtygatttttgttttagttttttgtttttttygtttygtttgtttygtgtttttgtgattttggttttggygtygtygtttaggygtttygtaatgtagttgtttttgygtttyggygggaggygttttgtttygygagygttyggggttyggagttyggtttgggggtttagtygagttygggyggggtyggggtygyggtggygatgtatygggttygttagygttaggagygttaggtagttgaggyggggggtaagttttttttyggaggagtygygttttyggtttygtyggtttygtygygatgttgttttatagtttgtygggtttygaggtgtayggggttatygaygagatggatygtagggttaagagygaggttttygttattagtttygttatygatygyggygatatygagayggtaggygygyggttgtggggtyggggttgagagttgggatggggtygggttagttagygtttttgtttttygaagtttggggagygtttttygtgtygtaygggattgggtgttggggattttyggttagaatgtaaggtyggtggttttyggttygggggaaattyggttgttgggaygtagaagggaaataaggttgaaatygaaatttyggttttgggggtagaggagagygtttttttygaattggaagygaagttttattygyggttyggggyggttttttttttattttgttyggtgtyggggtygatagtttygygtttttttttatttttyggtttyggttgttggyggygtygygagyggygttagggaagggygaattagttgggagtattggggttttagtyggtttgggtygtttttagtttttyggtaatyggggattttttttaatttttagygtagttttagaggtygaagttttyggggttaatatttgtygttgatygygtttttagatttttgattggttagatttagttaggttagggttgggagtttaggtttyggtttggttttygtygaaggagattttatttggatttttatatttggtttygygggtttagttttaaatagttagtttttygttttaggtttttttgggggttagaygagtagatattgttygattagygggtttagaagtgatttttaggaggtygyggaggtggggagtaygggagaagtttttttgtttygggagtaggagtagyggygttagtgttttttyggtttttgagygttttttyggttagattttttttgttggttagtttggatagggaagtatttgggttgaatttgttttttatttayggattttgagggtgtttttgtattttatttattttattttyggatttaagagggttttagttygtgtggtagaggagttagaagttggttgatttgttttggttttaatttttggtttaaggatttagggattattggagttggggtttaggaatttygttgtttttttaaagaggattttgtgtggagggtgatttaatggttattttatttttygggtggtttatttaagaagtagtttagggaaagtttttggagggtttgattggagtagttgttttggtttttaaatatagttygagtattttgggggaaaggatagggaggattggaaggaagagaggtaagtattagagttatttaggttaggagttyggtttgggttygtggttggygagggttgygtaggtaggtttgggttttgaatygtttagaaatggaaatgggttttttggggtggggggaagygygtygtatgttttggtagtttttttygygtttagggtagttaaggttatagagggagttgtgggtgtyggtttttyggyggyggaggggtygttggttgaygtaggygttgttgtttttygttttttttttttygtagattatgtygtttattagtagtgatygygtygygttgtgygtyggttgygggggtaagatttyggatygttattatttgttggyggtggataagtagtggtatatgygttgttttaagtgttgygagtgtaagtttaatttggagtyggagtttatttgttttagtaaggayggtagtatttattgtaaggaagattattataggtagtttttttatttaattgttttttaggatttttttttttaattttaggtatagttttatagtttggttttttttttttygtttagttttaggagagggtttattatttaggattttttygttttttttttaagttttttaagttattataagttgggtgataattttttaaagtagtaatttggggagtttttggaaaggtttaygaagtaggagaattagaaaaaaagtagaagttgtttttttgttyggagtttagattataaaaaagtttgagttgggatttttgtttttttttttttttgaagttttttgagttaattygaggttatagaaataggtatttttaaatttaggtagtttaagttggagtgaaatatagttggaaagagagttgtgggagtgggtgtatttttaggttttttgagaaaatgggaatgaaaggtggttaagattaaagaattagaattattagtagattttaagttttttgtttttttttttttttagttttaggattagggtttatgtatattttttttgtttttgtttttaygtttgtgtttttttttttttttttgtttttgtgttttttttaaattataaaagttagtaggatttttaggygttggtttggagggaggagtaaaggttgaggagggggtaagtggtaagtgtttttttttatttttaggtaaaggtttttttagggtttgyggagattttgggtgaagtagaagtttttgtaggtataagtgtgttaagggaaattattttaggataggattaggtttgggttaaaatttagtttttttttttttttattttttaaataaaggtygggttgttygttttgaggaggggattgtttttygtagtagtagyggtatttggaggaggaaaaggggggtatttaatygtgtgtttttatagtttttttttttatggtttttataggygtttttttgtgtagygttgygttygttgttatttgggtatttyggtttyggagatggtgatgygygttygggatttggtttattattttaattgttttaygtgtattaygtgtaataagatgttgattaygggygattatttyggtatgaaggatagtttggtttattgtygtttgtatttygaggygttgttgtagggygagtatttygtatattttaattatgtygaygtggtagyggyggtygttgtagtygyggyggttaagagygyggggttgggygtagtaggggttaattttttgggttttttttattataatggygtgggtattgtgtagaaggggyggtygaggaaaygtaagagttygggtttyggtgyggatttggyggtttataaygttggtgagtgygyggygtaygaagygtttttatagggttgggggaaagtgtgyggtttygayggtygggagttggattgaatttttgtgtgttgggtaaatagygagttttaagtatyggayggtttygtagaagggatattagttttttgggtttttagattgtgygttttyggttggagygggaggagagggtgtagtggttttttgttgtttygggtgtagggttttgtttttgataaattgtttttttggagatggttttttggtttgggtttttgttttattttgttaggtaggaagtggtagggatggagaaagtaaggyggygttgaygttaaataggttttgggttggygyggttgagggtygggaattggggtagygaaggaaygaggtagggyggygagggttttaagagaaagggttggttgtggttyggggygtygagttyggtttggagtgyggtttgatttygtgaaatgttttaagggyggtaggtttggggaattygggtttggggaatttaggaaagtaaaggttgyggttttttttgttyggttygatttttttttaaagataggttttagttttttyggattttttttttygagttttttggygtttgttggggtgagggtygtgattttyggaagygagtttttygggyggggaygagatyggagtaggtttggtttygygttggggtggggtggggtggggtgaggtggggggtttggttyggattttyggtatttttgaattttaggttattttyggagaagttttgttttttttygygtttttttttgtttaggatagttgtagaggttttgagtttyggtaaatgagtygttaatatttgttygaagtttgtaaggttyggaaaggtttatgatttttygggttttygaattagagtttatgtgtaattattttttttttttygtttgtaatagaattagatttggagattttgtgttttttttttttttttttttagtttaatgtataagtagaaaaaagtaaaaataaaaataaatttaagattgtgtagagggtgttayggygggaagaagttagttatttttattttaaagaatttgagttgaatagagagggaaatgaggggygggtgttygttttaaygaaatygtttggaggattatggggygtgtgtttttgtgtgyggaattgggaggaaaaygtagtttttagtttggtaaatggtgaagtagyggtaggtyggtyggtggygyggatttaagatttgttgaaggtattattatagatgtagttttttggaatttttatttttttttttttattattttttaaaaaaagataaaatygagtttagatyggtttttttaatattaagtygtttttatttattaagtgggttaatttttattyggaagtatttygyggggttyggttttagggtatttggtggttggggagttgtattgtttttttgggtayggaggttyggygtyggttttaggattgtgtaaaaagagagtagaaggtatagagatttatttttgttttttgttgtttagtygtygtttgttttagygaggtgggttggaggttgaattttaagttttgtttaatttttataagagatattttttatttagttattttattttttttttggtttttttttttttttttttttttttygtttttttygttttttttttttatttttgtttttgtgtgtgtygtgtttgttttygtgttttttttttygattttggtyggggtttttagttttgagagaaayggygttyggtgygtyggyggtggttatgyggttggttttttyggggttttygggattaggttggggaaagagggtattttttyggtttttyggggtttagtttagtttttttagatttggygttygttttttttttttttttygtattggtaggagagaaatggtygtagtgtgggtygyggggtagttaggattggaaagyggggattttggagggtgygatygyggayggggtgtgygggygygggtygtgtgygtgtgygtgtagggtttygattayggggataygagtttgtttgtggtagtgttttatattttgtggtttagttaygaygattttttgtaaagttttttgttttggggatagttttttygaggygyggyggtattttattgaagggyggygagttgggggtygagtggggagggggygtygtyggggygtygggygttgggtttatagtagagtygygggtygyggggtyggaaagttttttyggggyggggtygtagyggttttttttygtagtttttygggttygggtttyggtggaayggaaatttttttttatttygggaggggttgttagygggttgggggtgygaaaayggyggtaggagygggygaggggttygggtygygtattttgygtttgggtttgygygtygyggtygygggagtttygygyggatyggtyggaygttyggttttttttagttttagttttttgtgtgtgtgtgtttggyggygtaattattgatttgattttaatttattatttagataattgaatttataatttygtttttagtaaaatgaggygaagttagatttgattataggtttagttttagygataagagttygaaattygatgggttaataatagattaygagtaaattatttatgattttaygagttttttagttttattgaatyggtttaattgagaggaaaaaaaaaaaaaaggagagagaaagttygggtttttttttttttttyggtttttygttttttttyggattygattttggggaatttygattygttttygggtattgggggygggagtgagggggttyggggygtyggttaaatttgggttttayggttgtttttttygtygtygttttttgtttttgtttttggtyggtttyggtttygttatttagggtyggtttttttttttttttttttattttttttttttttttttttttttattttttygttaataayggtttyggaaaaggtttttttygtagggatygggtttttyggagtttygggatttagttyggttatyggattttygttataagttgygtttgttttygggattygttttttttttyg

SEQ ID NO: 6117 - DNA, 3969 bp, Artificial Sequence
  Description of Artificial Sequence: Synthetic polynucleotide
tygggagtgtgggtgtttygggggygtgggtgttttaggagtgtgggtgtttygggggygtgggtgtttygggagtgtgggtgtttygggggygtgggtgtttygggagtgtgggtgtttyggaggygagggtgtttygggagtgtgggtgtttygggggagtgggtgtttygggagtgtgggtgtttyggaggygagggtgtttygggagtgtgggtgtttygggggygtgggtgtttygggagtgtgggtgtttygggggagtgggtgtttygggagtgtgggtgtttyggaggygagggtgtttygggagtgtgggtgtttygggggagtgggtgtttygggagtgtgggtgtttyggaggygagggtgtttygggagtgtgggtgtttygggggygtgggtgtttygggagygtgggtgtttygggggygtgggtgtttygggagtgtgggtgtttygggggygtgggtgtttygggagtgtgggtgtttygggggygtgggtgtttygggagtgtgggtgtttygggagtgtgggtgtttyggaggygagggtgtttygggagtgtgygtgtttygggggygtgggtgtttygggggygtgggtgtttygggggygtgggtgtttyggaggygagggtattttagaagtgtgagtgttttaggggygtgggtgtttygggggtgtgggtgtttygggggygtgggtgtttygggagtgtgggtgtttyggaggtgagggtgtttygggagtgtgggtgtttyggaggygagggtgtttygggagtgtgggtgtttygggggygtgggtgtttygggagtgtgggtgtttyggaggtgagggtgtttygggagtgtgggtgtttyggaggygagggtgtttygggagtgtgggtgttttaggggygtgggtgtttygggagtgtgggtgtttyggaggygagggtgtttygggagtgtgggtgtttyggaggygagggtgtttygggagtgtgggtgtttygggggygtgggtgtttygggggttgtgggtgtttygggagtgtgggtgtttyggaggygagggtgtttygggagtgtgggtgtttyggaggygagggtgtttygggagtgtgggtgtttygggggtgtgggtgtttygggggtgtgggtgtttygggagtgtgggtgtttygggggagtgggtgtttygggagtgtgggtgtttyggaggygagggtgttttaggagygtgggtgtttyggaggygagggtgtttygggagygtgggtgtttygggggygtgggtgtttygggagtgtgggtgtttygggggagtgggtgtttygggagtgtgggtgtttyggaggygagggtgttttaggagtgtgggtgtttygggggygtgggtgtttygggagtgtgggtgttttagaggygagggtattttagaagtgtgagtgtttygggggtgtgggtgtttygggggtygtgggtgtttygggagtgtgggtgttttagaggygagggtgtttygggagtgtgggtgttttaggggtgtgggtgtttygggggygtgggtgtttygggagtgtgggtgtttygggggagtgggtgtttygggagtgtgggtgtttyggaggygagggtgtttygggagtgtgggtgtttyggaggygagggtgtttygggagygtgggtgtttygggggygtgggtgtttygggagygtgggtgttttaggggtgtgggtgtttygggggygtgggtgtttygggagtgtgggtgtttygggggagtggatgtttygggagtgtgggtgtttyggaggygagggtgtttygggagtgtgggtgtttyggaggygagggtgtttygggagtgtgggtgtttygggggygtgggtgtttygggagtgtgggtgtttygggggygtgggtattttagaagtgtgagtgttttaggggygtgggtgttyggggggygtgggtgtttygggggtgtgggtgtttygggggtygtgggtgtttygggagygtgggtgtyggggattgtagggatatgggtttttttttttatttttgtygtttagggtattttttgtgaggattyggagttygtgagtttttatttttttgagttygattttttggtgttttygtttgtatttttagtttttttttaaattagattagttttttaggggygtygaygtgtgaaattgattttaaagaaaataggtagtggtttttttttyggttttaygtggtttagtagygtttatttttygttttttttttygygtttagtaattaatttaggtygtttttgtagaattygggtttttgtttatyggtttatagygtttatttgaggtttygtttttttagtaaaggtygttttttyggaaygygttttttgyggtttttttagagtttttttygygygtttttttagtttygttygttttttttyggggtttttttttttygtttgtttttaggttygttttttttygygggttgaggtaggttygggtagtayggtygtttyggggygggggttattttttattatygygtggtgtttatagtttayggygttttygggtgayggttttttyggttgtagggygttttgaagagyggtttgttyggagttgagygtayggggttgtttygttttgggygtttttggtttttattagtttygtttttttatgggtaaaayggyggttttgtttgtttataagtaatygtyggggttayggaggggttaggagttgyggyggggggttgtgtttttaggatyggttttaggaggattygygygaggtttggagtttttaggggtygygggggatagaggggttttaagyggaggyggggaaggyggtagaagtttaggatygttaagagttggygaggaagttyggggttygttgtygggggagtygggtaggggtygygtttyggattaggayggaggtttggggaaggyggatttggtygtyggagaygyggtgygggtggagaygagggatttggattttygygggyggttgtayggatttttaygygyggtttaygtgggttttagggggttgttyggtattyggggtygygtygtttttttttygtyggtatygattygtagttttaygtttaygyggyggygttygtagtttttttyggttyggttttygygygtgttttygagygygttttygggattagttttyggaagtagagaggttaggtygggaaggatgggygaygggggtggttgattygggagtayggtagggaggatatttagttaggttygygagtagygtygttttttttttttaggaygggygggaatttgygatgttttygtygygtgggtygtggggyggttttygaggtattgggyggggtaygyggtgggygttttayggaattygtattttttagttttygtaatttaggaggaagtttayggygttttgtatyggygtyggygygttaaygygtttttggaggagttgyggtygggttttttggagagggagtgtaaggaggagtagtgttttttygaggaggttygggagatttttaaggaygyggagaggayggtgagtttagtttyggggygtttygygtygyggatattgtaggyggyggtgaattaggtygygtggggtygtttgygtttttttggttgyggttgtgggyggygaataygtagyggygttygygyggygttttttgygggggtygtttttygttyggggtgatttygtttttttgggygatgttttttatttttaggtaygygtttttttygtgyggtygtatygygtatgtyggtttttatattagaaaataygatttgtaaagtatatttagggtgttttttttaattttttaagggagtttttttagttttygaagggtttagggtagtttgygtatygtagaygygygyggttygtagaagggayg

SEQ ID NO: 6118 - DNA, 2490 bp, Artificial Sequence
  Description of Artificial Sequence: Synthetic polynucleotide
gygtttttttttygttygaggtttatttagygttagygttyggtttttttgtagygattgggttttaatgtygtaygaggggttttygygaaggttaatggtattatttttttagttttttttttatttttattttttatttttttaggttgtggggggttaggggtygaggttygygyggygygtattttttaggygtatttttatygttaggtatttttggaagyggtagaagggatagygtttgygttgygttttgtygattttgtagttttggttttyggtgtaygtgtagtgtttgttgttttgtatygtgygtttgaagaagttttgygggagttgagagttagygaggtttygtagygttygtttgtygtatttttgtygygygttygtygtttattttgtagtttttataygtgagtagttygtagtggtagtyggatattttgttttygtatayggggtatagttygtttaggttttygtygtaygaatagtttatgttygyggygttygtttgyggagggatagygggttagggagggtyggyggagatyggtagtttggggttttygyggtygtygttttagtygttgtygtyggttygtygygtaattttttttttgtgtttaggygttgtygtyggtatttatygagygtttygygtagygtttyggggtgggttyggtgtagttttygygttyggtttttttttgttaggttttaygttttygtttygttyggggggtttttttygygyggatttygtygygttygatttggggttttygggttygatgygtttygattgggattygtttgtttgagaataaaatttygattttgagaaaaagagatgggtttagtygyggggaagaygttaggggatttaggagygttggggygttyggttygggtgttttgggaattygatagagaygaaggaggtagagatagagttygggggagttagagatgggaagaaattttggygagagataaygatygaygttatygggygtagataygaggttagttygagagtgttagagatatagatattgagaygtttagttagagagaattyggyggggaygagatatagggagggatggagagagatagggagatagagagagagagagagagagagagagaygagagagagagagagagagagaaaygaggggtgggggattggattagagattyggagagatagyggaggttygaagagaaaatttaagagagattgaygtagagttagagatataaygatagaygatagatagagaygtygagaygagaggagtttyggagagaygaggtyggggagttatagaaatayggagagaaaatttggaggyggaagygtttagttygagggtyggggataggggaygygyggaaatttgtygggtaggagtttaagygttaaggygaggtttygtagggtyggatttagaygggggttygggtygtaggaggyggaaaaygayggygtygggatygagagttygaaaaygtagagtygtygggatttttttttygggggagataaagtygtagtagygayggtaaygggaggygtagttygagtygtygttgttatygggaygtygggyggggagatttygggygggggtyggygggtttygggaagtygagttygaggygagggagygatttygggyggagaggygaagttyggaggagggaagygygaagagttagggttygggaygygagagggggygygayggyggttgyggtyggttyggygtttatttggtygtttttgygagtagygtttygygtttygttygygyggagttygtatttttyggtygygtygtygtygtyggygaggagtygtattygggygtagygtygttygttygygatgayggtygttygggtyggggayggggaggygggggygyggggttggyggygygggggtttyggtttttttttttygttttttygttttttattttgtttttttgttttttttygtatygtygtyggggtygtttygaggygtatttgggattygggttttttagtygttatttygttttgygttaattygtygygttggggtygggggtyggtttttttatatyggygygtgyggtattygggggyggaggttyggtygtgttttttttttaagttyggttygygtyggtatttttttygtagtttagttygagttttygtttttattttttaggttttttagtygtagttyggtttttyggatttygagygyggttagagagttgyggagttygagtgtttygygatttgggtaggtatagggtagtgggggttttgggttattygtttgtagtgggaggaggtagtttttgtttgtgaatttagttgggtygtggygaatgttaygygggtggttggtygtattatagygtggaagtgggtaagggygagtggygatygtggtygaggttyggatttayg

SEQ ID NO: 6119 - DNA, 5370 bp, Artificial Sequence
  Description of Artificial Sequence: Synthetic polynucleotide
tygtgttygagggaggygggtagygtagaggagagggtgtaaggttttaagaagaggagyggggggattagggyggggtttaatggagttggggygttygtagattggaaggagtygggattttygttttagagtttttttttttattttygttttttttagtgatttygagttttygatttagttttttttttaggtagagagaattygaggttgtttttgtygttgaaatttgagygggagagtatttygaagtygtttgygtggagygagtagttttygygttatgggttagaggygttygggagaatttgygggttayggattatattygtaggggtttggyggagtaaggtgtygttygtygtttgygggtaggagtyggttttgggtttyggtttttgttgtgtygtttagtyggtygttttttygttttttyggtaagggaagyggtggagaggygygggagtttygattgtgttggagagatttgggatttttgygygtttgygtgygaaggattygagatyggttaatttagttgggagtaygggataygaggagtgaggataaagggtaaggaayggggtttatagggagggtgtgtgtgtgtgtgtgtgtgtgtgtgtgtgtgtgtgtgtgtgtgtgtgtgtgtgtgtgtgtagggggaatgaatggatagyggggaaggtatgtagaggggtttaaggggtgtggatttagtagttttattttagattagagaaggtagttaggttttggygtttatygagttagygtttttatttgggygygggtygtatggyggtagattattttatattygttttggtggygtgggatatgattggtaggagygyggaagaggygttgagaatgtatgygtattyggatagattagaygyggtayggagggggtattttttataagtttttttgttttgagattaggttttygagtggttyggggaatgygtttttgggtatagttagyggttttagatyggtattggaygttaattygagttagagaagtttgggagattggatygtaggggtttttatttagttaaggagggggaaaggagagttgtagggtaggagaggttaggtatagggaaggtggggaggggatggagttttgygttaggagttgggggtgtagggtttgtgaygagagagtattattatgtgtattttgaaggagagggagagggtttgggtttggaaygaggattttygtttgtaggtagtygtttagtttyggttgtagggatggatygygattagtagagggtagaaagtgtttggttygttygtyggtttygagtygygtttygygtttygggattttggttttgtgygtygaagttttgttygttyggtttttttttgtagtagtygygttttygttttagatgttyggagaaggyggtttaggtttagtttaatttygygggtttaggtttggggtttttaggttaagtaaagaggggatygagatgtgggagagaaattttatattgattgtttatttttttygatttagttatataaaggygtttagaaatataygaaggtataaagttttttattatatataaatatatatatatatatatatgttaggagataygygagtatatagaagtatttagaatttyggagataagtatagataygtaaagttgatagagatatttatatagaaaaggatygtagatataatatagaggttgagataygtataaagatttaggttttygtatgaaatgatgyggatatatattttagatataggtaygaaggatttatatatttatatatataygggtgtaggggatttagatatagatttatagatttatttttgggagtttggaaggttgtagggatatatatatygtgtgtgtagagttaaggagtatayggaggtaagagtygtagaggygggggttygataygtatagatatatatagatatttatygatatataygtaggtagggtagggygggagtttttaattttttataaagtygggttttttygyggggtttygyggygtagggggttatttttgattaagtttttygtaggttttaaattygattygttttttygtttttagygaggttaggggattygttttttatgtttttygttttygttyggtttygygtygttgtttygtttygggaggggtyggggtygtttygtagyggatygyggggggttagttygtygttatttygggtygtaatygtttttttgtttttyggtgagtygygygtyggtggggattaygggtygtagatagtyggttygaygttgtggtttttygtatyggaygygggtgttaggttyggttggygyggaagtyggtagttttatttygttagttttygygtttygttgtygaggtttattttgtttaggttggttagagtattgtttttgattygygygttttagygatttttggtygggtattygattygttaaaggatttygattttggtagttaatttaatttttttagagtygttattttggggttattatttttttttagygttttttattgtaaattttaggaggttygggttttgtttattgtttttgtttttgttyggggattttttttttagttttagttgttttttaaattttyggtygtttgaatttaggtttgattttttttgtygttttagtgttttttattttygatttyggggttttaattttttatyggtttagtttttygtttaatttttgttaggttyggagtttttttagattttttatttatattttaggtttatttttygtttttgggtttgggttttttttgtaygagtttagggttagtygttttygttttttgttygttttygtttttygtttttgggagtyggtttttttygyggattaagyggtttygagtaggygtygtygttygggggatttygatttagttttygygatttatttyggtygatagtygggggtttttaagyggttattttyggtyggygtygttttttggyggagtygtygygttttttgtygttygygtagtttggtttygttyggggttatttttygtagygttggagttttataaaatattaataataaagaaggtagaggagaaaaaagaaagttttygttttttaatttttaaattaattttttaagggggtggagtagagggatttgtttygaagaygattaaaatttttgygaggggttygyggggyggtygggtyggggagtyggggtttgagttyggggttaggygyggygyggggygygggttaggggygyggagtttyggggygygygggggggygggayggtattatttgaygtggagtyggyggygtatttyggygtagggatatyggtygyggggtttaaatgttaggaagtttygggaggtgaggyggttygtattttttygtygttagttttagttttaaattyggyggtttagygggygtattatggtattggagtagygyggggagygygttyggagtttygyggttygttgygtttygttygggatttygttgygtygygygtttttttygyggttygyggggtygtttttgtatttttattttttttttygtttgtygtygtygttatygttatygtygtygtygtttttttttygyggtttygtttgtagtagtygtygtygtygggtttygggattgataagtaggtgatagaggagtyggygygygtggttgtaagtgttygggagagygyggygygggttgtagtygtttyggttygttygtaygaygtyggggttyggggttagygygtygtygttttaygatygtygggggtyggygtaatttttgttttgygggggtygygttttttyggttttagggtygyggtggyggagagygggtggaygggtyggygggygagtagttyggtyggyggggttygtagygygtttygygttttatggatatagtaataggtttygagtygttggagaggtgtttttttygygggtagayggattgygttaagatgttggayggtattaagatggaggagtaygttttgygtttygggttygttattttgggggtgttgttgggtgagtgyggggtyggaaygttygagtggtttygggygtgggatggggygtygttyggttgtggataygggygttggggttaayggataaaggaaatgggtttgtaggatatggggaggaggtagagataggatttttggagtgatygttagagggtygtaagtaygttttyggtaggygttttgaggggataggatagttttagtygttatttattattttttttaggtttaggttttagagttgttatttygatgtggtaggtggygggtggtaggggtgatggaggatttagtaattattttggygagtttgggagaggygtaaggttatttggggtgggggagattttaagagaaaaaygtttttttggttatttaaattatagattttggggagatyggggatagaagattaygaaygttatygtggggygtgttagttagygagygttttagttttatttygtttgttttggttttagtyggttattttgygtygtgttygttgttatttgttttaatayggagygyggatttttyggagaaggggagagtatagygtygagttaaggttygaggttygyggtttttttaygtyggagttygaggattgggayggattagtyggggtygttyggtttttggygyggyggttyggggagygtaggyggtaggyggtgatttygggyggttygagttttyggggtygagggttgtgggttyggtgygatygggaygtyggggttgggtygggyggygttgayggtygggttttygttttgtgygttataggtttygattgttygtatttygtygtttgygagggttgttagyggtttattttygatygttttttgatgygagttaaygagtygttttggtaygaggagtgtttgtagtgygyggygtgttagtaagtttttattattagttgttattttygggatyggaaattgtattgtaaataagattattaatagtaagygtttttygtttttttttttygttatygttyggtattygagttyggttagttttttgtygggttyggttygygttygttttgtygtyggttttgtgygyggttgggtygggtagttttaagggtttygagagttgygygttttggggttggggyggattagtttagtttagygggtattgatggggttttgggagttttyggayggtttttagttgttattygttgtttyggaattttgygttgggtyggtyg

SEQ ID NO: 6120 - DNA, 3120 bp, Artificial Sequence
  Description of Artificial Sequence: Synthetic polynucleotide
gygggagagtttttttygaygttyggataygyggatggggyggtttttagyggtttttattygygtatttttttaggtttatttttyggyggttygtgtagtatgttttttattgggagtgggatgatattatgtataggtttttgggtttygtagtygagtygygggtattagyggyggttgatgaatttyggtgttattaggggtttagttyggatttgggaatygygygttttaataygygtatayggttttgttttttttaaagygtagtttttttatttagtagttgatttatggaggaattygattttgggaygygttaggttgaagttyggagtttagggttttgtagtagttttygggttttttagygtttyggggatttttggtggttygggggtttttttgggttggggtyggggtgtttygttaggtggggttttaygyggtttagaaagagttagtgattttttttggagttattgtaggttttygttggagggagtaagattggyggggagagttggtatttttattttttgttgagtatagttttygtttttttttaagtttttttgtygattttttygggttggttaaaagtagtaagttygggaggtttgtttattgagagaatagaaaattaggggttgygggggagaatttaagatttttttttygtttgagaaaygtgygaagttttttagtttttggaggtaattaggyggttygaaagtygagttttyggygyggatgttagggtygattttagtttttttttttttgygttttagttygagggyggygagtggtaggtttttttttattttgtttttttttttttggatttggtttgtaggggggaaatgtggttgtattaatttataaatatttatttttaatagatttgtatttgtggagatttygaataaagatagtttagggggattataaaaattttaaatttygtttttttttyggatttggtgttttaaatgttaattataggygagttatatttaatagtaayggggaaaggygagtaggtttyggggagggaggtggggggagagttyggttattaaatgtaattttttattatgaaaaggatttygtyggttttattttttaataagattatgttaygaatataagtatttaggatggtgttgagtgatagggttttgtygtttaattagaggttgtgtygtttaaatygyggggttttttgttttayggagtgaaygayggaaatttgttattttaatttttttatttatgttaagtatagaaaagaagtygagtattttataatygtgttttttttatttttttygaggayggygggaagagggggtttyggttttgtagttttttgaygtttttygttttygagygygtttgggttttaggagtyggagygttgtygtgggggygggggaaggggtggttttgygggtgttttaattggtagygtttggaaaatggggatagtgattttaygattagaggatgaatggggggagggttagtgggatgtgtttgttttttttgatygagagtaygggttttgttttgttttttttttttaggaaaggtggtatttygggtgtatatttattatttttattaaagygggattgattagaagagagaggtygaatggagatgttaggttggggttttyggyggggtagatttygttggatttttgggattaatgtygtagygttygtatttttgtaggtttttagggttggttattttyggttgtatgttyggtttttttttttygagggtgaatttttttgttttatttttayggaaattttttttttygttaggttygtggygtttttttygttattttygtygtygtygtygttattttygttttatygtttgtagggtttttttgyggygttttggtygtagagatttagttttgtttgtygattggtttttygaygtygtygtygtgtttgagtttygttgtttgttyggataagtagaatttyggtaggygtagygggygtygaggtttgggttttagtygtggygttygtttyggygtagtggggagtygygggygtyggagaagyggtygygttgtttygggttattgtatyggttgaaaaaattaaaagtaaaattaatatttagaaaygaagtttgygtgttttygggggtttygttttgttttttttatggatatgggggtggggagttygtggggttttagtttaaaggttttagttagtggaatyggagggggatttyggaggaatttgtttttgatgtttyggttttttggttttttattagaattygtagaggattygttttggagttttygtgygttttggtagaggtyggggaygttagagtgtaygtagttttttgygygtygagtttaggtttygggygtagggaggatygggttgagagtagggtgttatttygtaaaagygataggtaaggattgttttatggggagggagaaggagtaggaagtgatgtttttatttttgatagtatagggatygggagtttygatggaggaaatttttttygggtaggaygagtagagggataggatatggtyggggattatgggattygttgttattaagtatgggaygggtaggygagagyggggaaggggatygatggagttagaagttttgagtttatttttygttygtttttttttggagttttttttgtaatttyggtttagtyggtaatyggtttttttttttaggttaggggtgggggagagattttttttttygaaatatttgatattaattttgtttttttggtaagaaaaataagttttgtttggaaaggggtgggtggggggygtygagygagygagggaaggagtaaggaggyggyggyggagtaaattttgyggattaggttttagygttttygttttatttttagtttygyggyggtgatttgtgtgygggggtttgtgattttgtaagtattaaayggttygygggaatyggtygagtttagagggatagtgggtygaagggyggtttaagataaygtagatggtttttattagttyggtygggttygtagygttygtyggttygttyg

SEQ ID NO: 6121 - DNA, 3120 bp, Artificial Sequence; identical to SEQ ID NO: 6120
  Description of Artificial Sequence: Synthetic polynucleotide

SEQ ID NO: 6122 - DNA, 7861 bp, Artificial Sequence
  Description of Artificial Sequence: Synthetic polynucleotide
tygttttttyggaagtygtgtttttttttttttgttttttttattttygagtttttgtatttttgygttttygattyggttttttatttgttttttttatttyggtatygttttgttttagtttttttygatttttgtttygttttttttgtttttagaagtttgygtttttgttttttttatygttyggttttttggtgttttyggygtttttttygtygttttygtygttttgattagtttgggttgtggygttggtatygttggtttggggatyggggtgtgggygatggaagggggttygagaggygtaggggaggggttttttttttttygtttttgggygtttggggagattygygtgttagttatttgtyggtyggggygtygatttygygtttaygtattttaygtgggygtttyggggygygtttttgtttttttygagttttgaaagttaattatattgggaggggataggggtggggtgggagagggggtygttgtttttatttattgagtygaggtygttatttygtyggtagtttygygtaggtttggtttygagttaygtttgttgaaatygtttttttyggtttygtttttattygttttggtagttagtygygtttttgtaygygtyggygggggygttttggaattttgaatygttttayggggaaygggggtggggggaggggagyggygygggttttaygygaggaaggaattttttgggttattgygaaagattgaggtttagaaagttagagagagaygtgygaggaggaagyggagagggtgtgygaagttggagagggagtyggagygttagygaaagaggggagygttggggaaggaggaagagaaggagagggggagaagagagaygyggatgttgggygygygayggtagygggyggaggaggggagyggtygggaatttgygygtaggggaagttaggayggagygtagtatyggtaggggagggttgtygaggggttgtgtygaggagttygggtgggggyggttggatygygggtygygggatttatagatagtgygaggyggygygggggtttttttttttatgyggggttggggygtaggggttgggyggggygggtgggygtttgagygyggygygggygtatttttygttttttttttttygggtttatttyggtygatygatatttgygygggatttgttttygtygttaatatttttttaatgagttygttaggtttaaagygagygygatttgttttttagggtggattttttttyggtagatgtttygggaggaggaggygygyggagttttygggaggggggataaattttttttttygaggggygagaataggagatttttttttaaagtttaaaagaaagaygggtttttattyggtttttaaaaatgtatttttyggyggataatgggtttttttttgygtttttgagggtyggyggggygggtagggyggggattygtgygttttggtttygtttgatygattygtatttttttttttygtatttaggttygggttttagagygagggygtaggagtygygaagtyggtygttttttygagygtttttttgaagygtattgtygggatttggttttttyggagttaagtttyggygtatyggygagaaygaaagygtygtgyggggttttgggttgttttataygttttygtttttataggtgttttagtygggtygaagggaygygygttggtgttttaaggggaggaygaayggattttygggtttgggtygyggttttttttttttyggygtttygttttgagyggggtaataattagaaattagttaatttygggyggttgtygggttttgagattgttttgttygtttyggtttagttattttttygggtygtttttgttttttttttttattttttttttaatgttttttygtggggtygtyggtttgtygyggyggttttttttttattttygtgggtttaggggaagagggtattygggyggygaggatgattttygaagagtygyggtaaattgattygtttygttyggagtyggggtygygtgaatgggggttygggyggyggyggtagyggagaagaggataaagatgttttttttgaaagggggagggggygyggagygggaagyggggttatttatttttggttyggtttttygggaagtygygtygaagaaagggggtygaggtttatttaagttttaygagtygtttataatggatygatatattgagggtttttttattaaygtttatgaatattaaagagatygttaagtggyggttagygggygaggggggygayggagtttgagagtttyggttyggtygaggggagggggtttttgygygagtatatttygygtttgggtttygyggaaaatgataaaataataygggttattygttgggaaagttyggaatgttttttttygaaattttttttyggggagatgtgagtatagggttttgttttttattttaatgtattttgagattgggygttatttaygggttttttttttttygggygggggtttaggtgggttttgtygttagattagaagtataaaatgtgagygyggtggagatttgggygtattagttgggaggaygttttgygtttygtttttgttyggtttttagtattgtttttygggtttgygggttyggaggagaggaatgggattttttggtygtagttygagttygtggttattgygttagyggaatttaagtttttaattttaagtyggggtttaggatttaaaygttgtattttagtayggaggatgtatagatttgagggtttttygtagtgggaygtggttttggagagggtaaaattttyggggttgtygtggggtaaagtgattttatttaaagagagattaagtaaagaaattttagtttataaagtttaatttaaattattgtatagatagggatatygaggtttagagaggaaaggggtagtttataggatatatagtagtttttatttttttttggtgttttggaggaattgaggtygttttyggggtttgggagttgtygtagygtttggtttttggtagygtttttygaygtygtttttttygtttttagtattttgttttttttatttaggtttttttagaagttaagaagtaggtttyggtgaggtttttttgtaggagttatyggattttataygtttttttagattygagttttggttagggagtygatgygatttataagttgygtygaaaaatgagtggagggttyggygattttaatttatttttttttttagtagygttgttttttgttggygttttgtttaayggttttgttttttgttaggtgtgtttttttttgggttttagtttygggyggattyggaygtagggtttgaaggttagttatygtygtttttttttttttgygttttaayggggaygggggatgtyggagattattggtaggaattggggattaggggtttggagtttggaygttaggtgtgagatttttttagttaaggygygttygggtggtggaggggygtttatgttaataggygtttggatagggtttygtttatgggaggttagttygttgtttttttatttaagtttttygygttgaggagaaggtttagggagtttatatagtttagyggagattaattygtgagtttgatttaygtygagagggtttaggtatttttgttagyggtatttgaaattgtaggttggtgatgggagttagaagtgyggtaggtggggtgagtttttttatttagtatgttagggtttggggttygaggtttgaggttgatattggggagtygygaagtttgtaggaagyggggtttttygttgggtttagtagttatttgtttygggagaggggatygttgggtttygaggtgtttygaaatygtygtaaagtaagtttgtttttgggatgatgggtaggaggaatagaggagaggaagggaaagaagagagaggtagaggagaaagaaagaattaggaggtaagaaggaaggggygtygtaaygttatyggtttttygaggttgtagtttagtaaggagtyggaaagtygggtygtaagtygaattygtattgaggtttttygyggagttgtttgtagtttttgagggatttygtttttaggtaygtttgtttttatttaggaagggtttygggattttttttaatttttttatatttygtaggaaattttttttttagagataggttgttagggygatttttgttygtttatttygattttygatttggtttygtaagggtygggagtttggttttttatgaagttgttttaggtygggattagttttagtttygayggtygttgyggtttygtttyggtagtttygtgagttygyggaggagtttygtattygatygtgtatagygatygagttggygyggttygtatgaagygaagygtyggttttagtagygtagtttgagtaggggattygygtggtaattagggttgygygygagttyggggygattgtggyggttyggggagtgtagggtyggagagggaagaggaygygggttttggtyggggagggagagyggtgtagggttgggtyggttagtyggggtagtaaagtaaaggtgaaygtygggttgggttaggtyggtgaatatagattaggtttgaggggagygyggggttygaagttaggygtttttttttgtttagtttggtttttggagttttagagagtttygtygtatttttttttttttttygtttttttttttttttagagtyggttgagtttttttttttgttttgygttttttayggggagagaaggaaaaataggaggggggaggaaggattaggaaggggagagaggagtggaggggtattgtttggagyggttygygygttttygtttttygygttttygygaygaaggtttttygagtttagtygggtataataagtttgtttttygaygttagggggttattaataattaattaggagggttattgyggtttttataaaggygttgagattttgttaaggggaagayggtttyggtygagtgtgygagaggttagygygygtttgagttttttgttgtygtttttttgtaattattygttttttatttattttgtatttttygtattygttttygtttttattygygtttttttatttttygygtygtttttgttatttttatagattttattatttttttttttttttttttttygttygttttttttttagtygtttttttatttttygtttttttttgygtttttttttttttygttttttttttgttttggttttttttttatygtagygtttttttttygttttttgggtttttttttygttygtttatttttttygtyggttyggtygtttttyggygtyggggagtttygggtygtttatgatgggtttygtgttttyggttgaggttttggtgtttaagatygggttgaaggygtygggattggygttggtygaggttattattttygatattttgtatagttttttgtayggtygttggygtaaygtgttyggggagtagtttttygaggataagagttattaygttagttttaagatagtttttatygtygaggtgttggygtagttttttttyggyggtgagtttagtygtyggagttyggygtaattttttttttyggygatttttattttygttttggygatgygygagaygyggttgggatattyggtttygttgttattygygttaatttgggttttttyggygttyggtgtattttagtttttttatgggttaaattaggaygygagttattaagtagtttygtagtttattyggtttaaggatygatttyggygatttygtygttyggtttygaygttttygtyggttttttttttttttttttgygtttgagttggygggttttyggtatttatagttttattaggygtgtaatagtagttgatttaaaaagaaggggttttaaatttatttagttaatttgggtttgatttaygaaagtttttatttaaattaagaattttaaaaggtagtyggggttggggagggggtggagggagggygggyggggagaaaaagtygyggggagagygagggagagaaagagagagygagaaaagttttttttttttaagatgttttaagtttttattttttatttattaattygtaaataatatttttttttggttttggtatttttgygygtygtttttttttttttttttaygatttttgttttttttttaatttatygtgaagattaattttatttttatttaygttatgttaattatttaattttttttttttgtaaggggaatttttyggttttttttaaataagtttttttygtattgagttataatttattgttatagtatttttttagggttaatgaatttagaattagtaatttttttygaatggagtygaatgaatgygattattttaatagygtgataaattgttygtygygtygtaatggatatygtttaattttttttttttagtyggttygttygtygggtatttttttaggtagtttagaggggaattttgtaagatatggaggtygtttttgtgygtttygtygtttttagttttgtygtagatgttygataggggaattttyggggagttgggggtygtygyggttttttttygtttagagagatgatatyggggtttgtttgagttygggygtygttttttttggtattttagggtttgggagtagagagggattygggygygttyggggttatatagygagygtagagtttggttagttgttgtyggtgtttttttggtatttttaatatttgttagttygaggtttgtttttagygttgattayggttyggtttttttgttagtgtttagagtttggatatatagtgggttttyggaagtygattaggygaaagagttttyggttggtttttatttttttgtaggatttggttttagtttttttgtgtataaaatygttygttgtygttggtttattaatttttaaatttattyggggtagaggatggaagaagttgygaatgttttgagaattygyggagagattaaaaatttatttttaaaaatgatttttaaygtattattygttttttagggtayggagggtttttaggttgtaaatagaggagaggtygttgagttttygtatattygattttttttatattygggtggtttttttggatttggggtygatttgggtttggttggtttgggtaggatygaagtyggggtttyggyggggaaggaagggtygggtttyggttgtttygggttttgatyggtttttttggtttygtygtygtagaagtgtagaagttgtttagtttggtgttgtttgyggaggtgattatygtttagagttttatttttggygagggtttyggtattttttttaagaygtggattaaggygggaatygagatgggtttttttatyggtygygtgatygtttyggagtaygtggatatttgtaagaataataattttatgtgggaggtaygygygggttggggtagaggggygtaagggtyggygaggggygttggtygygggtaggattygggygttyggtygtygtygtttttattygggttgagagyggyggatatttttggtttggaygttttttgagtygggattttaagtygttygagtttggagtttatttygtttttaggttttttttaattygtgtygaaaattyg

SEQ ID NO: 6123 - DNA, 1434 bp, Artificial Sequence
  Description of Artificial Sequence: Synthetic polynucleotide
tygggtgtgygtttttttagggtttttattgygtatygygggttayggtagattattttagttttygttttgttgtgtaggtgttaggagtgtyggttggtttttttttttttaagtaaggttttagggtatygyggttgttttgggatygtaggggygtttttagttttttatygatgtttygaygtttttttggygttggaggttttygygagtttggttgtttttyggagtttgttttgtttgttgggttttaggygayggtttaggttggttgggattttygaattatygyggaaaagggttttagtaggtaggayggygtygtttttttgtyggtaatttttgttttaaagyggattttttgyggggatyggagagggatgtttyggygtgaggatgggagaagtttygggaygggagggtygygggtygtgtttttagttggagttttygygtygtygtygggtattttatgatttgggggtggtggtgtgttygtttttttatgttattttgattttaatttttgggyggattggagtttgtagatttygttgttagtagttagggggyggyggggagtygagygagaggaaaaatttatttattttttgggyggattgygtyggtttygttyggtygagtttygtttttyggtygyggttttygygygtagttygygtagygtttagagtyggayggygtttttyggtggyggyggaggagttyggagggaygtagtygggtaaggtagggygtagggygggyggygygaggygtagggygyggygggtagaggttatttggttattttttttggygttyggggaaggtgyggygatggtyggggygygyggggyggyggyggyggygggygggyggyggygggtygagggggygyggggatatagttaggygtttttgttygtygyggtgttygtygtttgaaggtygtttgggygygggagtyggtgttagttyggagygggygttggaggtagttygaggygygatgtyggtgtygttgtttaagatyggggtygtgttgagtattatggttatgattattaattggatgttttagaygttgttttygttggtgggttttaatattattaagttttyggyggtyggyggygggaygttggatygtagtatyggygtaagtgygttygtyggtygttttggygyggttttttttttttttttttttttttttttttggttyggagtttygggttgggygggygtygygygggattygagtygtttagggaggyggyggggagtagggygggtaagggtaggygtygygggtyggygtagyggtggygattttgtttttygtttttttagtttgggttattttattttygttygygygtttttggggyggygtttttttygtttgggtttttygtygyggggtyg

SEQ ID NO: 6124 - DNA, 5053 bp, Artificial Sequence
  Description of Artificial Sequence: Synthetic polynucleotide
tygygggttttttgggatttttgygatttygtygaygygygttygttttttttygagtttygygattttttygtttatyggggaaggagattttagygtygttgttttgttttttttgaaygttgtttttgttygatttggagtygtygygggagygttttatgttgyggaaatattgtttttagygttgtyggtyggygtttttttttagttttttttttttggttyggyggttttggaattaaatttgggggyggggyggggtgagyggtygttyggttttgygggggtttttaaggtygygggygggagggaagtaggggygagygttgatttgtattaygygtatgtttaggttygtttyggaygagagttgttygygtaygtggygygtyggtttgggygaggtgttgtaagygttttttagygtttttagttgtttggyggtgatggtygtgygyggtygtttggtygtggtttyggtttttgygyggygggygagyggtgaggygyggtagttttttyggtttyggtyggatttttagtttttttatttyggtyggygyggggaygtyggggttttaggtgtttatttttatttygttttataggtttttyggaaggygygggygttgggagygattggtaaaaaygggtagtattygggttggggtggagggggygtyggyggagggygggttttgtygygggggygggggyggygttttttttaaaatygtatttttayggygttttygtttttagttttggtttttttttttaagtattttgattttttygygggtttttttttattttaagggtgtgggtatggtttagttttygyggttaagaatttagggygataatttygattaggggygaaaagtygtatatttyggatygaaygaagyggttygggaygygggtttgttygtgatttygtygttttyggtttyggttttttgttgtttatatygttttagtttaggtttttttagtgagygtttggggagagaattttttyggaygtttttttgggygtggttttagttttattttttttagattaggaaaggtgggagygtygttttttyggttgatttygttgtttggyggtttygtagttygttttgtataygagtyggttgttttttatgaggtagaattygtygttygtggttagttgtygtttgtataygaygtaggtaaagtagtgtaggtggtataygaagttttgggygyggygtattatttgygtgggygggatgtttagttggtaygyggygtatttggtttygaagygtttgygggaygtatagggtygggtttagygyggaagygygaggtttatttygtttygagygggttggagagaggtaagyggttgtttgggaaggyggtttyggaggaaggttttgttyggttttgtagggtggtygttagtttggtygtyggggtagagttgtttatttttattgagaagggaattttaattttagaaagatttyggggagtttagtygttattgtttgtaggatttatgttggatttgggaaggtgaattyggagggagaggatttatttggggttagttttttatattttatagttggagttatgaaggttattgggttagagtygttgggtgttagtattaggaattaaaatattattaatttyggaggaattaagtttagtagaattttataaataggggtgtattttttttaatgattgtttttgtgatttaggtaataaattgtttttttttttaaataatatttgttgatgttttagttaggtttagttatttagggagtatttatggagaggttttatttttaatttggttaggttatagggtgttttgtttgggtgataggagtgggttgggattgygagagaygtaggtttygagggtttggttttggtgattgtgaggggaggagtttttggggtaggygtgtttttygtttttatattgaggtgaggtttyggggtttatttgaaaaagtygtttttgtagtaaaygtttttttttyggttgaagtagygttyggttagtggygtgtggtagtygttgtatttgagatatttgttgtgttagtggyggtttagagttttgaggatgaagyggtttaggatgtgttggttatagttagygtatagygggatttttgtgggtaygaggaagttttgggttatttygtagattaggaggtagtgaagttatttttttattttaaygygagttagtttttttttyggtttataggatttagggttgtygaggggtttttttttttttatatatttttttttttagttagtttaagtggtttygtaagtttygggagtgtgtaggtatygtattttatgttaggagttaaggggaaattgatatyggtttaaaaatgtgtgtgagtaagaaagtagtttaggttattttaygaggttgaatatttaattataaaatgttgttagtgttaagaagggtgtatgtggagtttaaatgaaaattttattttagggggatttgttttttgaagttyggtaggaaatatagggaaaygggtttttattattatttggagttggggtattttatygggttttttttatgttaagygttatggttattttttttagggatttttygtaaatgtggttgttttgtttggtggttttgtttgtaggttttyggggtaaatattaatgttttttttattattgggtagtygtaaaattatttatgagtggattggataagtygatttattgtttttgtgttaggygtgggtgtttttaatatygttagagttatttaaaygtttggtttttygttgtttttgttttttatattttatttyggtattgtaggttttttggaggaattatattggggaggtttaagggtgttttgtgggagtttygagtttgtgagygggttttttaggtgttaagggttgaggattttttttttatttagaaaaagtttttggaagagaggagtgttygttgaagggatygggatttattgatatattgtattygtttttttggttgtggatttygtyggttttagtttattttttagtgggtgagagatattaggaaggggttttttygattttyggyggaaaaaattgggttgygtttttttaygtagtggygggaaatyggygatgaatgygtttygtattyggtaaaatygtagtttygggtgyggagygtygaggattygttgygygttyggggtttttatygtgggtagygatygtaggygaggattyggttyggagyggggyggttygataggtygatatagygyggatttagtatygyggatyggatagygtttyggtygtagttygtygtyggygttygygtygggtaaaagtygttttagtttatttygygtygygttygygattttagttttaygttgtatggygattttagttttggygggggtttttgtgttagggatggyggggtyggyggagtttggaygttagttygttygtttyggttagttttttygagygygggygygtagttttttttttttttttttttttttygttttttagttttygyggttaattttttttaggaatygtygaaaaataaataaataagtagggaatygygagtttttatagtttggatgtaatttttttttygtyggtyggttttttttattttttattggtttyggggtttttttttttattttgyggttttagttggttygggagtygaggagaattgtttaggttttttaagaattaaagtgttgggagttagagtggtgttattaggaagttggggggtttggagaagagaggtttttttttatagaygggttttgagyggggataaatygagygggtgtttgtgggygtagaygttgaaatttgatttyggggagatygayggtyggagtttagttygattttggtttttgtatttgattttgtttygttggaaygtggaaagagttyggttggggyggtttttttggggatttttttgtttygtggttattgtttygttattgttttttgygttttttttagtttagggagttggtttygggttgtagaggttttttaagtttattttggattttygagagttttttggtyggagtagygtagtgttataattttatttattttttgataatttaggttaggggttttgtaataaatataggttgaggygtttaggygyggaygtttyggggttttygygtttattttygtttagattttttagtttttgttagttttygyggttaggttyggaaaggtttgaggattttttggttttttyggtgtagttattyggttygggtatttatttyggygtaggttygtttttygygttagtagtgttagtagtaggtygtttttygtygattttygggtygggtttagtttttygygygtttttatgggtttygtygttyggygtygttattttttagtttygaattttttygggtttagygaygttatttygtaatagtttygaatyggygtttaagygatttygggtgttgttgggygttgygttygygggtygttttggggttyggagtttttggtygagyggagggyggagyggtyggggggyggggtygyggggyggggyggggtygggggtygyggagattagttygggttattgyggattttgagygtttttgygtygggatttgyggtgtttagaggtygtttygygtgttyggttygagggygggtatyggtaagggagggtttaggttagggtttttygttagygttygtttyggtttygtagttttttgygtyggagyggtttagaggtagaggtttgagttggagtataygttaggagggttaaggttttygggagaggggtygagaaggtagtagggttttttygtygttgaggtttggtttygggagtagtagatggtyggygggagtttaattygaaaygtagaaggggtgagtgtggygtygagggttgygtatyggaatygtaaggtgtyggatyg

SEQ ID NO: 6125 - DNA, 6343 bp, Artificial Sequence
  Description of Artificial Sequence: Synthetic polynucleotide
tygttttttattgtgygygatyggaggggtygttttgtagtgggygttgtgaygggggygtagttattgaygttttttggggtaatatttataaataaggtttaaatgyggttygtttttttaattgyggatattagagggygtagttttaggattaygtttttatttttttattttattyggaaaggggtttattygagtygatttygtygttattagtygggggaggggaggttttggagttttaygygggagttttygtygygggaattataattayggttaagtttttttggttygttygttttatygtagggagaggayggggggaygggtaggaygggygtttggatagttgggtttttttygtaggtgtttttgatttyggtatggaggaagygttygygttttyggtttaggttygtagttagggttgtttygttygttgygttttaggtaagtygggttagygtgggggagtagyggggtttgggttgyggagggggtygttttgattygygtttttttttagggtaaaagtttygtaaggtagtgtgagttggagtygttagtttggggattttttttaagatgattygtayggatttttyggatttgttggtgtygatygtgtattaggatattaaggtggygatttygggattygygtttaagtgttygttatgtgagygattygtggttyggtttgttgagttygygttttttaataagygttattgtygtagtttygattttttggaggygttggaygggtyggttatggagattttgtyggagttatygtygtyggagttygttgtgtygygygttyggattygygaagtygagttaygtygtygygttygttttaagagtgygtttygygygttttygggtttgaygttygygttygtttygtygtyggtgttgtttygtygagggygggaggtttagygtgyggygygggtygaggtatygtygygtygggagttygygtattyggygtttygygtttttgttaaygagttgtattttattaagttgtagtygtagyggggyggtttyggtygygtygygtttttgtgygtygtygygggtygttgygtatygttygagttattygygggtttygttttttaygtgygttgtygtttggatattaagttagaygaygtagtgttttagtaygttattyggggttygyggttttgygggtttatygaggtygygtattgggttygtttygtttygtagttttayggttttayggtgttygggtttygttatatggygttgtygygtatttygaygtttagygatttatattgtgyggattttygggygttttattgygaygggtttttgtttgggtttygggattaygtygagygtygtagtttgttttttattatttygtygggttttatttagtttttttatatagaggagttttaaggttttyggggtagttttgtagttagtttyggtttaattttygaygtttattattttaggttttattygttygaggagttttyggggtttagtttaaggygtatgggyggttattaygtaggagaggtgygtatttttttaatttaggaatygttttttygtttttattatggggaggttttaygagtttayggtttgttttaygggtttygttatgttttygaggagtttygggtttattttatygttygttttttttatayggaggatttyggaaggtatygygagygtgaygttttggttyggaygtattygtattygygtagtagttyggtttgggyggattggggttygygatygtatygtattttgtaagtggtgtygttttttgatttygattygttgttygttttttggtayggyggtatyggtattagttygtttyggttggttatygatagtygttattattygygtttttgggataatattttggtttyggggtygygtygagaagattygttgggtygyggtygtagttaygagaatttgttggggygygaggtgygggagtygygaggygtgtttttygaaggtyggygttygttygtygtygtgaatttgtttattttttttagaygttaygtygtattgtttttgttygagaygtygttgayggagaagggtygygygggygagggtttgggtygtaattggtaygtgaygttygagattattattattgataatgatttgygygttatygagygttygagygttagggtttgggagttgttygggggtygtaygyggttatttttttaygyggttttygayggttttatttttggtygttagyggagtttagagtagttggaygagtttattayggatttggttatygattygygatttatygtyggttaggttttagagttygyggtygattgtttgggtttttaattgygtygattgttggattygyggttygygggtttyggggttttygygttggygtygttaygttygtttttygtttyggtyggtagygtygaggagttygyggtttygggagaggyggtygaygygtttttygaatttagygtygaygaggaygatttgatgatttgttttaatgygygttgtyggygtatygagattatgtttaaygtttgtttttattttaagttttgttatagttgttatatttattattgttygygtttgtgtygtygygaggattgggaygtttataaggygygttgygtgtayggtygygtgggtagygtgtgtygttaygtattgtagttttgtygygatagyggttyggtgtatygygttttttygygtatygygygtgtyggttttttgtygygyggtygyggygtgttttttttgggttttttaagtttaggttyggtygataattttttgygttttggtttggaggggttgttgttattttttatttatttatygttgygtgagttggttatataygyggygtttttgggtagttaygygygygagttggyggtygttgggygtttttaygaatyggtagagtgttttttgtttagygtgttygtggtygtgggattyggtatygygttatyggggatatyggttttgttygygttygygttaygtagttaygggttaatagtgygtaagttygttaaggtagygttggyggtyggtagtttygygyggtygttttyggygyggagtygygagttygatatggagaygttgattttgaygttatygtygggtayggygggtttggattaggayggygaggygggtyggygygygygygaggtggtttttatttatatttagygygagttgyggttgygyggygtttttttgygttaygagttttygygygtttaygagtagttttgygagttygtygaggttaataggygttttaygtttattattatttattttayggatyggygtatyggtygtttttttatgtgtatgattatggtygttttygagtygygygygttygattgggtggttagygttaatttgttggaygatattatgtgaggygtygggtttattaggtttagtttaggygttggttygaattttgttttgtttatttaggtttygttyggtttatttagggtygttttygagtttygttagggttttatttygattttttttaggtttygtttttaattttttagttttttaagtttygtttagttyggtttttagtttygtttaggtttttatttttyggtttttygttttygtagtgttttttataggtttttygtttttttatttttagtaatttttttttttttttygggtttttttttttttttagttygttttygaggatttttagaagaagtyggttttygttttyggtgtttttygttgggaggyggggtgggtttgaggatygtygagttttgtttttattyggaggggttattattgtatagattttattygtagagattyggttttygtyggttygyggggttttygttggagttttttygatttyggttttttttygtttagaagttygaygtaattaaagtttagtttgttattttaaataygtttygtttygtttttygyggttgtgttgttttttygttggagaatattttggtygatttttgtgygttygtgtgygygagygygtttygtygaggyggtgggtagggyggayggtgygtagtgygttttygttggtyggagttagtatattaattaygttaygygttttgtygttttttygtttttagtygttgtagtttgggttttgtaggagttgggaaaaatygtagggaggtttttaggtygatatgtaagttttttagtygaaggggtaggggatttgaataggggaagtagagtatttgggtttggttagagttgatatttggttaggagaggaaggattaagggayggggygtttttaggtgggagtttggagggtaaagygtggtgygagtaggtgagggagagagttagttggtaagygtggaagtttattygagggggtttgatttgtttygagaggttttygtatattygttttggtygtaygtygtattgygggygtggaggygtaagttyggyggttyggtttttatttgttttttaagtgtattttggttygygtttagagttttttggagggtggggtatgygggagaggggtggaggttaaaygtaagggtttttttggagtttttagttttatttyggagttaggggagggggtattaagtgagagaaattgggtattttygttttygtttttgttttygtattyggtaygtttatttygttttygygygtttgtatyggttaggygtttygtttgtttattygtygtygygtttygygttttttattttagggtttttgtattyggttttatttttgagggtyggtygggaaygtttttggatyggaataatttttagggggtaagagttttygaattaagtaaaatagaatttgaatgtagyggttgtygttgtttttttgtatyggtagyggggttggggayggaagttttyggtyggtggagaggagaaagggagaggttttygggyggtggayggggaagagagggagtttttygggyggtggagggggtggagagygaggttttygggyggtggagagyggggaggggggaggttttygggyggtgggagggggagagagggaggtttttgggyggtgggggttayggggagggtggttttyggattaygtgygggataggaggttagggttggtaagttttttaggtttttttygttgttttagtttygygggtygtttaattgtttygttttaagggtgttatyggatttygttggagaggaattttttygttggttggattttattattatttattttygattttaygttttttttaagyggggttggyggagtygtaaggyggtaaggaattggattgygattggttagtaygtgtttyggtyggyggtataattggttgaggygttgggttttgggaagtatttttygaygggattggtygtygttttygtagagttygtttttygtagtataagyggttttygggtygggtgggaggaggggatttygggaggaggaatatggyggtggyggatttygtttttatttttgatgtggatatygatttygayggygtttttaagtatgtgttgattygagtttattyggtttttygtttyggggtttyggttgtagagagtaaggagatygtgygyggttataagtgggttgagtattatggtgagggygggatttgygggtatgttaggggtaygtttggygaggygggggyggggttggygggayggagayggggttgaygaggtaggggyggggttggyggggygggggyggggttgygggtygtagyggattgygttttgtttygagttttgtttttgttaggtttgatttaggttgaggttttgggygggaagggygtgatayggtttgatattttttttagtagttttttagttttygygtttttttyggttttattttttttygtttatttatttttgttttagttttaaggggtttygttttttttggggaaggggttgtttagagttgggattttagattttttyggttgggagtttttttygyggtttttaagggyggttagggtaygttttgaggtygtttttttattttagyggatatttaygataaagtgtygggygatatgtagaagtaaggttgygattgtgagtgtttgggyggygggygtattttttattagagttaggataagaagatttaygtgtayggttattttatggtgagtygtagtttygtttygttttgtyg

SEQ ID NO: 6126 - DNA, 1089 bp, Artificial Sequence
  Description of Artificial Sequence: Synthetic polynucleotide
gygggaaaygtygttttttttggygtttgagatttggggttttttttttatttggttttttygttttygttttagtttygtgygttttaggagggtatygtygagygtygggttttygtagggttygggagatttygyggatyggaggagggataggattttygagttttgggggygggaagggagggtggaaggaggaggggagyggggttggggaaagttggagtttyggtatttttttttygggttaggtygttttyggggttttgygttgygtttttaagtgttgggaagatttygyggggaaaggtttgaggaygyggtyggttggtataggtgtggyggttttagagggtyggggagaatttatggtttygaggttgtggattagaaatgtttttgattagaagttgagaatttttggttagggaggtggggyggyggggaggggtygttaagtyggtttagagygygtttatttgygttataagggagaagaggtgtttttygttttttttygtttatygtygttaygatgygtygyggatttyggygatttagttygggtagaagygygygttttttttttttagtttygtgygtyggtttttgtttygttagtttygttatggttttttatttattttygygggagygtttttgtttttttattttgtattttttttagagtygygygttagtttttygtttygtggaagygtttttttttygatttyggttgattttygttygtygtttttttygygggtgygygttyggtttttttttygttyggggygggtttgygtgggyggtgtttygggtyggygggyggagtttyggttttttagttttgygtttyggtggagttygagtyggagtyggtagaggggygygggygyggaygyggygtttggyggggttttgggaggttyggayggggttttggygttgagttyggtyggttyggagygyggatttagtygtaggggyggygatgggtatygagggattttygttttyggtygtttttygyggaygttagggttgtttgttggtatttgygygggtgagtgyggttttttagyg

SEQ ID NO: 6127 - DNA, 1020 bp, Artificial Sequence
  Description of Artificial Sequence: Synthetic polynucleotide
gygggygtgaggtttygttttygtygttttttgttygtttttagattygyggttygtttggtygttttatttggtygatggygttggtggtgagtataggaaggttattatagttttaatttttgaggtaatggttgaagttyggyggggygaagtygttgtaygaggggtyggtattggtggygatayggttggyggygttggttgttagggtagygttggygaygttgaygtygttggtattgggaggttgtttttagttagaggtattaggggggaaggtttygtagtggtaatgtagygggggygttagygtgaagatggggttygaggttatgtttagagttaygaagagtatyggtaggtagtagaggtygagttgtagttgttggtygtygtttagygtttttatttgggygagtagygttttaaagttgagggggtttgggggtayggttagygataggttgttgtttagttygtygtygttygygtttttttttttttttygttygygttttygtttattttgtagttgtttygtgggtatygtattttygagggtttygatttgttgttggggggtagggggtggtaggagaagggtgaagyggaggaaatygtagagtaagggtagggggtaggtgggagggagggttaggaaggtagttaggggygagggatgygtaggaggaaaatgttagaygtttygygggggygggggtgttgggagaggatggygtygttatttggggttygggtatttatttygttggaggtgggggtgatttttatagtgttgtygattttgtygtygttttygttattgggttygggggtttyggtggttattyggggagttagtttgtygatygtaggggttttgtyggttygygtygaaaggatgygttgttttttggtttagttgygygtyggttgttyggatatagatagttygaagagatttygttttgtagttttgtagtygygggygtttttttggtttttgygatttttgyg

SEQ ID NO: 6128 - DNA, 6343 bp, Artificial Sequence; identical to SEQ ID NO: 6125
  Description of Artificial Sequence: Synthetic polynucleotide

SEQ ID NO: 6129 - DNA, 1109 bp, Artificial Sequence
  Description of Artificial Sequence: Synthetic polynucleotide
gygaagttatagtygtatagttaggggttttygtttagaygtagggagygtagygygggtagygyggttagggyggttaygttgaggttgygtaggttgttgtygttgagttttagtatttgtagygattttagggtttygaaggygttttygtgtaygtttattaggttgttgttagttaggttaagttttattagtttttyggtygagyggaaggygtyggygtttagttgggttaagttgttgtagttgaggtygaggaataygagtttggtygagtygttgaaygtgtttttttttagygagygtagygagttgtttttgaagtttaggtagattaggtygtygtagaagatgaagaagttttyggggattygttggatgyggttgtyggttattagtagtttgygtaygtttagggggaaagggtttggtaygttgggtagttygyggtygyggtagtttayggtgtgygggtyggtgtaggygtagttygyggggtaygygtgttygggygygagtagtagtagaaggttgtagagttygagygtygyggyggygtaggttggggttygggggygtatggtyggggggttygygtyggtygyggygagaaggaagyggttttyggagygagttttggygygggayggygyggtgaggtattggttgtygggygyggggagttagagggyggttygggyggggagggygtgygttygggygtgygggggygatggagygyggygyggayggattggggagtygggatagtagggatggagaggggaggggyggggagggaggggygagggatttattaaagggtttattyggataggaaattaattygttagaaaaattttttgggagaggygggagyggtaggggtggtygagtggtygtygttaaaaygyggttttattttggtagttgattttygagatttggtagtaagaygtygygygtatygggygggttgtattygaygtttaagtttagttattaagtttaggagyggtttttttaaggygtgtttygggygtgygttttgttttttygygttygtttggtgttaaagtaygttttttgtaygttattttatgtyg

SEQ ID NO: 6130 - DNA, 1109 bp, Artificial Sequence; identical to SEQ ID NO: 6129
  Description of Artificial Sequence: Synthetic polynucleotide

SEQ ID NO: 6131 - DNA, 1384 bp, Artificial Sequence
  Description of Artificial Sequence: Synthetic polynucleotide
gygggagtattagyggtttaygtygaggaagataggygtttttttttggggtgggtagygtaggtttggtttgygggtggggggtggagagtgagaggtaygyggggtattagtttagtttttttttggggatttygtattygtagtttaaggaatyggtggagtaygaattttatttttgagttggygtaagygttttttttttatggagatttatttyggtttttttttgaggttttttttttaagtattttttttttygagtatttagtatttttttaattttagtayggttyggggtattagttttttagggygggggttgttttatygtttaagggaggggatagagggtyggtttyggtttaggygatttttgtttttygttaggggygttattttggttttttttygattgtygttygtygttttygttttttyggggggtgtgttttygaagtaygggggygygggaggttaagggtgtttttagttttygatygagattttttttygagtyggyggygaatggtaggttttatttaaagagtgtttggtggygygyggtgttttttttggagtagttttyggygttygttygtyggggtttyggygatygttgttttttttttttttttttttttttttttttttttttygtttttttttttygtygtttygttatygtygyggttagggttggaggygtygttgttatttttgtgtyggaggaatyggygttgtyggtgtttgggggtyggggygygggygaagtygggtygyggaggatataataggtagagtygggggtgttyggtygygygtttttygygtattatgtagttttttgttatttttttygtttttaggttaaaattttgagtatgatggaagataataagtagttygygtttygtatygatggggyggtttagtyggttagttaggaggtgattaatttgygagtygaatttayggttattaatyggagattggyggaattgagyggyggyggyggtttyggttygggttygggagtygyggttagygtttyggyggygggggattyggyggygaygaatatggagaatttttagtttggagygtaaggtaggatygtttyggygtttagggyggaggaaggygagtagagtaygttyggtttyggaggtggtyggggattyggggttttttatattyggggygaaatygttttgtattttggtttgtaatttttttygttyggyggtggttatygttgtttttyggttgggagttgtaggttgttgttatttaygaaaattygagygtagtgtgtayggggttatayggttatatyggtttyggttagtttgagygaggygtagtyggygggtttttttyg

SEQ ID NO: 6132 - DNA, 1384 bp, Artificial Sequence; identical to SEQ ID NO: 6131
  Description of Artificial Sequence: Synthetic polynucleotide

SEQ ID NO: 6133 - DNA, 835 bp, Artificial Sequence
  Description of Artificial Sequence: Synthetic polynucleotide
tygtgaggtygtgtgtgagtttttgygtgggtygtgagtgyggtagggagygyggtgttygggggtygtttgtyggtgtgtttgtgygtgtttgtgygttagtttttgtttttgygagtgygtatttttaggatygagtttgtttatatgagtttgtgtttgtgtgtgtgygttttyggttttgygtgtgtttgtgagygtttgtyggggygygtgtgtgttyggaatttygyggtggtgtgygggtgtgttygtgtgtttgtgtaygtgtaggygagygtttttatttgtgtgtgtgtatttgagtttgggttatgtgtgatttagggattagtttatgagtttgtttgtgtttttgagtygatatttgtgtgtgatttagggaygagtttatgagtygatatttgtgtgtgtttgggtgtttgtgtygtggtgtgtttttgtaagygtttgtgtttgtaggtgttggagtgtgtagttgtgggaatgagtgygtgtgagtgtgyggaaggggtatygygygagggagygtyggtgyggaaggttaagygagttygygttttttayggayggtgtygttatttttttttttygtttygygttatgtgtttttgtgtgttygygtygtyggggtygtttttgggtttygggagggggttgagygagyggttttttttttttagggatttygggttygtygttagttttgggtatattygtttttttttttagyggtttygttygttgatttaygggtattygatgggtattygggaggtaatggtyggagaggatgggtagttagygggagggattgagtggygtyggttttayg

SEQ ID NO: 6134 - DNA, 2248 bp, Artificial Sequence
  Description of Artificial Sequence: Synthetic polynucleotide
tyggttttygggyggtygtttaggaggagatttattygttgggtttttgatygttttttaggaaaattttaagtayggaaattaagttygatatyggtttyggtattttttttaygtygttggtagtttaaggttygttttgaagaagagttgtagaggaggaaggtggttttggttyggyggagttyggttygtttggtgttaggygttggtgttggygtygagtgaatttaggyggtttaggtgttyggtttggtggygggygtagggtttgyggtgatggaggtttygttttagttyggttaggtttagttttgtyggtygtyggttygggatatgygyggygtttaggtttgtagggtgttttgggyggttataataaagttaaagatyggagtaagagttttyggygagaagagaygyggagaagtyggagtttyggaaagtygygygtagtttygttagtygtygttagttgyggaggaattygggttaattttaaaaatygttggygtttttgggtygtttgttygggtygtattgggyggtttttatygttttttttttttatttgtattgttttaggygggagagaggttttggtttygagggattagttgtagygggtagyggggttttgtttttttaattttygttttatggtayggggttgaatyggtattatygaggttaagggygattattaggagagaagatyggttgttttygttatgygaatttgtgttttgygatttygttgyggttgttygagttatgttagaggtggggaygaagggttygyggggagtgaggtgggtagaggagagaagttggygttttttttagggtttttattttgyggagaagttygatygtagaattyggtyggttgyggtttatgttggtagttatygygaaatgygttttygattygggatygtattggaaattttygttatattgtgttaggtttgattttttaggagygygttaagggtttttygtttattgyggttyggyggttttttttttaataagtaaggttygtgatttygattttggaattttgtttttatagggaggagtttttggtggttatygatyggtttagtagttyggagagaggttaggaaaattttttyggaaygygttgggaggtttttttattttygttttttttygggygtayggagattttyggttttagggagygtttatygattyggatgaygtggggtatttygygygagttygggatttagaaggygtataygaggagttyggtttagtatttttaaattagatttyggaggygtygttagggagyggttatygttgggygtygtygagygtgttyggggygyggtygtggygggttttttggggyggtagttttaggygygggygygtagtagtttygaaggygtygtttggtttagtygttyggttttygagygtygttgtaagtggggggygtttygyggygtygygtatattttattggggggtygtttygtyggygttygtttygtttggttgtygtttaygggttgttygygagygaggtttttgggtttygttyggatttygttyggattyggtttyggtttygattygygtyggttyggttttygygygggtttttatttgtttyggttgtygggttttggygggygggttgtaygygttttyggtygttttttttttagtygtygtygatgttatygttygggttygtataaagtttyggagtggagttgtaygygygtatatttttttttttagtttttttttttgygttttgtttttygtttttygygtygttygtygttygygtttttttygygtattttttygtgtatatatattttatatttatatttgtygaggygtatattygygygtttatatttgygyggggggyggggaaggggattttggttttattgtagggggaygttyggagaaygaggatttttttygttttttagaygtttttattygtttygtyggttttagttttttttattgygagggtayggagttygggagttaggygtggagygygagagttggtatygygagttgggagayggyggtagtttagyggtyggattagttggaggagaygygttygtygggagtagygagatygggagttygtygtttgyggagtttggtttygyggtttttaygyggygggygttggttggayggyggtggtagygggagattgattygggaatyg

SEQ ID NO: 6135 - DNA, 3541 bp, Artificial Sequence
  Description of Artificial Sequence: Synthetic polynucleotide
tygyggggagtaggggtygygttatgyggyggtyggtttgtagtagggtagaagttttttttygtttgggtgtgtgggagygtagattttttyggygtggtygggaattaagtyggggttyggatgaaaygaaaygaaaaatgaatattygaattttttttgttagttttttttttttttttttgtttttttttggggggagggtagggtagggaaatataaggggaaaaataaattaggttagattaaagttttggttattttttgtttttatatatagaygyggttttygygatttttttttyggggtttygataaatatagtatattgygatttaaattaagggygygggyggagttagaaggattttaggagtygagaggttttaygaataaataaaaatygtaaaaaattaagttyggagaaaggggaaagyggggtggggygtatttttataggagagaagaggygtgtagygaataaagtgatagttttttattttggattygtaggtttaggagtttaygyggggagaggggatggagaatttttttygtttygttttttttttyggggaatttttaatttygtattgygttatttgtygttttggggaggtygttgtygggattyggtttygaatagttygggggggtaggggygggggtygtygaggggatgggggtagagagtaggyggygggtaggatgttyggggtgagttggygagtttyggattttygtttttttttttyggggttygggygaygtagtttatygggttgttttygtygtttatyggagagggtygttygggtgtttggttttgttygaaagtttttgggtttttttttttttttgtaaaatttaaagtaatygaataaaaagagtttaggtygygygggygggttgygygttygygttttgtagygygtyggygggggttyggttygyggggttattgtattgagtygggtagtgtgtggtggtggtggtggtgtagygtygtyggygggggyggtgggggygyggagggtggygatgygtygttttygttaggttttagttttttaggygygtatatatygtttatgggygggtggttygygtyggtygtaggggttatgygtttttttttttgtygtyggttgtagaattagaygygtattatttttttttttagttgtaggttgtttgttaagtyggtgatttygtgygtygagggtttggggtatttgagaaagtggttttygagygygtttttgatttttatttygatggaygtgygttttttgygtttgyggttttgygtygygattttgtttaggttggtggggttgtygttggaygagtyggttttttttagttatttgttgagtagyggtttgagtttgtatatgtttttgaagtttagttgtagggtttygaagyggtagatggtggtttgygagaataygttatygtagagygtgtttagygttagttttaygtyggtttgygtaaagtttagtttgatgygtygttgtttgaattgtttggygaattgttttaggtygttygagttgggygtattttygttygagtgttygtttatygatgagtygtygtygttygygttygggtgtaggtgygtygtygtygygtgtaggtygttygygtgtgtatgttygtgtgygtgttygtgggygtttagatgyggyggyggygayggttttagttgygtttygtggttattttygtgtagygygtggtgtaggttyggtttygygtygttatygttygtygttagtatttyggttaggtygtygtygtygtttttygggtaggtygtttgygygtatagttygagyggttggggttggtggttttygttggtttygggygagggygatatggtygggtttaagtggtgygttgtgttgttttgygtttatgtygygttygygtgggtygttttttggtgtattaggygygygtggaaattttygtygtygtygtygtygtyggttyggtyggtgtygtygtygtttgttttgtygtgttttaggtgygggtygtyggtttaatygtygtygtygttttttttygtgggtagttattgggggtgygttaggtttayggggtggttygygttygygtttagttattygtggtgtattagtttttgtatttygyggtaygyggtttttgtatgtaatygtttygyggtygtygtygtygtygtygtygtygtggygttygggtgtataagyggttyggtgttttyggtttygttatyggggtttygyggtaggtattgygyggtggtggttatgtygtttygygttttgygtygygtygtygtygtygtttygtttygtttgygggtttygtygtttygtttygtyggtttaaagtttygattygttyggygtttyggagttttatttygttygtygtttattggttgttygyggagttgtttttygttttttttgttyggttttygtttygygygttygttygttattttgttyggttgtttagagttttttattgggygtygttttyggggtttygygygtyggtygtgttgattggtygttggggttttatttayggtttttttatygttygygtatatatttaygtttygggggygyggtygttaygtggggagtggygygggggtggttttgggatygtattttttttygttttggttgtgtgggtttygtttttttttagygttggagatttygagttyggtyggttttatattttaygygagttgaattttygttygtatttygttygggtagtagggattgtyggtttygggaggygttygggtttygagaagyggtttagtttygygtttttttttttttagtatygttgtyggyggattaggattttygygggttttggyggttgygagygygaggyggygyggattygyggttyggtttyggygygattgtttatygygttygtttygtttttygyggttgttagygtgtattgggygtttttyggygygtttgttyggttygtttyggtttttttttttttttttttagttttagygttataatttygtygattttttttgttttgagagygygttyggtgygggyggagtyggayggattttggttttaygtttygygygggtatattttttttygggtattgaggtttaggtgagtatygygygggtagttggggttgggayggygggyggtagyggttttatagttttaygygagtttttggtattyggtygygtttyggggttttagaaggagaagatttygaggtggagattgtggtttyggggaaaaygttgttggtaagggygttagttgggggtggaygttgggtttaggggtatttgatttgygtygttgtagttttttygtttttttttttagtttgaayggtttatyggttgtggtygtggtgggattaygtttygggagaggagaaggatgggtttagggaaggggttygggttttttagaaattyggygtgtaggtygggagttgtttagtttyg

SEQ ID NO: 6136 - DNA, 1513 bp, Artificial Sequence
  Description of Artificial Sequence: Synthetic polynucleotide
gyggggygggtyggggygtygttgygggayggtatttaagggygygygttgygtgttgttttygyggtttttygggygttatyggttyggttaggtttygggagttgttygttttaggtygygggggygtttygggttygtaggattygaaaatttttttttygggtyggggygggtgagtaggygggygttgggttgygttygaygtttttttaggtygtttaggagagtttygagggttgggagaagtygtyggggyggttgggttggaygagygagtttaggggttaatygtttttattygtyggtygygttgtagagyggtgtttttagggttggggtttgyggygatttygttgggaggaagggagagygagaattgagaygtttgttttaagttgtttggagttaaaggttttygagagygtggtygtggggttgggtygttggagtggtygtttyggtttagatattygtattttyggyggtgyggyggtttttaygygygtatttatttagygygttygggggtttgaggtygtygttayggygtttygtttygggtagtagtaattagtaygtaggtatttttggaataggygggattgttttttygaygygyggtttgygtttaggyggyggaggggtttagtttttttttagttttyggttttagggygtagggttaygagttttygtttttattttyggtttttggtattyggygtyggtttygtygtttttttttataygtatttttggtagggtttygyggggygttttaaagtttgggggtagtttttaggtgtttttgggaagggaaagaaaggttataaagtaaaagaaggagtaaagagaaggygagggaggagtaggggttygggttttgtggattygtttgggttgggagtggggatattgagagggttgygaaggtttygggggtygygygtggttygtaggtttatttttggttygyggttgttttttttttttttttttgggtttttggttttttttagtgttgttttttttttttttttttaggtttttttttttttygygtagggtttygttttggggattaagagaaaggagggaggggaaaggggaggggaagggaaggggyggaggagaaagagggaygatttttttaaaggygggtgttgagttttagtttaggattttygggtttaattgtttgtggtattttttatattttttattttygtttygttttggttttgttttagttttyggygtttttttttttyggatttygttgtatgtttygtttgyggtggttygatyggtttttttygggagttttttttttttygttaygttttygttttttyggtygttttygygtttttyggttttttttttattagttttatatttgttttttttatgggagggagygygygtttttygtttagyggggtttttagtagagtttttttaattttyggygttttttttatatagggttygttgggtygtttttgyg

SEQ ID NO: 6137 - DNA, 3541 bp, Artificial Sequence; identical to SEQ ID NO: 6135
  Description of Artificial Sequence: Synthetic polynucleotide

SEQ ID NO: 6138 - DNA, 558 bp, Artificial Sequence
  Description of Artificial Sequence: Synthetic polynucleotide
tygagagygtaggattattaagagaggtygggttatttttttygtygttygttgatttttaggggttgggtyggygtatagtaagggggttggaggtggggtygtttttttttaygyggttgggtttttaggyggtgttttgggtygagtygtttggagattttagattagtatgtgggtgggaaagggygtttygttttgggttttttygtttttgygygtagagtagagaygygtagattygtttttatttygtttggtttttttggagtagtttyggyggyggtagygatgggttgggaggggtyggtaygttggtttgygygggtttttagtygtttttygttattyggaattttttttttttaagygttgatygtygatttatagtttttttttaattyggggygagyggggtttttattatatatttttttttttygttyggttttatttttttttygtttttttttaggttttayggtttgtaagtatttttgtaaataatttttagtttatttatatygtttygttygtatttttygagagttaggtayg

SEQ ID NO: 6139 - DNA, 7244 bp, Artificial Sequence
  Description of Artificial Sequence: Synthetic polynucleotide
aygtttagttagggygtagagagagygttgggygaagaggggtygatggttygygggaatagggttggggtttttgtttggggatyggtyggttgttaggtttttygttttattgttttttyggagygtygttgattataggttygtataggtygtygtygtaggtyggttttttgtgtatygtygtagtagyggyggtygagyggttaygtatgagatygttaaaggygtagtttatgggtgggyggaagtygagygtgggtattaagtyggtagtggagtagggygttatgaaggttagatygyggttgtgygtygtygtygyggagtaggttaggygtagggggttgaggtygagyggygygtttagygggtaggygttygygtyggtatygaagtgattggygttgggttgtagyggygagaaggtygagyggttgtttagygagtttagygttttaggygttatggygtyggttagtaagggtttgtggtgyggaggtgyggygggtttygtttgtagyggygtaggtagtttaggtttttyggyggyggyggyggyggyggyggyggygtygaygyggttgggttaygygtygtttgtagttgttgtagtatttayggyggttttatttgggggygtygtagggtttaggtyggtygttaggtttttayggtggtggtttagtatttgttygatggtttgtattaygtygtygtygtagttttgtaatattagttttaggaygtttygtyggtggtttgggaataygygtgttaagatatttagyggygttygttgtygtggattygagttttygtttagttttggygtyggygyggttttatttttttttttgttagtttttgaatyggatttagagtttagagggttagyggagttygggttgtttttttygtygtygtygttagggttagygttgtttgggtagttgttatttgtttttttggaggttygagttaggggygaattagaaaaggattygttatygtygtttttygagtttgagtygggtygtatttttggggaygaygtttygggtttygagtttgygtygtygggtgataagggttttatyggyggyggtagygggttgttygggyggtttgtttgtagtagygttttaggaaataggttaaatttttgtaatttggtttttgggaggggagaaaaygtgtygtgaggagyggttagttagaagatagtagttatagtatttyggttttttggattttagtttttttttttttagttttatagtttttatttattaggttttagtgtttttttttttttttgttttagtatttttttygttttgagtttttatagttttgattttagggttttttttttttttgtattttttagaattttaattatttgtgttttgtaaattygatgtttagtgttgttttttttaygtttgtgttttaatatttttatttttaattgtttttttagttttgttttgtygtggagaagtggttaggtttagggtttaaataagagataatataatttttgtttaattaygttgtatagaagagtttattgtatagaaaatgtttgttttggtagtgtagtttgtaaggaaaggygttttggttatttaggaggttttaagtttttttataggtagaagtatagtttttgtttttaatttattttttttaaaattgagatttgagaagttttttttttttaagtttagagyggatttttttttttttttaayggttttggtttaattttttttttttttataaaaagttaygggggtttagaaaaagagggtggtgttaggtaggtagtaggaagygaagaggaaaagatataggaaagtagatttgagaaattagggagggtgyggaagaaattagaaggagggagggygtagtaagyggttgtttagagggygttaggaaygygagaaggggaaaagaaattagggygttttagaatttagggygttttaaaatttagggtgttagttaaagggggggggattttttaagggagttgggaaggagtagagggaaagggtttgtggagaagygtagagygaaygaagatgygtaggtttttatttggggagaagaygaagtaaagaagtagggatttgtttgygtttgggtagaggygagtaaaaaaattaaagygtgtatatttyggttygatgtaggagaaaggggtaaagtgtaaatgttttagaagygggagaaaggagagtttttgtatttaygttttatattygaggttgggygagyggtgaattttagtagtygyggygattggataygggggttttattttttttgaatygagataagtttttgggtttygtgttttagagttaygattttgttgtttttatttgyggtttggtygygtttttatttgagttttttgygttagttgtttygttttyggttttygygggygttttygttttaggtttttygtygtyggyggygtatattgaatygaagatttygtaggygggtttyggggggatgatgtygttggyggyggttagygttagtttttyggtagtgtygtagagtagttgtagttygygygtttygttttttttttgygtttgttgtttgygtagygttatttgygtygttatgataygttggygtttygygatgagygtgtatttggygtataggtagtttttttagygatagtagygtttgtggtttttgagggtygatattaygttatggttgygatagygygygtatttgggggttygygggtatttttyggttgttygtagtaatagtggyggttttygtagtaagtygtttgttaygtttatyggtagygatgtagyggtygtygyggttgtygttatygaygttatygaygttataggyggtttygtygttgttgtygtygtygtygtygtygtgtygggtaygttgggtagtttygagygtagttttatgataggatttgaygggaaagaaggtgggagaggggagagatttggtgaggagtatatygygygttaggttaaagygtygttttgaggaatttaagttggagagggaaatttgggtygyggaggttgggttagaggggttagaattgttgggaggaggtgtagtyggaatttttttgtgagttttagtatttttattttagtttggttatggttgtttttagatttgatatataygttaggggtaagattttgtttgaattagtgatttygttggaaaaaataaagagatatgtaaagtgtgaaagttattgatttagatggttgtaatgagaatttggaaaagttaagatgatattttaaagtttagtttaattggggtgagaygggtgagagaaatgttygtttgaygggattgggattagagygatagttttggtttagaagttaggttgatgttaagggtaaaataggaaaattyggagtaaaayggttagtttggtggaagggtgaagaggagagagatgtgaaggygtagatgtgaaggtyggttgggtyggagttttgtttttttttgtttgtttatttttaatgtagtttggggtagaagttttggagagaaaaattaataatagaaagaatagttttaggaagtagagtgaggaygaggaaataatttgggtaaagttaggtttagtggttttgggattygtaaaaatgtgagygttaaaagttttayggtgagggtttttagagagtgagagataaaatgtatgtggaatttagtttaggattgggaagtattaaagagaaaaattyggttaaagaaattttttgtataggtaaatttagtttaaagatgagttttatgggtaaggaaaatagtgaaaagtagttgatttgggtgttygggatttaggggtygygtttgggagaggggaatgtgtaagaaaaaattttataggtaaatgttgggggaggggattgggtaaaatttgtggtgtagttttttagtttygtagtttggagtagtagtyggggyggaagaygtattttgygaaaagttaggtatttygggagggggatttttttygaagattattttatattgtttttttttttttttygggtttagggatagagtygttagataygtttttttygttttggggttttaggggatttttttygagygtaggtttttgygttttgattttagagttggggttttaggatayggatggtttagtaggtygtattaagttaggggagtygttttygtaattggttataaayggatattagagttttttttaygtygtagttttataaggtttaagtaggtttagtttttygtttttgtygyggttttttttgtttttygygtttttygtttttgttagagttygygatagagtttttgtgttttygttygagagttttagattttttttttatgagygttgtttttttttttagatttttygggygtttttaaggtttayggggtttaggtttttttaataggggtygtagattaggtttttatttattgttttttttgyggtttttaattatttgttttgggtttygggatttttttttttygttggygttgtaygygtttttyggttttattggygaygttggagtttttggtygtttttttttgttttyggttttttatttgattaygttatttttttttagttattatgttygaattttyggattttttagaaygtagygtagtttaattttttttttagaaattygggtyggaggttygtttgygggtygygtggttggaattygygatttgattttygtygtgtygggttttttygyggtgygygtyggaygttgygygtagtyggggtttagttgttyggygttgttagatttttaatgagtygttygttygttttattgttggtttttagggttttattagatagaattggataataatgtggygtttgttattggttaggggaggtagayggygttttgattggtygggttygygttyggggagtttygtattttgtagtgttygaaagattygaaattttaaaagttttattgygtgtttttgggaggggagggggygygttaggaaaggagtggaaaaaagtgggygaggaggagygttgaaaattttttgataagtagttttygtgygttygagagygtgtgaattgtttttaattatygtgttyggtgygtttttttgygtagatttgtgtaatttttyggtttttggggygtyggttyggttgtatygtttttattggtttggggygtttggtaaagtygagttttttaagtggttttggagttttgaggygggatggggggtaggtgataatttaattattgyggtyggggtaggggygggataagggtgygggggtggggaagggagggtgtttaaggtataaatgttaggaygattttttttgttttttttttgttatgtttyggygygtttttaaattygaygagtttggggtagttgggggttgttttggttttttttttttgtttttttaaagtttagttattttattttaaaagttttgataygatagttattttggagggtaagtgtggtttatgaagattttygtgtttaaagagaagtttagygaagagaaatgagattgtattttttgtyggtgttygttaygtttttygygttttgagtttttttttttttygttttttttttygygttttttagttttttttgagtttttttttttttattttttagtatttygatttttttttygtggtggtgggattttttttgtygttattgtaaatgaataaatagttttttttttttttttttttttttttaaaygaaagtaaaaagtggtttttgtgttttygtagatttttttaaatttaggaygygtatyggtttgttygattttttyggtaagagataaagttattgttgggaggttttttyggatagtttttagttttaattttygttttattttygttttgttttgatgttayggttttgaggaatagttygttttgtagaagaggtaataggttttagattttgttttttttttgaaaggttgttgttttttaaatatttggaattaatgtygyggttttygggygagtygttttyggtttttgtagttttgattttatttttgtgtttttttttttttaatttttaaagttttgtttttttttttaattttgtttttttttttaatttttaatgttttgttattttygtttttgttttttattttttttttttttttttagaataaagaaaattygtttaaataatgaggaaaatgagygtttttgtygttttttttttatttttgatygtgygtttttgygttgttttttygaatttttaggtyggygggaatttgggygygtagattyggttygggtygtygyggttttaggaygtagtttatttygtttggtaygattattgggtygygttttgttagtttattagtttttgagtttaggaatgggggtgggggaaggayggtgygattaaygggtttttattygaagatygtagaatttggygtttyggaagagttttggaagatgtttatygggaggttgaggttggagggaggagtgggtgggggtgattygttggaggatygggyggagagtttttagaaagtttattaggtttyggygygagggygtttygatayggataaggtttatgatagygataaaaagttggttattygtttttagaaaatgttatttgttggagtttgtgaatgggtttaggagagagaagggtgttagttttygygagggtttttygygtgaagtgaggataagggagtgttttagggataatatgttttttaggagygtaggatttagattttattttttaatatttggaggtttygaggttaagtatgtttagtttyggttgtatttgggtaggtgagttatggggtygggggaagagygtygataatygtyggatttygygtaggggtygttaggygtttgtttttagagtttttttggataaagttttygggaaattttattaaatygaaaaygaaataaattatataaatttgtttagtttttgagggggyggtggtttaggtatttttttygtttgaggttaggttatygtgagatttttttatttyggatyggggatttygtagaagttaagggtgtagttaygaggattygggaattygaggyggtttagtagatgyg

SEQ ID NO: 6140 - DNA, 824 bp, Artificial Sequence
  Description of Artificial Sequence: Synthetic polynucleotide
aygyggattgagygaggaaatgtttaagattataggattgaatttttyggaagtttygaygttgtttagttagttagagtttagtygtygaygyggatgaagttgttttttygggataggaagggttaaatggttgygygttaattyggtttygattggggtgttagggagtaagagtygtttgtttygggggatttygtttggggggtttttaggggtygttttggygtttyggttataatttgggyggttttgtgyggyggttttygtttgygtttttgygygttatttaaaattttgygtatattgtagtygtygttttttygtttttygyggtgagaygygygtygttaagtgtygtaggtagttttttatagtygtygyggtagtygttgtttggtttttggttttagattttttttttattgtttttagtttttatttaggaggttttttygyggtygygagagttyggygttygatttatagtaggtagtgygggtatagtgttgtagattattatttygttaggttygggtagygtttattagayggataggygttygyggtygtttttatttyggygygtttatttygagttttttaygtygyggygggygggygtaatatatttttttatttttagtygtygaggattatatttttygtttagttttttygatttatttttyggttgtagtagagggygagygggtttygtttttgttttttggggttggtaggttygtgtggggttagggygygygggagaygtygyggagttgggtatttyggagaggggatgtttatttttagyggtttyg

SEQ ID NO: 6141 - DNA, 824 bp, Artificial Sequence; identical to SEQ ID NO: 6140
  Description of Artificial Sequence: Synthetic polynucleotide

SEQ ID NO: 6142 - DNA, 1415 bp, Artificial Sequence
  Description of Artificial Sequence: Synthetic polynucleotide
tygygttgttagaagtygaygttagygagggaggtgtgaagagttggttagaatgattaattttttttttatatttattttttttattatyggtggttygttgttgttgttttgygaggaagaggagtygtgggygggtyggygtatttyggtgttatttttgtattygggtttggttatygggggtaygttggttaayggtatggttatttatttygtgtygttttttygaaagttgtagattattagtaaygtttttatygtgaayggttgygtygtygattttagygtttgygttttttggatgtygtaggaggyggtgttygggtttttgtttatyggttttgyggagtttttygtagattgggayggygttgggggtagttatygtttgttayggggtgggttgttgggtttyggatttayggtgtttttttttttttattgtttygtggttttgaatygttatttgtttattattygggygttygttatttattaggygttgtattagaggygttatayggygggtatgttggygttgttttgggygttygttttgggtttygtgttgttgttttygttttgggtatygyggttyggygtygygttatygygagtttattattyggygttgttggtygtygyggygttgttggygtagatagttttgttgttgtattgttatttgggtatygtgygtygygtgygtgttagygttaagygggttagygtgtttaatttttatttgttgtattagttgttyggttgygtygtygtygtygtygttttttygggygtttagtaygygtygggtttyggtggygtygygtattyggygtaggtttagtttttgtygttygygttgtattygyggygggtatagyggygttttagyggtttgtyggtgttgttgttttgttgygtttttttgttggttaygtagttattggtgtgggtgagtttggttagyggtttttygttgtyggtgttttggggagtgtaggyggttagttggtttttgtgttgygttttgttygygtttaattygttgttttataygtggaggaaygaggagtttygtygtttygtgygtttagttttgtygggygtyggygaygyggyggtygttgtygttgtygttatagtygtgttygtagtgttttaggygtaattgggtattygygtygygggttagtattggtaatttagtyggggttygagggaagyggagattttyggttttygaygtttttgggtatygtygttttttttttttttagggtattttttgtttgaaygaagattttygtygygaagttygatagatygggggaaaatggggttttygattttagygggttatttgaattaaggygtttttttaagtggggygttygaagttattttggayg

SEQ ID NO: 6143 - DNA, 1415 bp, Artificial Sequence; identical to SEQ ID NO: 6142
  Description of Artificial Sequence: Synthetic polynucleotide

SEQ ID NO: 6144 - DNA, 3039 bp, Artificial Sequence
  Description of Artificial Sequence: Synthetic polynucleotide
tygygggattagttttggtttttatatttygttgtagttttgtttygygtygtattgtttttttyggttattgtggggttattaagygatttgtagaattygttgaggtttaggtttttgtagttttygtygaagatttaaagttagagtggatataaaygtygtgggtaggatttyggtgaggtttyggtgttttttttgggggtttttagygttggtttagaagttttagttygggtttaagaatttgggatttttttygattttggygatyggtygggttattyggtttagggttttagyggtagygggtaaaattttagtaggagttttttgtygagggygtgtttygaygttagagttaaattygggatagattagttaagygyggayggygygagagtggttggtagygttagtaygtagtttgggtttagagtaaggttgggygtttttagtaaagggyggtttggggttgygygggyggyggattgtaggygggagaagagygaggtgygttaggttttggggygygtaattgtttagtttygtgaaagatygygtygtagatggggygtagttgygygtttattygtgtggattggaaaygtttygagtyggttattttaaaaatygggaaataaggygggtttttttttygttygttattttttattaagtaggttgtgyggttttgggggttgattgtttttaagtagttaggttttatygygygtygygttgygtygaggttygttttgtygtagggaygttggtagttygttgaatatyggtaagagygttagaggttagyggtygttaggatttttattaggttttgttygtattygtttgtttttttttygtttggtttgtttttygtttaattgaaatygttaatttttttatttttttgtttttattttgatatattttaygttttaaatatgtttygtttttttttgtttagtttgttttttttttttttgtttttttttttttttttagttattygtttygttygattttgtttttgttttttttattygttygttttttatttatttattttagtttattttagttygtygattgttatttattttttygttttygtygygtttttygttgttttgtttaatttttttttttttttttttggttgtygttygttttttttggttttttttttyggtatttygttgttaaggttatttttgtygtyggatttyggggtgttgggtttttttyggtygttygtttygtattagygttttttgtagttygygyggtatyggtgtggttygggggttygagttgtyggtgtyggatgyggygygtttagtagggaygygggtttgggggggtggtttttgttygaygyggagygttgagttaggtygggtatttgtttttggyggtgtttatygtattgygyggtttttgtygtttggttgggattagaggagttaggttaattgttttttattaagttttaattgtggtttttattaggaaagttttttttaaagggtatagataygaagtttygyggattygtttatttttttygttgatttatatatattttttygtttttttttatatatttttatygtttyggttgggygaaagtyggagatgttyggttatttygtggaggttygygaggygttagtygggyggyggtagggggttgaggyggattttggaggatttagttttgggtttaggttgygggatatggtagygtagataaggtgggtgtagtgyggaagtygagaygttttataggttatagggtgyggyggayggtygtagagttgtygattagtttgttaggtttttgtttttaggygtattttyggatgtyggygyggtttagtyggttttagtatagggtatyggttygtgagttygyggygttagggggttaggttgtttagggttgtttttgattgtttagyggtgatgatttagygyggggaagttaagattgttagaagggyggttattatagtgtataayggtagggaggttagtttagtatgagaaataagaatatagttatttygttttgaggatagttttggtattgtaygattagtygyggttagattgtgttagtttgtygtataggtagtattttttttgtgaaggttaggttyggggaggagagaygggttaagattaggtygtagtttttagtygatttygatttgattattttaggttgaggtttagttttagggtttttaaagggygttagatataaaagtygygttttttygttaggttttagtgtggttttatagttttyggtygggtttgggttttagggtaggtggtagttttagtttaatttyggtagagtatgtttttttttttttaggtttaattgttttygggtttygattggatttygggtygtygttattgtattttttttygatttttygttttttattttygtygtygaggaayggtggtttattttttygttttatattggtttttgtttggttygggttagygttaattyggttttygtggaagtygtggygaaaggygagaggggtaaaaagttgagaaataggygagygggagagataagtaggaaggttygggtgggttygggtaaggaagaagaagagagggtygggttgygygttaygtttygygtygygygttatttttygyggggttttygtagaagtggtygtygttgagggtygggtygggttygaggttttgtaggtatttggygggyggtttggtyggttttgggaggtagggttttaggggttygtaggtyggaaagygggttagtygygggtygyggggyggygyggggtgtaggtgaggygtagyggygggggttttttgygggttyggaggttygtttttygaggttatataggggtygggtgtaggttttaygyggaaaggygygtagtgttyggggtttatgtyggtttagggygtataggttttyggggtttyggggttygygttgttygygtygtttgtgagygttyg

SEQ ID NO: 6145 - DNA, 1277 bp, Artificial Sequence
  Description of Artificial Sequence: Synthetic polynucleotide
tygttttaygtttatttttttygtttaygtyggttattagagtttygttygttgttygagagtttygtattgaygtyggttygygygtgagttaagtttgygttayggygtttygtygttagggtggtttttyggaaagygagggaatagtgygygtagygtttygtttagtttygttttgtttygtagagtyggygttgttagggygtagggagggyggtattyggttttagttttygtaatttygygygtttttttygtygtgggatttgggttttygygtygtttttttgagtttygagygygyggygggygggagttaggttgggattggtggtgaggtagggagtgaggagygagyggagtygygtgygtyggygygtagtttygggtygttttagttttagtygggggtttgtggttygggggaggagttgtgygttygygattygtyggggatygtagttgttyggtyggagtgtaygggtygagtttgygygattatttaygygtgataggtgagtygttggtygygtttygtttggttttatygggtyggttattgtaattttttttgttttggtttygttttagttagggagggttgaggattaaggtgtgaggyggygttgttttygtattygttygattttgygttygtttygggtttttttygtygttttagtygtygttgtttggygayggagtttyggggttygttttttttygygtatyggggtttttagyggygtaygtaygggttggatatygggttttagtttttggtgtttagaagggtttaagaatttyggaggaaattgggtttagttgyggaggtaagygttygyggagaatyggagggggtttgttyggtttattygyggtttgaaattgygygtttagggygtagttttattgggagttttttaygtagttggagattttagttttagtygttyggttttaggtttgtgattttgatagtaatattggtaagygaagtagaattgttaygttygagatgaatatttaatttttagttttggggttggttttygttggattyggagttagtagagagttttttttttttygtgggaagygtatttggggaayggaatggttgagataggggaygtgygtgtggtgtttatttggagggggygtygttttggygggtygagaggtttttgttgtatttatgtttgtgtgygtygtgttttgaagygatgttggatgttygtagtattatgggtgggtygttttttaggggygyg

SEQ ID NO: 6146 - DNA, 2394 bp, Artificial Sequence
  Description of Artificial Sequence: Synthetic polynucleotide
gyggttyggtttgggttgtttyggtgtagygygtttygtatttggtttygtyggtttattttyggagaaattttttttgttttgtygtggtttatagggttgatttttyggtattygaaaygttagtagttttgggagtttagyggagagtyggagttattttggggttagtgaygtttttygttgataagaattttaaagttgttttagttttttttttttttttttttttygygtttaattttgatattattatttttttattttttaggtatttttttaaagtygtgtygggattgtaattygtttttygatttagttggggtygggttttatttagttagttaaggggygagttagygatgygaatatyggtttggggggtaygattttygtttaygtttttygtaggygygtaggggatttaattttatatattttattttygaattaygaggaaaaatattttattttttaaaaaaataatttgttttttatataaatygttatttaaaaatatataaataaggtttaagtataaaatttaattttggggttggyggtggagggaaggtgagggagggggttttggtataygtttttygtgtgtgtttgygygayggttgatgagggygygttagggattttggygtttaaggagatggggttgtagggaggyggayggagagygttttaggygttyggtttyggttttgttttaatygtagagygygttttaaagtygagggtagttttaggtgtygttttgyggttttattagttttaggagattagggygggggatgttaagtgttggtaggyggggaagaggttaagygtygagtygggatygaaggtagggtagttyggtagagggtaggyggyggttggaggggygtygtattttttttgggtygyggyggtttttatttygttatygtygtygtygtygtayggttgttygtygygaataagtatyggtattattaygygaygtagtaggtygggygyggygtgtagttyggyggatgttgttaggttaggygatttygtygtttttggagygygagygygttttagtttgtagygatgattttggaattagattttgatttgygtgggygtgaggygaagtaggttygttagttgttygygttygggygtagataggtatygttgttgtyggaagygtygttttaattttagygtttgygttttggagaatagtattygtygttttttttttttttyggygttygagttyggagaygygggtttagyggayggtygttgygaygagtttggygggttggtttttaggttgttttygttygaggttagggatagtaaaggagataygggtgggtgagaygtyggattttaygagggtttgttgtttttttggygygggygtggaggtattggttagagggtaygtttattagttygagattttygggatgaggttattttttgagtttatatttggatatttattttttygaatgyggtgattttatttatattatagyggttattagygggtttgagatygtgtttygaaaaaatttatttyggggtttttttaatatgttygtatyggtagttgygttggtygattagtttattataagttgggttattagygtyggttttttttaggtygattgtattgtagtgtgtygaggtttgyggagttttgagtgggaayggggtgggggtaaattygttaatattggttattttagayggaggtttggagatygtggtygtgtttttaggtatggagagggggyggggggtggggtgggggyggtaggtggyggygygttttaaattttaattatttygatttttagaaatygttagatatagaaattttaaatttyggagtattagtgttaggtagggatttgtttttaggatgtgtygatygggatgaatgygttaggggttygaggatagggttttygtttttaagattgaggaaatttagattttgggttgggatttyggtttttyggtttttygtgggttgggtttttgattttgttgttttaygttttttattttttatttygtatygtaatttattaygtatttataagggtagtggtygygtttygaatttagttaggyggygtaggggtygggttggggggygygtggttttggttttygtttyggtaggtgttgygygttttgttygggtaaatttagaaggttgygtayggtgaagtttaggygtttagaggtggttatggtygaggaggggaaggaggygggggtagggtaggttgggaayggaggggyggtygggaygtygtttttayggatgggygtgggaggygttygttatgygttggtagtygggatattagygtatttatagyg

SEQ ID NO: 6147 - DNA, 1627 bp, Artificial Sequence
  Description of Artificial Sequence: Synthetic polynucleotide
tygtggggttayggttaygttgttttgygttttgggtattaygttttttagttataaggtgygttggagtaaggtggagtttggggagtttygggaaaygttgatttttattattaayggattgtaygttygggggtatgggtttttgggagggygygttaggatgyggagggggtatygattagaygtttttttggttatygygggygtgygtttggaggaygagggtyggtatygttgygagtttattaayggtatygaggaygagagygtggygttgattttgagtttggagggtgaggttttttygttttygttttatttttgtgtagtagygggttygtttygtttgggttttttagggtttttttttagtatttttttygtatttttggggattttagtttttttttttaggtygygtygtttttttttttttttygtttttattygttggttttttttaggattttygttattttttaggtgtggtgttttygtattaatttagtyggggtyggtattagtttaattattaygaggygaagtaggygtgygaggagtaggayggaygtttggttatttatttttagttttattagggtgagyggtygaatttagtattttttaagtttygyggagttgttttaggggttygagagagggygttaggygagtttagtttggtttttgtttatgaygttttttattttygattttygtygtttttygttagtttggatygagggtttggattggtgtaaygygggttggttgttygagggtttygtgygttattttgtgtttatygtaygygtttygtgyggyggtygaggtyggttygggattygtagttayggatttygygatyggatgygygatygttaygaygttttttgttttattttygygttggygggtgaggygygggaygaaggtagggttttggggaggggtttgaaaaatgtgggggaygaggagtggattttagtttgagattagggtagggttttygggtttttttaaggtatygtttttttattagttygttygttygtttaggttttagtttatttttttaaattttttttgtatttttgtttygattttttaattttttttatttaagttygatttagtatttttgyggtttygtattttaatttygttttttgggtgttagtygttttttttygtttattttgttttyggtyggtgattygttgtggtttttaggttaagtgtttttygtgttygggyggttgaygttgtttgaagtttaygyggygtgtyggygaygyggygtygtggtggttaaggttgggtatttttaygtygtttggaagttttyggggttagattagtgygayggyggttggttggttgayggtagtgtgygttttttaattattaygtygaggtygygttgyggggggttttyggatttyggagtgygtagtttyggtttttttaggttttaataggtagtttatgggatttattgttaygtygagaattaggygtttatygtgttttttttagygygygygaagaagtttgggagtygtggygggggtttttygttattttttttyggagagttttttttttttttagattyggagyg

SEQ ID NO: 6148 - DNA, 271 bp, Artificial Sequence
  Description of Artificial Sequence: Synthetic polynucleotide
tygttyggtggttgtygyggtttttttygygttgttttttaygtttggtttattatgtaygaggtaggtaatttgttttttttttyggggatttatttyggagataagaaggtagtttgttttttgtaatggtttttgttggagtgyggyggggtttaggygygagygggggtaygggyggggagttggtagygaaggatgygttyggygtttttyggyggtygttyggagttygaggtyggygygggaggagygttgatttygygggtyg

SEQ ID NO: 6149 - DNA, 884 bp, Artificial Sequence
  Description of Artificial Sequence: Synthetic polynucleotide
aygtyggttgtgaaatttattgaagtgagyggyggygttaggatttttgggatttygatttttttgtagttygtatagttaagggygagggygtttttyggtagaagtagtaaatygtyggtaagtttagygaggagggttgtyggggtttgggtttgggaattggttggtatttagyggaaagggaygtgagttgagyggygggggagaagagtgygtaggttagagggyggygygtagyggygtttygygaggtttttaygtygggygatatggggtgtttgttgtttttgttgttttgggygtttttttaggtttggggaagygttgaaggtgggtggaaygagggygtttgagtgtattygygggagggyggagagagggagttgggtagggayggggagggtaaygtttgatggggattggtgagattygggaygtattggygygatttaggtagaaaattygttgttttttggtttyggggagaggtagygyggtatagagttygttggtattagtygttttttgaagtttatttttttttgttttttttttttttttttttatgttggttgttttttyggttatttgttataygtttttaatttttatttttttttagtttygtaaaggttttttttttttygttgtttttagatttygtttttygttaatagtagttggaygygtatygayggtttggygtggttgggggagttgtagaygtatagttggagtaaygattyggatatygttygttttttgaagttttggttttagggtaygtttagygattagtagtgggagaygttgtagtatatatttygggtttatygaagtagttttattagggaygtgaaggaattygttaaaatgttayg

SEQ ID NO: 6150 - DNA, 1007 bp, Artificial Sequence
  Description of Artificial Sequence: Synthetic polynucleotide
gygayggtgttygtgygtttttttattagtgtatgtgygaggagggttggaggtatgagygaaagagggaaggtaatttyggtttttaaaaaatttaggggatttttttttttagtataagygtttataygtgygttygygyggatatatatatatatatttatatttatatataaataaatttttagtatttgtttyggaaagttttttttygtaggttggttygaaggygyggtttygttagyggagagtttttggatttatygtggtattatttttaattaattttgyggygyggygyggggagygtagggtgggttttaatttygggttygtttgaygttatttgggaaygygyggyggygyggggyggygyggattygggaygatttygtygygatttggtttygttttygttygygyggggttttgtttygygggaattaaaggaaggagaaatgttagtatatttttaattggaaatygagttttttttttagagyggtttgtttatttaggattgggtattagaatttaggggaggttttaattgaagtgayggttttggagattatggggaatatatggttttatygtygggttttttatttgtatttttttataaaattgtygttygtgtgtgtttttgygtttggttttttgtatttttaaggggtttttgaagatagggtygaatgygygygggggttttaggtattttgygttttayggygggtttygtagttyggttygagtyggttttggaagtttygttttggattagattggtatygaygtygtttttagtttgagygttgagagggaaaaygagagttagaaaggaaagaaatyggattggtgattgtttggtaggggtgtaatttaaattgttgtgagtagayggtaggagggagttgttaaggtaaygggtgatttttattygtygttttttygttaaggttggggagagggaagttttygygtgttgggttagggttaagttygyg

SEQ ID NO: 6151 - DNA, 2191 bp, Artificial Sequence
  Description of Artificial Sequence: Synthetic polynucleotide
tyggaygygatygttygtagtttgyggtttttggyggttgaggagtygyggygatttttggtttttatygtagtagttaagttyggygygtattaatyggygttgttgaaagttggagagtttttagttygtygatagaattyggyggtgggygttaggggaattttttttagtgtygtaattaggaaagttttaaaaagtaaggattttagatagataagagatttatttttttttttagtataagaaatatttygygtygygttagtygaaygttgttygtataaggttattygttttttttggtygggaygtattyggtgttttttagttttttattagaattggtttagggggygyggaaatagagaggtaattgtgttyggtttgtggttttagayggaaaygttttygggttttttggttygggggataagggttygaaattttaatagtygygagggtaaggatagaattattaattttygttyggatgttygggatttgtttttttaagttygtttyggtttttttaaaggaygygyggtatagtttatgygttttyggtattttattttatttttttatggttttttttaaatttttttyggggagttttataaagtatagayggygttttgaaattygttaggtattygttagttatttttattttygtttttygaattttttttgtygygtttttttygtttygtattttttttttygygtttttgggaagttagaagtaaattaygagaaaatgttttygtaaggagtttttttatattygttttgttattgaaataaaagygtagggaggagggaggtgggagaggaggygggaggaaggtttagaaagaygatggggatagtagtaggaaggagttggggaggggggttaaggtggtaagtagagttgggggtttagagttygttttygtgtygygyggygagtygtttatatgtttaggtygttgtaggtgttgaagaattttatttgattgtaygtttgaatttagtttattatttaggtttygtggygggggatggggggtatgattaygygggyggaggttttgaagtagggggttttgtagygtaggaygatgggygaggttttttygatgygygtggggtattggtygatggtggygtatatatygtatattaygatgttttygygtyggattygygttttgtaggtgatgttttggatatagtttattttgtagttyggtgtyggtayggygyggygtggggtagygygggggttygygygggtagtygggggygttygttaygtyggtatggygaygygtygttygttttyggttagatttagttygtatttaggagyggggagtygtygggtatttttggggaagttttttttttttgtagtygygyggggttttygttgtttygaygttygtttaygttygttttttygtttyggtagggygygyggagggtgtatttttaggaggyggygggtgttttygtyggttttagygttygggyggagggtagggaggggagyggygttgygaggaatggtgtttatttygggtyggagtttttygtttttygtyggagaggaggaggyggtagyggyggyggtatggagtygggggagggyggyggtggtagygttyggtttgtttgttttygyggyggtagtagtagtagtygtygtygtygtygtygttgtatgaatttttgtattayggttgtttttygygtgtagygtatttagyggygggygagygggyggtttaagaggtaggyggaggtagtagyggyggyggyggygatyggagttttygtyggtttygtttygtagtyggattatatygatatttttyggttyggttgtttyggttyggggggygttaggaggttgtggttyggggtggagagttttaayggttggagtagtataggaygtgtttygyggaggaaattggttgtaygttatgagttttgtttttattyggttgtygttygggtggggggggggtaatgtgtaagggtgggggtgtttaaagggtygttagygtyggggtggggtttygtaygtggggttgaggyggggyggggttttggtaggtggtgttttggggtgggggtgggggattagggygggtttaagygttatygggtgggtgaggtygagtagggygyggyg

SEQ ID NO: 6152 - DNA, 859 bp, Artificial Sequence
  Description of Artificial Sequence: Synthetic polynucleotide
aygtagaggtygtggtatttggtygtagttgggttgtagtgygtgygygtttggtttggtggttygatgggaagttyggggyggggtagtygyggggygggggyggggygtygyggagataggttaygtttttgttygttygygtaggygygttgygggtygttagttgttagagttaagyggygggttggyggygggtttygaygtttgygttaggatttggttggttgagttyggygtagtagtagtagttagggtagygyggtttttattttttgttaggtygtagaggygagtagggattagttggtygtyggtttttygggtaagatggggaatygggagatggaggagttgatttygttggtgaatygtttgtaggaygygttttyggygttgggatagagttgtttgttggagttgtygtagatygtygtggtgggyggttagagygtyggtaagagttyggtgttygagaatttygtgggtaggtaagygygtagggygyggagtaaggatgyggtagtggggygatttygttgygggtygttggaaygtggaygggtagygggagttagagggtggatggattaggygttgyggtggaatggggggtagagtggaatggggggtagagtggyggtgttygtggggygggyggggttttttagttttgggtatttttygttttttgttatttttygtttggtggtttttttgtttgttttttatygtgygatataaagttattttttttttgttttttagtyggggagtygggggaggggttygtttygggttygatttttattttttyggtgygygttagtttygggtagtttttttgygtagygygtyg

SEQ ID NO: 6153 - DNA, 791 bp, Artificial Sequence
  Description of Artificial Sequence: Synthetic polynucleotide
tyggggtattygtgtgygygygaggattttttttgtagagaatgaaattatygttttttttygttygtggtttatttyggggtttttattttaygtaagtgttgtggaatttyggggtgatgagtttygggggaagttagtattttttgttttttagtgtyggygttyggtagagtttygggatttttagtttttgtygtygttgaggaygyggygygggttgttggtygygtygtygagggagggttyggatagttttgtagygygttttagyggagttttgggggtygygtygtttttttaaatatgatttagaatygttygttagttttggttttagygtttggygygagygaatygggtttggttgtttyggtttygtttgaattttgygggtygygggttagggygygtygggattygttgygttaggattttgtagattyggtygyggtygggtygagtgtttttygtyggggttttaygtttayggtttaygtttgtaatattagggttgtayggygggttygtagttgggtttgygtttgggattyggggttttttgygtttttygtgtygtattttttgttttaattttaagyggaygggttttggggttttatyggttaggtyggagttttagttttataatttttttttttttatygtattgttttttttgygttgtggygggagttggggattggggtyggagaaaggagaygygtyggtttttaagttttttgagttatttyggtttygggygygttttttagggttgtagtygygyg

SEQ ID NO: 6154 - DNA, 586 bp, Artificial Sequence
  Description of Artificial Sequence: Synthetic polynucleotide
gygaagaggagggagtttygaaaggagggaaaygagtyggtaaggggygataggagygagtygggaagggagagtagyggagggttgtagagttgygggygttyggatygtgttatatatttttygyggggtayggagggtattgyggggggagatatataaagatatgygaagaggggttgaaygaggttygygtataaagaygtyggggygtayggtagttggggttgtatttatygttttygygtygygtygtgtyggggtygggttagygagtagttyggggttgagygygtggyggyggyggyggyggyggyggyggygggtaggygygggattygggtygttygygtttttygggtgattygggttyggtagtaggygygygygggggyggyggygtttaagtttaatttggttttygtttygttttttgtttagttygtyggtgttttttttttttygygatttygtttttttttaygttttttttttygttttttttygygtttagtttygttttttttattttgtaaaataaagtyggggaaaatgtttgttygtgtagttyggagygygtagttyg

SEQ ID NO: 6155 - DNA, 1678 bp, Artificial Sequence
  Description of Artificial Sequence: Synthetic polynucleotide
tygataggygaaattgtaagaatygggaggggyggttgyggygtttaggygygaggtatatattatattttttygtagttttttattttttttagaygtaygtgtttaaagagtttttgttttaatyggtttygttttattttygttyggtttttagttttgtttgtattgttggttttaagtttttttygagaggygggygtgtatagttgtagtggyggyggtagyggttattaagygttyggyggygtttygttatttatttttttttagttttyggygttgtagttttygttygtyggggagggygygtttagyggaataggagtygagggtggggygtygagaggagggaatttygggtygtatygttatagttttygtagtggtaaaggyggyggyggyggyggyggtagyggtagtagtaggtggagygagttatagygtttggtttgaaatttattgttgtagttattygggttggagttggttygttgggtggagttagtgttygtttyggttygattttyggttttygggatatttgggttgyggaggtyggttggtyggagttayggttggggaygggygygtttyggagygtayggttgygttggaagtygygtttggggygtaggattaaygggatttattttttttyggttatttaaagattttttttttygggaaagagygttgttyggttttgggatttgggaggagttyggaggtygttygggtatttygttggatattattygtttgygtttyggtggygygggagggttyggagyggagygttygtttttttttagyggtttagtggagaaaagtagagagttttttttggggygaatgggattttttttttyggtttttygtggagtygtygtatygtttgtygtgttggtttygaggggtttatagtttggtattaatttgtaggtgttygttgttgatttggtttttttttygatttgyggayggttttttttagygattttygatataygtttttttgttttygtyggagggtygggtttggggtygtyggagtttgygggaatttagygtttattygttgattttygagtygtttygttagttgtgygtttttttgggtattagtttggagaggagygtgtagaygyggttttttggagggagtgyggttttttagggaggtatygggtttttaggggttttttggygtgtgtggtgggattggggttygtyggttatggtttttattttygttgygttttgttatatgttgtttttggtgttgtgygttgygtttatttttttygttatttggtaygtgagtaataygttttggttttttttttttygttttaatttygttaaattttttygattttattttattttttttattttgygggygtgggygaatyggaaggttggattttttgtygttttattgtttyggggtaggaggtagttygttgtatttygtygggygygttttyggtgttttggttggaggygaggggtygttggtgtttaggtaggatattttttgtagggttygattgggygtttygggtttygggygtyggggagtggyggttataattataattaatttttttttttttygtttygtttttttttgtyggygggaggygaaggagaagygtygtygtyggtttyg

SEQ ID NO: 6156 - DNA, 1600 bp, Artificial Sequence
  Description of Artificial Sequence: Synthetic polynucleotide
tygaygatattgttattggaaaagtgttggttayggttttygttttattttttttatttaygggttyggagtttttaggagtagttagatygattatygtttttgtagttttatttgttttyggagagatatttataagttagtttayggagagtttggattygttygttttagtatttaygtttttttygygttyggttttagygtygttttygatatttattygygggtagttttttatygtyggtattttygaagygygggggygggyggtttygtagygttgygttttagttygygtyggtttygttttttttyggtttttgtgygttyggggygyggggyggtggyggggyggtttttgggggtttygggggttygygttygtygttygaggaggyggtygaggaggagygygaggyggtygaggtgttgtagaaggggttttygtygttgttygggtyggattygtygaataygtygttygagatgtgtaggttttygtagygygygygggtagtttygagtagygtyggygttttttttygygygttttygtygttttyggttatggtttyggtygtygttygygygttygtttttatagtgttttttagtygtataygtygggttttgggttygygtygyggttygtygttttttattagygtagttygtagtatagygttygtygtttygtgttyggtyggttygtygttttggtygtttygggtttagygttyggggaagygttttyggagttygggygtygtaggttgygggtygyggygggaggygagtygygygyggggttggtaggggygatttagagygggygggaygtagaggttgyggtygagattaggygtygtygtygttatygtygttattatygttattatygtygtygttgtgttttttyggygttygtygtttttttgttygttttttttayggttttyggygttyggttgtygattttttygggygygagtygttagaggygggttttgtygttttttatttttygttygtyggttaatggggagttyggttyggatagtygygggggagttgggygggttyggygyggggaaygtttttattttttttygyggggyggggyggggygygyggtyggggttggyggttagggggagggtygtyggyggtagtgtyggtttttttttatagggaygygtagttygggatygttaygygtagygygggagggggagggygggatyggggaataggaggggagggggattygggtgtttttagyggttygggttygyggayggagtgygggtygatttygtttattgttttttttygtagttygygtgtagttttagggagttgttygtttyggtggttttgaattaggygtygtygaaaygttttaggtaggyggygggttygaggttattatattygyggyggyggttgttgtygaggttttttgggggttattgttagttgygtygtatgtttttataaatataggggttgtttagtttttgggaatttygttttaattaggagttygtttygtyggtttattgttggtygttggttagatgttaatttygtttyg

SEQ ID NO: 6157 - DNA, 2394 bp, Artificial Sequence; identical to SEQ ID NO: 6146
  Description of Artificial Sequence: Synthetic polynucleotide

SEQ ID NO: 6158 - DNA, 1160 bp, Artificial Sequence
  Description of Artificial Sequence: Synthetic polynucleotide
gygygttyggtgttttaaggtttttaggyggagygygggygygaggtgygggtttyggggyggagygtaygttygggaggygggaagtgggtagtagygttttygtttggtttttgtgygtttygattygaygttttttygttygattaggtgtttygagagygtatagttgggagggttttttyggtygyggygagatttaygtttgyggtgtgttagggyggyggygayggtgaygggygtggggygyggygttgtttyggttgtygggtygttgyggygagygygygggtyggtttggagttatygggttgaatygtygygtttgtatygtgtygtaygtygyggaggygttygggtatagatygygygggygygtataaagyggttyggggyggtyggygyggygtagattttyggtgggtagygtattttagtttttttaggttagyggttgtagggagtttyggttygyggttttttygttttaagtttgggagttgtyggttttattttgtttttgtttatggggattygagagttttttagyggygtatttaggggtaagagtattgtygtgtgagtagygtttygggygtgggtgagygagtyggygggygggaggtyggagygtyggggtagttttttgtagttgggatattgggtagtttgaggttyggggaagggyggygygygyggtggagttgttygggaagttttagttattttttttttygttattygttttaattygtattgtttygagaygtttaggatagggtattggggatagttgttyggggaagtgggtgagtggyggygggaagggaggagygygggttttgtygyggygttygttttyggagggtttyggtygygtttttgttttygttttgggatttgttttttaygaatttttttttttttgtttatgttttttttgtttatttatttgttygtggygtttgygatygtagtggtatgaggaggttatyggaygttagttttyggagattgttygatattagtttttagtttyggtagtttaagtatttggtggtggaygaggygattaaggaggatttgaaatggtygygtttygtggaggattttattagygggtyggtggggtttaygtttatygaggagyggattttgyg

SEQ ID NO: 6159 - DNA, 588 bp, Artificial Sequence
  Description of Artificial Sequence: Synthetic polynucleotide
gyggggttgggygtttyggggaggagggyggagtaggtgagttgyggggtgggagtagggagtgtatttgtaygtgaygttggagtttgtagtaatttttaagtaggaggttgtgygygygtgtgtgtggagtggttgygyggtyggggaggatgtgygttgtagggyggtygtygtagtgagtaaygyggtaatyggagttyggygggtagtyggggaggtygggattgagaggggygagtygttggtgtttttyggyggtagagggtygygtyggttaygggttygggagagaygygttttagtyggttttaggatgtaggygatyggyggtagygtttttgtaggyggtyggtttattatgaagaagtattyggttygggtggtttygtttagygtttgtaatagttyggttttgatttttattaaagtggaaggtaatgygyggtygtttygtttygggggtttttgtattttagtyggggaatgttgttattttgaggggggttgtttggttgyggggygtyggggttgggggtattgtttttttaggaygyggtttygtagtgtagagygtygtygtttgyg

SEQ ID NO: 6160 - DNA, 878 bp, Artificial Sequence
  Description of Artificial Sequence: Synthetic polynucleotide
gygattygygattgtagtygttttttaaggttagtttttygttygtagtttgtttygggyggtagtygtgttagtttttygttaggattygtttagggggaygtgggtatygggtaggaygygygttttgggygttggggaygttygggatattyggggtttygttttgygttttagtttygggtygyggtatttyggttttygtttygygtttttggagggaggtatygagggaygygtagygaaggggttttgttaattgttaaagtaggaagtgagttygtggaagaagygaaggaggagaagaagaagggaggggaaggyggaggagggtaggggygygtagagttayggtttgttttaggygygtyggaatygtaggattttttattttygtggttttayggttttttygygtttyggaggtttgttagtttygttyggaygttygtttgtttttaattygtygttatggttttatyggaygattttttgygygtaggtaaagggatatagygtygygttygtttttggagygagtatygyggggygggagttygggaggygttygtagtagtygtagggttatygaggtygggtttyggygattttygagggaggttygggaattattttygatttaggygttagattyggagtygtayggggtttttagtttagtttygygagyggttgttgatygtttttttygygttygttagggtttttgtttygygttagttatygygygttttttttttgtttatgtygtagttttygtggtttttgttttggattygggatgttaggttgagataygttttgtaaatttttggtagaaatgggygtaagggggtggatttygttttygtttttyg

SEQ ID NO: 6161 - DNA, 561 bp, Artificial Sequence
  Description of Artificial Sequence: Synthetic polynucleotide
gygygggtttaygttggtygttagyggygttaattttatttattygttaatttgttagtttttggattgagtaaaatagtttttaaagaygygggtaaaygtygttttaaagtttattattatgtaaygttaggttgttyggagttaygttggtggtatttttttttygtgtttattttgtataggtatttttagaatttygtgtaaatgaattttatygggagaygtaggtgggtaggtygggtyggtagggattaagagtttgaaagggaatttgttttttttttttygtagttyggttattaaggtaagaaattgtaggtagagaagttttygaattygatttaggaygtyggygtttgttaggattttttygtttgtttttygygtttygygygygtttatgttattattayggggagggtgtatgyggtaggtgtttggtygaggttttygggagygagtygtttttaygtgttttagtttgtttttttttygaagttagaygttggygttgtagttttgttgtttgaygttgttgtagaagttygygtttattyg

SEQ ID NO: 6162 - DNA, 1235 bp, Artificial Sequence
  Description of Artificial Sequence: Synthetic polynucleotide
gygatygtagggtttygtttattttttttttygggatagtttggatgggagtagttggygygagggttygttttttygtttttgggtaatttttttggtattgggagaygagatggttttyggagggtggaaggtagtgttagttyggtyggttattggggattgyggggttyggagaygygyggggttttyggggagtttttygtygttttygttttatttygttygggttttttaaatatgtygtagygtggttgtttattgttttttttgggtaagaggaggttttagatatttttaygggatttgaattttygagygttttgtayggagtagttatttygttagtattttaaagtgaagttgtttataayggataagttyggagattttatgagaggtyggggtggagaagtygggggtgaaggggggtaggggtyggygygttaygyggtttttattttttygtttggattttygtttttttttttttttggatttgtatttgagttgattgtttagttttttagattttttgtygttttttaggatygaggttatggtygagatttaggygyggagtttagagtygttttttttttgtatttgtatttgtttttttttyggtagtygtygtygtygttgttgygaagtttgaggttgtaaattygggagyggtttattttttaggattgagtaggaaagygygtttygtttttttgtttttygaattgttttttatgatttgtttttattgggttgggggtttyggttgggygtttggagygagttgttttttggttagggagggyggggaagggygygyggygttttgagtgtttygagtttttygygggttttgttttttgttttgggtttttagygtagggaggttatttttgygtttttgttagttgtttggtattagttattttgaagttaattaygtagggagtttgtttatttgttgtagtagygtttaattagatttaattataattgttttttggttttgatattagtagtagtattagtygtatygtygtttggtygtttgtaaatttagttttygtttggayggtgaagtttttaggatyggyggttggagggaggttgttttyggggaataaggaygyggygygggtgygtttgggagagatygggggagtttttaggagggattttgttygggaggaygaggttttttgtygtagtttygyggatagtttagttyg

SEQ ID NO: 6163 - DNA, 5964 bp, Artificial Sequence
  Description of Artificial Sequence: Synthetic polynucleotide
gyggtaatygagttagatttaagaggggtyggtttygtttaaattggttttttattaatggtttyggattagtygyggttgtgttgygggagtttttaggaygyggttggggttggtgygyggggtttyggaattttaaattyggttyggttyggtaaggtttagggagataaggtagagaaggttggggtgagygagaagtygggyggtygatygttagggttaygagtttygttttgtttttttggaattttatttaattttaaaggtttaaagattttgaaaatttygaaagygaaattgygagttggtttttagaagtttgagaayggttttttaggttttttagygtygtttygggattttyggatattataaaygttattaattaygagtatyggtgttygtggttattgtttygaatggtttttattygygttttygggaattttttyggtttttygygtatttaggtttttagttttagttattggtgygtttygagtttttaggtgttagagyggtggtyggtygggtttttgtttagtttyggttttttttttttttttattagaaggaaaaatttgggtttttygagaattttgtggaatgttttttgtaattaattgtatattygtttttayggtayggtttygtgtaaaatygygggtttyggggttttggagtaaattgygtttgttagyggygaygttaggaggataaggggaggggttygyggttgaaattgtagtttygtagtatagagttattttaggttgttttttatttygyggggtttatgggaaagtyggtttygggagggygygtttaaaygtaggttggaggagttayggaygygttttggtyggygtgtygttatygtttagtttygttgtttaggtgggaggggttatttgtygyggggtttttaagttagtgtygtttgttttyggtttttatttattgatagtayggygttygagtgattttgtttagtttygttttgygtttttgtaaattaygttgttgygttaattataaatttggttaatatgtttttgtaattttattatttaaaaaygtttttaggtatttggtygttgttagattaggttygygggttyggaggaggtttttttatttgttttygttagtttyggggatygtgygyggttttygtgtggttttygtttaygaggtttttygggtaggaatygtygygygatttttgtttagyggtygygttttggttaygggygatttttgtygggaattttgttttyggttaagttgygttttygtatttyggtggtttttattygagttygygtttgttggttttttttttggtttttttgtttgatttygattttgttttygaattttatttttagatttttttygttttggaaygtygatttttttttygtatttygtygtttatttatatttttyggygattgttyggtttttatgttygttaagataagaagatgttttttttygatgygtygagagggtttttaagtygagtaagggataattttttttttaaaygttgtttttattttttattttttttagagygygaaatttaaaagtaaggaaggtaatttttygtttygattttaygtgtttgttttttagagtygygygttttygtttttttgttttattttattattattattattattttggttttttttaagtttyggtttyggttttttattttttattttagagyggygtggaggaaagtaggagtttattattaagtgtagygygttttttgtatataygaaattyggttggygtttgtagttygattgtatttaatattygggatagttagtttttttaataagtattttttygttttatttattyggggatttattygygtaggatttagtatatataaggygagagttagttygttttttagaaagataaaataaattattttttttgtttttatgtattttatattaygtgttygtagtttgttaygttaaattatggtagggtttggttttaagaygtatatatatattyggggtggttttttttgatatatatatttaaaaaaattgygtataygtaggtttgtatattaatttataggtatataygatagttgygtttyggtgttttggttygggttaggggtatttttttattttttttttttttagtaatggatttgatatatagattttaattayggaaaaaaaaaatyggatagtttattttttttttttttttttatttaattygttaaagygttttttggggtagttaaagagagtygaaattaaggggtggaaattttagttgggtttttttttattttaaaatttttatttttagtttttaaaagttattttagttygttatattgaaattggtayggtttttaaagatttttttttygtagttgtggygtttttaagaaaataygagtayggattaggttttggatgagtgttyggttatygagaattagttattttttattttttaggattttttagttttttttagtttttttttatygtttttggttaaaattaataaatatatttygtagtttttatagttgtattttggyggatttttgtaaaatatatatatatatatatatatttaygtaygtatattaaaaaataaattttagaattagtttaagttagtaattttgaaagggggtygaataagaggagataatyggaaagtttttaagtgataggatattattttaaagagaaaataatgaataaaaagattattttygttggagtaygttttaaaattattattgttaattttattttagttgtttaggtaaatgtttttaagggagygatttygaatgtttgtaygatttttatttttatgtyggttttygatttttygtttttattattttttttttttatttaaattaaaagaaaggggagattttagygyggaggagaygygggagygyggggtaggtagtagyggyggttgygtygttaaaatgagtgtagaaaygaggaaggtgggyggygggaggggataggttgygttyggggaaggaggatattttgtaatttyggayggattttygtayggttyggttttttygagttyggagaygtaggygaaggggattygggaagtaaaaatgataatttggagygtatagaggagtttgaagtttygtttaagtgtagtygttttttttttttgtttttttttttygtttttttgtattttttttagtttttttttattygttatttttaattttagtttttttaggtttttttttttttttttttttttttttttttttttaggttggaaaaagtttttgattagygtatttaatttgygggtygaagggttgtttttyggttagtttgggygtyggggatagtagtyggygyggygttttatttggtgaagttygttttgttttyggygtggatttaggtttyggtygtygttygggagggtatyggtttygttygtttgttygttygttygtttttgttygttygtttttygttygtygtttttttygygygttygtttyggtttttyggtttttattatagtttattttaatatggtattttttttgtgygtatgttyggygtttttttttttttttttttttttttttttttaagattttgtgtgtgtgtgtatgtgtgtgygtgygygtgtagygaatttttttaaygattttttttagygtttgtaaaattttttaagttaattagtttgygggaygtgatyggttttttttttagttagtttygygttattttttgygtttaagtaggygggtatttttaggattttgggattttttaygtttaygyggttttttttttatygygttttttttttttttttttgtgagttttttttatatatgatttgtagaaagtttttatygygggygttttygtatattttttygtaaggataattgggtaaattttygtttttttggttgyggttygtgagttgggtttttaatggtttagtygatygtgtgtataaatttgygttttattygtyggggatygttgggagyggagataaatttaatttttagggtaattttggtttygttygttttattttattttgtgtttaaatagagttttttttgaagttgygaatatttttaggttttttgggtagggttggaggggtygaggagagttattygagggaaaggtgtttygaggggtaggaaattaagttggggttgttygggygagttgttaggtagtygtgttygttayggygttttatggggtatttagttagtggygggttttatagggygggaaaagaatygtygtttatattttagtaaaaygtggttttygayggttygttggagagtttyggyggtygtgagtttygggtagggttggaygtttgyggagttttygggtattttgtttygggygtttggggaggaaygyggagtttttagggttttaggtgtaayggttgygtagagtttaaaygaaatgtttttagtgyggaaaagtyggtgaygttttggtagtaagattaagagttttygaagaaygttgygtttttaattagggggtttygtagagatgtttgtgtgggtttgtattgtatatttttgygaaatagygaatggataygtttgtttagggtttttatggttgttaaagggggtaaaattatttagttttttaaatttgtgttttatgaattttttttatagtatttttttttagggggttaagaggttttttaggttttygtgggttygtagttttattygttttttttygttttgtatttttaaggagaggtgttygttttgaagggttaggggttagttatggagtgaggggatyggggttgattaygygyggtatagatagaggtttttaggygggtttttttttggayggtggggtyggagttgatttagaagaaatayggagggaygtgtygagaagtygttttttttygtygygattttggagagygtttttttatttaaaggatttgtygagttgagagatttagggygggygttygtagtygtgaggttttttgygtygttagtatgggaagattttgtttttttatattttggagaaygttgggygaygattaaagygtttttygtyggtttgttattttatgtgatataggagttaygtgagatttagaagagtttagygattygtygygyggygtattttaaattttagtttgagtttgygatttttttagttttttagtttttagttgttggggatattaagtyggagttttgggttttttgttttgtgggtygttgaaagtagagattttttaaattaatygaatygggygtattaattttttygtttgtatttygttgtttttyggttgagtttygaggyggttttaggtagaatttgttggattgattgyggygtttagaaatttggagtgtgggttttagatattttttayggtttggtttygggttttaatatttaagtygttttttttggtttttttattatatagyggggtttgtggaaagggaggggtygagagattygtyggygtattattgttttygaggggtttttattttgtgtattgttgaagygtagggygygtygyggtaggaatggtttygagtgyggattttttgttttgagttttttatttttggttygygttgygtttatttagtggttttggtttygtagggygatagyggttgtttttttttatttgygttttagatygygyggtttygtttagttttygggagtygataggygtttgttttggtgttagygtagggtttttygggggtttggggtaggggtaggggtgygggggggaaggggagaaygtaatttttttttgtaggagtygtggagaygtgagttgtaattagttatygyg

SEQ ID NO: 6164 - DNA, 5964 bp, Artificial Sequence; identical to SEQ ID NO: 6163
  Description of Artificial Sequence: Synthetic polynucleotide

SEQ ID NO: 6165 - DNA, 5964 bp, Artificial Sequence; identical to SEQ ID NO: 6163
  Description of Artificial Sequence: Synthetic polynucleotide

SEQ ID NO: 6166 - DNA, 703 bp, Artificial Sequence
  Description of Artificial Sequence: Synthetic polynucleotide
aygygaaataaaygattttaggtttttagtaaagaagtagyggygygtttttttttttyggtttagygtgaaaatayggaaggygaagggttgtygttagtygtttttttgttatygygatygggaaataaagatatattattttttattttttgygtttttaagggattygaggaatttttggttgtaagyggttggtatttyggaaygggygttttattygttygggygaaggtttttggtttattaggyggttttggygttygtagttggygagttttygtttygttttygtygtygttttygtygtgggttttyggygttagtttatagttygttygygtttttygygtygagtttggttyggygttagtgagtttygtygtyggttygtttttygttygygttyggttygtygtatggtgygtttagygygtttygagttagttttyggygygttgttaggtygggtgttaggyggttatygygygttatygtygtygttatygttygtygttygattttggataataatgygygttttygtttttttagaaagttagggaygtttttagtygtygttagagttggttyggttttttagttttttttygtggtattygtaggygagataaagttygttttyggtgaggttgygygygtttaaagygtgygggatgtttagtayggaggtttttaagyg

SEQ ID NO: 6167 - DNA, 1315 bp, Artificial Sequence
  Description of Artificial Sequence: Synthetic polynucleotide
tygygttttttttaaatataygtatatttttatatttattygygtygttttagtttgtttatttttaaygagtttaagtyggtgtagtygygttttatgttyggttygtagttttygagttttagttygttygygttgggygtygttgtatttgttagtggygygyggtatygyggtygtygggtttyggagygtttttagygttgygggggtgtygtgggtggtttttttgtttttttttattagaattttgtatagtyggggagaaaatttaagttgttatatttygtygggagttgttggttgaaaggttgggagtygygttttttgtttggtagggagatttygtatttttyggtttttaggttaggtttttagttttagagttggaagagttttagggygggaaggaagagatagtaaggattagaatggggagtatgagattttgatgyggaattygayggtaggtttygttttatagttgtttygtttatagygatgygygttagagttttygtagttttgatyggtttttttgttttttagtygtygtttatyggtyggagggtygtttttttgygatttttttttttattttatttttaggtygtygtygttygtgggttgtttttygtygyggttaaaagttttygygttygaggggaagygatgggyggtttgggggttygggggygttaggyggggygygyggygyggggygyggtyggygggtgggtgggttatttggygyggtygggygygtttgtygggtattagagtaggtgtagtagtagtagtagtagtaggttggygagtagggygagtagtgygtttttyggtygtattttgagttataggygtygtygttatygttgttgtyggggygaagtatagttygggyggtttygattygyggttttygtygtygtygttatygtygtygtggtygtagtttygygtatttatagygtttataggyggtagygaggggygttygtagtttattyggtagagttttygyggygggyggagaagaagtygygttygggttygtttygggttttyggtttyggttygyggagygtygygatyggttggtagatgaygattygtygagttygtygtttgttttttyggaggygttyggagttgttgygggtttyggtygtygttgttattgttgttgtygtygtygtygtgyggggttatttgaaggttggggygyggaagtttaatttygtgttgattgggttttaagttttttgygttttygtttygtttygagtgttygygaatttttyggaygtttayg

SEQ ID NO: 6168 - DNA, 1316 bp, Artificial Sequence
  Description of Artificial Sequence: Synthetic polynucleotide
gyggtygtyggtttttagttttgggattattttggtttygatayggagtgataggggatttttaygygttttygtatttagggygtttttttagttgyggyggaggtatagagaggttttggyggygttgtggtttyggtyggtatygggtttygygtagtygggttttttattttgagtggagttgttttttaagtatttagtttttgttaattattgtgtttaatattaagttttyggggygttttgttttgygttatygygygttygttygttygttygtttaatttatttgttgaagattaggtagtttaggtggttgattttgtggtyggagyggtggyggttgtagtttttttataggtttttgaaggtygtgatggttaggatgaagagtatyggygttagtgttaggtygggttggaaggygtttatygtyggtaygaagttgagtagygygatgaagataaagtataygttggtygggyggtggaattgttygaataggtttttgggtaggaaggatagtagygtgtatttggtagttttgagtyggttgtyggttaggtgttgggtatattygygtygtygtygtygttygtttttggtygygttagtygtagggttttyggygttygggggyggtagtaggttggagygtatygtgygygttttgttttttyggygttttygtygtttyggaggttygggtttttyggttttygtyggttttygttttatggtygygtgtygtygygttyggttttttygtygtttaygttygttygygtyggttttttaggttattattattygyggttygggygyggyggtgygagtttttygtttgygggaygtayggagatygyggttagygygtygtttggtyggtttagygygtttagttygygtttagtttygtttattttygtttagtttygtygttyggtygtagtttttagggygtaagttgggygggtgtygtatagagtttttttgttttygtygttygttttyggttygggtygttttygtygyggtggttayggtttygttttygtttygygttyggattgggttaygtyggatagygggaaataaaaaaagttygagttggaaattttagagaggtttagtttygttttttagaagtattagttyggttttaaaaygttgtaaaygygygttgtttgtagtaggagagaggaaatygygaagygygagaaaaggygttttygtttttaagtagttygygygtttttttaggggttagatttgttttattttggayggygaaaygatttygggagatttyg

SEQ ID NO: 6169 - DNA, 1110 bp, Artificial Sequence
  Description of Artificial Sequence: Synthetic polynucleotide
gygtygggtttggtttttgtggtttygtaaattttttagtttgtgtgttayggygaygygtagyggttgagtyggagtttaygyggygygygtttttygygaggaatttttyggtttgtaggttgtttgttattttygtttttygaygygtttttttttggttygygttttyggagttttttttttttttggygaggatttttttyggygttygyggtttygattttygtygygttgygttygttttttyggtttyggttgtttygttgagggttttttttttttaggtatygtagtygygttttygygtttygtttttygagyggttygtttygttygatgtttyggtttygtttygygtattgagygtttggtagtagggygtygagtttyggggygttgyggggygttgygtygagaayggtygggtttgagttttgggyggtttttagagtygattagagygyggggaggygggggygaggaggaggggattygtygtygggggttggttgtttygtttygagtygatttttygttaatggtttaaagggatatgtttaagtygttttttatagyggyggyggyggtggygtaggagatttagatggaattgttagagaaygtggttttygygggggygttyggagtygtygtataggtagygagagygyggygtttttttttttttttgtgagtygtygggtagggtatygatttygggttttttyggygtttttattgtagggatttttagtttygtatttttttttttygtygtttgtttattttttgttttttttttggygtyggggattttgtttttttgygtttttttttggttttgtttyggtttttatttttttttgttttygaaaagttagtggggaagggygggggagatttgttagtttttttagatttttttygggttgttttagttggtttttttygttttttttygggagaggtatatggagagatatgaattaggggagtggattggatttgttgaagatygtgagttygggtgggygggagggggttygtttttygtagygttttttaygatgtygatttttttggttaygtttygagtyggggtgggyg

SEQ ID NO: 6170 - DNA, 1655 bp, Artificial Sequence
  Description of Artificial Sequence: Synthetic polynucleotide
tygttttygttttygttgatattttgtaaagtygyggyggtagyggyggggattaygttgyggtgtattatttttygttattttttygygttgggttggggtygagggggtttygtagagtyggtaatygaatyggttttggtttgttttttttattttttagttattattagaattagttttygygaaggggygagttgtggttaattttttygtgtttagggagatttygttagggtyggggyggggygygatygtttttygtagtygggygygaaggyggttygggagttaggtgggtgtggggygtagttggyggagttgtttagggygtgygagtaggttgygaggatggygtttyggyggygyggaggtatygtttygygttttttygatagtttttyggtttgtttttttttttygygttttggggtagtyggttgtttggggygtayggggttggagtggttttttttttttttttygttaggttttttyggtttaatttgttggtygygattttttagttagtttygaggaaagtgtagttattggataggtttgtgygggttgtyggttttagggaggaaggtgggagaagtttggaggagygaaggggagggyggagggaggagggaggagggtgyggyggtagatttggtaaattgygagttgttttttttttttaaagtgtggagaaggagygygggggagygtggygayggtagygtttttttygttattaaatttttggggtttygygggggtttggggttatttttttttgagttyggaggaattttttttygataggttttagygtgatttttttttattttattttttttttttttttttttttttttttttttttttttttaaatatattttttttttggtttyggattttagattgttgtagttttaatttttttagggtttagttttttggagttgtttattttttyggttgygagaaaggaygygygttttgygtygggygaagaaaagaagtaaaatttgtygggagggtttygttattaatttttttttygtaaatttaaattttttgtyggggttatttttagatagaggaaagtttttgtagagtygattagttttagtggatttggggtaggtagyggygttggttgtggaattagatttgttttgaatttagtggagygtatygttggggttyggaagttatygttygygggtatygggttggygttgttygagtggaatygatagtttgygagtttyggttgtaagtggtttttttttttygyggttgttgtttagtgtygggtgagggttgygagtgtggtaagttgtaaagagagttttagaggttygaagagygttgygtttttattygygttygttttttttttttttyggttttttattgtgaaatygtagygatatttataaaggttttygggttttatygagatygattygtagygtttggttyggtygtgtttattgtatygggagttttygagtatyggygaaggattggygggtggggtagggaggtggyggyggyggtatggygaggttttygaaggtygatttggtygttgtaggagttatgttattttgttatttttttayggattagttttagttygtygatgggaaattyg

SEQ ID NO: 6171 - DNA, 1655 bp, Artificial Sequence; identical to SEQ ID NO: 6170
  Description of Artificial Sequence: Synthetic polynucleotide

SEQ ID NO: 6172 - DNA, 304 bp, Artificial Sequence
  Description of Artificial Sequence: Synthetic polynucleotide
gygggygttggaaggggggyggggtaaatgyggtyggygtagaggtggggagtaggtgggaaaggtggaggygggttygtttttggagatttatttttgtttttattgtttttygtttgttagttttatagataggtttgaaygygtagagagttttttggagtgttttgattttgttttygagagggtttttaattttygtatttttttagtggttgttttggtaggtgygygttttgyggggagttgygtttygggggttatygtygagygggagttgttttttggaattttgtttatygyg

SEQ ID NO: 6173 - DNA, 1666 bp, Artificial Sequence
  Description of Artificial Sequence: Synthetic polynucleotide
gygtattttttttygatygttagtagtataagtggygatatttttatggagyggtygygtygtagtttgtygtatttagygyggayggtttggtygygygttttttygttyggaygatygggygygtttgatattaatagttygyggtttaggtaygagygggygtygtatttgatttaatttaatttataatyggtygygtttgtaggtgtygttttttgaaatygttatttaggyggtygttgtttatttttygttgygtygygggttttgtagaagygtaagaatggggttgattatttyggtgtttatatgtygtttttataygtttttattttygttyggygtaagattttttttggttaaaagaggygtttaattagttttggggtygyggagagttagygtggtygataaagttyggttttttaggtaattygggttttttgyggattygggagggggygygyggggtyggagtatyggttttgggttgygygtttttttyggygatattgtygtttttttggttttyggttyggtttttygtaggttaaaggtttatttgtygggtttgggtggttygggttagygtygtttgyggttttygagtgyggttggttttaaggtyggygtttttttttyggtttttagtgtttagagttaggttagygggaaagaaggtagtatggttygtaaaagataggtggtagtggtagttttgtatgatatttgttttttttttttgttttttattttggggaaatattggaaatatttttttttttatgygtattygygttttagtatygagtgttttaagttttgygygtagygtygggtttggaaggyggygaatggttgtttagtygtygtttttattagtgatattyggtygttagttttygtttaggatgtgtatatttgttggtagtattggttygggtggtagttatygggttatttattttataggtataatygtatttaatttaatttggaattyggagggttgtgygygtygagttgggatygygttttagygagtygggtttttggttgygttagggtttaggtygagttatttygtygttygygtygtygygaggygggatatygtgtgatatttttgtygtgggttgggygtyggtygyggggyggagagygggtgttttatttygttttattatttgattttygttagygtttgaggayggygtatttaattygttttattygttgygttttgtgaattagyggygggtagggygggggaggtygggttgggggagggtagggtggttttaatttttygttttygtttygtyggtttygyggagtataagtgttgggatttttaygggtaggygtgttttgyggttggaggttygagygtttagggtttaggagaygtggyggatatagaggggtttgtaggtayggtgattttygtgtttttgttttgaaagggtttgaaaggagyggtttatggtgtattattagttaagggtttaggtattagygttttgtgtygggaattygggyggtygttygtgttgtaggtgtttgttatataaaygtttygggagggggagggtaggtygtyggattgggggtyggggaggggttttyggtttggtttgtttttgttattygygyggtttyg

SEQ ID NO: 6174 - DNA, 5030 bp, Artificial Sequence
  Description of Artificial Sequence: Synthetic polynucleotide
gygttaygtggagagttataygaattttaagygttttygttttttagtttttygygggaaaayggattagggtgttaatgggttttgattatttgtattagygttatttgygagtygagggttaagagtattttttyggttttggtggggtaygggttgttayggtgtttgtaaagttattgtttgaggggtygygttatgttttgtagggtttgtygtttgtgttttattttttygttattttgtygggygttgggatatggggagaggaggyggttttggtgagygaygygtttgttygttyggaygttttaygtttyggttaagttygggtttygtatttaaattgygtatttttgttttgygtttttgttttgygygygtttagagtgtttgggagaggtaggaagtgggagttatatagtttttggatggggagattatttygataggtttattttgaatagggggatattttgaatttaatattttaaggttagaggtttagaagaygaaggttaagtgatttgaagaatattgttattttagtygygtatttgggtagyggggttaattgttattttttttttattygttggygtygtattttygagtggttttggtttggtaggtttggtagggtatgyggttggttttygaaatttttttyggggattttttgtttgtttttagaggtttttygtygtttgtggttaggggaaaggtygtygattggatatagggaataaagtaaaggagtattgtygtttyggttttttttaagttattttttttgattttttaggaaaagggggaaattttttaaaggagttggtggtttgtggaggaaagttgtagaatttaaaaatatygtygggtygtttttygattaagggagggttaaaagtayggtaagttttgttttattatgtaaggtaaaaagattttaggaaaagtatatttaaagggggaggaggtagaggtagttaggagtttggagygtggtttggggygttgygtttttttaygggttygggaggtgtygygygyggtygttagygagtttagtygtttttygaggtttgygygtttgygtyggagttttttgggtttttgtttttttaaatattttgaaatgtaattttattygaaaygattggtagtaatattttgaygaaatygaatttttgttttattaagtagygaygtygtagaataagtagttgatgtaatygtttaggtggaggyggttaggayggtygttttttttyggyggggygttyggggagtygtyggatygggttaggtagagtttgttttttatttatyggtagtttgagtagttggtttattygtaagttatygttttttttagtatattttttatttygttaaatttaaattyggtttygtaggttyggggttttttttttygggttygtygygggtttagtygagtygygtttaygttygggattttttggygggaggygattttttygattttttgggttaggygagtygyggggttttggygaggggttygagtgatygaagagaagttygyggagtttgagtttggatttttygattgttyggtttygtttgtttttttgtatygagtttagtttttttttttygtttttagtygygtatyggtatttatagttyggagaggggtaaataatttttaatttygaggtttaggtagyggagggtygaggggtagtttttggygtttttagtttttattaagttttttggagttgtttygaygaattgattttttatgttttaagataggagttttttaatatgagaatgygygagttttggaggggtagatttgtatttttagggaatttygggttttttttygtttattygttygygttgttaygggatttygttatagtttattatttttattttttygggtygtaggygggtagggtttttaggggagtgygtatattyggtttttyggtgttttaggtygaggttgtttttgaggggygggtygtygggaatgtttatttyggggygggygtgaggattgtttaggatatygttgtagggtyggttatttygttttygtttygaggygttttygtttttaaatagtatygtatygttgagtttgttgaagaygatggtgtttatggtgtyggttggtagggaygygyggygyggtygtagagtttyggggttgggtygtygggagtttygtagyggggttyggtttttaggagaggaaggtgtatttygttatttattggttgagagtgtttagatttttgtaggtttagggttttgaatttggtygggtygtygggttgyggagtygaggggaggagyggygtygtygtaattggtagggattttgyggttttttttagttggttataygttttygtttttgtaggtttttyggataggtatttgtttttttttttgtttgggygatygatttttttaatttttttattttttagaattataatygggaattatttattygtagaggtaaaggaaaygaatttttaaaygagtttttgggttttagtttgaatttgggagaggtatatttyggattgyggagygygatyggygtgaggtygygygtggttttttaattatagtagaagattaaagtttttaggaattttaattyggggygttaggaggggttggatggaagggaagatttggggtaatgtgttaatygtatttataagattttttagtttatgagttttaggttatatygggatttgggggattttygtgttttttagatygtggatggtttggttgaaattttygtattttttgttygttaaggtttttyggggtgaggttgggtttaaggataggaaaaagttaagtggygttaggaygaaagtattatttttttttttttttttttagaatttttttattattttttaaygygtttygggaagtgtatggttttaaggtttaaggygttaggatttaggtttttagagtttttaattagtgttattttttttygtagygygggtgttagtygygagttygtagtttttygatattygtttttttttggggttttyggggatttttttagaggttgtaaaggtgttagaagtttaaggtaggaggtagtttggtyggygtatttttygggttattgttgttattgtyggggagagttagtagtttatttttggggtygyggaggttttgagtttttgtttgtygygtatyggygttaggagtaagttygygyggtygyggagtygtagagttatagttttaaggygygyggyggatttygttygttttattttttygtttygygtttygggatagttttygtttttttygagyggttttagtttygttgttagygttttttttgttygtttagtygyggtatgggttgttattttattaatataygygygygygtatatatatatatatatatatatatatatatatatattttttgtttygttaagygtttatattygttaaygttttygtttygtttttyggttatygtagtagaggttaygygtgatatttaggattaygygtgattatygygattaaaygayggttayggtttgtgttygtagggaagtgaagttagatttttgttggatgtygtgtgttttttaggattgygttttttygygtagataggtaygtgtttggggtgtgtatatagtttyggtgataagtgttaaagagaattttygtgtttgtagtttttgttttatagttaagattygygttggtgtttttttttaaaattatgtttttagggatgtgtgtttatgttgttttatttgtataagatattttttttyggttyggtttttttygagttattttagygygtttttttagatgygaygaygtgttttttttagygaagttattaygaggttagttatttyggatattttttyggtagttttaagtttaygtagagatygtagatatagatattyggygygttgtaggtttgtaggtagtaggtttagaggtaagygatggtaaaggttygagygttgttttgtygtaaggggttygggggygtgtgaattatatttgttgatttttttaggattttygygygyggttattygygtttttttttaaattatttatttygatttattttagattgtggtyggggaggttattttttgtagaagtgttttttttttttaaygtyggygaataattttaaagtaaaggaggygyggttaggtgggtttttaagtttygygtagatttttgggttagttttggtygttattygagygtttttttattagattttggagggaagttgggggaagggygggagagtatyggygtttagggygtaggggttagagygagtttggygtttygtygtagtyggttgagattyggygaygygggggttgtatttgtggttgyggggtygayggtyggttgtagggyggttggttttttygtttygagattaggygtatttttattttygtygtatgttttttaygygggttttagygygtttattatygttatygtygtygtttyggttttatttatttagttyggygygygtygttygggaataggaatagygaggtttttttatgttttttgattgtyggttttagtyggygaatattttgygggygyggtatttaygttttygggygggtggagaggaagygttygygttygttyggtygygggggttgttgttaatttttagtagaggagtygttgtyggggagtttygggttygtygagtttttyggagtygggygyggtttttagattygtyggttttgtagtygtggagtagayggggttttttttttygtattttaggagagaaattggagaagttgtygggagygttyggtttyggttttagaagttgagaggttgyggtgtaaatttygtgttttagttggttygattgtyggaaattttattgygygtggttaggygggagaggttattgtgaygyg

SEQ ID NO: 6175 - DNA, 2868 bp, Artificial Sequence
  Description of Artificial Sequence: Synthetic polynucleotide
ayggttttaygygaggaagagggyggggagygyggatygggtgtgggaggtygaggtgatagtaggtgagggtygggtgyggatggggaagtgagataagtatygtgtgggtattatttatttygttttattaaggaggttgttggtaagyggaatttttagttttttttttaatttagttgaagtttaattttattgaagttattttttatttyggttygtttggggggaaattaggygtttttggaagggaagggaagggagttygggttgygygggttaggtagttttttttyggtygtygygtgttttygtygtttttaaatttgtttttttttttattaagggaatttttyggggagtttagatygygatttttttttttggtttyggggtgyggggggyggataygygaggygtgggattgatggtagttttgtttttaggaagtaggtaggyggggatttttgggygttyggaggggtagtttygagggtatagggtatagggagaattagttagatttttttttgtttygggtagtygyggygggtgtggttagygyggaggtaggaygtygtygagtttttaattttatttttttaatttygatagttygtygtttttttgatygygtttttayggtttttyggtattygtttttttttttttattatatttgaggaaaatttttttttygttttttaatttaaatttagtagtgtttayggttgtygtaaatygttyggtttttagtaataaggtttyggtygtagagygagagtttttaggtgtaaggaaggtgatgtygtaaagtygggagtgtygtaaattaggtgyggtggggaggggggaggggtggaggyggaggggtgggggggaagggggagggagggggaggaggtgattygagtatttagatataagygagaggattatggyggatggttttaggtgtaagygtagaaagtaggygaattygyggygtaataayggtgagtggyggaggggatyggggagyggyggagttagggggagttgggtagtyggggygttttygggggtgaggggggygagtygggttgggggtagtyggggtagggayggtaaagtggagtgggaaagtagaaagtagtgttttttgttttttttygttgtygtygttgtyggagtygygtygyggtygttygttttttttgaatygttatgttttttatttggttttttttygtttagyggttttygtygtttttgtygtttttttggatygttagtyggygtygaygtygtygtattttyggygtagggygggyggtygggaygtattggttatttttttggtttygggtggagyggttgttgttttttttygtatttttttttatttttgtgtttttyggygtttttttttttttttttttttggtttttttagygygatttttttttagygtttaggttttygggagtygyggaataaatttgtgttyggygttgatygtgtaaagtggttttygygygtygyggtttyggtyggygtygtygttgtygttygggtttygygattygggtygggttgtgggygygyggtaggygggttgyggyggyggygggayggggyggtygygggttgygtggggtttgtgygygygtgtgygygggygtyggttgtgygygtygygggyggatagggttyggtyggyggyggtaaagttgggattygygggtygggygygttygygtaayggggattagaggygygggggygygggtttttaagygttttttttttttggygtttttygttgttyggtttagagtttyggtttggggatttygyggygagtttygygagtggggtttaygtttggyggggygyggyggggyggygyggggaataaggtaggaaaggtatttatttaaygtygtygggagtygygyggatgggggygagttgggyggygggtgtgtttgyggagttgttatttgggtttagagatygggaagtattatagatagatttttttttyggggtagaygaggtttttgygtygggatgggtyggtgtgygtgygtttygygtttttttttttyggtttttggggaagttgttatttgggtyggaygtayggagygttgaagtyggataatggggtttggatggygttttgggtttygggtggaaggagggtgggggagggggyggayggatygayggaygygyggggttgttatttgtatygtagttgtagtgtttattgatttgtgttgttgtgttaagggaaatatatatttttttgtttggygtgagagttaaaaaaaaagagagatagttygagggatygagatttgaatatgtggtggtggttgtatagtygttttttttagtttggagagaygttgtaagttgattgtatttttggttatttyggggygatgttatgttttttttttttttygtgtagtagygaaatgtttgttgattgttattgtttggatagtttttgtggygagaggggygagatttgttygttygggggyggygggagygtagggagagtagttttygtttgygtygtttyggtatttgtttgtataataatgggyggtaayggttttgtygtyggtygtagtttaggttatataaggaattataygtatatttyggatygaggggttygttttggtttttgygttatttttaaaaygatttttaagagaggggtaataaatgygtttataatgggatygttgtagygtygagaaaaygaggaaataygtgtttaggagaaaattttttygtgtttttttagttttatttttygygtttgggtttttttttttttttttttttgggatgygaaaygyg

SEQ ID NO: 6176 - DNA, 2678 bp, Artificial Sequence
  Description of Artificial Sequence: Synthetic polynucleotide
gyggttggaygygygtttaggttygygtygttgyggatygyggagttgtgtagaagygyggtttggygggtggtataagttygatagttgygtygygtagttygttygygtttggttaagagtttygygagggtgtggggagaggatyggtttygtagggagyggaggttgygyggttgtatyggattttatagttttaagtygyggtatgaggygaattttgtaaagygygttttygttatgtatygttygatttttagtattgtgygtagtaggatttyggagtttattygtttgtggaaatygagttygtagygggaaggtagtgggtggagggtgggtaggtaggggtttggggttygyggttttttattttygygttttttygygttagtttygaaygtttttttggggygtttttgtttagttgtttyggttgatttygttttgtagttagtttgaggttaggyggtygttttttgtaggttataaattttyggygtaaaagtagggttttgaaygygatatygtattagagygtttagttaagygagttgtttttatttttattgtgtygggyggygtaaattgygggygtaggtagaggagtygyggttttgygtygggygggagtygaagtttagagtttygttagggttttttygtygagygtatttatygtygttgaggtagagygyggttagtaygaggattagtaygattaygattttggygtttatggtgygggygggygggygggygggyggaygagygygggtygggggtyggaygtygagygggtaatgyggttgayggagagtgaaagtgyggyggtgggaggygygygtygggygttttagaggggagagttaggyggggyggggyggggygygyggtgaggggygggttyggagtygagtgttggtygtggtyggggtttttgaygygygattttttyggyggtattttttatttatttttttygtttttttttygttttttttgtgttttygaggygtagtgygtttyggtttttgatttttttaggtttygttgggtttygtatygttggttyggtttgtagtgaggttygtagtttgagygaygtyggttggagggtygtttattgtttttgtgatagggttttattggagagattgaggattttaggygtaaagtggggygygygtggaaagttgygggayggggtttttygatggygggaattgaatgagaattaatgaaaagtaaataagttagtttygggyggagggtttgttggyggtggyggtttaaggtagtygagggggttttgttttttgtgygtgggggtttaagttygttatttgttyggtttgyggygtagtygtyggtagagttygatttgygggaatgagattygtttttgtagttagygtggttyggattttaagtttayggygttattagtygagttttagttttttygtttgtataaataaagtagaaggygtyggyggtttttagtaaaagygaatgtagtttttgtattttygattttttaatggtgaaatgagttaattataggtttatttygyggagtgggaygggagatttaatgagattygttttaygtygygaaattttttgtatygtgtttgataagtagatagtatttaataaatggtagttgtaagtaagttttttaaatttaagtatttattgttttatttaagaaaagtttygtgygatttaaagagttgagaatttttttatttygattttygatttttaggatagtattattggygtttgttttttgggtttagaaaattttttttayggagtygtttttyggyggtgtttagtttttyggatattttygagatattttagatggttttagttyggtggygaagggagggtgtaggtyggtatttaggagaygtgggggtgaggagagygtttttttgggtttygttttgtgatygtaggttgttttagttatttttttgtgttttttttagtatagygtttagygaagtggggttagtygtygygtttatttaggggtttgttttggggataygtttttgtttttggggagttttggtygtyggggagtgggyggttagyggttgtattaggygggagyggttaataggaggttgygagggtttyggaatttygttggtgggagtaggtgttttttgtgtattttttttttaaaattattttggtygttagatggttgtgggtyggtattttatttatttatttatttatttatttatttatttatttatttatttatttattttgggtattgggtttggagtygggaattttattgatttggttttgtttttaaagaattgaaggtagtgaggtttagtgaagaaggtagtygtygggygtttttaggtttttgttgggttgggtyggggagtttggtygtttatyggtygtagygttggggtttyggygttttttggtggyggygttttttttttygtttttagagttttggttagttttatttttgygtagttgatgaaattygggagggygaaggggttygygggaaatttatattygggtggaggggygttttggagttyggagattygattttgygggagtygygygtagtttygtttgtttttaaatttggttaaagtaaaygttatygtttttyg

SEQ ID NO: 6177 - DNA, 2756 bp, Artificial Sequence
  Description of Artificial Sequence: Synthetic polynucleotide
gygggagggyggtagyggttaggttaatattygygatttygattggggygyggtaatttttgtttttagtttttataagttttyggtygygattygyggtygagaaattttgyggaggggtyggtgggttagagttaggttaggtagttgttgagtttttttttttttttttggygggagtgtgtgtgtaaggggttagggggyggagtyggagaaagggttgggggtgttygtgtttagygttttttyggaygyggttttataatttagttgygagaatagatggaygtagyggyggtttatttygggggttttttgttygttgtgygtygaggtttaggttgaagyggagatygtaagtttttggttttygttttttttaaggggtttygaggaatyggttgtygygtttttttttttaagaggagaagagygggygttgatttygygagttttagaatygygggyggggggtaggtagggggyggggggtagagggttagttatyggygyggaaygtttattttaggggttggtttaagatttttatatygagagttttttttgggtttttagttttggagtatttggagagyggatttttgttyggttaygtttygttttyggttttygtttygtygaygtygtattagtatgagygaygtaagtggttygggtattattygggggttgggattygtygygttatagtttygagtggaagggaaaaaaaaagaggaggyggyggaggaggtaagagtygaygygaggggaggggagygtagyggyggggttaaygggygggtaagygggygggyggtaatagtatgtttttyggttagygygggyggttttttagygyggygggggttgttttgggygygtttygggygaagtgygtttagttttyggtttyggtttttyggygygttygatttttyggtygtttttgagtttagtagtygygggtttygggatyggttaagagtagttgtaaygtttygtyggayggagtttttttttttttygggaygttgggttatgagtttygyggttatttgaggtataggggagtttgttyggttaggatagttttttygaagtttygtgttttygtttttgtattgygggaygttagygttyggttttggyggaggygttttyggaagagtatyggggtgggggtatggaattygyggaatttgygggttaggttygggyggyggttattaagttgtyggaggttgtgggygyggygttgtaggagtttyggyggtagaggygtttggtgtttgttatygtgtgygtggygttgttattggataatatgttgtatatggttatygtgtttatagtgttygattatatygtttatatgygygggggyggygagggttttattyggattttygaggtgtgggagtttattttgtygttgtttatttyggttaatgttagygtttatayggttaatatttyggygttttygatagttgygtggttagygggtttagtttttyggtttygttattttayggagagygaagaygtgaagatyggggtgttgtttgtttttaaggttattttgtagttgttagtgaattttttgagygggttttttatygatygtatgagttaygaygtgtygttgttgatyggtttgggygttatgttygtttttatagttttgttygttttygtygaggattaygttaygttgttygyggygygtagtttgtagggtttgggtttagttttygtygataygtttggtatagttatgatygtygataagtattyggaggagtyggagygtagtygtgtattgggygtggygttggtttttattagtttyggaagtttagtggtttygtttttygggggtattttttatgagttygtyggtaagygygtgttttttttggtgttagttgtygtgtygttttttgaygygttgttgttgttggtagtggttaaatttttttyggyggttgtaygggttygggttaatttgttagtgggtatttttatttatygttttatgttagatttttatattgtygtggtggtyggygygtttattatttgtaatatttttttygtttttttygaatttattattgttaygtggatgaagtataygatggyggttttygagtgggagatgggtatggtttggttgtyggttttygtgttttatgtgttgggygtttattttatygtgygtttggyggygygttatttatatttgtagtggttgtayggygygtttgggttggttgtgatyggygttagttygtgtatygtgttygtttgtygttttttygygtygttagtggttttattatgyggtttttgttttggtatagttttagtygatatagtattgttgtttaygttygtttttttggtggaygtgygttatgttttagtttatggtagygtttaygttatygtygatattttttattyggtggtttaygygttygggtttatagtggtaggttatattgtgtattygttgggttttgagtagtttagttttggtatgggattggttaatttgttttatgttttygttttgttgttgtttygtaaygtgggttttttgaygygttttygtttygagygygatgtgttgtttgatgagttatygtaaggtttgtaygatgyggtgygtttgygtgagygttttgtgtttggttaggayggygagtttygtagttygtttggtttttttgatgygtgygaggayg

SEQ ID NO: 6178 - DNA, 990 bp, Artificial Sequence; identical to SEQ ID NO: 5948
  Description of Artificial Sequence: Synthetic polynucleotide

SEQ ID NO: 6179 - DNA, 829 bp, Artificial Sequence
  Description of Artificial Sequence: Synthetic polynucleotide
gyggtgygaygaggttaggttygygttygttaagttttagggtygttgtygtygayggttatggaggaygagtagttygatagtttggagggttgggygtygtttygggagggttttttygtygatttttagaggtatyggttgygttttttggtggtttggaayggygyggagggtaagtttgttgtgatttgttaygatygtatygygtagtagtygtagyggygygagggggttyggttggggttggagtataagttygaggtygtygtgttttygtttagttgggtyggtyggttttyggtygyggggtttygyggygygygtyggtagttagyggygttgtggtygtttttggaatattgttttttayggttgtygtyggagttggaygtgggyggyggyggggtttgaggtttggggttygggyggtgggygttgttttggtyggygygygtgggtttyggygaggyggygttgtaggagttttgygggtagttggagygttatttgggygyggyggtttayggttgtggyggygttatygtgygygaygtttttttygyggttaagggtygygyggtygattgygagagttygygygagtttygggagygggttttgygygtttgatgggtygaggyggaygygyggttgygttaggtaagygaggtygggtygtyggygtttgatygygtttgggtggtttgggattttgtgggaggttttttyggygtygagagttttggttgayggttgatggggaggagtyggygggyggagaaggttaygggttttttagtatttttatttgygygggatygttgyg

SEQ ID NO: 6180 - DNA, 4119 bp, Artificial Sequence
  Description of Artificial Sequence: Synthetic polynucleotide
tygtgatggtgttaaatygagaggagagttygagaagggggtgggtgatttttyggttgttttttattttyggygttttgtgtttttttttttttttttttttygttgygttttagtygagggttgttggagygaatgggggatgtagaggaaggagttygtaggttttygtgtttttttaatttttttygtttttttygatagtygygygttttygttttagtttaaggttagtggttyggtttygaggaaggygygggggtygygagagaygattttttatagtatygttaaggaaatyggygtygtyggtgttttygygggtttttttyggtagttygggggttgtttttygtygttgygygtttttttttattatttattygttgttttygtyggtyggagttttygttttattaatttttttaatttygygggyggygggtaggtgggggygygtttttaggtygtaagaagggagygtttygagattttttyggggtyggttttgtttaggagggagttatygaygtttttttttggygttttttygtygttyggttttttaggygygtagtttttttygagagtttygaattttatygttattttgtttttgtttygggagaggggaggtygaagtgttgtyggttagagggtttaygtaagtttygaaattyggggggaygttttttttatttttatttttgygttygttyggggttgggygygtyggggygtaygtaygtyggtttgttggygatttggygtatttgttygygygttttggttttagttgtygtaggttttttttgtatttatttttagtttttaaagttagtgtagttagtatygtttatttggagttttaatttttttttgygattttygtatatttattgtattttatttattattttygggtygygtaggttygggtttgygaagataygyggtttattttyggttatttygtttatttggttaaaggggttttttagttyggtattgggaaagatggttatygaygtggyggygaggttttttatygggtagatgttgttagatagttggtgtataaaattattgagagttattgggattttgtttayggttttggyggttattatttgtttttygtataatttggagatttaattttttygttatttggagtgttagaaaagtygttttggagaggggttggattgagtttgggatggtatttttttttgttttttatatttaaaaataattattatatatattaagaaaaaaaaattaatagaaataaaagtagtaaataagttgttgttttttaagaaataagaaaaatgtttatttgttattgatttttttttgtttgtgtttyggttgttgggaagttaggagttgttggtgtagtgttattataatagttagtgagttttttygtygagttattaattaattgtttttygtttagttagayggaaagtgttgttttaagtatttatgggtaggtttttaatattygtgaygtygttgtttatatatggattgaggaatagggttgggttaggyggtttttgtygttatatggttgatttgtatataygggttyggtygygyggatttygtygggttygygatttttagttygtaggyggyggggatygttggggtttygggygygyggttttagttgtagtttgggttyggggygtagggatygygggggagagggygygttatggatttagttatagttatagtaggagagygagttgttttaggttgyggtttagtttttyggggyggggaggaatttyggttttttgggattttttaaaaaaggygaagattyggtgtyggyggtttygtttttttagtttttgtttgggagttatttyggaaaattaaatttyggaaagaaatygagyggagtygagatattatagttaaatttttatttatttttttggtagtttaaaatygtaagtaaaaggaggtagygaagaaaaaaaaagttatatgtatttayggaagttgattgtttttttttgaattatttggtggaaagaagtggttggtgataagagtgaatgygtattgtttttttggaaagtttgttttatttatataggagygaaaayggaataggtttgggttgtttgtttgtttaagtattttgggtattttgggattgggagggtaaattttaggaggagtagaattattgtggggagtttygagagaaatttttagtyggagatatttttttttttttgttygygygtttttygtttttttttagttgttgygyggagygggygtttttttyggygygtttgggyggtyggttgygtgggggygtttagatggaagtttggatatttattttgtttttttagatatatatatatatatatttatattygttttattttygttatatattttygttttygttgttttttttatatattygtttatatattttatattatatatttttttgttgattgygttygygygtygtygttgttagtagtgtttyggyggtagagygggtttygggttygttggataggaggttttatgaagatattggtttaatttttattatyggtttttgtagttatagaatttttttgatttttatagtttaggatttaggatygygttttgttygtattygagttagaatataygtattagaataaatattttttttttttttttaaaaaatatttyggtgagtttagygyggtttttagtgayggtygaaagtatttttaattatttttaagaygttatttttattttttaatttattygttttattttgygagatttyggtagaaatttttttgtttygtttttaaagtaatttttaaaaatttttttaaagtttaaatagtagtaggttttggtttgttgggygtaaagtttttattttttagtgygttttagttygtaatggatagtygggtttgttyggggttttataggaggttggtttygggtgtttaagtttagygtatygtygtttgtatgatttatttatggtygtttgtgtaggttgygaattgttttagagttttttttygttttaaagtygyggaggttagggataaygygtagggttagtttygtaggtttgttttgttttttttttatttygggttyggagyggttttagtttagtgtgggtyggggygggygggagttayggygttaygtygtggaggaagygyggygttgtaggygggtttttagtygtttatttgtttygatygttgtagtygtgygttagttttygtygggtttagygtatygyggttagggttttgaggttgtygggagyggtttttttttttgtttttttattgaagygttgtttttttttttttttttaaaatagtyggtatttagyggtyggttatttttttgatttaagttatttagagtatatttgggaaagtttttygttygygttgtgygtttttttttaattggggatgaaaaggatatggaaagaaatygtagtaaggttagtattttagtagatattttattttagtaaaaatgtgtaaagttttattttttaagaaagaaagaaagaaaagaaaagtaagaaaagatagttgygtttttattaygtgygttagtttatttygtttgygttttggygggtttygyggttttygygttgattatgggtaagaygaygtttyggaagggagttygattygtatttygggttttgagttygaaagaaygggggaaagtygaattatgtaaatgyggatttttgygatggggttygggttayggttttygtyggttttttaggtgaggtatttatyggtagtaagygygggygaggygattgttygygtttygtttttttttgygtaygtgggyggatyggtaggygggygagttgttygggtygtttygygattggygttgttgttaaattygtyggyggtygtygygygttatttygagggggagtttttggaygttygagtgttyggttagtagggygyggagggtaggatyggggttgggggyggggyggggtgtttgagygagggaaaatygygaggttttyggttgttatttttttyg

SEQ ID NO: 6181 - DNA, 1575 bp, Artificial Sequence
  Description of Artificial Sequence: Synthetic polynucleotide
aygygtttatggaaggtggtgttygttttatygttttygtggaaggttaaaygagttttyggtgtgaattyggagaaagagagggaagtgtagygttagttttattttatattttttttttgtttataaataattttaagtgttattttaaagaggayggggagygyggtagaggggttttygggtyggygggttggggtygtyggatttgtttattaygttttttattttgggygagtttgtataaataaataaatttaagtygtyggtttygygggaggtggaggaggagtgaygaggaggaggaggaggagggaggggggagggagagattagtttgggaagtagtayggattgtttattygattygtgtygtygtagggagtgtgttaagttatagaggygtyggaatyggtttttgygtttttygttagtygttaygatttatttttgtttatggggtttttygtgtgygttttttygttyggggattgaaattgattggttygggagataygaggygtttagaaggattgatagygyggtattaattgttttgtagatatttgaagggaaagattgggyggagagaaggagagtyggttagatttttttaatttttttggatttggaaygtttttygaaataattttttttttatttaggtgtattttaattatygttggttgtgttttttyggtatttttttttttattgttaattttttygttttttttgtygggagtagyggaaagggaygttttttagygatataagttttttttttttgtttygtagtttggatagagttttttggtagyggttgtygtttttatttattttatttatttatttattggtttttaagaygygagaggatggtagyggagygtatttataaagyggtagttatyggtgttygyggttttggggagttgggygygttygggayggtggttttggtggyggygygggyggagygyggygtayggttgtygagtttagggtygtgygggttgttgaygttggttttttgttygttggtatttagtttgttygtttattttyggayggtygagttgtaggttygggtgttgygtttggaagyggagygyggggagtagtaaatggagayggttattttgggaygagttaattaattgttggaygaggtttgtgttttttgttgttggtttttattttttttygyggygttttttygygtagtttttagattgtttagtyggtgttygygggygttygttttttgygagttttaggttygygygagttgtttgygggaggggtyggggatayggatagaygttgttttattagggattyggaggatttggtgggtaagagtatgatttagygattttygtttygggtaagygttttyggtttttagygttgggagygttttgggtaygtygggtaggtggaggaaggttgggygygyggaggttygyggaggygggtaagttttatttttttttttygggattyggttagggtggtgtgatagtygtttygygttygygtagyggtaagygygtttagaggtttaggtyg

SEQ ID NO: 6182 - DNA, 2401 bp, Artificial Sequence; identical to SEQ ID NO: 5958
  Description of Artificial Sequence: Synthetic polynucleotide

SEQ ID NO: 6183 - DNA, 1579 bp, Artificial Sequence
  Description of Artificial Sequence: Synthetic polynucleotide
tygaagtyggggagygggagygtaygtgygygtgtttattttgttttgggtttttygttyggggaatttygggggtgttagggtatttagggttagggaagtaagatgtygggtygtttattttttttatttygtagttygtttygaaaattttttaaatygagatttaatttggatgtttagtttygtttttttttttttttttttttttttttttyggtygaggttttttttagtttagtttttttttttatttttttttygtygtggatttttattagtatgtttatttgggaggattygttggggggygggagatattygaagttatttatygttagygttttttyggyggttttttygggygatagygtttygggagttttattygtataagtgttgtttttaattaattgtttgggygggggaaggaaaggggtttygtygtygttttygttyggaggttggagtgttgttygtygggtygtgygttygttyggtagyggygtgtattagtattatttttgygtgtaagtttgaaatgtgagttgttttygatttatattygttygygttttttygtagygaagtggttgggttgayggtttgygygygygagtgagtgygggyggygggttggggggyggggtgyggayggygaggttygyggggyggggagggygygygygagtyggggttttttggagaygttaaggtaggtttgttygttttttatttttttttygygtttttttttttttttttttttttttttttgtygyggttggtttggtttttttyggagtttttagttttaygygggtataygtagggtgggtggttaygttygtagggttygygagygyggygtagagygygggtygtgggaagttttttyggygygtttygtgygttttygtttttygygygttttyggtttattttygtttttggagagttgtygtttgygttygggygygyggttggttgttttttyggyggyggyggyggyggttttattagyggagttttygtttatgattggtttygttygggaagttggagaygggygatgaataattgatgtgtgyggtgyggtagtyggayggyggyggyggtggygggtagtagygagygggagygygggagtyggagygttttyggagygggtagygyggagygagygggygtyggattygttygggttttygygtygtygtygtygtyggggygyggagyggggatgtaggyggygttygttgtttgygygtagtttttgttyggygttggttgaattttattyggagtygttygtygyggtygtygtyggtygggttttaagttttygagggygttagggygggatygygatyggtgtaatttttaggtaagtgyggggtyggaggggtyggygtttgggygtttaygggtygggttttgggtttttttygggygygggggtgagtgtgygtgtttgtgtgtgatagaggagggtyggtgtattgtgggtagygtygtgtgttgtatggtgttagttttaggtttggtygygagagtggtatyggygtgtatygggtyg

SEQ ID NO: 6184 - DNA, 919 bp, Artificial Sequence
  Description of Artificial Sequence: Synthetic polynucleotide
tyggggygtttagtgtggtttttttattygggagtttggaagggtttttygtagttygtaggagaygtagygtttttygtttagggggagtaggaggatagttggtygttttygggagttttaggygygaagyggttttttttygttttaggtgagttttgttygaygtttaaggtttaayggttagaatygtttttgttygtyggatttagygaagttaggggaataaattttaaaaatagttygggttttttyggtgygtttatttttatataygygtttgttygttatttaggagyggygtttygttgttaggtaaygagagttygygttttaggagttagtgtaggygtygtaaagyggaaggggygygyggataggtgagtagagggtaygyggtgggtagygaagggggaaygygtagtagagaggagagggygtgtaggagtaggagtaggyggtagagtagagggggygyggtagagtagagggggygyggtagagtggagggggygtgtaggagtaggagttygtygtagagtagagggggygyggtagagaggagggggygtgtaggygyggggygttyggtagagagaaggggtygtgyggaagggggygygygttaggggagggggttagagaggagggggygtttaggagtygggtttgyggtagagatgaggyggtgtgtaggagggagagygygtaygagggggtaaygggtagagaggagagggaatgaaagaaggggagygtggtagagagaagygggygygttttagggggyggggtttagggaggagggggagygtaggatyggggygggaggtagagaggagygggtaygygggaygggygtgtgttygtgaggggtygaggaaaggygtatgtggaggygygyggggtgggtgagtyg

SEQ ID NO: 6185 - DNA, 944 bp, Artificial Sequence
  Description of Artificial Sequence: Synthetic polynucleotide
tygtyggagygygyggggayggyggyggyggygttatttggaggygyggtggygggtaggtgttygaattgtayggygatgtagaggtygttgtttagggggaatttgtggtagtgtagtattttaggttaggggaagtygtaggtttttatgagyggygygtagtyggygygtayggtttygtatagygagyggtaygggtagatgggtyggtygagatagaygggygtaaagagygagtataggaagatttgygtattygagtggtagygtttggttagtagyggtagttagttgttygtttgttgttttatttyggttaggttttygtgttttagtaggttgggtagtygtatgygtttgtagtttatygtgtggtagagyggtaggtyggtagggatgttaaggtattgyggyggtttggagtaggagyggtygtgtagyggttyggtttgttagttatagtagtygtatttttygtagygygtyggygtttagtgtagygtttttagtagtagygttagygyggtygttygtaygttttttttygtygtygtygttygtatggttgygttttttttaggtgygygtygygtagtttttygaygttyggtgttyggyggtttaggtgtttyggygtgygttttyggttttgattttatttagtygtygtygtygtygtygtggaggtygtttaggtgggtggtagtttgygttgygggygtttygattgattttggygttttttatttyggggttttagttygggtttygtygtgygttttagttaattttyggtygtttggttttagttttaaggyggggaggtagtgggggyggtttttagtttttttygtattttgttygagygtttygtttagygttaggttttgygtttttttttyggttyggtttttttgtygtagttttggtttygtttagyg

SEQ ID NO: 6186 - DNA, 1096 bp, Artificial Sequence
  Description of Artificial Sequence: Synthetic polynucleotide
tyggttaygygttgggttyggggaagaggygyggtygyggtygaggyggggatagggaggyggtagttttttttgygtagygayggygygggygggyggaggtyggggygttttagtttttygttttygtttttttyggtygtgaygttagagtyggayggggtaaattgagyggyggyggyggggygttggggyggagattgygattyggagtygttyggattgayggagtttattgyggtgygggygttggygygggtayggaggattygggtaggtatygtaagygatttygaggtaatayggtttyggttttttgttygtagggygyggtgtyggaggggagygggttygggggaggtagggaggtagggaggtttttagagttaygygggyggggttgyggggatttyggggtagtyggggygtagggygtagggygtaaggtgtayggggtygagygtgtagtttgggaggtggtatagttgggggyggyggggattagggtagygttttgggggttttaggttgggtttttagattgggttttygayggygttygygggygttttttttagggagygygggttttygtggggaygygttygaggtaggtgagtygaggttggggygttygggggtgttttyggatgtyggtgygygyggttttttgattygttttttygyggtttgggggaygggagaatggggggtttayggtygttttgggtttttatygygtatygygttygtagyggagtttyggagttatggttttgagygagttggygttggttygttggttgtaggagagtygtygttygyggaagtttattttgtttatygtgtttttggygttgttgttggataatatgttgtttattgtygtgggtaygtgyggatagggtatttttgtttyggtattttagttttagygtttttttttyggtattttatttatttttgygyggtttyggagtttygttaaggttygggaaagttggagaattygttttgtaaaaaagatattttttttaggttgtygygtyggggttaggaggagtygygttgtgtggtttygtttttttgatgttyg

SEQ ID NO: 6187 - DNA, 4048 bp, Artificial Sequence
  Description of Artificial Sequence: Synthetic polynucleotide
aygttagagatygtggggygagagagggagagagttggaagtttattgtttyggyggggtyggtagttttyggttttaattygtaaaygaaygagtygggttaagaatygygaaygtatygattttgggatttygaggttaagygtggttgatggggtgggaggatttygtattttttattttaggattttttttggtttaggaaatygttgggagttttgttaagtgtggggattggtataatygaayggygtttttagttygggaattagtttttgttygtttattttygyggtgtttttggggygattttagttttttygaygyggggtygygtaaggtagtagyggyggagygttaggttagaggaatttgtttgtttttttgttttattagtttgggygaggtaggttygggatttagggggtygtagyggaggyggygtyggttagggattttgtagggatyggggtgtttyggagggagtggtgttggtggaggaggaggyggtggttgagggggagtaggtggggaaagaggaggaggaagaagaggaggaggaggaagaagaggaggaggaggagaagaagaaattggaggaagaggaggaggygaaggaggaggagaagtygtagygggygtygtaggagygagtgagttgggagygaggggygaaggygyggagaagttyggtygttyggtgggyggtagaaggtttagtygaggyggyggygtygatttygttttattttyggttyggatttaggttttygggtttttaggygtttatttttttttgaygtattttaaagagtttttttttttttattttagggygagtaatagygattaattattaagttatttattaggtttyggaggaagttgtttatgtgattttygtattaattaggtttatgaattaataaatygtttgtataatttgtgaagaagygaatatttttatggattgtttttggatttagggygttttgttygttttttgtagaggagaaaaaatttttttttttttttgtttttttygagaatttttttttttttttttttttgtttttaatttygatttttttaygttatttygttaaaaaaaaaaaaaaaaaaaaaaaagaaaaaaaaagaaaaaaaaagaaaaaaaattattttaatttaygtttgtaaatttttttggaaggatttttttttttttttttaggttgggygygtttggtgtaagattttygggattttyggttttgtttttttttttttttttttttttttttttttttttttttttttttttttttttttttttttttttttttttatttttatttttattttaaataaaygagtttttaattttygttygttttygtygygggtagygggyggyggaggtagygtgyggyggtygttaggagttgggagtttagggygttygtttttyggygtagtatgttttagtyggygtttaagygttgttttattatygagtygttggtggttaaggatagttttttgttygtttygygtttygaggattttattygtttygyggtatttagttaygttaattttagttttataaattygttttttaayggtttttattyggtygtygtygtygtygtyggtaggggygtttattttaattyggatttggtgttygtygaggyggtttygtattygtttaatttygtygtgttagtgtattyggtgtygtygtygtaygttttggtygtttattttttatttttttygtattygttatattttttattygtttygtagtagygggattygtttattttttatttttggtttatttatygttatygatatttgggttatygtttttaaggtaygtgttaygtygyggaattgtagygygtygttttygtygtattttttattgttttyggtttgtttygggtgggygtttggtaaggtttgggyggaggttttttyggttygygggttagygygttttgttgggaaattaggyggygyggggtygggygtggtgtygatttttagttttygaagttaygattggtttggagtgatggtttgygggtygtttgattttttgggaaggggtgygaayggagaagttgttttttagtgygttygaattagagtaggttgggttgtgygtgttyggygtygyggagtttagagttygygggatttttaggtttttggtattttyggtaatgtttttaatygttttggtttygaggggygyggataggattyggtygttaggtttgttttygattgygttygattttgtttattatttattttgygtttttttagtttagattygyggttttttagttttttatttttttttggaggygagaggattttygygtttygggagaaaagtatgggatttgtttttttttttttgtttttyggaggtttggggaggggygggaattygtgygggaggaaagttttagggtttggygttttygtygygatttgtttaattggggygtygagtagttatagygggaaggtaggttyggtttggtttttgtttttttttttttttttaaaaaaaaaaaaaaagaatttggttaggaaattgttttagagggaaatatttgttygtgtgtttttattttttgygatattttttatttgtttgtttttttttgggtayggggtgggaggaggagagttaaaattttagaaaaaggagtaattagtttayggattggagttagtaaaagatttattttyggyggtagtygattaatatttygyggtttgtttatttattaatttattgygtttttgtyggagtttagaatygggtagatgttatttttttttttatattttaaaaaattaaattaaaggaaaaaaaatttaaaaagttttttatttttaatttygaattggatttgtttgtattttgtttggattgtyggtttgtttttttttgtttgggttttyggtgaatygattttttatgttaatgagtgaatttaaaattttgaggttttgtttgaaaagtttagggttgtttttttttattygttattagttatgtttatggtttttttattagattyggagtygttgggatttttttgygttatagattgttttggyggtgtttgtaagtyggtaatttttygggtttygattttttygttygygttttttttttagttttygggagtygggagtttyggagtttagttygygagaggtagtagyggttgtagttaagtatattygtyggttagatttttgtttygatygggttttaaygattygtttygtttttatattttttyggaggggtaataaaataaataatttaaaaataaatttttatgaaaattttggagagtagttygtygtttttttatygtgggttaaagtttttygagaggttagaaagaagagaaagtagttttttygggttgtgggygttaattttttggttaggttttgyggtttttttttttgtttttagygttyggygaggaggtggygaggttygyggygttagggyggttgyggagtyggtygaggttaggagtttggggattggtttttttgygatagyggttggttgggtgtygtatyggtggagattyggygtttygggtygggtagttgagtaggygtttttttygtgagtttttgggaggattatyggttttygtaggtygagyggygyggttatgygaaggttttgagtayggtgtygggttagttyggttygggagaagtgygyggtttyggttagagtagttttttttaatgggatttttgttgtgtttttygtagggaaygatattagtttygagagtttttttttgtataaygygttggttygaaagtttaagyggattygaatygtttttttttygttttagtttttaaggttggaataygtttttgagaagaattattaygtggtgggygtygaaaggaagtagttggtatatagttttagttttayggaaatttaggtgattgyggttygggygygaggaatttatttaggygtgyg

SEQ ID NO: 6188 - DNA, 3292 bp, Artificial Sequence
  Description of Artificial Sequence: Synthetic polynucleotide
tygttgtygtygagaygygtagyggatgtygttgtttgtygyggyggaggaagttaygtygttgygttttyggtttattttgtttttattaaagygttagttagatagttttaaaygttagttggtyggagagattttttgggagaaagtgttgtygtyggggttatagattyggagttgattygygagttttgggtatyggyggttagagtagaggggtgttttttygagagtagtygtyggtgtygagaagttgttgttttagtagttttatygagtgaygygygggttttggtygggttagygygtataygtatataggtatatttatttttggtttygggggaaggtttatttttyggttttttagggttaaaggttaaggttaygyggatttttgagttygaagaygtagtgygaggatttatatttggatttttttattatyggttggatggtgggtggggaatttaaatttttttttttttggtttygttttttttagtaggttttaggaaaaatatygaggtygtyggattttaaagggtaggaaaatgatgagtttttygagggtygaggttaygttttgttttttgggtyggygttgygtggttttttagttgygtgggggyggygggtttttgtttagttttagggggygggggagyggtagttgygagygtagataatttygaggtgattygggagggtttggttygttttttttttttttygtaggtttggyggygggaagygggtttttgygtygtaggggggagaggtaggygyggttttygggttygyggtygttagtgygtttyggttaagggygtygtttgtttygygtttttygttygttttttgygttygtaggagygtttygagtgtttttttagygggagttaatatttttttgtgttaataggtttgtttttatttgttgtttaattggattatataaagttaataaygggygggtttttatagttygaagttaaagygttaaaattygagggaaggygaggagggggyggtggyggaggyggttgyggggtyggggttyggttgagttttygtttgtttaattttatttgttattgtaygygtttaatygtygtatatttttygtatttaatttggatgatattttgattttattattagtattyggygtyggattgaygtagtttygagtyggggattgtttttgttgtttttttygygggagtygtagtygtagtygagtygtttygatttttyggtgtygyggtagggtygtttttygttttttygtattttttttttatgygagttygttygtttgggtttttatttygttttttygtygttggatttgygttyggggyggttttygattttgygtttygtagttgagtttygtttatggtttgattttyggtttttygtttgttygtttygtygttygtttgtttygttttttttttttyggggattyggaggagaggggattatgtyggaattygggtyggaygttgtyggtatygttagygtatagttttaatygtygtygttttttttattygtttttaaggagttttygttttttattaagaatttgtttaayggagattattatyggtygttttttaagttttagtygtttttayggaygtttttygygttagtttyggttgtygtygtygtygtygttgtygttgtygtggyggttaagggggttttggagggygtygygggtttygygttttygtaggtgggygatttggttttttttygttttgagatttyggygtagaggtttgttttgttygygtattatttggagygttttttagtttggtggtatttttatattttgattttygtyggyggttatttttygygatttgaaggtatygatttttttttgaattttygttgtttttttgygygttygtttygttttygtttygygttgttttttttygtagttttgggattttagtattygtaaattttttgttyggttagtttttttyggtttttagtttgttttygygttgggttgygttgttygttaatttaattttatttggtgagaaaagaagtggaattggagtttygggtayggtgtttttygggaaaagtggtttygggygtgaatagggaggtttyggayggtyggggtttgggatayggtttggaaggagggggtgattttaatgygtttaagtygaaagggaatygttttgtyggtttttggygaggaagttgagggaatggaaggaggtggtygygttattattatttgtttgtttgttttygggaggagggggattttaggattyggygttttttttttggtttagtygagaaggaggtagttygygggaatggtgaggttttatggtttgggatttggaggtyggygygggttgagtttgtygtttttaggygtygggtttygtttaaggttgtgtyggtgtgtatgtgtgtgygttygtttgtttgtttttttagtttyggagaaggttttgttgagagatttttttttygttttyggtatagatygygatttttyggagttattgtttaaggtygatttygattataaggagttggattttaagagttyggaygagattattttggaggagagygatttygaggaaagtaaaaaggaaggygaagyggygttaggygyggtyggggygagygtaggggyggyggyggttatttygggygtagaagattggaagaagggygttgaaagtttagagaagaagtyggygtgtygtaagaagaagaygygtatagttttttygygtagttaggttttttagttygagtttattttygatatgaagygttatttgagtagttyggagygagtyggtttggtygygtttttgtattttatygagaygtaggttaagatttggttttagaatygtygtaataagtggaagyggtagttggyggyggagttggaggyggttaatttgagttatgtygyggygtagygtatygtgygggtgtttattttttattaygagaattyggyggtygagggygyggyggttgtagtygygggggtttyggtgttagttagttagtygttgtttattttttygtatttygtttattattygtattyggtggtttttttygtgtygttgttayggtyggtttgaggttttagaggggtgggggagggagygttyggtttttttgttyggatttyggaggagattgggtygggtygagggygtygagaagtttagyggtttttaggaattggggtttgggygyg

SEQ ID NO: 6189 - DNA, 3753 bp, Artificial Sequence
  Description of Artificial Sequence: Synthetic polynucleotide
gygyggagattygtygtttgyggaggygtygagttattttagtttygagtttygtatygtttttgtttttggagagaagggtttaaggggtttaaggagtyggagttgtygtagtygttaggaattygggttagaatttgtagttgtttttagttttggttgtttttggttagaygtygttgatgttygttaggttttyggygygttttgggggygtatyggtgttgtgtgtttggtyggagygttttgaaatttttyggggtygttyggyggygttgygattggtygygttygggtaatttttatgtaaatgaggtygygtygttttygygtygtyggagattyggygagttggygggygaggaaggggtatttgtatyggggttgggygggygtatttagagttaggygggtaggaatttttgygtagttattyggtgtttgtatgtttttggygyggaagggaygttttattagtttyggygttttttttttttagatttttttttygtttttttttattgtttgtttgttgtattattttttatttagattatttagatygtttttaaagggagtttttggtttttttygattttttatgaatttaggatgggtagtaaagaagatgygggtaaggggtgttyggyggtyggtggygtttttagttttattatttagtttattttgggygggggtttttyggaggtatygygggagttygtyggttggttagttaggaagygtagtttgttygtgttttyggaggaggaggagtyggaygayggttggaaggygttygtttgtttttgtttagattagtayggttttaaggagtagggttttaagtattatttttttattttttttttttgtttgggtaaggatygtaygtygttagtgtggtagygagygagygygaggggagggaggttgagygtttygttaagattttygygtygggttttttttggttagagttgyggtagtygggggttygggatygyggggagaggggygygtattgtggtgtttttttygttyggtgggtttttgggagtaggygaatatagattygtgtyggtttgggttttttggggaaggttgagttgttgagagagtggattatagygagagggataygyggtyggttttatattyggttgtttttaattattgtatatttggtatttttttttyggataygaggtggagatttgtaagtygggtttgggtagtttgtttttatygtaatttttttttgagtttttttttttattygtttygtatttttgttttttttttttttttttttttggaatgattagtattttaagatgattgataatggtgtattttagagayggtttttttttataatatttgaygaaggggagttttgygttagtttttagygtgatttttaaataaayggtttgtgaaatgatgttattttataaagttygaggaatttttttagtttaattattattaagtaaattygttttttaaaattatgttaatgtttttttttttagattttttttttttgttgtttttggtttatttataaaggtgggagtatagagattttatattttaagtagttgggttttttttttgtygtttttaaaggayggggtgttgggtttggggggttagtgagagggataagaggaggggattggtaaggtgggattaaggttgtaggygtttgttaatygtttggttttagggagagttggyggttttygaggttttttaattaattttatggtttttttgtttgttttygttttttaggtatttttaagggtagyggaggttygggttygggyggtttggagygtaygttttttttttttttttygtattyggattttaaagaagagaaagagaggtttttgttygygggttygttttygtyggggttygagyggtygygggayggyggygttgagyggtaggtyggygyggttaagaagaagaygygtatygttttttygygtagttaggtgtattagttygagtttattttygatatgaagygttatttgagtagttyggagygygtttgtttygtttttagtttgtagtttayggagatttaggtaaagatttggttttagaatygtygtaataagtggaagyggtagttttyggttgagttggaggyggttaatatggygtaygygtyggygtagattttggtgagtatgtygttggtgtttygggatagttygttgttgygygtgtyggtgtygygttygttygtttttttygygtygttttattattygggaagtaatttttyggttttatttttttataatttatataataagttygattattgatyggttygtygtttygygtygtttttagttgttygtagagtygggygygtattgtattgtaagtagggtttyggagtaaggyggygtgtttttagaaatatgaagaaatatattatgtgtatttattagtttttatttatggtttttgttttattttttgttttgattgtttygggtatttattggtattttttaagttagagagtttgttttttatttagatygaattagtaygttttgaaaattattyggagtgagatgttttygggtggtggtgggaaagggagttttggttagataggttgtggttggtagggaaaaaaattaggaaaatatttataaaattaggtatattttttttttatatatatatttgtatatatgtatatgtatataygttyggttaagttaggtttttagaggttttggataattattaaattgttttttttygttttttttatttygaggatggtagggaygaaaaggggagagtttagatttgtaaatatttttaaaaagaaaaaaaaataaaatattttaaatatttttgttaattttggtgggtttggttattyggtatgataaygtayggaaggtttttaggtttttyggtggaaagatttgtatgygtttgtttgtggaagtttggttygttttaygtggagggtgggatyggggttaggggttaaaggtygggattttggygtygtttagattgtaygtggttggagttgttygtttatttttttttttaaygtttagaatygtygygygggttggggygtatttyggttggaatttagtttaagagttygygyggagaaagataaagattgggaggtaggtttygttatttaagygattgttttttgggaataagygagttgggtgtttagyggtatattttyggtattgggttygttttgagtttggttatagtagttttygttatgatatgttttgtgtygygtattttttttttaggggtataaagtaggygatggygttgtttgtatttagtaaagtttttattttgttygtygygagtttggygygattagtttgtygttgygtttagttattyggtyggtggtagagttatgtgtttygygyggagagggaattgggygyggtgaggtagttttgyggtttaggagagattygaggttygggattaggtaaagaaggtgagggaggtaaaggygtttttttatatttttttgttgttaatagtttgtattggtttagygtgtggttggattatyggttagtaygyggtygtttgttttgaatggaattttgaygygyggygggggygtttayggattttttygttttgatatttgyggtygygtaggggttgggagggygttgtatygagagaatagtygyg

SEQ ID NO: 6190 - DNA, 829 bp, Artificial Sequence; identical to SEQ ID NO: 6179
  Description of Artificial Sequence: Synthetic polynucleotide

SEQ ID NO: 6191 - DNA, 1328 bp, Artificial Sequence
  Description of Artificial Sequence: Synthetic polynucleotide
gyggggtygttgygygtttttttaagtgtgttagygggggaggyggggttggaaaggaaatttggtgaagggttggttyggagtttggggtggggatatttattgygggatagggttagtaagaggattygataygtatygtttygagtgataygtgtaaatgttaagatatagagatatttgtaaatgttatttaagagggtgaggaygggggagyggtttygaggttgtgtttttyggggtaggtattggtttttgtggggttgygggttaagtgtygtttttttttaaggaattggtatttggggggggggggtyggtttygtygygttggaagygtaagtttyggggtttyggagatgygtyggggygygtygtttttyggggtagttttggatttyggygygtttaggygtagygtgyggtgttttyggyggggygggtagygagtygttttagttyggygatttatttygggtttygtagggygygagtagagtatyggttagggygagtaggagggygygggygggggataygggtagygggygygttgttatygtygtyggtttttagtgtagtagttttygggttyggyggygagygttgtattattttaygygggygtygagtyggggtygggygtygygatyggagggattttttgtttyggygagttagtttyggagttttygygtagygttygygtygtygttgagtttttttagttttttatttttaaaaaagttttttttygtgtgtgtgygtgygtgygygygygygygtygttttggtataagttagttttgatygttgtaataaatgagtaaattgttygagttggttyggggattaggaagagygttagtgagagaaggtaggtttgtgaaatggatttayggttagtagttatygtttttattatygyggaataaattattgtttttttygtattttygttagttggyggygtttygygggttttagagatygttygggttttttygttagggtttygtttygagtygyggttygtttattttygagggtgggyggtttagaygtggtttagtggygttygggygttyggagygtataygttttygttttaggatgatgtggtygtagggttyggggygttyggttgttaagygtatatgyggyggtayggtttagttttttaggttgaagttggaaaygatgattttgttattygtttttyggttttttgggaattttyggagtgygggttaggtttttatygyggtttatagttyggygygygatttygttyggttttaagygtttaaaggggtatttttygttyg

SEQ ID NO: 6192 - DNA, 2957 bp, Artificial Sequence
  Description of Artificial Sequence: Synthetic polynucleotide
tygtttttttygtataggtgttygattyggagttygggaggygggttttttttttaggtatttagtttagygttagtttgggtttatttttygttattttatagygyggggagtaggggaggtygaaagtygggtagtttggggggtygggataattygggttgtagtaatttygggyggtagtaggattggagagttggtgtyggaygtattgtagagaygtttttgttttyggygygtttttygatatttagtagagagtttggygtttttygttttgygygttygaggttatagygyggagaaatttggyggggtttyggatttttyggtttgggaaaagygatgattgttttgaattgttggggygttygaaatttttagggtttygatttttygtggggtaygygygatttyggygtagatgttagttygttgtttttygggttgagggagygaggattttagaygattttagggtygttgtttaggtttagtttygygttttttatttygttatttygttttgyggttttagtttggagatttayggattttattgygattttttgygtagtgtagtygttttttatttttagtttygagtttygggtaatttaggggtttyggygaggygagtttttttggggygagatgtttygagtygagtaaaggggtygygtattggayggggtttttaagttatagttttgggggttttgaggagtygtggtayggtttagggtagtyggggttgyggggttygtgaagttagaygaggttayggatttagggtttttgtaattaagatygygagygattgtggattygggayggatygtataaaggaggaagggggaattagaggggygttyggtttaggaygtgttaggtttgggyggggyggaaaattgatattagggygaggataaggatttygtttttttagggttgttaggggaggggttygttatygttattttttatgggttttggtttygayggtgtttaaagggyggagggttgggtygggttggtygtattygggygttgttggyggttaagttggatgggtygttagtgagtttyggtgyggtatygttggtttaggttygggygyggttggatatggttatttattgygaygatttgggttttttttyggtttygttyggttaggtttaggttatygygtatttttygggttatgagttaggggatttgggygyggtgggygggggtttttttttgtgggtgaaygygttagygtttagttttaagttttaygtttygggtttygggtttgygtygttttaygyggtttygagttayggggttttyggttygtttttyggygtttygggyggtttggygggygtygatttygtttggttgagttttttyggttagtaggagttgttgaggttggtgyggtygttttatttttattyggygtttatygttatggttatttagagygygtygttgyggaagttgaygtttagttagatttattagtaygtggttggtaatttttttttttataagygtagtaaggygggttggtagaattttattygttataatttgtygtttaaygattgttttaagaaggtgtttygygaygaggaygatttaggtaatagyggygygtyggttygtttygtttaggattttttattttttygtygggtygygggtatttygggggtgggagtattttagataatttaatttttttttgygyggttggggatattyggggaggagggagaaggggaagaagtgtttgggtatggataggtttttagatagyggttgagtttattataggttygygtttatagtgyggyggtttyggggtttttaatttttgtgygttttttyggaggaagaagygggagagttagtaagttgggtgattttgggagtgatttaatttttttgggttttagtgttttatttggtaaaatggggaagatagygtttattttaaggatgggtaaaataaataggatgttygtttggaaagttttggagtttatttgggggtttggygtggtttgygttgtttttggtagagyggttggyggagttttattattagtatttygtaggtttttttttattttaayggggttyggttttttttagggttttttttttttttttttttggattgttattttttttttagttttgttgtggaggtttatygggtatagagtgttygttaagggtggaatgggggygaggatttagattttttgtaagggttagtaggggatttttttgaagttgattttttygttggtttatattayggttygttaaagttygaattttttgaattgggttgtttttttttttgtaggtaaaggtaattattggattttggattttaattgygagaagatgtttgataaygggaattttygaaggaagaggaagaggagagttgaagttagygyggtygtgygttygggagttaggagygtgggaggggtygaggygttagygttggagttttygagygyggtttgtttggatttgtaggtttygttttttttattygtattygaggtygttatttgttttttyggtttygtttttgttatgagygttttggttggyggttttggtatttttttygggggtttggygggygatttttttttygggaggyggttatygatagtygttatttaygttttttagatttttaattttttttttggtttygtttttggttattagatygyggtygtyggttttygttttagttattttttttatagtygggaagggatygaagtttgaagggaggttggaggttagtygggtgygggtttagaggtgttgagtttaggttttyggttttttttggtgatagttttaygtgttggygttgaaggttttggtgttttgggaggaagygtagagtygggggyggttyg

SEQ ID NO: 6193 - DNA, 1860 bp, Artificial Sequence; identical to SEQ ID NO: 5965
  Description of Artificial Sequence: Synthetic polynucleotide

SEQ ID NO: 6194 - DNA, 1422 bp, Artificial Sequence
  Description of Artificial Sequence: Synthetic polynucleotide
tygtgtagttygttyggyggygttttygggygagggtttggtgttggggagygagygyggagygaggtgtttttttaaataygttttgtagtgtgayggyggtygttyggttggaagagttatttttattttgyggtaggagttygttygtygttatygttygtttyggtttttatggttaygygtttgttttyggtttygggttttygttgtygtygygggaggtgygygtagaggyggyggygttgttggtygggttgggtygttygtgygyggggttgtgatttatyggtyggygtygtagtttygtaatttgttgataattyggttttagttyggtygttgttttygygaatggagagygggttttyggyggggggagygtagygygtttgttttygggagygyggttyggtygtttyggtagtygtttyggttatagtaggtgggaaggaygygygggtttgggyggygggagggaygygyggggtygyggttyggtagaaaagttygygtttygaggtgatattggtygygaggaaagtagtttygagtaattttyggtttygttggggygggaggygttayggataatttagggttttygtttygygygttyggttyggagttygagttatatttaggtagagtaggygtygyggtygggttggggygggygggttattyggtgtyggttttyggtgtaaatttttyggygygtttttggttttgtgtagttygagatggttgagtttggtttyggagtygggagtggggygtagattgatttttaaatatggagaaggagaygtatttgtygttggygygttyggttygagttttttatyggtttttatyggtatygttttygttagttttaggygtagtttttaggtygttygyggaggggagggagygataggggtygyggttgttttttggyggggtyggggttgygagttgtttttygyggggatttttygttygtttygttgatygtygttgtttttatagatgggagtagttttyggattgygttygtttygtygyggttattttgaggttaggggttygggagygygattttttggtygtygtttgggattttgattttttagaggttatggaggttggyggggagtagggygttatttgatygtttttttttggaygttttttttagyggygtttaygttttygtaattttgtagygtttatggtgagtaygggggtttygggggttttgtagttgggggttaggtygttgygggggggyggttattygtatggggatttttaggttggaaaagttgtggaatggygagttggtgatygggttttygggtttagtgtyggggtgggaggttttgtggagtgggggtyggggataggtygygtgtttgggtatttttgtttttygyg

SEQ ID NO: 6195 - DNA, 1479 bp, Artificial Sequence
  Description of Artificial Sequence: Synthetic polynucleotide
gyggttttttttaagttygaagtagggattyggttttgygtatttggygggtgtgtttagattgtaattttygtattaggtatttaagaaygtgttttggatatattyggyggtgggagygggtgtttggtttgtattagggatgaggggtggagtagygaaagygttyggagygygtatttatttatattttttaagttagggygyggtygttttgggygygaggttttaagttaagtttygygttyggttaggagtyggggagtattttaggttttyggtttggggtygtygttattttattttgyggygygtatttttgatttggtttygtttttyggyggtygygagtagygggyggagygtaagtagagaggygttttgggttgtgyggtatygttttttttyggtgtttggggagggayggagggatygggygggagagagagaaagtttgatygatyggttggygaagagttgtatgtaatyggtgggaggtygggtyggttgggtttggggttygggtttaggttygtatygtttttyggtaggtttttggyggtgagygyggayggttyggaggyggyggttttgagttggtaggyggagggttgttttttgygttygtttgttyggygyggttygaggatgygggggggygatgttyggggttagggaygygttttgttattaggygttgtagttgttggtygagttttgtgttygtggggttttggagtaygatagttgttaggattttatttattatttgygggatygtgttagatttyggtttygygatttaggtgagtgtygttatygtygtttggagggatttaagggttttgggttgggatttggggtygtatyggggtttgaggtagaatagygaygyggattgggagagggyggggggyggttatygagttaggagagtgattaagaattagygtattgtggtttgatgttgtaattaggyggggattygggyggtggttattgtayggaggtygatttygggtyggttagggtagggttggagggattaygttygttatttgygtttttatygttaaggtttttgggggyggttttttagtttygagttaygttttttatttttygggttatttgtatttagagygaggggaggtygyggyggtttyggagtygtgggaagggggaygaggtygaaggaaattttgggaagttgggagttggggayggtttygggttggggtygaattttatygggtgttgtttatttttttttttaagygtttagtttttttttttggtatggggtgagaagggygggaygygattyggygttgggtyggggatagggtgtttttggttttgggtagaygggtttgaattygttttyggygggtygtayggtatggaggtggtttgggtttgggygttaggttygattagygattatygtyggttaygatggggttygtagattygtyg

SEQ ID NO: 6196 - DNA, 446 bp, Artificial Sequence
  Description of Artificial Sequence: Synthetic polynucleotide
tygttattygttgataataayggaatygtgggtattggttttttaaygtygtttygttygttttttttagttagtttggtggatatttyggtgaaggttgtagatttttagagttattttttttttaagtagygtttttygtatttttyggygtygggaagtttagagggagttggtttgtttttatttttaggtgtyggyggyggtttttgtygtttttygygggataggaaggttttgggtagtagtagygatagagttaggataagtttagaagttagagygattttttgtattgtggagtaygttatgattgtttayggtggtygtaggtgtagaygttagtyggaatyggaatyggaatyggagtaygggttgtygttttygatygaatygygggyggygyggayggygtygygygagggataaggtgygygaggygtayg

SEQ ID NO: 6197 - DNA, 2991 bp, Artificial Sequence
  Description of Artificial Sequence: Synthetic polynucleotide
gygygygtagttagygtttttygyggatatagtagtygggtgttggagaggtttggaaagggygtgtyggagagttaagtgtagtygtttagggttgtyggtygttttttttttttttgttyggtaggggatttagygygtaygttagtgtggaggggygggttggttggttagtttgygggtttttgyggttatttyggggatttttttaagtttygtttygtagtgtttttattggtttyggatttttttttttttagttgttygtttgggtttyggggygtttaggttattayggataaatagtttagggygtttggygagaagttaggggtgaggaagttttggggygttgtygtygttttttttaattataaattaggtyggataggagagggaggggtgggggatagtgggtgggtatttagattgttagtattttgttatttatagtyggggttttygagyggtagaaagtttyggttattttttgtygtttgggttgggygaagttaggatygtgtygygttatygttaggatatggagttattgtygttatygtttygygaygtagatttgayggttttygayggttttttttgtttttttgttataayggaygatttttatgaygattygtgtttygatttttyggatttgygttttttygaagatttggattygygtttgatgtaygtgggygygtttttgaaattygaagagtattygtattttttygyggyggtgtattyggtttygggygtaygtgaggaygagtatgtgygygygtttagygggtattattaggygggtygttgtttattgtgggtttgtaaggygtgtaagygtaagattattaaygtygatygtygtaaggtygttattatgygygagyggygtygtttgagtaaagtaaatgaggtttttgagatatttaagygttgtaygtygagtaatttaaattagyggttgtttaaggtggagattttgygtaaygttattygttatatygagggtttgtaggttttgttgygygattaggaygtygygttttttggygtygtagtygttttttatgygtygggttygttgttttygggtygyggyggygagtattatagyggygatttygaygygtttagttygygttttaattgtttygayggtatggtaaggtygggattttaggaagtgaggaagttagggyggygttygggatattagggaygygttttygagggyggggagttggttttgygggaggtttgggttaggatttttttygagagagaggatttttttgttttgggtagttgttattggggtagtttgttttggaagtgtgygggtaagygttygagttgttttattgggggygttattagaatattgtagygygaaygtgaagatttttttttttatttatttttatttttaaaatgtaaatttgygttttttggtgattgttygtttttggtttggttttgtatgttgtagattttattttttatttattygtaattatttttttaattaggataggtttgggttyggaattagagttttaggttagagttagggagggggyggttataggaattggtgttygggtttygagtygtttygygggtttgatttagtygtttttgttgtttgtagatggattatagyggtttttygagyggygttyggyggyggaattgttaygaaggygtttattataaygaggygtttagyggtgggtatttygggtttttttttgttygtttttttttttttatggagttgttttggtttttatttaggaygtttttatttttatttatataygtttatgttttgggaagtggtgtaggagatgaaatattaagtaagtagttttttgttttttggattgtttyggattttaattaaagtttttagtttttaatttgttttaaagtattgggttygggggtgggaggtttgtygyggttttatttttgtttattaatygagtttttttygygtagaatttaggttygggaagagtgyggyggtgtygagtttagattgtttgtttagtatygtggagygtatttttatygagagttttgyggygttygtttttttgttggyggaygtgttttttgagtygttttygygtaggtaagaggttgtygtttttagygagggagagagtagyggygattttatttagttatyggaygtygtttygtagtgttttgygggtgygaattttaattygatatattaggtgttttgaggggatggtggtygtttattygttygagggatggtgtttttagggtttttygygtttaaaagattgaatttaaatgttttttttttaatagygttttaaaagygattttttttgaggtaggagaggygggagaattgaagttttygttttygttttatagggtaaggatatagygyggttttttttaygtagtatttttttyggagatttattgygatggtygtttygtgtttttyggtgggttagagttgaattttgaggggttaggtttagttttttygygtttttttttatgggggtgagattttygtagatttaagttttgtttygggatgtatyggttatttgggggggygtgagatttagtgtatttyggttttaaatgtagtaggtgtaatygtaatttatttttaattygtttttyggtttaggattattttttgtaatatttttgtaatttatttttgtaaataagagttgttttgttagagtaggagtttttggggttgtatttatttttgaggtatggtgtgtggtgttatagggaatttgtaygtttatatygtaggygggygagtygygggygttygtttaggtgattaaaataaaggygttaatttatatygtygtggtttyggttttttttggatatgggtgtgggattyggaggaaaattygtaaattgggttagttgttttttagygaygtttgtaggyggtaggyg

SEQ ID NO: 6198 - DNA, 928 bp, Artificial Sequence
  Description of Artificial Sequence: Synthetic polynucleotide
gygggggygagggggygagggttggtygttygtgaaaggaaaaataaattttaaggaagtaagaaatyggaygaaaggattttattttaagtgatttttttgaaygygtttttttaaatttygygatagtttaaggagttgygyggygyggyggttgyggttaagatttgtgattaatgttatttgatttgagtttatggggttttgtgygttttgttatttattgttatgtygttatttttaagtttatttyggagaaattattygygttttttgttttaaggttgagttttttgtttattttttttttaagagaaaagaagaygggaggggaaaagagagaatyggagtttttggtttggggtttaaggtttttgtttaygttgygggggaggtygtagtagattyggttggggtttttygggtttaggtggttaaagttgtygaaatttgttttggatagtagaaagagygtgtyggaaygtattttgggggtttygtttttttygygtaggggagagygagtatgtttttgtttygggygtygtgyggtygtagtagtagygyggttttttttagtgygagtygtgtttggaatgtttygggtaagygaagggttagtaagygaggygaaayggatattataaagtagagagtggtgtgagttttttygttttttgaaaagatggtaagttttygtttygggaaggttgtaaygttaaggttattttttgtaggtttyggatttttagttttttatgttttttgtyggagtagttaatagagtgagagygtattttggaaagattggtyggatgtygggyggygatagggaaaagygttygaygtttggttttggggtggggggtgtggggagggggggtagggagttaaygggygaggygaaggaggagggttgygaggttyg

SEQ ID NO: 6199 - DNA, 1267 bp, Artificial Sequence
  Description of Artificial Sequence: Synthetic polynucleotide
gygaatttygagtaattgtttttygagggggttygtgygygttyggtggygtygtttyggtttgggttttttygaggaaaaatatttattygygagggttyggyggtttttygattyggyggggatgaattgtggtaatttyggtagtttttatygyggtgyggaagtaaagagggtaatattggygattgyggttyggaggggttggagygygtgaagtygtgggggygtygtgygtttttygttttttygtttyggtygtaggttttgggatttygatttyggtgtttygggtgatagyggttgyggygtttgtagtttagattttygtagttttgygggygaaggaggygaayggaatyggtttttagtggggagygtaataagttatagtagttaaatttygygtttttgttygggtttttagaygaaygtagtygtagyggggggtygggtttygagttttaygtygtygtygtygygttagyggtggggggygggttgggggyggggyggtyggggttgttttttygggygtatatgygagygtagtattyggygttgtygagttatttttttygtygttygttagtaagtttggyggttttaagttaggygygttttaggatttaggtttatttgtttttatttagtttyggtgttttttgttaggyggggattttygagagygatgtygatggatttgattttagttgtgtggttttgtgtgtgtattgttaggataggtaagtatgattgtggyggttagagggattygggaaatgggggtgtttatagattayggyggygtggggagatttggagtygagttttgygttggtttggggaayggyggtagygtggatyggtttttgggatttttttgttttgttyggagtgatagggtgaaaatagggatttaygggtttgaagatgttttygttgagtgtttttttttaggggattyggttttaggggygtaggagtgaggggygyggtygagtaggygtatttttttgttgttagtaatyggtttttygttttagggagtygaaattygtagtagggygggttygygtgtttygagttttygaatttgtaaggtgttgtggaaattattttygtygattttygttaggttgggaaggggtagttgygggagtygtattygtagagggagygttttyggttggygggygyggtyggggttygggagggygyggtgyggygagggtagagagttgygggagaattttgggatttygyg

SEQ ID NO: 6200 - DNA, 1225 bp, Artificial Sequence
  Description of Artificial Sequence: Synthetic polynucleotide
gyggaagtygtttyggattatgtatggaaggttaattgaaaagattagtyggggygtttgtggtagttttgttattttgtgatagtgtttygtttygggaaattgtatygttaygataaaygggatygtgataaaaygatttttttygtttttatttgtagattatttagaygagattgaattgtatttgtttttttttygaggggagtygygtttttagggtagtygaaggtttggggttgagggggggtttttattaaggygygggtgggggtyggagttttaattygatgagaagtgataggygtttgggggatttgggtttyggtygggattagygtaagtagggattttgyggggatatygtttttttaatagagtaaggtttggtttaygttttyggttttttttaatttttttttattgtttttttttgtttygtaagttttatttatttttttagttatagagttttatttttaggtataggaagtttttyggaaaaagaaaggttgttttagaaagagatygagagagattttttaaatttygggtatagttayggtaatttttagtttgttaatgttaaggygggygygtaaggtygtttaaatttagatttttttttttatttattttaaaaaataataaygtgttagttattttygtagatatygtyggttggtgtttgtttaggagaygttagggttagagygttatttttagtatygaaatggtagagagaaagygtagttttaaatttttttttagaggttaagttttaattattgtgttttttttttagggattgttggygttttygtttattggygatgattatgygtttagaattygatygygaagtaattaataggaaaatatatggtgttaatttggatgtttygygtttygygtatattygggaaygagyggtataaagttttgtyggtyggttygygatttygygtttttyggggtttgttagtygggtygtagygataaaygtttagggttgygygttttggttggggttygttygagagatagtttgyggttggggagtttgagttttaaggggagagtttagtygtygaaggygagtttatyggttaagttttggggttyggtaggttttgtataattattttygtaaagttygttatttttgtgttttttttttagttaygygtttattagtttyggaagtattagggggygatyggyg

SEQ ID NO: 6201 - DNA, 1627 bp, Artificial Sequence
  Description of Artificial Sequence: Synthetic polynucleotide
gygtagtagagygtyggagaggagggaygyggaggttatygaggggttagtagggtygyggygttagggtgggggtttttaggyggygttggttayggtttattygygagggygagygygttyggtyggtygygttttttgtygttygtgttygggggtgggattygygtygggagttgtygagtgygtggagggagttaggtttyggttygtttgatggattgatttggagatggatygaattatattatttgtygtgtatyggtttgttttgtttttgttttgttttgttgttgttgttgttgttgtaaggggtggtggygagttttaggattttattaaggaagttaagatttaaggagatagagggatatttatttttataatatttttttttatttttttttttttttgygygtggtaagtttttttttttttttttttttttttttattagtttttttttaatgaggtaagatygtttttaataatttgttaatgtttttgtggygttyggtgggggtyggaatttgagatttygaatygttgtgtgtgtgtgtgtgtgtgtgtgtgtgygygyggtgggggtyggaatttgagatttygaatygttgtgtgtgtgtgtgtgtgtgtgtgtgtgtgtgtgtgtgtgtgtgtgttgttattggatagttgatttattttttaagttgttttttttgtttgtygtgtaagggaygygtaaagggttagagaggtttggyggaygygttaaaattggtaaagttggyggtttagggggaggggtaagtggatttggaggtttttttttattgtgtatttttttggaaaaaaagyggagggggtattaagtaaaagttttttgttaggtagagttagttyggygtttttygtatatagttggggttagtaggggttgtttttttgtygggtatagygtttttaggagttagtyggggagagttgagttaaggtygaaggagtygtttgygggtttagtygttttttttygttygttggttttagagyggaygttgggaygttyggggtttggtagttttgygttyggttaggagygggygggygagtattagtttgygttttggagaaggggygtagygtygtagttgaggtyggagtagtttttygygggygtaggatatttgttagtgagygttyggattgtayggttttygggtagtgtttgtyggygaggggygggagttygggtgatttggttatttttattttyggtttaggttyggagggyggtygttttttatygtttttttttttttattggtagagygygttgygggyggattttygggttyggagtagtttatyggttattttatygtttattyggttttyggtgttttttttyggtygttttatttagtaatttttygtgttttgtttttygattggaaatgttttayggaagygttttggatagggttttygttaggygataagagttyggtgttgagatgtgttaygtttttatttttttattaattatggatggaaataaataaggaagagttaattttgttgagtttttttttyggtaaygagaggygttttgtagtygggagggagtygtygttygygtyggtagtyg

SEQ ID NO: 6202 - DNA, 1857 bp, Artificial Sequence
  Description of Artificial Sequence: Synthetic polynucleotide
tygygttgtttaggtaaagggattyggygattaagatattttygygagggtttagggygygtttttttygttaggttttagatttyggttttgygttatttttttttaygtttyggygygggygtagttagttyggttttttttaggtttttaagtttyggatygagtgtggggtygtttttttttttyggaaggagttatygtygttttaagtggaagaggagaggaagggggygggggagyggggggyggggagyggaggyggaggagggggagggggatttttttggtttttaygtggttygggygtttgtgaatygygtttatyggagggttttatagygaaatataaaagtagttgggaagyggyggggattygagtttttagygtygggyggagygtyggatagagtttygtagygtttygyggtygygatggggtygaagygttygaagtttyggagtttataaattgtygggttygtttygtygtygggattygggtgtttgggttyggtttgaagyggyggyggygtatyggtatagtygygggagtatgggtaggaggatgyggggygtygtygttatygyggggttttggttgttggygttgggttygttgttggygttgtggggagggtttttgtygtygyggatygagttgttygtttttyggtygttygaagatygatttttayggygttyggttyggagyggyggtttygygttygygtttygtttttttttgttttygtttttggygtgggaygttygyggyggttttttgaaaatttttygggygttgtttattttggyggtyggygyggayggttygtttyggtagtttyggagygagtttaggtggtaygtgttagttaggtagtttyggtyggaggagagygtygyggtgtaygggggygttttttggagtygyggtttggaggagtaggtgttttygggtttttyggaggtttaggyggyggygtggttggaggyggttygyggygttyggatggtggttttggagygygggggttgygggygtagttttaatygattggttygttttgtygayggtattygygtttgygtgygttayggtattaattyggagtagatttagggygaggttttgttttattatttggygygtttgttgggtttttagygttaygtgtygtygttggtattggttygggtggaggttyggggygygtagtgggygtaggtgtaggaggagttgygygttgygtattggatygagggtagygtggtgagtttgataygttggttgtttaattttayggaygtggtggtgttygygttttggygttyggaggayggtygtttgygtttttttygggatgtygggggtgagttggttaattttagttaggyggagttggtggatttagtataatggatygatttaatttttttygattatttgayggttaatttygatyggttygtaagtaatttttttagtttgtagtgggattygygygttatgtagygtgttattagtaatttgtatygyggttygggyggggygttggtttttttggataatgaggygggtttggtgtayggttatygggtagtaggtatgtgggataagtataaygagtygttgttgtagttagtgtgygtgtttygygagyggatygygyggygygttttggagttgtatygyggataggaygtygyggttyggttgttgygtttttatyggygttaygagtttygttttttygagttggtygtttttgtagatttttaygtttagttgttatagygtygtttygattttttygttaagtatattttgtattgtaaggttaagtayggtygtyg

SEQ ID NO: 6203 - DNA, 2423 bp, Artificial Sequence
  Description of Artificial Sequence: Synthetic polynucleotide
gygygygygygtttgyggaggggggtggtaaggatttagaaggggagtttattttttttttygagtttagttttggggagtygggygtttaggttygttaggttgtaaagagagttgagagttgtttygygtttygygtagaatyggyggtggaataattagygttttaagtgtgtgtatttgggattagggggygggggagggggatttgyggtttygyggttaattyggttggtgtagatttggggattttagaagggatagtgttygtttagtygyggygattgagggtttttgttygggygtagttygggttagtygygtgtttyggggtygyggtttttttyggaattttygygggyggggtttgtttttyggagtyggttggyggggggygggyggygtyggggaaggggtygttatttttttagagyggyggggygaygttaggyggaagggygyggggygygtaygttttaaatggtattygttgttattygagtttagagtygtgtgggtagtygygggttatataagtygygagtttggtygtygyggggtagayggygatagtagyggyggygagygtttyggagygyggyggaatagygtttttygagtttygtgtttttygaygggttygttygttygttygttttttygaggagygtyggttygggttygygagggtygtygttatttygtagtagatttggatttttygttyggygagttttyggttgttgtttttyggggggtttyggygtagyggtygttttyggagagtttyggygtttygtygttyggtttygtagaygtyggaggygttatggtygttaagttyggygagttgatgggtatttgttttagttattaggyggtgatgtygtatttygtgtgtttggtygaygagttttygtagttygtgyggttygttaagttgtttaagggtyggggtyggttgyggyggtygygttagtttygttttaagaygtagtyggtgattttygaygagatttaggaggtggaggaggagggggtgttttttatggaggaggagaaggttaagaagtygtttttgtagagtttggagtgtttgygtygtagtaygtagagtttgtygttgtagygggagtagtttagtagttgtaaattgaggaatagtttggattttagygatttygattyggttttgtaaggggygtygttygygggggggaygygygygttygyggttygygyggggatyggygtgtgaatttygagagtgttygygttttgttttygggggattygtaaggattygggatygtygtttttygygygttyggattttygtttygttgygaatyggtyggtgygtttttygtygygttygttttggttygggagygtygggagyggggtygtttttttygtttttgtaaatgtttattttttaattttttttagtgygaattttgttgtgagtgtgtgyggggaggygygttygygttgagtyggyggygggtagttattttatgtttttgttygatggtttgtaatttygattttgtatatygttttatygtgttttttagygtatatttatttatatttaygttaatattttygttgaatatttttataattgttaggygtggtygttgggattttgggygtagygyggttgttattgygtttggaggattgatatttatttttgtattgygatggttgaaggtatttatttaaygatttttttatttggatatgtttgtgaggtttttgaaaggagataaataaagttaatatatttgtatagtgtagttttttaggtttttgattttttgtattttyggggtttaggtttttaagattyggggaggtgggggaggaggtggtagggggatgtyggattagggagtygggagtggagttatttttataagtttyggttatyggaaygaggttgygttatyggtgygygggtyggttgtttgtttttttaagtggatttattttyggtttagtgtgtttttgygtttttggtttattttttatygtyggtattygggttgaagtgaagtygtaggaggggyggaggtagagttgaygatggagagttttttttttygtatagtttattttttagagttggggttagggttttygtttygtattygttatagaagaygtatttttttttgygttgatttttggyggygggtggggagatgtyggagttagtaatgygagatgtttgggygttgggattygagagtgggttggaggttagtttgggttggtygagagtgtgggtgygygttygttgtygygggtaggtgattttttgatygtagttgatttagygtagtgtttggygtttttgygttgyggggaaaatygyggtygttatgtttttagtygttttttgygtttyg

SEQ ID NO: 6204 - DNA, 1146 bp, Artificial Sequence
  Description of Artificial Sequence: Synthetic polynucleotide
tygtygtaggatttaygttgattaygtttaagtyggtttygtttattygtttygtttatygttaattttaygygttttygttyggataygygttttygtagttttggagygttygtatttatttataagttttygtgtttagttttygtgttttaggagtttatatatatttygatttttaygaagygttttaggtttttattttygygtttaggtatygggyggtygtttttyggggtttattttygttgtagaatttgtygtygaagttygtgtggttgtagtygtagtttatttygtygggggttagtayggtgtagaggtygtygttggygtaggggttgygygygggygygtatagygggtyggyggtggygtygygtaggttttggttgtttagtagygyggggggtygttygtttagttttaggttggttaagaggtygyggaagggyggttygtatttgayggtgtttagygtaagygtygagaggygtaygtygggygggatgtygtttaygaataggtygttggttatttgtatttygygtygtttggagygtatttyggyggygygggtttygtygtttatygttagygtygtgyggygygygtygygggttagtagtattatgtgttagyggtygtyggttatyggygtgtttagttgtagygtggtyggttyggygtaygaaagygtgaagygtagtygtaggyggtygtttattagtagtagttttaggaagtygtagtygtygtygtygtttaggtagagtagtagygygygygtggygttggtgygtaggttgaagttgagttygtygttgttygtygygttygtttagygygygtagygagtttattgttyggggtygtygtygaattttaggtygttygygygygtygttagygttagtagtagtagtaatagtagyggyggtggtgtyggtygttatyggttttyggaygttatgtttayggyggtttyggtttygttyggttttyggttttygtttaggttttagagtygygggygtatggggygggagggggtygggygtttttygygttgagyggggtttttttgtaggtttatagtgttatgggttyggtygyggggygaggygygtagaggtttagatgtyg

SEQ ID NO: 6205 - DNA, 577 bp, Artificial Sequence
  Description of Artificial Sequence: Synthetic polynucleotide
gygggtatagtyggtttttgayggygtttaaggtttygttygtgyggygttgtttattttttattattagagatyggttygtttagygggtaggttttattttaatgttaggttaaagtttttattttttggattygggtttggygttttygttttyggygygtttttattyggyggaygyggtygygtataaggtttagtayggttygygttttygtagttyggtygyggttgaatatttttagygygaagygggtgggygttagtagtttyggggayggyggtttttaggtttgaaagttggyggttyggggttgggygggggyggttattgygttygggagtagttttagtagygataggagttgtagttagggygttatggygagggygaagtyggyggttyggatttaatagaygttttatygatttatygggtatygagttygyggttagyggggtttgagttttttttttagyggggygayggtaygtygattaatgggygttggtttgyggygtttgygygtttttttgtttataggaggtaygtggggygygtagggtagggagagyg

SEQ ID NO: 6206 - DNA, 1721 bp, Artificial Sequence
  Description of Artificial Sequence: Synthetic polynucleotide
aygaagaatyggttggttaygtygaagatgtttattaygtttygttttaygggygagagttttagtaggtttgggggyggggygtaggttattgyggggtaggtgatttttggtttatttygtttttyggtttgttygttttyggggattttatttttggggtggggttggggataaagggttagggttttyggygtagtygtttttaagggtttttagagtttaagttgttttttagggttttyggagtttaagtttgygttagtttagattagtttgtttgtgtaggggattttyggyggtygtatttagtttyggatttttagaygygagttygattttagyggttttttagtttgggttaggtyggggygygtgtttygggttttttgtggttgtatygygygttttgtgtttaygggygaaggygttggaattyggygttyggagttygagtttttgaaggygggaggyggygttygattttaggggttgygttgggttgtyggagttaagagtgtttgygtttttagtttygygttagaagggatyggagttygagttygtttyggttttyggggttttygagtaggtgttygtygagggttttagagtgtgattgagygggttggttyggyggtygttgtttttygttttygttttttygygtttggtygygttatttattgtygygggtgttygygtgygygtygtygatgyggtygtyggggagygtttggaggtggaagtygatgtttaygttgtagtagagtygtygtagtygtttgatgtttagtaggtagtygtyggygtygttttggayggtygtttttttgggttgygttgttatyggtaggygygttaaygagagygttattaggtttttttagyggygttttagttyggtttttagygtgtygttgggtgtagtgggtgyggyggygttttttyggttygtttagggygttagtaaggttagtaggatygtygggagtagygttatygyggtygtttygggtttygatatttyggttygagggtygtgygtyggttaggyggttagtgygttygggaagttggggggtagagttgygtttgtggygtttygygggagygtayggtygatttygggtaggagtgygtaatygaggaggtgygggaggtaagygayggggttttygggygtygggttttatttyggttgtatggagyggygagtygggyggaaagygygyggttggagttgggattttgaggagtagtgygygtttttttgagygttaggttygttygaggtygagtygttatatatatagttyggygtttttttttattygttygttttygyggggggtygttygygtttttttgggygttyggggygttgtggygttygyggttggtygtaggtygtttgttaattagggtygggggaagggaggaggttggggattagygtygygagtgttatttggagggatttyggtttttatttttggtttygttyggtttayggatttgttygtttygttttttggyggtttttatatttttgttttttagttagttttgttttttgtattttgtttttgtttgttttygttttygtttttttttttgtttyggtygttttggygtagttttaattygggtattygaagtttttagtgggygtagaagttagyggttgttgtttgtttttygtttttyggaggtttayg

SEQ ID NO: 6207 - DNA, 1721 bp, Artificial Sequence; identical to SEQ ID NO: 6206
  Description of Artificial Sequence: Synthetic polynucleotide

SEQ ID NO: 6208 - DNA, 615 bp, Artificial Sequence
  Description of Artificial Sequence: Synthetic polynucleotide
tyggygtttgtygagygygtagygtygggygaggygygygggattagygggtgttgygggygygygggttagaggyggtyggygttttttgttyggtgggttyggggtygggtygygggggtttggggttyggyggggyggyggttttagtagyggyggyggygyggyggtygyggagggaggttgagygygggtyggttgtgttygttaagggttttaggygtygygttygggygtatttgtattttgtygygggaagtaggtagttyggtttggygttggtttagygttggygttttttttggggtatygygggttyggtggattggttattygagaaataggtttatttttttttttttttttttgtgygggttttygggayggaygttttaggygyggygtygagtggaggygagggggttgyggagggggaaggggttaygygggttayggggtttaatttttgatttttygygaygttaagaatgtaggagggtagagttgagggagattttaggtggaatttttaggtggggaaggttgagttgtyggggttgygggtatygggaaggtttagggtaaggygttyggyggtgygtgttyggaatttyg

SEQ ID NO: 6209 - DNA, 1542 bp, Artificial Sequence
  Description of Artificial Sequence: Synthetic polynucleotide
ayggaggygyggygttttttatagtygtttttaatgaagggaagygtgtttygaagttagtttyggtgygtttttttttttttyggygtttttttttaaatttygtyggatttttaaaggttggaataggyggtgyggttgtagttygygttgtaatygtaggatatttgatggggyggyggyggygggggtagggygtagtttggaaagaagggggygaaagaggttaaatggtttygttygtttttttygtygggagaattygtagyggyggggtatagggggtttaagggttygtttaaggttaagtygtygyggggggtagttagggggttttttttggtyggggagtagttygggaygttttagggttyggggtatagtaggttttttattattgtyggyggyggtttaaagaggtygggttttagtttygggggttttygtagtayggaggtttyggyggggaataygtygagaggttyggyggtaagtaagattgtygttttygtgtyggygtygtagtygggttttagtagtttaaagaattttayggttttygygtttttttttaggtygtttaagtttaygttyggtttygaygggttatattygtygtygtttgttygggayggtttygtgaagaaggayggaggtagattgygtgttygtagygggatttttttggtttttgggatygtygtggttttygyggggtttgttaygttttttttygygtttttagtgttygtattttttagttyggtygtyggygtagttattttatttttygtyggttyggtattttyggggaygtggygtagygagtygaagagygyggttagatttyggttttgtaagttggyggtygyggyggtttgygaygtttttygtyggggggtagttttgtygtgggtyggggtygygattgtyggggygttaggggyggttagyggtygtttggttggygtgtyggyggygttyggggagggygggtyggggggygyggygtttatgaggtygttgtagygtttgatttgtttttgtaggtatttgyggtggtttatttttygtttygatttgttyggtttgtttagygttagtttgatgttgttggaygtygagttaatgaagttgagtagatygygggtggtttygygtaygttttttttttyggttttygatagtagygtattygtyggagtttyggttttatygttttygaaatagtagtttttgtttagggtttygaaggygttttttagttygttyggggagttttygaagtygaagggtaygaaagggtgygtgttgaggagygtygtttgtatygttatygtygyggttttygggttgttygtagygttgttygtgygttttygttagtttttgttygtygtttagatttagttttygtttyggygyggygygygyggygtagtttattagtttygggtttggttygttgygttgtttttygggggagtttattaggttttgtaagtaaggggyggagggagggagygygyggygatygtttyg

SEQ ID NO: 6210 - DNA, 1542 bp, Artificial Sequence; identical to SEQ ID NO: 6209
  Description of Artificial Sequence: Synthetic polynucleotide

SEQ ID NO: 6211 - DNA, 1768 bp, Artificial Sequence
  Description of Artificial Sequence: Synthetic polynucleotide
gygygtygtgttttttatygtttttttttttggttygattggttttggttttttttaygtttttagtttttaaattggygttygttttatggttygtgtaggaygttaaaagtayggtaaattttagggygatttttagtagaygttttygaygtatgatgtygagtygttatyggttttygtygttttttgtygygttyggggttyggtttgyggtygtygttgygttttgaagygtatygygtygtyggggtttygttatttygtygttygtttttygggtygggtttttttygttttttttaggygttgtttttattttaggyggtttttgttagttgtaatatagagataaattttygaggyggggagatttttagggtatygggatgttgaagtttygyggtttttatttttaagtttaattygtgygtygtttgygygtggygtagttaatttgggtaagggaagatygtttggtttatagttggttggaaagtttaggttttyggyggtagtagtttyggtygatttttyggtttttygggtttygttagaagagygyggygtaaagtatttatatttttagyggttttaagtttygggygagttttttgggtttattttttttagyggtaygaattgygygygatgygygttttgaaygttttattttttagtttgtttttttygttaggttggaagttagtygygtygttttygtygatttygggygatgttatygtttttygaatatttgaygyggagttyggtattaagagtttygggttaggaagttgttaggtaggggagggttagygttagttgtggaygtttygggatagttttttattttagtttttgtttttgttttyggygyggygtaaaygtaaaagttttygtggtygtagttttagtttyggtggtygttygattttygtygggatttyggttgtatttattggagaagyggyggtttygattttygaggaggyggyggyggttgtttttagtygtggtygttatagttattgttyggtttygttygtagttgttttagttgtggtttttgttygtttgtggtatttatagtttttgtygyggttttygtagtttttttttttttttatttttttaagtatygttygygtagyggtttttygygagagaaatattttttttaaaaaaagaaagaaaaagaaaatgatattttttttttygtygtttttattattattttatttttyggttttatttattttttttttttatttttttttgttagttttygtttyggtgyggggtttttygttygtaggattagygtagtgggaggaggtagaggtgattaggttttgttyggtttgggattttttgttttgaggtggggaggggagaaatgggaagaggtggagtagyggttttagttygttttgyggttgygaggtttagattygagattaatttttttygygataggtgaagttttatyggagtagaaagttgttttatttgtattaagaatgygygttggagayggttgtttyggaggttttggttygagagaaaattagttttygttgttygygtttttyggtagygygttttttgygtttttttygtyggatatttagtagaygtyggaggtygggaggttaagattgggygygtygtaggtygggatygyggtagaggttgttgtgtygatygaggagagggttttgtygtttttatttgttttgggtgtygagagtttattttagaygyg

SEQ ID NO: 6212 - DNA, 2656 bp, Artificial Sequence
  Description of Artificial Sequence: Synthetic polynucleotide
aygtttttttygyggtaggaaagtaygttggtgttattttagagttttagagggttgagggaagattygagttttaaaattagtygtttttaggttyggygtygggaatgttttttagttygtygygtttttttygtygttttttttygygygtttttttttttttgygttaygtttttagatygttagttattttygtygtygaggtttttttttttttygtttttttygttygyggtttgggaggaggagattgygagagataagygygagggggagattggagaggggtttggtygtgygtyggygtyggttgtgatggggagttyggagtagttaggyggygagtagtagyggyggyggttgtagttyggagtagataggagagtyggygttttttttygtaggttgygttgtgaattggtttgyggattgggatttygygtttttygttttttttttttygttgttgttttttttatttyggtttttttttttygtttgygaattttyggyggyggyggyggyggygtttygagygtagagygtttttgttygyggttttagtttyggttagygygyggtgggygttgyggyggtagtagtygggggatyggttygttyggagtaagagygtygagtatygggtgaagaagattaygggggaggygtttygtagagtygtggatygttagyggaggtaagggtgygtggggatttgtagygtgatgatttggttgtttggtgtatygattggagygygtttgtyggagtatagttttagttgttgggtgtaaatgggttgygaggtgggttggggaggygagagtygaygaagygygtgggggaaattttttattttgtaaagttttaattttygygtagtttygagtygtygttgttatygttgtaaataggagaagagggtggtttggtttygyggygggagtygggaggtttatayggagagttggttaagtttggggttgaggatttggggaggggttgygaggggggttgyggattagtgtatttattttyggtttttagtygtttttgtaggtggatgagaaggtttaggtggygagtttgtttggtagtyggtgtttttygggygtagtgggggatgtttagatgtygatggatgatgtatttaggggatttygaggtgtaagttgggttatygttaggygaggygyggygtagagagggagtttagtttttattttygttaggaaagggaaagggttattagtttgygggttygttttttaygtttgattygggtttgyggggtttgtggttagggtgagatgtagtgaayggyggyggyggtttttygattggggaygatattttttayggagtggttggggatagagattgtttttgttattttgataaggagagggaatyggaatgttttgygagagtgtatgatttttggygggygtgtgggaaggttgtttgtttttgaaaagaaagtagygygggtttgattatttttaggagtgyggaggagttgttttyggattgggggygagaaygttaggggtattagtttygagtttaggttttattttygggyggttygggaygaattttttttataggttagtgtgtgtgtagggtaagtgtagggggttgaggggygttggyggggaggtagtagaggtggtttggattattttggygyggygygyggtgagygygaggatttygttagtgggagtygttgagttaaagtgtatttggtttttyggtttgtatgatggygagttyggatatttttagttgtgttgtgatttgaattttttttttttttttttygttgatttttgttatatgtgtttttygagatggtttaatattgaatatgattgggttttgyggaaagtaatttttatttattttttatygttttttttttgtgggyggggggtggygggggygtgtttggggtaaggatgtaggggtggtyggagtttggttgygagttaagagagtygtttgggttgttygggatgagaggaataggggtgttttyggggtgtgggtgtgttggyggtgatattttgaggttgtagttygttggaataatgggtttaaattaggyggtggagaggggttttyggaatggaygtygggggyggggaggttgyggagattttgygaggttttygtgaaggattaggaggggttttygggagggagtggygtttgyggttyggagygtgggyggtyggtggttttggtaygyggaatttggtggatttttagygtttyggtygggagttttagttttatttygtygtygtygygygtttaatgggatttagtttygggtttgggygaatttgtagtagtygyggygggagggagggaygttgggatygyggtaatgattgaagttttttttttttttttttttttttttygttttttttygtttttagattttggygygtttgttttttaagttggattttatttttatttataagtgttagataaattygygagaattttttttaattygtttyggttttagttagattagggagggygtttagggggagggggygagttgtttgggtagtgtttggggaggtgygaygygtttattyggggtttgagyggttggggtttttgtgyg

SEQ ID NO: 6213 - DNA, 623 bp, Artificial Sequence
  Description of Artificial Sequence: Synthetic polynucleotide
gygtygtagygttttttgtttataaagttttgttagtyggagaaggtgtagttgttttaagagaagaagtgygaggtattgggtayggttagggtygttttygygttttgttygtyggttyggttttygtggggttyggtggttygtattaaggggaggagatagagtagtaagaggtgagggattattttgtaggagttattttttttttgggagtttgygggtygggygttttttttygttgggatyggagygygtagtyggggtgyggggygtatagtatataaggtygtttygaggagttagggagttyggaygygyggagtatygygtygttygttattagttygyggtyggtaygttagtttygggtttgttggagtatttttatatttttgtttttattaggttgttagggagygtttttgtttattgggtagygyggygtttttygyggygayggtgaygygttttggttttgataagtttggttttttttattttatygggtggygtygttgttgattttaygtttagtygtttttattttygtttgaaattttttygatagggtttygtttygggggtttagtttttagygygtatatattygygtggtgtyg

SEQ ID NO: 6214 - DNA, 1967 bp, Artificial Sequence
  Description of Artificial Sequence: Synthetic polynucleotide
gygygtygtttttgttgtttagtygaatttygttttttttagggttgygttgtayggggttgttttttygagtygttagygttyggygttttttyggygygttygttttttttattttgtgygttygyggyggtgggagtagagtyggtyggtttttggggatttagyggtygygttggtgatgggtagygttttttttttaaaggygggyggyggggygggggaggtygyggttygggtggtgtygtygtaygggttyggatttygagggggaagtggtttgttagtttyggtttygggaagagtgaataataaggttagggtagtygttttagatygttatatttttgggtttaataaagttaggatygttgttttgtttttttygttttagaagaataayggtttgtaaaatggggtaaaatgggtagaatygtayggtygttgttgttggtgtgatygttgttgtattttagtygatatgaygttagttttttatttgttaaattgttggttagttgtaaagtttattttyggtygygagtattgaaggatgggagggtygagygtygygttttgataggaggaagtgyggaggggyggagggygaggagggygtgattggggttgtttggtgtgtgygygygygtgtgygygygtgtgtttttataygygtygygtgtttagtgttgtayggggygggagaagaatggtaggtagtygttygaaatatttygttttgttttttttttttgggygaggttttygattttggtaaagtgtgaataatagggagttgggaggaagatagtagtgatgttgtygygggtggygggggttgygtygtygtttagagaatttyggtagtgtgtagggaggtgtattttattttggttatttttatttyggtttttttggaaaatttttttgtgygtgtttatttttttttttagttgttatttttttatttttatttaaggatttgygttttggttttgatggaygggagggaaggaagaaaagtaggggtygtagagagttgggtgggttgggyggatattttgggyggggggygtgtgttgggaagygatygaggaaagtygggyggaggggttgtgtgtygyggtygtagttttaggtatygttgtatttgttttggayggtygattttyggttggggagygtayggggygggttagggagtatttagtgygtttttttygygggyggtataagagtagygttyggtygtygtttttagttaattygggttttttttayggygattaattagtgygaagttggttgggygggaagtygygagaggtttttattgyggygygggtggyggttaggagttgttaggatagtttttyggtgttttagtttaayggtttygtttatttatygttaagagaaatttygttttgyggtyggtttttygtttgttyggtagttttygaggaaataaaatggagattaggtggttatygggagtgtttttggttyggtygttygtgttygtttattttygttttttttaygtygatttggagtattttatygttttygttagygtttattttygygtygyggaattygggtttgagygygtygtyggggagggtattttggtaggtatatttaygygygtgygttgatyggtygatygygggtygggggttttattgayggyggggyggggtygtggtagggttyggagaggaggggtggggattaagtttagttygtttggttttgggttttygttgttatttgggygggggttatttyggttatgttttttttygyggtgttygtgggtgtygygaygygatttgtttatatggggygggggaaggggggtgtttttgagatattttygttttygggtgggagygtgataatggagttyggatatttggtgggttttttgggggatygtttggyggttttttttattatyg

SEQ ID NO: 6215 - DNA, 2558 bp, Artificial Sequence
  Description of Artificial Sequence: Synthetic polynucleotide
tygygatagttaaaaaygggtgtttygtttygataatagattttygyggattttttggtatttggtttattagygttygygaattttgtttygggagatttattgaaattyggatgtttaagtygggaggygygtagtaattaggaggatgagagggtygggtttgggttaggaaagyggttttttaaaatagatgttagggggattgtagtttygagttatgagaaaaaagttaaaggygagatgataygtattgaattggggtaaatattggaagaggagataaaattgygtgtttgagtatyggggtgyggggagggggggataaaattygtatttagtgtaaattaaaattttgggagtaggtgggggttgttgygygttttttatttttagtttttttattaaggattttgagtttttatgtatttttgttttttggttttttttttttttttygttyggtyggtgagaggyggtygtyggygttttagtagtagttagatgttaggygaagttyggagygyggagygtggggaagggaggggaagggaggggaggggaaaggaggggtggggyggggagygygygygggttyggttagtgyggggtggtgggygggttgagttyggggayggygygggaggggggagggaaggggggtagttgtgggtagggagtygggttyggtygttagtattaaagatggagaggygtyggggttttgtaggggagggggttyggygttgaygtgggaygyggyggaggygtagtagtyggtggtgatttgttaatttygtagtagagaggagttgagggygatgagagygggtattgygaattgtygggygatgttgtygttgtygtygtgatayggagagtaatagttttttagtaatattttttttygatataggtatatatttttygataggtaygtatatttattttatagtgttyggttyggttgyggtgagtgaggggtygggaagaggygtatygtttagygagygtygygygtyggggtttttyggggttggagaggtttggggggygygygttygtttyggttattyggtygttgggtttgtgttttttttatttggygtgttttttttttgtygttgtagtygtygtygttatyggttgggggtyggttagaagggggagtttyggttgttagtttgggygtagttgtttttttagttttttttttttagggtayggtyggggtgagaggtggggggygtagyggtgtgygggggttgagggygtgagtagaggggtyggggattyggaggttttgtatygttaggggttggyggagtaatagagttygtgggtgtttttatgtatgyggatyggtgygygggygtaagataaggttgtggtttatttatttgtgtgtttattygtyggtyggttgggaagttagaatyggaggagttgaygagtagatttgggggyggaggggagtaggattgggattgtttaygttttgtttttttttgagaaaaygtggtgggtttttttttgattggatttgatttttattttttttttgtaggggagggagggaagttttagagggtttgtagygttgygggtttttttyggttttyggygggatyggyggtgatatyggagttygtygtgygttttyggtygttttyggtgggtgtyggtttttgtatttgatgygttygggatgttttttttattttggygygttygtygttagttygtatagygtttygtatattttygtaygygtttgaaatgygtayggtttygtyggttygyggaattattyggaygtayggagygtttygtatygattygttygtygttttttygagaygttygtatygtgtttgggtygggygygttggtygttggygtygttggttagaggtttgggatttagtyggtygtttttagggggttayggttttgggtyggagagggagggygggtagattttttttygtttttttttttataattygttgyggggtttttgtgtttttttttygtygyggggygggttygttttttttgtygttttygtygyggagtttagttygttyggattgtygtygttttttttygtttttttygttttttttygtttttagtttagtttttttttttttaggagtttagtttttygggaaaagttgtttttttaagtttgttgaagtygtttttaagtttyggtgggggtygttgggaattgggggggtgtgagagygyggtygattttyggagttygggygggttatygtyggttttttttygygtygtttggttggaygttgtagttagygttagtyggatygygggygtygagyggygggtgggggagayggttgttygtgggygtttagattttttttaggatttaaaaggtttgttttagggygttaagtttttatttttttggttgtttttttttagtttttagaaatttygatgtttgygggaaagtaygyggtggttyggttyggttgaatgtttattttaattttgayggttttygtttttatttyggggyg

SEQ ID NO: 6216 - DNA, 2558 bp, Artificial Sequence; identical to SEQ ID NO: 6215
  Description of Artificial Sequence: Synthetic polynucleotide

SEQ ID NO: 6217 - DNA, 1508 bp, Artificial Sequence
  Description of Artificial Sequence: Synthetic polynucleotide
tygtttyggggygagaaggagaaaagttagagggttgaataggtgaygttgagtttgttggagygtgtgtgttttattaygtaagggygyggagttyggtygttttatttttygttatttgygygttygggggtaygttttttgygatagtttggaatttagattatttgygtttgtttggtttygatttagtgtttaggtggttttagtyggaaatgtttgtttttttttaatttttygatttyggttgtttygyggattaggtaygtagygttttagtygtaggtttggatatgtyggatatttggatttatttttagtaatttttttttttygggaagagggataygttttttagtttgaagatttgtttttaggtttaattggttaggygyggaagyggagaatttygtattttggggygygttgttygaggtggttayggtggygtattaagtyggggttaaagtyggggtagaggggtggggtagggtygggggagggtgatttttgggtttggagaataaatttgttattygagggatttttagttttygggatttttattatttttattttgtttttagttaatgygyggataagygttatgyggtgygttaatattygygttagggttggggttygyggygggagagggaygtayggatatagyggaggaattagtygtygagttygaggtttgaataagtaaggatttttaggttaagagttayggtttgaggatttttygattyggagggtatttyggggttttagtgttattaagtygtaggaagagggtaaggggttgggggaggggtttagggtagaattgtygtygtgtagggagtagggagatgaggggtttttttgttattatttttaygggygygttttaaaayggtagaygygggtggttggyggagyggtygggggttgatttttattyggtttttgttagggtgtttgttttttttygttgygttttattyggggttttgtatttyggtyggtttttttaygtatttggagttygtygggtatttygtttygtygttagtygygttattttggtttygtygttttygtygtttagtygttygygtaggttttatttttgtgtaaagagtttaggagtaggaggaaagttattagttatatgttataaagaggttttatttttyggggaggtggttttgtggtyggtygtgyggtagygtttttttttygtttagygygtttttagtygttygtattyggygtttygttttttttgttttttagtttagygttyggttgyggyggyggttttttttttttyggtttttyggtttttgttattygyggggttgggttaggyggtygtttttttygttttttygyggtatttygggtggtgagygtygygygagttyggagtttagayggattttagttttataagtttaggaataggagyggyggttygggttagatygtttygattyggtttygttgtttgagaggyg

SEQ ID NO: 6218 - DNA, 1119 bp, Artificial Sequence
  Description of Artificial Sequence: Synthetic polynucleotide
tygggygygtaggyggyggttagygttggagttttagttagttttttttttttaygtgygygttaggttttggttattttggtaattygtttygtttagayggtattaggtagttgaatttagttttttgttaygggggaaaatgtttttattgaagygtyggagygtagtttttgttttttattgtaagyggygttatyggattttatttgtaaatttattagtgtgygttygyggggagggggttygggaattygggttygggtaatyggygtygtatgttaattagggggygttygttttygttttgttygtggtttttttttttygatttttygaygtttygggaggagtggggtyggagygtagggttgggaagggttttaggatttaggaaggagaygggtgttttttagagaggattttatttttttygaggttygggyggttttyggtttttttttggggtgtygtagtttttttygattygttttttygtagtygtagtygttygggtttggaggtggtygggtatyggtgtygaygtygygagggtagygttygyggygggaatattaatgtattttaaagggtayggtygtygtygtagtaggtaattagttggatygyggyggagygygyggaggtggttgttggttgtaaggattgygtttagttttygtttygtttttygaggttttygygtgggtyggygggtagtgygtgggttataggaagygggttgattggattyggtttaggatttygtataagggtagttttttgtttatagttttttttttagtttttygtttttttttygtttatygtttttttttttyggygatyggtttygtyggttgygggggggtggggggggtggggtgttttgtgtagtygtttattttttgtttyggtttygtgttttygttggggattgtttgyggtgagtttgtygtaygtaygttagggtygaggtagtgatgyggggtagygtgggaggaygggttgyggagttygygttattttgtttgtggggagygttgtgtttgtttttttgttagygygtttagttgtttyggtygtygttaygygggattgtttgttatgtygttatyg

SEQ ID NO: 6219 - DNA, 1119 bp, Artificial Sequence; identical to SEQ ID NO: 6218
  Description of Artificial Sequence: Synthetic polynucleotide

SEQ ID NO: 6220 - DNA, 653 bp, Artificial Sequence
  Description of Artificial Sequence: Synthetic polynucleotide
gyggagaagttaggagygatgaggggyggggyggttttyggygtttttttttttagtttygttttygygttgtygtyggagagggattyggggygtagtygtttygtttttgtyggggttttaggaggaatttaagaaaagagagatggagggaggaaatggtatygttttaggaaggggtaggatttttaggatygaaggygttttttttttttttttttttagygatattgggaaataaagtttygyggttgaaaagaatattaygygyggttaggattygagtagggttttggggygttaagggyggggaaaatagggtattyggagtgtaggagattttttagggtygttttttttttygggggtgttttgaggaatygyggyggggattygtygttggtagtttgygggttttggtgttagygygtatgggygggttgtgyggaygtggttggttttttaaaggttttagatttygttygggtygtttagttttttaaagttgtgttttaaagtttaggggagatagygaggttggggaygtygggaagtttttttgaggtgtggggtttttgagtagaaaygygygggggattgttagggttgtagaaattttggttygaggyggtggttggttygttttattttyg

SEQ ID NO: 6221 - DNA, 1768 bp, Artificial Sequence; identical to SEQ ID NO: 6211
  Description of Artificial Sequence: Synthetic polynucleotide

SEQ ID NO: 6222 - DNA, 1101 bp, Artificial Sequence
  Description of Artificial Sequence: Synthetic polynucleotide
gygttaagtyggttttttaatttggtttgttgaaygtaaatygttgagagtttgttgtatygttttttggggtttttggttgtygagtttygttaaggtaaagaygttagtaagygaggaagygtagyggaagaaaaataagygggygygygaggggagttttaggagggttgtygagtggttggtaggyggttttygtttttttygggtggtttygtyggyggttgayggttyggaggaygygygtttygaaaagttagatttygggyggyggygygttaygtygygttttttygygtttttttttygttgygtttygggaaaggaatttgttttttyggttttaggattggggagtgtgtygyggggtygagggtggggaatagttagagggagaygygaattaggtygttggyggagggtttagggggagygtagaggygayggtttttatgtyggyggttaatatgatggagaatyggtygttgttygttttgtaggtgttygagtygtagggtgygttygagggtagttyggtttggtttagttygtygatttttaygtttygtygtyggygttttaagatgygtygtatgaagaaygtataggagtagagtttggaggtygggttggttygggatttgttygtygttttggttttyggtaaggagtttttgtagttgtygtttatygagattaygttttttagygaygaggatatttygtggtttaattgttttatatttagygygttttygygtygaaaaygttttttttttygtaagtggttgagggtgagggagyggaaggagtgtagtgaaagtaggtaygttttygtttygttygttttttttttttttttttygttttttttagagtygtttagggtttyggggtattttgggggaaaygttttgggggagaataggagttygttattagaggygtttttggagggygttgygtttggttttagggatggtggtatttagtttttaygygtgttattygttttttaatttagggtgaggggttttatgttgtaygataygtttaygtggggttttaygttgtattttattttttttgattttygtagyg

SEQ ID NO: 6223 - DNA, 1101 bp, Artificial Sequence; identical to SEQ ID NO: 6222
  Description of Artificial Sequence: Synthetic polynucleotide

SEQ ID NO: 6224 - DNA, 2341 bp, Artificial Sequence
  Description of Artificial Sequence: Synthetic polynucleotide
gygtggttyggagagygtggataaggtaatttgttttggatgttygggagaagggagttyggtygaaagggtttagtttttygaggttgttttaattggggygygyggyggtttaggagggaggyggggaggttttygggttgggtyggggaaygtyggtttttaggttgggtagggaggayggtttagagygygggttttygggttttatttygggaaaagtttgggtttgttttgygttgttgygtgttgygtttttgggatttgttgattgttttagagggaaygtttygyggtagtgttagttttttggggattaggaagggygatttttgtttgggagttagtgtttgggtygtygggttygggtaagygttgggggtttggttygagaagatgyggataggtggtttagggygtygyggattttygttttttgygggtatygggagtttagggtygaggygygtygtttygaggggtttttttttttaataatgygttyggaatggagttygygttttgatagygygggttagttygaaatygtttagaattygtttygatgagtgggtgagtygttttgggagtttgtygygtttyggtagyggagggtttgagtggaaaaatttttattggatgtattttttaatggttggtttgtttyggttttygttygagtttttttyggtagtaggygttgggttattygtagttttagttaattttttttttatattttttttattttatttttaaaaagtttgttttyggttggaaaaagtattaatgaaygtatttgtgggaagaaayggaaagtgaatgagttaggagggttattttyggttaatygttttaggaaaagtaaagaagttaaaggtttttggttttggattttgggggaaggtgatggggggaggtttagatttygggaattagggygyggaygttgggygtggatttygttattgttttyggttagtttttattttttaggagtaagtattttgtgtgygtagygtatgaatgtgtttgggtattttygygtatatttatatagtgtgtgatgygaaaagtaggattagtaggggaggaagagggggtgtggggggggagggaagatgagggagagtagaggggagagaagagagaggagagttygaggygagagagagagagagagagagagagagagagagagagagagagagagagagataggatttttttttygattygtaaagtgaagttattttttaaaattagttgaaaaaaaagttttattyggttaattgtttttttygtttygttataataataaaygtgtataggggagtgagggtagggygttygtagggggtaygtagggagggtttagggygttagggaggtygygtygggttaattygaaggggttgygaggttaggttgtaatygggttaatgtgtggaatattggggggttyggttgtagatttggttaaatggaygggattattaaggtaagyggyggggtaayggaygygggyggyggggatyggtyggggaggygaagyggygggygggtaggtgyggggttygygtttyggaagaygtggtttttttttttttttttygygtttyggtttygygtyggttttttyggygttygggtggygagttttattygygggttagtyggttaggygttygtattgagggygattttttttygaaattttagtttttaaagtggagtttyggttttttttttatttygttgttygtyggggttgtaggaggggayggygggaaatygggggattttagggtayggaayggagttaagggygagagatttyggggtttattatttttatygatattyggggttttygtggttttagygttaggtattgggtttttttttygtagaggyggaatayggygggggygggggttgtagtygttygggttygggtttttgtttggtgggttttggggtgggtaagtggtttygttgtaygagggtaggggtgtaagtgagtgtgtygggggatttatttgagygggtttttttagatggaagtttttgtttatatgttagygttttttttttttttyggtatttagtygttyggttttaggygttggagagtygtyggtttygygggatttttgggtyggtttygtygttttttyggyggggaattttttttagttttygttygtatagatttttagygtttygagttttygtttttygygtttaggygtgygtyggttttaggattagggtttttggagttgtygttttygaaagggttttgygtttttyggagtygttttygttgtaggggtyg

SEQ ID NO: 6225 - DNA, 3857 bp, Artificial Sequence
  Description of Artificial Sequence: Synthetic polynucleotide
gygaggggyggggggyggggagggaggygggtygyggygttggtttyggggttygyggtayggttttttttgtygygttgtttagggttyggattttgttyggygttgygtttatygygagggtgttagattygtygygtygtygtygygtttttttagtygyggttttttttttygtygtttttttttgtttttttagtttttttttttaygtgtggatgaygttaaaatttygygaaaaagtygygtggtggtttttygagyggaggygygatttygtygtttagyggttttttttygggggygtttggagggggagaagggyggaggyggtyggtttttttttttttygggaggtaggatttttygaygtygatygtyggaygtttttygttttaaagtttattggaaaatttatttttgtaaagtaaatgtatttttagagttattttyggtygygtgaggygtgttttaagttgaattagataggaagagggggaagttygggttttttaatttttttttttttygaagggaggggagtgagatgttaggtgggtgatagayggtaggygttygtttttttaatttaygtttgtygtatttgtygttttagtaatttagtttygtttaagtygaaattygtygaagggagtgyggatgtataggtttggyggattttgtttttttttagaaygtagyggtttagygtttyggygggygyggttgygattagagggtttyggaagygagtgaatatttgtaatygtattgttygtttttatttattttgttttttygtgtttttygtttttygaygttttttttttttttttgttygtatttttttattttgtttgtattttttttttttttttgatgtgttttttatgtgttttttyggatttatgtgttttttygtattttgttagtygggttttyggttttgattgatygtttatttttttayggagaaatataaatatagttttattttttgggggagtygaggggaaggtagtggtttttatttttgagtttgaatttagttattattygttttttatttggtttaggygtttttgygyggagaaggygggattygaattygygttgttttygggttttgagtygatygyggaattatttggttgggaggtattttttaggtaagtttgggagtatgtgtgtttagtgttgtaggtttttgtagaaaagtgtttataaatatttaatattttgttgtattttttatttttaggttttgtatattttttaatygaaattttaaaaygttagygtagagggtggggagtyggtyggaaaaagaataaaagtttaataaaattggygttygttaaagtttattattagttttatatgggatatatatatatgtattttttttttygtgaagggtgaaaaggagataaggaagaattaataatttattttttttygtygttttttattttygygttayggtgattagtttggattttaaagttagagtataggtttttgygtttttttttgaaatygaagtttatattgaaagaaagtgtgtatttttgtttagaaggtaatatgygttttttygygtgttaggtggagtgtattttaataagatattagggttttaatatatggttggagtggygattaaaagggaaaatttagtttttagtttaagttttttagagatatttttgttaattttygtatttttttaygttttattttaygtgtgagagtttgtaaaattatyggggattggattygatggygagttttaygttygggaatagttagtaatyggaaggggaagtggataggggaattttaagaggygagtttgttaygygggaagygttygaatttgygggtttttatgaatgtagagggygtygggaagggggggtattyggtygygattttttttgttttttttattygttgttttttttttygttggaatttttttgtaaagtaagayggagtagggggagggggagagggaaggggygagagggttttyggtttattttygagaygtgaggattygttatttaggtatttttttyggggtgggttgggtttygggaygattattygtttttttttygttttygttgtttttatttygggagatttagagttttggatgttttttttyggagaagggggggtgtgyggagtyggggtggaagagattttgttygtagagttatattaagtgatgtttagaggttgggagtttyggyggtttttgttttttgtttgtygggttagatttatattttaaaaatatttttygttttttttttttttttygttttttttygttgtaattttttttgattygtttaaaggtggtttaggtgaaattggagtaatttttttatgggggttttaaaatgtaagtgaatgtttttattyggggtgatttaaaagtttaagtygggaagtttaaygtgattaaaattaataggtgattgttyggggtygattgtgtgygggtgtatayggtattyggttygggtgttattygyggygttggattgttttattttgagtttgtaatttgggttttttagygagttttttttttttttgaaagttaatggtttttatagtaattagatatttttttygttygtttttttttttttttttttttatatataggagatgggatatttattttygttgttattgataaggtyggaggyggtygggtttttttttagttttygttygttttagygttygtttttttttygtttttttttggtttttttttgatgtagtggggaaygygttttattaaaaaaaaaaaaaaaaaaaaaaaaaaaaagtaatttgttyggtaataattagygygtagtagtaggagttttagagttattggttatgtaaatagagggaggggagayggygttttaaatttttttttatttttttaaagygatattttttttttttttttttattatttttttygttttattttygtttaaagaggttggtttyggggtttgagttaatygtttgtatttttagtttattygtttttttttttygttttgtagggaatttagtgtayggtttatttagttygygttttatttygttttgttggtttttygygtttttgttygggttttttttttyggtgagggaggtatttagtyggtttyggtgtgtttagagagttygagttaygttatgttygttgtaygtgttagtttggttagtatattagggygttggtttttttttttttttttggagtgaaatatattaaagggygyggtgggggtggggggtgaygggaggaaggaggtgaagaaaygttattagatygtattttttgtaaagatagttttgatttaagtatgygttagagtaygtgttagggtygatygtgttggyggygattttatygtagtyggtttttagggagaaagtttggygagtgaggygygaaatyggaggggtyggygaggatgygggygaaggatygagygtggaggttttatgttttyggggaaaggaaggggtggtggtgtttgygtagggggagygagggggagtyggatttaattttttattygttttttttttttttygggttattttttagaaagttgtatyggtgtggttaygtttagygtagatatttygggyggtttgttagtagatgtaggggygaggaagygggttttttttgygtggtygttggtygygggggaatygttgggagttttgttttyggtttgyggyggttttagaygttgtatygygtygttttayggygttygaagagtttttagaaataygatggtttttgttyg

SEQ ID NO: 6226 - DNA, 1439 bp, Artificial Sequence
  Description of Artificial Sequence: Synthetic polynucleotide
tygttattatygttattttttyggaattttttgggttygygttagttttatttggttaygattyggtaggygaaggggtgyggaggyggttttattagttygtttttagttttgtttygagagagaagttygttgagagggtagatagttgagaaattygattttaattttttagtyggygtttttygaatygtttygagagtttagattagtygggtagtggatttyggagtaaagtgttatgtatattttggagaggagggaggygtggagggaaagggyggtaaaaatgaaatgtttttaagttagtttygtaatttttttyggttygagggaygggyggagggtagaggaggtagyggyggttagygygaggtgagggatttatttgaaggtgaggaygtagagyggtyggtaggatttgtggttggtgttttyggttatgtttttgttttagaagtygttggtgaagatgttttagyggagyggggygtygggtygtaygtyggggttgtttaygatygtttataygtygtygtgtaygaattygttttgtagggagyggtygtagtataggtagtttgtttyggttagtagygtygyggtttyggtyggygttagttygtagtttygtygtygggagggtgtgyggttttygtygtygtttygggtagaggtggttattattatygygtygtygtygtygttgttgttttggtttttttygggygtttggtatttttttttatyggggtttyggyggygygyggygtttgttyggaggggggttygggtatggtgttgyggtagttggattygtygygagtttttygygtttygtygtygtttgygtygyggagttggtttagttgtaaataaatagtagttttttygtttttttyggttatygttatttttttygttttattgygtatgttygttygtttttttttttatygttttttaatttygggaygygggtyggttttttygtatagttyggygttttttgttttyggttygttttgtttgtaggtggatyggggttygyggygygyggttgttygggagttgyggggaaggatattttaggtttttatttgyggtgttyggttgtgtttatttttaygttttygtttttatttttttttttygaatggggttgggaaggggtatatttggyggatttttttygggggatttaggagggtttagtaggtgygtagtttggaatttttatatttattttttagggagaaaagtgtygttgtttttygggaagttttyggttttttagtattygggataatagtagyggygttyggagagaygttttttattygtttygygttygygtttagtygtyggttttgtgtttttttgttygggtttttttttattygttyggygyggygtttygtttggyggaggaattygyg

SEQ ID NO: 6227 - DNA, 1288 bp, Artificial Sequence
  Description of Artificial Sequence: Synthetic polynucleotide
tygataggttgtagtygygggttatttyggaggttaaggtagttatttttgtaagggagttttgygtttaagtatggtttgttygtttygtttggtttttattaataaggtygggattagyggtyggtggaaygagygagagtagttttagttttataggtgagtygtttttataagtagttaagtygygagtygtttyggygtygttatygttygtatttatttttttatttygggagggagatgggaggygtgggagaaygyggagaggygyggygaggttgggagygggagayggygtygggaggygggaagyggattagagaatgggagaagttyggtaggtggataggaggaaataaaatttaaaygttttattttygaagtygttaggagttgagygaaggaaggagygaggtaggaaagygtggygttttaaatatgtygygggagyggygygggaggygtagaatttyggagtttgtagtttagygygyggggttttagyggagygygaggaygygagyggagttttttyggttatttgtgttgttttygttttggttgtttttgtttygagggaagatgttygagtattttttttattttatttggtyggygaagtatagttyggtgaygatgtgtagagttttttggtatagattgtttatttygttttttttgtggaaatttatygtttggtttttttttygtttttttttttttttttagttagtygttttttttttttttygtatttttaatttttttggygttttaagttatagttygttygyggtgattttggttggagattgygtygttgagagtyggtaatttttaggagttttaygttggttttatggygggagyggagggygtaggggaaggagaggygygygaggaggttgyggttgtygygaggtttgygttaattttttygtygygygagygagtygaggygygttggaattagagattyggtatggagtgttgaggggaggggggagtygtaaaaaagttaaagtaagttttygattygtaagtaygttttttttttttttttagygtattggtgtttttggygggtgtttggyggygaygygtttaatygtagttyggygygggygttaggtgataggyggyggagygygtagattyggtttttygygttttttgaagaagggattygtgagggagggagggagggagggygggyggttyggygtttttgtygaggtyggggatgtttatygttgtttagagttggttygaggagtttttttyg

SEQ ID NO: 6228 - DNA, 1006 bp, Artificial Sequence
  Description of Artificial Sequence: Synthetic polynucleotide
gygygtgaagaatttagattttttaatgygtatattatttttataygtagggtygaggyggtagygyggttyggagggggttyggagggaggggtyggattygtttyggygyggtttygtyggggaattagttttygagtygaataaaagtagttaaagattygtatattyggtagaaggggggyggttttaagaaagttygggttggggyggtttygtattttttygtttttttygtygttygaatttgttgtaaaggtagagataatggagaaagtttygggagaygygyggagagattgtttttttggggagggaggggygggtygggggaggyggggtaaggaggagggaggggtygtygagggygaggtyggygtttagygtyggtttttygtayggttttttggatgttaaattyggtttagggagtttaggagtygttgtagttttagtttttttttttttttttttygatgattygggtaatgttaattttttttygggattgaaagttttaaatttaaggtgttaagttgatgggyggtttttgtttttatttttygatttygggygygtgttttgaaagataggagagaaaaaagattatttagttgtaggaggtaaggttggagygagtagygttygtttgttttttaagtaaaggagggaagtttatgtgtattygtgtattgggtttyggagtagtttyggggtgtagggtattttttttttagggygtgyggaggaaggttattaaaataygttgtattgtygaggtggagttgggtaaagtaggtagagattggtggggayggatggygagtttgggaagtttygggtgttttggtggagaggttttttgtygggggyggggygttggagagttttttyggygyggagagtttttygggygyggagagygtagagaatttggttaggaggtgttggatagtttyggaattygygygttttttgttaaataaagygtggagattyggattyg

SEQ ID NO: 6229 - DNA, 1185 bp, Artificial Sequence
  Description of Artificial Sequence: Synthetic polynucleotide
tyggttttttttgggygtagtgygtatygtyggygtttttagatttttggattattyggtttgggggygygggygyggttggggagggaggggagagttggtttatttggygttgaaggttggaaggtatagtttyggtttttyggagttyggttyggtagtttygtattgttygtagagggattgagtatttgaaaagtttatygygtttygtagggygtttyggyggggttaatttgttyggttgyggggtatagttttaggggaattgggttagtaggtaggggtyggagttgygygttygyggtggttagggyggtygtygggtygtggggygygggyggttgtagtttgggygttggggygttttygattygtagtaaattttygattaggaaatttttgtttaggttgttaaagtygggygtagyggggaggttgaggagygyggaggaagttataaygttttagtaygtatyggygtgggttgygatygygttggggagtatagtgyggygttaatyggtttgttgygygttygttttgygttygtttgtygttygggygtttygtatygtatttagagtygtagtttttygtygtygtttttygtagggttggagygygyggagttaggtagggaggaaaggttattygggayggyggyggatttggaaygatattatttatttgygttgggygtttttttaagggatgggaggagtgagtgtgggagggggaagttgtgagtttttttggtygatagygtaggttttgggagygtaggggggagtttttttttttttttatgtagatttggaygggttttttttttgttttttgtttttttttggayggayggaaggtgtgtttagtttatttatttatgttattagttttataaagtgatagaygyggttaataataagggtagtgttgtggtaaggggaggggattygtagtgggaggaggtgggygtggaggygaygtgaatygggygygttygttattttttygttgtygtgtagagtygtggtattttygttagagtttaagtagttttttaggygtggggtttggtggaygttggtttggagygttyggagggyggggtgggggtgggggggaygygttgtygtttggggtgttttygygtatttttgttgggygaattttggtttttyg

SEQ ID NO: 6230 - DNA, 409 bp, Artificial Sequence
  Description of Artificial Sequence: Synthetic polynucleotide
tygtttttyggggaaggggtttttgaggttygggtggtygtttgggtaatygtagtttgtttgygttttttttttttttygygtgggttttagtaatatttattgtagtygggttaggygagtyggygygtattatyggygyggggggaggagagggtygggtttgggaagatgttgyggaggaygttgyggattygygagttyggggtaaggyggyggygtatygttttttttygtygttttttttttatttygttttttatygtygtttttagttttttttygggatgagagagagtygygttgyggagtaattttagtggatgggttygygggggttgagygggyggaggaygygggaatttygtgatatygattagttgaygttgttygygtgaaattagagtyg

SEQ ID NO: 6231 - DNA, 1813 bp, Artificial Sequence
  Description of Artificial Sequence: Synthetic polynucleotide
gygggyggyggaggagggttggyggttagatatagtatygttggagtttagagagtygggtagaggttggyggagagtygaggttggtttagtttttaggagatyggygagttggggtgtgtgggagygggatgtttttaaggygaaaagaagygttagtttygtaagyggtttttatttgggttgtttaggtyggatgtttaggagtttatagtaggggggatggagygaaggatygaggggttgggaggygaggtygtagygtattgaygtaggttagygaggtygttggtttygaygtagggygttyggtaaggtgtttggtattaygagagttaatttttgygygttattttyggaggttagtgygtttagggygygtyggttyggtaggagggtgggtgttagtttttttttttatttttygagtttttttttyggygtttaygtgggyggagtagygygagggtgtgygtggtaggggtygyggyggygtgtgtygtgygtggggtggggtgygggttgggyggtttygttttygggtttygygtygtyggggygyggtttttagttttattttttttgttatttgggyggagatttgggggattgtgatttattttgyggaagatayggaggggaygggtyggttatatttttygygttatttyggtaggtatygggtgggtttttttttygttttttggtttgagggyggaattyggagaagagtggaaataggggtggygtgaaggagagttgggggttgggggygggatygggagggggtgttgggggaagygaygtagyggttgggagattttgtaagggggtttgaagaggagtgggggatgggtatggaagggtgggggattattgaggtgggatgygagagtggaagggggatttagagggggygygatggtyggaggagggggagatggaygatggggyggggyggtatyggtygtygygttttttgtygttaggttygtttttyggtygtygggtttaygggttttttttggttagygttygtttttygtttttyggygtatttgtatttatttgttyggygtttaggttygagtygggtagtagtagyggaygtagygagygtagtttygygtygtatttttyggtygtttttttttygttgygagtttaygtygttgtygtygtygttatygttttaaaaaggataaaayggaatagaaaatgaatgtatgtataaaaaaaatygtaaaaagtaattgaggaggatggtagtygygygygyggttyggyggggygggagtygagaggtygyggtattggtggtygygattygggtaggyggtyggygygtgtygtaygygggtggttgtagttttttyggtygttygygttyggtttaggtayggtatygttttttttttyggggagttttttygattggtttgtttttttgttagttaggtaggagggygyggygttygtttygtttygttttygttttygttttgggtagatgtygggagtttttttgtygtygtgggagggggagttgagttgtyggagygtgygtattgggttagygggyggtyggggtagggttggggtttyggygttgagygtttttagtygygtygggtagtttggygtttygttgagtyggagtaattttyggtaggagtttttaggttttggttaagtttygggattygggaagttatttttgttttygggggttygagtttggagtggggtttgtaggtaaagyggggttggggtygttttggtygttagtggttaggaagaygtagygatttyg

SEQ ID NO: 6232 - DNA, 1294 bp, Artificial Sequence
  Description of Artificial Sequence: Synthetic polynucleotide
aygtttttttyggatgygygtggagygttttataggatygtygttttttgygygttggygygtataygtttttygttagtttgggygtygggtttygaattttyggtttgtaaatttgygtattttttttygtygygttygttagataatttggygaatagttygttygttygtatttygtttttttyggttttttttttaaattttaaaygtatygtygtgttttaaagaaggtgtttaygtygtttttagatttyggagygttttttttttattttygggattttttaggtygtttatttttttygtttttygtttagatttgagagggatygaaaatatattttygattygggtagttagggtygaaattgttaagaggagaaaaggtaaagyggaaggagggtggttataaatagatttttttgtttttttttaaaaggatattgtygttttaaaagtttttttttygggtttttatttttygtattttygtattttgggggagygtatttaattgaggtaaygtagtttttttttagtgtttgtagaaaaattaaagttaggggggtgagttygtyggttgttaattttttygtygtttttttygttttattttgttttygtaagtygagaaygggttgtaaaagtttgtaatatttttggggggyggaggggggaggggaggggggtttttygggttyggggygtygtygtaggttygygygyggtygtyggatttygygtttygggygttygttttyggtygtttttygtttygygttygggttttygtygttttttttttagtttttttttagttttttatttttgttggtgttggaatagttttgtttgygtatyggggtaggyggttygtttttgygggyggatttttggtttagyggggtttttttggagtyggyggtygygttygygtygttgttgtttggttygttggyggyggggtygggggttgtyggagttgattttatgtttttttttaatgtagagatygttggagatggygagtttygagattttttttattttttgtttttagagtaattttatggtattaaaaaaaaaaaaaaaaaaaaaaaaaaaaaaaaaaaaaaaaaaagaaggagaaggygatyggygaaagtaggagggaaaaagtaggyggyggygggygggtaagtaaaagygygagggagygygyggagtgtttgggtggaygtgtgtgtgygttygaaaggggataagaggygggtttggttataggtagygttagygagagtttttttagtyg

SEQ ID NO: 6233 - DNA, 939 bp, Artificial Sequence
  Description of Artificial Sequence: Synthetic polynucleotide
tygatgtygagagtggttttgttggagaatygtygygtttgtagtttttgtattttttttyggagttgygttagggaattayggaygaattggaaggggtygagaagaaaggttttggttattatttttagttttaagttttttygtttttttagattttggatttttttyggggaggatttttaggagttttttggtagtttttygtygtttagggtygatttttttatttttttttttattttyggttttygggygagggaggtttygygtygttttttagattggttgyggtyggaagattgtagtygttttgagtttattttttgtttttttataattaaggagtatggtggagttgggttaattttaggtatagtttagtygagttaggygaggtttagagagatttgattygtttggtagttttaayggatttgttttygtagtygttgyggatttttyggtygttatggygattgtgaaatgtggggtggggygtatgygttggaagttattygygygggtagtttttgagtgtttttttaygtgttttttagygygagtagtattttygtttttgygttttttagagygtgtagttttyggtgagggtagttttaygtatagttttttatattttttttagygtttgtagttttyggtgygygtaggttttaagtttatatgygtagtttttattttgygygtagttttatgtatagtttyggaygggtttttagttttattggygtagaatttattatygtttgttttttaygygttttattgggagtgtagtttttatttygagygygtagttttaygtagtttttttatattttttttagygtttgtagtatttttagtgygtatagttttgttagtygttttttygggygtygtttttgtattatttyggtttataattttgyggyg

SEQ ID NO: 6234 - DNA, 939 bp, Artificial Sequence; identical to SEQ ID NO: 6233
  Description of Artificial Sequence: Synthetic polynucleotide

SEQ ID NO: 6235 - DNA, 899 bp, Artificial Sequence
  Description of Artificial Sequence: Synthetic polynucleotide
tygaaygtagttaygygtttattggttttttgtttttggygtttttgggtaygggggagttggggyggtttygtttgygtayggyggtgtygggattgggggygggtaygtygttttygttttttaygygttygttygttygttygttttygtttttttygtttygagygattttttgttttagttttgtaggtttygtattgtagatgtttgttggtttttttgygttyggyggttttygyggtgtttygtaagttttygtgattttttagtattagtyggttgtgygttttttgtttttaygggtyggttagtygtagatatttatttagtttygygagtttagtygtttagygagtggggtagyggggatygagayggayggtagtygtgttagagttyggggygttttyggatgyggtaggataagttgatygggtttttgaggygyggggggagatgtttgaagyggtagggyggyggygtgggtattattttgagtaatgtgtttaagaagygtagttgtatttttyggatygygtttyggttgttgtgtattttggagtygggtgaggattttagggttgtagatggggygttgtaaagtagygtyggggttgttygygtttttgttttagtttgatttygtttaggtyggggagttttggggaaagttygygtgttatttggtgyggggtatygygttggtatttgtagggagygattggtttggaagggtagagggtagaygggggtttgggtggggtagyggttattttaggygyggagaattygttgtttttatttttttttygyggatttttattttgyggtttgtgtgttyggtttttttygygtggyggggaagtgygggtggttgttygggtttttagaggtyg

SEQ ID NO: 6236 - DNA, 899 bp, Artificial Sequence; identical to SEQ ID NO: 6235
  Description of Artificial Sequence: Synthetic polynucleotide

SEQ ID NO: 6237 - DNA, 547 bp, Artificial Sequence
  Description of Artificial Sequence: Synthetic polynucleotide
ayggtagatttyggagggggtgtttaggatagtgayggttgatatgaagttagyggtgagggatagygttaygggtattgyggttattttgyggtygtttattaggaagtttttggaggtttgttggtygtttttagygaaggygtagtagatgtygatggyggtygagatgattagtatgttygygaatattaygtagttttatattaygaaggtgtygatgtttygtggygtgtttatggtygtayggtygtttgagttttgygygtaaattggtggtttygyggygygtagtyggagttyggygygtattttttatttyggatttttggygygtaggygtggygtttygyggggattggaggygttttttaggtgtyggttttygaaygtatttygaggyggggtgagggttggtagtygtttttgtattygtygttgygagtygygttttttaaatttaggtatgggatttyggaaaatygattygttgttttgagtgtttattaygtgaggaattggagtggtygagttygttaaggygtyg

SEQ ID NO: 6238 - DNA, 2505 bp, Artificial Sequence
  Description of Artificial Sequence: Synthetic polynucleotide
tygagttaaygygttttagtggtaggtggygaatggtyggagattyggttttttagtggtgtttatygttaygggttttygttygataggtttatttttttttatgttggagtaaatttyggttgaaagagggtygtattaattggtttgygtattygaagtgggaatagagagggaggaaaattatgttttaggtgttayggggggaaaaaagtgaaatgygaatygtaggggagagagygatygttaggtagatattttgtgaatygyggtggagagtatatttaggtggggaggttatyggtttaatttattatttttygggagaatgygggtagggatagtagtagggggtagtatttaygtttttaygtttgtaagggttttttaagtttttggttattgttttttattttttgtagtttyggtgttygtygggggygtgtgtgaggggyggggtygtatggggaggagggatttaaaaaaaaaaaaaaaaagygaggtaattagtatttttygattttattggtttttygtygtttttgttttgtataygttygttttattggttgttyggggtttgttggggttyggtaaggtttgtagtygttayggtygttgttgygtttyggtgtagggtaggttggygtygagygaattagggtygggaattgggagtygggagtygggagttagttgttygyggagttgyggyggyggyggtatttggggtggttttagttttaygaatatygtggtyggygttyggtggttattgygtttagyggggtttagggaagagyggtttagatattttttattttggaagaaaggggtaagtttyggygggagtttttttttyggtttggttygttttttattgygtttagtttyggttyggattttggaagatgattttagggtttgttttgtatattttagyggyggtagtttygggaggtagtygaaagtattaatagttggtagtagyggttagtggaaaagtgagttaaggyggygyggattyggtttttttygygtttygyggtattygttgtttttygtygttttttttttttggtttttaggyggttgtagtatgaagtggygtagygatggttaggagaggtaagaagttygtggtgagaaygttggaggatttgaygttggattygggttatggtggygyggyggattyggtgygtttttttaatttgtttttgtgttgtttygattygtattyggygttttygtatggygggagttgttggtygtttttagttgattttatgtatagtyggtataatagttttgatattgttaatattgttttggtggaagatttygaggggttggattgygtyggttagtattgttygyggttgttgtyggatttagaygaggttttttggattttttaggagttggaggygttgttgttgygttygygggattttygggtaggttyggyggttttyggyggtttgtttaaggaygygttggttaagttgtygaygttggtgagtygggygttggtgygtatagttaaagaggygtagygtttgagtttgygtttygttaagtgtattaagtaygagatttagagygttatggagatygtgttgttttggggtttggtygygtattgtayggyggttgygttggtygtattgtttttttataatatgagtagygtyggyggygatygtttgggtygyggtaagtyggttygttgyggttttatttttttygtgggtygygtgtatygttggatggtggatagtygygtggygttgygtatttaygagtaygtygttatttatttgatagtttgtatggagagtttttttygggatatttattygygggtygtggttttyggggtgtttyggagttgtagtggttttgggttaggttygggtttyggtttaggttygagttygggttttggtgyggttttygyggyggataaagagygggaggygttygggggaggagyggygagyggyggygtttgtagygtagttagtagygttagygggggtagtagttgttgygtttygtyggtygtygyggtygtygtagtttygtyggtagtygtygttaattattattattattattattatgygttttaygaggygtttaagtttatygtggagattttggagtatayggttaataaygattyggagatttggggttttttgtagttttattagtatttgatttgygggaagaaygttagyggtaagtgtttgygygggtgttatttttttttatttaatttggttaatttttggygtaagtttgtttygygtttttttttygygtttttttagttaygygttgttgttttaagtygttgaggaggyggtygggttggaggtagttagaataagaggttgtttgtttgtttttgtattygggtgygygtattttaygttgttggtgttgttttaggttygggagygygaggtttygttttyggtgyggggyggggyg

SEQ ID NO: 6239 - DNA, 1587 bp, Artificial Sequence
  Description of Artificial Sequence: Synthetic polynucleotide
gygygtttygatagtttttaagatggtygttaatgtgggatygatgttttaatattggaagygatttgatttayggygattttaggttagtgygggtagygtyggtygygyggtygtgaggagttttygggygygttttgggygtattggggaggttttygggygggtaggyggaygttttggggyggygggyggyggttgtyggggttygtyggggttyggtygttygttgtttatygataggtattaggaattgatttygtygttgttttttgttyggtttagttatygattagttgtygygattatggagaagygttagtgagttttyggtyggyggagyggtygagyggttaggyggtygggygaggagyggggaaggtaggggttayggtttygggtagggggttgttggygggaattttyggyggttttttttgagtygtattttgygygttttttaatttygyggygttyggggaggtygyggagygygtygtttgttagttygtattyggttggggtttyggygagggagggagggagttggygggtagggaggaggaggaggagaggaggaggaggaggagagaggaggagggagtyggggttggygaggaggyggtttygygtttygtygttygtyggtattttagttttygtygttygtttggttgygtagttyggaygygtygttattygggggtygtygtygtygtygttagagtygtygtygtyggattggtygtaagygtyggtagatttttttttttygggtyggggttttggggttygttttgttttttgtttttattttttygttttttttattttttttttaagtttagatgtagaygggyggtggaggtgggttygggygttygtaagtttgygtttttgtttttagggyggtggagagtygggagyggygtagagtaggtgatttttagttttygggtttaagggaatttttaaatgagagatttttttgtttgttttgttttttgygttttttttygttgtttttttygttttttttttttygtttttgttttttttttgtttttttttttttttttttgttttttttttttttttttttagggygatttttygaaattttattattttttttttattttttttttgtgggagtttgtgtgttttttttagatttggaggtgttttttgyggatttygtaggagtyggggttgggaggtggaattttagagaaygtatygtggaggygyggtttyggtttttgttttttttyggagtgtttyggaygygtttggtaaggttttttagttttggagtttygtaaagtttyggygggtgyggyggggattaggggygggaaaatggtgyggataatagggyggttagagtattttgttttgatygtgatattygyggaagaygygagattattagtttggagataaaaagggatttatttttttttttttttttaattygtyggtaaatttygttaagttttttttgataagtggttttagtattygygtttttttttygttttggtygttttttagttttygttttttygaaygttttatttttyg

SEQ ID NO: 6240 - DNA, 5693 bp, Artificial Sequence
  Description of Artificial Sequence: Synthetic polynucleotide
tygyggttgttgggagagtattggyggtgggttgaggtttttggagagttygyggggtggagatgggggtyggttttttttyggygtttagtygaggagtagttgttagttgagtgyggattygagagagaattttygagggatatttaygttttttatygygtttgygtygggygttttggttttaggaggttgtttyggggyggggttttygggggtygagygyggggggyggttyggyggttttattatayggyggtttygttgagttyggggttgggatgygataggggttygttgtagtygttggtgtygtttattgggaagggygggttgggttygtygttgaatatttygtygggtatggggtgtagygtgttyggtaggtttggttyggggttyggtgtgttygggtgygagattatgtyggtgaatttggggttgttygyggygtgygggtyggygagyggyggttttagygtttttagyggygtygagtyggggttagaggtygttaggaagttggagtyggtyggggattgygtttgygaaggygggtygtgygygaagaagtygtagttgtttttyggygygtagtagtygttttggtagtttgtggagggggagygggaaggagatagggygyggtgagagaaggygaagtaggygggggattygggattyggggaggggattygggygggygagagaggggagygygygatatygatttaaggttagagagatttgyggaggtyggygttttttgagayggtggaygtygtaggtttayggggagggttggggagagagataatgagagatttygaaagggtaagagatttagattgttagagattatatatagagaygggagagatttygagatygtgggggatataygyggtaaaaattyggagattttagttataggttttttgatatttagagatggagagagatagaggyggttagagaygtagagatagataatgatttttaagtgttttagggtyggtgagagatatagagatgygggatagygagagatagayggagagatyggtagaggggtagagagaaaggyggaaaagagatttagagatgyggagttygyggttgagattygaaagttygagatatyggagggtygyggaggagtygaggagaygtagagagaggaaagayggtygyggttagagataygygtggaaattttygggggyggtagygagggagttaggagtgagttygaagatggagagaagtygatgygtttagagaaygtaagayggtggattagagatgagttttaggaatttttagagaagyggaggttgataggttyggggagaggaatygggtagggataaattagyggatagagtagagygygaaatggttgagatygggaagygatttggtygggggaaattggattygggtygyggtaggagygattggtgggttgggtygggyggggyggttttggygttttaaattyggtttttgygttttattaatttagtttaagtttttygtttygttaagtayggtygtygygtygatttyggtgagattatttgtatyggtttagtttagtttgagaaagagaaaattgagttttagygatttgggagagggggaggaggataygaagattttttgggttatggttagagtttygygggttttttggggtagaagttyggttttttagttttgtttygggttggttttgttagtatttttaggttttgaagtatttgaggatattgagattttttgagaagttggtgatagttatgggtttttttttaaggaaaatgtaaggatgagaattttgtttataaatttaggaggtgtagggatttyggattgtaaatttattttgttttaataaatttgtattaattttttgatygttttatatagttttttttttagaattttygggatattttgtttttttttattaggtggggttttgaaggattgaygtgggggaygttaygaaaggattattttgtattaggtattygttttgtayggygggaaaattagygagtttagaagtttgagttttttttgtaaatttattttttttgttgagttttgggattttagttaaggggygaatttttgatgttttttgttatttttttttttttttaaattttgaaatttgtttaaatggggggtgtttggaggygtggtttggaggtagtttaagtaatagttaaaayggttgttaattattttttaaaattattaatttaatttttttygaaagtgaaggggaagatggggagyggtaaatttggagttttaaagggatagggatgggagayggtygyggttygyggygagtyggaaaattagygaaggtygttgttttygygtygtgygygtygttttygtttatatggyggtygggtyggaggtaattggaataaaygtygtttgaaaagggtataaaagtygtagttggggttttgttygygtttttayggggagtygtyggtttygtygttyggtttttttttygttygttgtyggtygttatygtygggattttttagygyggattaggyggggttgtttygttgggggttggggagttttttttattattayggggaaygaggggtttttagtatttagttttttattttatttagygygtagggagaggaggyggtgggataggtyggggygggggygaagtggttttyggggaaattttggttaattatttaggyggggaaaaatttygggtyggtatygtttttattatttygttgtttygggtttagattttgtagggaaagaggtaaatttaggtggagagagtyggtgagtggagatttyggaagataygtttattattygggttttttagggttgggggtttgttyggggttgggggtttgtttagggttggggggttgtttagggttgggyggttggggygttttagtttgagttttgttattgtttggggtttttgttttgaaaagtatagtttggtattttgtttataatttttaggggtttyggttyggttttaaggtttaatttttttttaggttttyggatgtgttgaggttagtgatggggttattttttttttttttttgygtttatttgggtgtttagtttttgttttgttaatattgttattgaatttattttttaagagaaattgtttttttttaatttgygttataatttagaagtgtagatgttttttagatatagatagttttggggtttttttaaatttagaagttttagaatagaagaggagaggtgtttttttgagtttttagttttgggaagaataggatagtgagtttggtgagtttaagtaatgyggtttagggtaaggagttgaaaaaatyggatagggggagttgggatggtttattaatttagtgtgagggaagtgagaggaggaaaagttgaggtggtaaggggatagtttattttaggtttaagtttggtattattatttgaagttttttgtaaattggggtttttygttttttgtagttttaaagayggtggaaatttggggttggtttaatatttgtgtttttagtttgtaggaattttaggggtttyggggttggagggtggattatagttttgtttagagtaattgtyggtatttgggttaatattgttagatgttgtgygtatatatttygttatatggaataggagttgttgttttygatgttagtgagtaggyggtttggaatgaatttagatttttattttttttttttatattattttttagygttyggaatttattttatgttaagtatattaggtatagggyggtaggaaggttgtgygtttgttygtgggggtygtatgtatgtggatttgttagtattggttttagtgtgattggtgggagtgtgygygtttgtggagttgtgttttygtgagtgtatttgtgtgtgagagggtggaatttatttataygtgatygtgygatygtgtttagaygtgtgtttttggagtttttgaaygtaagtgtgagtgtattttgtgttttgygtgggtgaatgtgttattgtatttygtgtgtgtttttgtgtgtattattgtatgggtgagattatgtatttgattttgtgtttaggatatgtgggtgagtgtatatgtgtttgtgatygtgtgtttagygagtgggygatgttttggagyggyggaaagygtgttggtygggatttttygtttttagttttyggaataggataggtgyggaatagygaatttyggggygttttttattttygtagtaggtgtayggggtggattttaatattttagattygtttaagyggtygtttagyggaygtatgygtygyggatttyggaagaaggygtgttttygggygtttagggygtttagttgttttattyggygttttttggatygtyggttttgaaattatatttgggatagaggagggggttgtgaatttaggattaggagtgttttttttttttttttttttttttttttgattgggttgtttttgttgggtttttgygtttttttygtattaggattttttygaggyggggtygggtyggattaggtygggaggggtggagagaggtttyggygaattagttaagggtgaaggatttygyggattygtggggygatttataaagatttgggttttttggttttyggttygttygyggtttgayggttttataaaggtttttttttyggtayggttttygtttyggtttttyggtttyggagttagtttttggtygtttgtttgttygygtttyggygtagggagggagggggtatygtttgtttttttgttygaaaggtggaggtaaagagggatttyggattttagagaggtttataattttttataagtaaggyggggggyggaatttagagaggtaaagtgattygtttttaaatygtaatattaggaggatagtagggttagatggaatttttyggtttatagttttygatttygggtaagtgttttattygggygtayggtttgtttttagattagaattaggygygttygtagttaaggaagtttggygggagattttttygaggttttyggtttttaggttagyggggttaaggagttgtgttygtttygggtygtatttggatgaygygtatgttgaggtyggttttttgygttagttgttygyggatgtggygygtgggtttgggygtggyggygaaggtagttttgagygtttttagttgtttggttttgatggtggtgygggggtygygtygtttggtgttygagttttgtttttygttttygttgttggtygtttttttgttygaygaggtygagttgttygtttttttggggtygttttgtagtgygttttggaggttyggggataaattgyggttygtataggatgatattgygggyggayggatygggaaggggatagyggygttagygayggttagaygtttttttagtttagtggygggttttygtyggtttaagttayggtttgtttaggttayggttagtttygttggatttttttttaaatttgygatagttttttttttagggattyggtgttygtttattttttttaggyggggttgggtttttggaggggygtttttaagtttttttygygyg

SEQ ID NO: 6241 - DNA, 589 bp, Artificial Sequence
  Description of Artificial Sequence: Synthetic polynucleotide
tygtttygttttyggggttttagggaggyggygattggagtttygttgtttatttataataaaagaaagtagggttggygtttttataygygtttttatttattgtyggtygyggggagaattttatttygygttttygttagggtttyggggagttttgggttggyggaggygaataagatgyggtttgatagaattaggtygtgtttttgtaaattttaatgtygtttygttagtygyggyggttttttagattttatttgtyggggagtttygagtygygtaaaatttttgtaagttgtgttttgtagaatgtaaagtygggttggaattygttattttygtygttttagtygattyggtygaygagtttttttttgagtttttygggttatttgtygggayggttatttygttyggtgaagtyggtgtatttattatattttttgttgtttttagtagggaagtyggyggtgaggygggggagtaggtatggtggtttyggggtttatgyggggtttattgtttatttagaatagyggttattgttgtttattagggygtatttatygttggagttttygyggyg

SEQ ID NO: 6242 - DNA, 1294 bp, Artificial Sequence; identical to SEQ ID NO: 6232
  Description of Artificial Sequence: Synthetic polynucleotide

SEQ ID NO: 6243 - DNA, 1373 bp, Artificial Sequence
  Description of Artificial Sequence: Synthetic polynucleotide
gygagygtttggygttttttggggygtagtttygagagagtttttttygggatttyggaygtaaggtttttgagtggttttggaagttggatttttyggggattttgtttygaattttggttatttggaagtaattttatygagygttttttttattgtttagtttygaatygtggyggaaygygtttttyggtttttttagagttttttttgygggagaagtataatttttttaggttttggagayggygtttttatattttaatttygtttagayggaagaagtgagaggtgygggyggtttygttatgatygygggaggagagygtaaggaggtttttygtaaagttggaggttaggtyggagygatgtttygggagyggagtttttttagtttygggtttttagtygyggatagttggtagtgttaaagatttygttattatttgyggttygtagttgygattyggtygtagagtygggtatygaggaaggygtaaagttgagtttgggtaggtataayggtttttagggattggtattttttagttygggttgttygygggagggtagygagttgtgttaagggtttygttattatygttagygtatagttyggagttaagygygyggttgaggaaygattagggttttgtaaagttggagtttgggygygtagattttyggatyggagttttyggtttgaggtygttygttaggaggaaaatgaggtygttygaattaagttgggaygygtagtaaagttygagtttttygygtatattaggggttygggygggagyggggagttttggggayggagaaggggygygggaygtttggattaggaatttatttgaygtygagtygggtagygtygaggttgttttttygygttgygtattygttygttygtttygtattttttttttttttttygggygttygyggtygtygygtttygggttttgaatttttygagttygtygtttygygyggttggagggygtyggttgtatttattygttttttggtaggagtygygygygtttttttttttttttttygttttgtgtttttaagatttttttttatttttttttttttagtttttattttttttttttttttttttttttttttgygtttttttttttagttttagygaatttaagttygggayggaggttgygggttttttyggygtagtgttgggygtttygygygygtttttggtttatttygttygttyggtygttgttygttgttyggtygtttttyggaggagtygyggygttaagtagttttttatttagyggttggaaaygyggtataaatatgtagggattgagtygtgagtttagygagggtyg

SEQ ID NO: 6244 - DNA, 1524 bp, Artificial Sequence
  Description of Artificial Sequence: Synthetic polynucleotide
gyggttttgyggattttaggtttaagggggtatygttttaaatattygaygygtttttattattagttttttattggtaggttttaagygggaaygggattgggaaggtttygggtttggggggttttatttygatgttttaggggygttttgaatttagttttagttaggyggyggtattttaggtagygtagggagygygatyggttyggggagggggaggaygyggygttttygttttttttyggttygtttgtttatttttaggtttttttgttygtyggttttttggttttgtttattttggggttggtggtgggygygggtygggtttaggtttatgttyggttttttttattgtttgttttttttttttattattttattttatttttttagtgttyggtttygtttygttatyggattttttggaatgggggaygygggygygaaataygaatttagttatyggtagttttttttttaygtgygttyggttygtagygtagagggyggttyggggtgggggygttttatttttgttttttatggygtgtaygaagtttttttggtatagttggttgygaagttttttttttaggttgaagtygyggaygttgaygattttttttaygttygataagttttygttttygtygtatygttggyggttaatygggygttgygaggatttaaattagagagttygggatattattgtgggggttggaggtygttttttaatttgggtttagtattaataggtgtagtagtygagygttttttgtattttattattgtaatttaagtaattttgygtaattgttaaagatgttgaaaagtaggataaggagaggggttygtatttygagggtttagttgygttttaygyggggtattttttttyggtgttttyggaagtattgaagggatatttggggatttttttttgtttttygttttygaaatgtgttgggtttygtttattyggtygggagtttggttatgtaattygygaagggggtttyggataygggttggyggggtaaatgtaggttttaggaggagtygttgyggygttyggttyggyggtaatagtagttttagyggtygyggyggtagagtygggaagtyggaatygggggtyggyggtatttttaaagttggagtygttttygagttatyggggaagttggaaagttgaaatggaagggttgagattttagtygttttygtygttygttygttagtgtaagaagaggaggtggggggaggagaatyggggtttggaagggggagaggtagayggttygttataaagttyggatyggagattttaaaaygtattagtagttgttttatttttttataagygygygygtatatttattttttaaggagatttttttattatttttygtatttttttgttttttttttttatygtttagygttyggttttttagttttttagatttygggygaatttygagttygtttagtttttttttaygttttttttyg

SEQ ID NO: 6245 - DNA, 1009 bp, Artificial Sequence
  Description of Artificial Sequence: Synthetic polynucleotide
gygtttgtagygaaggattygygtgggagygagaaatgtttttgtttagtgtttygygygttggatygygggggygagtttgagggtggagaggtygtygggtggaggygygtaggggtgygtgggtgggtgyggaaggagtgtagggtatggaggggaattttggggyggygygaaggaggagygtttggaaaggygyggtgtttggttatagaggggttyggagtgggagtgtaggggtgyggggagggagtgtagggaygyggggagggagtggaggggtggggaygtgttggaggggygygtttygatagaattggagaaattggaaaagtggaggggyggggtagtggttggaggaatttttgaagygaygyggggaatatgtgaaggagtgttatgttggaatttggaggggaggggggatgttggagaggtatayggtgatggatatggaaggattygggaggtgtggagtggtgggttyggttygtygygggaaggatatagagggatataggttgttttggagaggygttttyggatatttggaggggygtatagtgttgggatttggyggygtttggggyggaggggygygtyggatttagtygggygygttygggggtygggygtagtgggagttgaygggygtttagtyggyggygttttgggttyggttaggygtaggayggttttggtagyggtgtagtagtttaggttagtttttggggggtttttggttttygttttttygygygtttyggttagtatygttyggagttygggyggggaagtgggygttygyggtttgggaagttgttttttygttttggagtagagtygtygttgyggtygttgaggaaggayggagtagaggttygygttgtttggggagaagattgtggtgttatttygtygggaatgaagggaaatgtagyggttgtttgygtttygggattttaagaagtatagtaggtaaagagaatagttayggttygttatttyg

SEQ ID NO: 6246 - DNA, 961 bp, Artificial Sequence
  Description of Artificial Sequence: Synthetic polynucleotide
tygtttttttygatatttaaaagtttyggttttgygtaatattgyggattttttttagtttttygttygttttttttttygyggggtttygtttagggtyggtttttygtttttaygtygtagttygggttagyggggttygtygyggtggygttygyggatgttgtygtattggtygttgyggtayggayggygtagtttygggygyggttyggtataggygtyggyggttttygttagttagtagttyggygaggygttggtttatttatggttttygggyggyggtttttgygtttagttttgygygtagttttygtttttygttyggggtygtygagttttygataygggygagatgttgaayggygtaggtttggataaagtttttaagatgtttttgtygyggaggtygaggattygttygttygtgggtgagttgggaggggygyggygagggagggtgggttyggggygggggyggygyggggygygtttgyggttatgygatattgtttygttygygtttygtttttttttttgggttttttgggttttttgggttgtaggattygtygaygyggygygttggtygtaygggggttgggygtygttgtatttgyggggttaaaaggttttaggtyggggygaggtgagyggygggygttagagattttyggttygtttttgtatagatgtgtgtgtgtgtgtgyggtttttttgtgygygtgttygtgygtttttaygygyggatgyggtttagggatgygatttaggyggtagttatygygatggtgggtayggtttggyggygtagagaagatgtagttttttttgtyggyggtyggtatygttgtgttgtagagtttaaaagtagagggggaaaaaggtattygaagggtttttygagtgatttttattatttggagtttygggttttygygygtttatagyggygayg

SEQ ID NO: 6247 - DNA, 961 bp, Artificial Sequence; identical to SEQ ID NO: 6246
  Description of Artificial Sequence: Synthetic polynucleotide

SEQ ID NO: 6248 - DNA, 980 bp, Artificial Sequence
  Description of Artificial Sequence: Synthetic polynucleotide
gygtgagygaggtaggtatatayggattygyggyggtttgtttgtaatagygttgggaatgtatattggaaaattatattttgtatgttgaaaaygaataattgtttgatatttgggttgttgtygagaaaattaygyggtagyggtaggtttygagttaggggtygttattttygatggaatatttaaatygtttatttttatygaatttttattttttaaaygtatttttygygygygtgtatatttttaaaygtattttygatyggaataaagaggggttttagatttttttygtgygtayggggtagtygggagggttaygagagggaggtgtgtgtaatggaagtatygagatagatagatagatagatgtttatgtattgttgtygattttttggyggyggggaygggagtyggaygygagggggatagatagggtgyggggataggyggttygygggggygggggggttatygagggggttattttggttygtttaggtygagggggttttttyggtgttttygaagygygtgggttattygtgtygtatgtyggygtagttgttygttgtggtaaggggggggyggtygggtttyggagygggtygggagggygyggggygygtatttygyggtaggtgagyggygyggttgtaggtgagtagtagtttyggttygygygtttagtttttttygtygygttygttyggtttataygtttttygygygygygtygttttygtttygygygygttyggtygttygttygttygtgggattttygygaggtygygygtttttaygggttagggttgttttagggtgygggtaggygagggyggtttaggggygyggggygaggggygaaggagttaggaggttgagaattgtatggtagttttgtttgtttgtygygttgygygttttattttagtyggyggtttygggtttgtatygggyggggtaggggagyg

SEQ ID NO: 6249 - DNA, 408 bp, Artificial Sequence
  Description of Artificial Sequence: Synthetic polynucleotide
tygtattttttgaagttygttgggygygttttgggttgtttttttttgagtagtygggtttagagttaaggygygatgattgtygygtaagttagggtttaygyggtyggggtttttttttygtttygggygtattagaggttagaaagyggaaagyggttttgttaggttaaggtygatagaaatygagagtatgtygttatttgtyggagagaattgttttgttaggttgttataggtgatttgttygygygagttayggtttttgygtagagtttttttygaaggggagagttagagttattygygggtttggtyggggttttttttagttyggygtttaygtttygygttttgygttygtttttgyggttgtttatgtttaggtgtttyggaagaggygtygyg

SEQ ID NO: 6250 - DNA, 2190 bp, Artificial Sequence
  Description of Artificial Sequence: Synthetic polynucleotide
gygtttygaaatttggttttttgygtttaggggaaygaggtataaattttygttatttagttttattgagtagagattgygagttygaatttttaagtttttyggggttttgattttttaatggyggyggtttaattgttggtaaaattttyggtttttgattgttttatygttygttttttaaaygtttagygaaggttgatttaggtggygggyggattttatygattttttaaattatatygtttggttaaaatygttygtttttttttygttyggattttaaaggttaggtttgtaagttagtaagttaayggtatttgggttttgggttgtttttgtgggttagggttattgatgttygygatayggattggatygygtattaygtttgttttyggtagaggttttattygggtggttgagygtagygtattggggtttygyggttygagagyggyggggaggagygggygttygtygagygtttttygggatagttyggtttggggatttaagygggttatgggatgtyggygttggtttttttttgagatttttttgttttttygtaggtaygagttttttttaaatyggttttttttttatattttygtgaygygaggtygyggttagtgtttaatattattaaagtttyggttttagtttagtttygggtagtttggtaggtttttaggagtttttgttttyggtttygggggattttgygtatttgttttaggttttttgggaatgggttttgggtgttaggtaggtttyggtgygtgttgtttttagtgtttagggtttyggtagtgagattttaattygatagttggataagggattagygattttgtygtaaayggatagttttagygyggattyggtttgagygttgatgttygygggtttaggttagttatttttygaggygttttttyggagaaagggygtagyggttttaagygtgttygttgtaattagtgttttaggttttygtygtagttagttttttygggttatagtttygttttttygygtgtatttygttttggtttyggaggttttgtttttyggtygttttatygtagttygttttaggtttyggtttttagtygygttttatttgtgagaagtagatagttgagtagygygtatagtaggatttyggtgttttagtagttgattatggtgagygygaygyggtttgttygttyggtgttygygtttttygyggttaaygattyggtygttagagttygttttttygttygtygtygtyggtttygygttttgagygttygtttygyggttttagttaggagataattattttttygggtaattttygtygttaggygttygttggtygttgtattygagtttyggagttygtttygagtygtygtygttgtyggggaggagtygagaggagtgttygtttggygygtttygagtttttygyggatttygatgaagagtagtygagggygggggygatttataatttttttttagtttattttttatttyggtatttttttttggtgaygttaaggggttttttattttttattygtttttttatttattttttttttttttttaggttygtttttttgyggttayggagaggggygggggtygaygagggygggtggttyggggtygagygygygtggggaggtgttggygaygygggttygggagygyggtttyggtaggtttagggtttttgtttygygtttttttgtttttgtttttttttttgtttatygygtttaggaaatttttgtagattttttttattyggtttatttagttttgggggtygttygaaattggggaagggataaggttgaagtttygtygtttggttttaggggyggaaagttygatttaagggaagttggtygygttttygygayggtgtttttggtayggaggattgaggygtagttyggttgtttttttttgtttgtttttttygygttgtttygtygtttttgatttttttagattgtttygagaagtttaggaaggtatyggagattttyggtataaggtattgaatttggagygtttgaggggaattgaygtttgtttggtatttttgggaagattgygaattagtttaggttttaggggagygtgttygtgtttttttyggtygtattgatgtattyg

SEQ ID NO: 6251 - DNA, 2190 bp, Artificial Sequence; identical to SEQ ID NO: 6250
  Description of Artificial Sequence: Synthetic polynucleotide

SEQ ID NO: 6252 - DNA, 679 bp, Artificial Sequence
  Description of Artificial Sequence: Synthetic polynucleotide
tygagtggagagtagyggtygtagygyggygttaggttygggttgggttggtyggygygaattttygggggygtttgggyggttaggtygggtggyggttgygtaygtaggagtattttttgagtttagtygttyggtyggtttgattygygggtgatyggataygagtaaygygtgygtttygatttgtgttttgygyggggtygggyggggatyggtygggggygtygygygttyggtygggttgattgtygggggygattttygyggggtaaggygggggygygggagtagygygtagttgyggggttattttatttgagygttttgaggttagggtyggggtttgaggatayggygttgggtttygggggaygygggtttaygtyggygttygagygttattttttygtttttygtyggtttaygtagtttyggggttyggtaygtgaagtgtyggygygaggttgtttaggttatygtatgggtygggygataaataatygtataggatatataatattttggattgttataagtttttygtaggaaaagataaataatatttgaggygttgyggygyggttttttygggttgaataaaaattaggaggtggggggyggtggggygaagtaaataatagaatygaagaattgtygtayggagtttgggtyggyg

SEQ ID NO: 6253 - DNA, 2013 bp, Artificial Sequence
  Description of Artificial Sequence: Synthetic polynucleotide
tyggtagatttggagaygttttyggttttttgggagtttttgagggtttaggtygggtggggygygttttgyggtaagttttttttttttagttatygttttgaggagtagaaggygyggggatatatatatataygttygggtaygtygtygtatttttttaattgaattttggtgttttttttttgtttgtaaagatattttaggttttgggtttgggagttgttttygygyggttttgtttgattttagyggggttatagtagtttggygttyggagyggttttagygyggygtygygggtttaggtgggtgttttagagagygggyggttgygygattgaggagttggaggygtattttttygttygttagayggttyggttygygttttygttttatttttttygygtttttttttttggaaaggaaggtyggagttgtatttttaaagygttttygtttttatttttttyggttygtygygttttaggggttttataaatttgttgtaagtygtyggggttgtagttgtaggtaagggtgaggyggggtygyggtttgggttgtygagtaygtttttttttagttttaagygtgtaygttttttayggaygygtatttagtattttattttygtygttgttttygaggttttygtttaattagaggtygygygygtygygtygtyggygggtagatatatyggtttttyggtttgygtttttgyggttttggtttygttgtagygtttyggttyggttatatttatygtttygggygygtygttygygygyggtttygtttygggtyggtatttttyggttyggttgttttyggttttygtttyggtttyggttttygtttygtagggttyggtttygygatggtggtygyggyggygagygyggtagggagggygtgtgtatgygygtgagagygygtagygtgtgtatgtgygtgtgygygggagggtttyggtttttttgygygtttygtttttgttttttgttygttaygatgygatgtyggtagaatttttatygygygtttttattgttyggygtttatattygygtatataygygtatatttaggygygtatattyggtttygtattttygattygtttttttggagygtttataaagattttttgtygggayggtyggagtttgyggagygyggttttgggttttttygggattygtyggttttaggtgtttygttgtttttygtagggatttygygggyggttyggttttygtattttgtttggtygggtygyggtygygtttttagttygaatttgggtttaggtgtygattygggtttttygtattttygygggaagygtyggtttttttygyggygtygtygttttttttttttttttttagttyggttttttyggygtttttttgttttgttttatttgtttagttyggttttygtttttttygttgtttttygtttgtttygtygtygttttttttygygtttttttttttttatygttttgygttgttttttatatttttygtattatagygggtgtygttygtygttygyggggtttagggttygagygygtagtgggyggygaggggattygttaygttyggtttygtygtttttttygtttttygyggtttygyggttgttagtttyggtttggygttagggtggygaygtttygygttagtttyggttgtygttgatagtttttatttygttygggtttaaagggatagygtattyggttygatyggttttattygggggtttyggggaagggatttygttgygygggaatagttyggggyggtggtatagtyggggtygtgygggygaygtttttttygtygtygtggagttyggttttyggggttggaggtgagttaaggagaaggayggttagattaygttatttagggggygtttagyggttaagtttttgggtygataatgggtgtgyggyggtgtaggttgagygttttggattgygtggyg

SEQ ID NO: 6254 - DNA, 1501 bp, Artificial Sequence
  Description of Artificial Sequence: Synthetic polynucleotide
tygaaagaggggygygggtgggygygttttttygygagtattttatttaagggggaattttttttagygtayggygaagttttttttyggttgttttatttggtagtttttttaggatttyggttagtttttaattggttttagtaatgtttagtyggagtttttttgggttttygagtgggagaaaagtgagagtaggtgtttttttagyggygygtttygttagggttyggtaggatttygtttttaagtyggggaaagttggtyggygtttttttttttygaygaagtygttttagggttgtttttagaggaygygyggtaggtaaagagaatgaatttgagygtttaygaaaygttttgtayggttttygggagttgggagaaataggtgttttttttygaygttygygggygaygtttgtygtattttgttygttgtygygtttttttygggtatttttygttttyggygtttttgttttygtttttagtgttagggyggaggtagtttyggttygtaggtaattattgttagyggagttygtyggggagygggggtgggygygtyggyggtgggygggygggygyggyggggygygggtataaaggggygyggygyggggtttyggagtttggttttygygtagtatgttygttagygtttygtygygtygttygyggtygtygtygtygtygttgtygttgttgttggtgttgttgggtttgggyggtygtygtttgygtgyggagtygggygayggygygtagatttgggttygtttttygyggttttttgttttygaggtygygggttttttttagggtatttttttygayggttttttttgggtygtgggtagygtygtttattagatygagggyggttggtagtagtayggtaagggtgygtttatttgggataygtttatttattattttttggtattttygggagattttyggaaygttagtttgtygttgggygtttygtygtygttgtagttygttatyggggaygtagttagygatagttataataaygtttttygygatayggaggygttgygygagttyggggttatttattatygtttttttatttygtgggygygagtgttttttaatggtagygygggygtttttaatygygaggggttgygttattatyggygtttgttggagyggttgygggagttgggygtgtagttygtggttattttgtattattgggatttgttttagygtttgtaggaygtttayggyggttgggttaatygygttttggtygattattttagggattaygyggagttttgttttygttatttyggyggttaggttaagtattggattattatygataatttttaygtggtggtttggtayggttaygttatygggygtttggttttyggtattyggggtagttygyggttygggtatttggtggygtataatttttttttggtgagtgygaggggttaggyggagggttayg

SEQ ID NO: 6255 - DNA, 668 bp, Artificial Sequence
  Description of Artificial Sequence: Synthetic polynucleotide
tyggggtygttygtaygtaaygttttygggtygggttaggttggttagggtagggyggtygtttttygaggaattgygggyggggyggyggggttaagttgagygttygttttgttttyggygtttygyggttgygggyggagygggttttgyggagtttttyggtygtttttttygtagttttygtttttagggaaggtaaattaygtatyggttygyggagagaygtygtygggggtttttgtggtygygttgggggtygttttttggtgttgttttygtygggttgggygyggtyggggttgyggggttgtagggttggggggyggyggyggggtygggttgggyggtagtagttgttggagygyggygtttyggttgyggttattagtgtagggatgtgtttyggttygtttttattgaaatgyggygtttygtatagttttattttagtttttttttttagaggagggyggyggyggyggyggyggygggygygttttttttttttgttttattygtttataygttttttygttttttttttttttttttttttttgygtgygygtttygtygttttygttttttttggtagggygtatttattayggttgygttttaggttttttttttttttagygttttttttttatygtagtaatttyg

SEQ ID NO: 6256 - DNA, 1006 bp, Artificial Sequence
  Description of Artificial Sequence: Synthetic polynucleotide
tygggygttttgttygttygttygygygttttaggatttaaagtygggttttaagtyggygttttaygtygaggtttygtygtagttttyggagttggtygtagataagaaggggagggagygggagagggaggagagtttygaagygagagggtygagygttatgygtygygttagtagagattatattaagtatttgygtggttyggaggagatgggyggyggtttyggagtttygtaygagggttttttgtaygtttygtygtygtttgygtygtattagttttttgtygtttttygttttatgttygtggtttttttggggttggggttgggttaggttgtttgtagygtygttttgtttttttattttagagygtaggtgagtggttatttttttaggggatygyggttgagagygtttatttttttttttygtatttggaaattgagtttggyggtagggttgggttatttagagtttgtatatttyggaagggaaagtgattttagaagggagagaggaagtgttgagtttggggataatttggygtagggttgtygggygtattttgtttttttttygtttaygtattttagtttttyggtgttttgggggyggatttttttggtyggaygatgggtttgaattttatttygttttttygttgggaaataatattggttttttattttttttggtagtgattgtatattttttttttttgttattttttatttgaagttaagaattaatttttgtttaygtaggaaaaaagatgagygtttttatttgggtatttattttttttttttygtttattattyggygggtttyggtttttgygtttggttgttttgtaggtgtgttggggttayggtgttggagggttgygyggagygggaggtygyggtgttygtgtttaggtygtttaatgggtgggtagaatgatayggygygattagagaggygygggttygggatgggggttttgyggttgtggyg

SEQ ID NO: 6257 - DNA, 867 bp, Artificial Sequence
  Description of Artificial Sequence: Synthetic polynucleotide
gygyggaataaggygttgattgttttttagttttttttttttygygttttttyggtagtagygaaaattyggaaatttgattttggttttaggagagtygggttttatgaggtgtattgagtatgttttgtagggttyggygtgggagggaygygttggygttttttaggttygggyggaagyggygttygtaggygttgaaagygagygattttttgagttygggtggttyggygggtaagggyggygygggagattygtagggygygggygyggattyggggaattagggttatygttgygggyggatgggggttatygaggyggttygtttttaggygtatatttygtatatttttttgttaagtgaaggggttaaaatgtatagatgggggagtttatttaggaatagaggygygagaygtatagttatttttgggttgggagtaygagttagtagattttyggagygygttaaayggataatatgttyggtgttgtaaatagaggtttttgttggtagggatattggaaagaagggyggagagggagtatagygaaaggtggggatygtagaatttggaatttttgyggagatyggaaagaaaattaatyggagtattttttatatgtagagttayggaaattgttttggaaagagaaagtggtagygtttgggttttttyggttagttygggttagtyggttgygygtgygaagttttttttagyggagygggatyggtygyggyggtggatygtggyggtttttgtatttttgttttagtygygtttggaaatttgagttyggattygyggttgttgtaaaattygtttttagtttattttattgygaattttgttttyg

SEQ ID NO: 6258 - DNA, 1072 bp, Artificial Sequence
  Description of Artificial Sequence: Synthetic polynucleotide
tyggttgygtygttttagtttagggaygttttygttttyggttgttatttatyggttatygagygttygtttygtttygggtttattatgtttgttgtagtttggttygtattagaggygygataataaataagtgtattggattgggttttgtattygtttyggagtagttgttttagagattyggtgttgtttatygygttgttattttttyggygttygggaggaagaygtaattttttyggagttttttttagagttatygggttgttaggataagttataggtatagaaygaygyggttgttgttygtttttttttttttttagaaattttaaaggatgtyggtgatagagagttttaattaatgaygattgtgygtygtatttggggaagggatatagaaaaaaattttgtaaatatygtgaggatgaaattgttaaagggatgtaagagttttttaaatattaattaggggtygyggyggyggygggttyggygyggagatagygtyggygggattttagygyggtggtygtygttgygttggggggyggaggatagygtaggagttgtagtygtygttttygttggagtagtygaggggtyggtgttatttttgttygtttttttattattatgtatagtgtgygttgtaagaagaaggygggagatgtatgtatattttygygattygttttttttggttygtttttyggygtgygttattgattaggggggaatgtggtgaagayggygaggaggagagtygaggggggaggggagggtyggtyggygygaatttaggtyggagggtgygaggagttagaggaggttggagggggyggyggttatagttgggtyggagaaagttgttttttatgtagatggtaattgtgagtatttttgtgggggggagggtgtagygaaggttgttagggatttygygatygygttttaataygtattggagygagtgtgygagtgattatgagtgtgagygggtgygagygttyggyggggttgatygttaygttggyggggtyggyggggttaggtagtttttttygyg

SEQ ID NO: 6259 - DNA, 1633 bp, Artificial Sequence
  Description of Artificial Sequence: Synthetic polynucleotide
aygygygtatatatattygttttygtttgtttatttttttttygggggagtyggygygygtttttatttttgtygtatatttyggygagtygagttygtagygttttaggattttgyggttyggaattyggattgtagttttgaatttttatggtggttttttaaatattttttttttttttttttttygttttgattgtatygtttttatttgggggttagaggagtaaggtagtagtttttttagttagtttttgttggtttgttatygtttatttggtttataaaagtttgttgagygtagtttagagggttgygttgttygttttttyggttggtagaagggggtgaygttgggtagyggygaggagygygtygttgtttttggygggttttyggtttgaggggtaaggtgaagagygtatyggtygtggggtttatygagttggatttgtatgttgtattatgtttttttggatyggggttgtgatttttttttttttggggttgttgtttttttttttygtyggggyggatgtgaaggttyggagttgyggagaggttygttaggygtayggtgttaagggatttagtttggyggatattttttattaggagatygtaggtaagygygggygygttgtaggggtaggttgtagttttyggttgtygtaygttttattggtygttyggygtttttttttttttttttgttgttgagttggtgtttattttttgttatygttatgggatttygygttttygtgttgggyggyggatgtttttgyggttttttyggygggggaaggtgtgygttttygtygttttattgtgtgtataygygggagtattttggttttygtttttygttgttttygygtttttttattttttagttgatggtttaggttyggttggttagggagttygggttatttyggggyggttgtaaggygtagayggagagtygagtygggygtttatttygygttttggttygggtaaatttggaagaattgygatygtagtttgtttagygttatagtttgagtggygttttttttattttygtttttgygtyggtaggggyggtggagagaygyggagggtttttttagttttttttttttttattygtttttygggygatagagygttyggygttygggtygggggygggtaaggttgggagggattttygtyggggatttggtttttggaygtyggygttttaaggttggtttggggattttaygggttgtttgttttagatgtggggygggttttttygttagggttttttagtgtttttttagttgttgttggttatttagggttyggggatattttgttattyggtttggagtyggtttygtttgttagygaatagttaattttagygggtggtttagttggggattygggttygggttygggggtttygtgtttttygtatgttyggttattggtattgttttattaagagtttgagagygtttattttttttttyggygttagtgtgtgtagtatttggttttygataatttgygyggtagtttgggtgtttgtttttyggtttttagttttaatygaattygagtttttttggggttttgtgaatgaaaygtgtyg

SEQ ID NO: 6260 - DNA, 1143 bp, Artificial Sequence
  Description of Artificial Sequence: Synthetic polynucleotide
tygyggagttttygyggagatttgttggagttaggttgtttatttttatttttttattygygygttggtttagaggtttatttaggtagyggttttggtgtygagggggtaggtgtagygttgtagtgatgtttagtggtttygtttttagttatttgttttttaatatttgttagatgtttaggyggggtaggttygaggtgtygtyggttttgggttttttaagttagtttaggggtatttygyggtaggygttttygatatttaygygtaggaatagggagggygtatygyggttttygygtttyggttaggtyggtaaggattttatygtttygttttygggtggaggygtttttttttatttttttttygygyggggttttygttygtagtttttttagtagtttttttygtagttttagygtttttgagtygttttggttyggatyggttaaggaattaaygagygygtatygygggtttygggygtagggtayggagtyggtygygtygtagtttttygggtatyggyggyggtgattaatttgtaattttagygtttagagttgttatggtgttygygggyggyggyggyggygatagtgggygatyggtaggattagtgttaggygyggygtttagggygggyggggaygygggttttttatttayggyggtttagtttaggtagygygttyggttyggttggggtygyggtttaygttygtygtgttatttattgagygtygtygtygtygggtaggttgggggaggggtgggagtyggagttttygggtttttaaaaaattattattttatttaaatttttaaagttagttttgttatagggattgtagtgatgtygaagggygggtatygtagaggaggttgygtygtagttggtggggagygttagggtyggtattggtagtttttttttgtyggttgttattygtagttagttttatagtaatagttaggtttttatttgygagtttttttygggggtttttygtatttaatagtayggyggyggtgtgtaygggagttygtygggtataygyggggtatatttaagtgtattgttaggaggtygggagtttagygtgygagygtgaggttagattgtgtayggtatyg

SEQ ID NO: 6261 - DNA, 1143 bp, Artificial Sequence; identical to SEQ ID NO: 6260
  Description of Artificial Sequence: Synthetic polynucleotide

SEQ ID NO: 6262 - DNA, 1371 bp, Artificial Sequence
  Description of Artificial Sequence: Synthetic polynucleotide
tyggttgagagygtatggygttttgagtagtgtaggtttyggtatygagggyggaaagygttttgagtttatagtygtaygatagatygtyggtttgggttttttaggaattttttgtagttttgttyggttttygattttygttatttattagtttttttaggtatttaagagttttttagyggygggttagggtyggttttttttagtaggtttttttggagagygggaggaagataggaggygttttttyggtggagggttttttagygaygtagttaggagygttaggaggttataatyggaggagaggttggygttttagttttagttttagtttygaagygattttttttttttygaggtggttttggttaagtttttagttattttygttaaatgaggaggtgggygggatgtagayggtggagygggaggtttgggygygttagtttgggagttagtgygyggggtagggygaygggtagygyggggaygygaatttttaatttttgygtttaagaygaaggattyggtttygatttttttattattyggygygtattagygttygtttagtgatttttaggtttggtggtggttaggggtgggaggtgagtygaaagggaaaaagttattttatttaagtygtygtygggttggagttagtttgygygggtttygagttttyggygayggygttagtttttttygttygttygygyggtgttttygtyggtagttttttyggatttygygttttttttygggygttygttttttyggagttttaaygtttgtgygygtatttggtagtagagatagtagtagtagtagtagtagtygyggyggygatagtgttaggggtagygagagygggttagagtttatggttggtggtygggttggtygyggattyggayggtygggagygggygyggyggtygtagagayggttttttttygygyggttttagygtagattttagatttggagtygtgygggyggagaygygyggggttttttttygtttygtygtygttgggtttttagygttttyggattygygggaggataggaattattyggagtgaagttgygttaggtgygggygggygggygggygtgygyggggyggggygtaygtgyggtaggggaaggggttttaggttttagtttttagygtygggygagtttttttttygtygggttgggtgtttyggtyggyggygttygattagatttgagtaggtgttgttattattattaggaaggagagggatttagtttttgttttaggttttyggggygtgtgtagttttygtagggggttgggattatygggttaggygggygtygtaggagagayg

SEQ ID NO: 6263 - DNA, 1545 bp, Artificial Sequence
  Description of Artificial Sequence: Synthetic polynucleotide
aygygaatttygygggtggtttygggtggtgggttttttttagygygtagttttygttygtttttttttyggygttgtagtygygatttgggatygaayggatatygttttttyggggtttyggyggygttttgatttttattttttttygtygtagtttttggtagggtatttttttggygygaygtygygttttttttygggatygttttttyggttttttagggtgygtttagttgttgttygtgygtttygttagtttgagygtttygggygggyggyggtggagaagtttagtttagttttttttagtygygttttyggttygygttgtttttagtttgtaagtttatgaygtggygaygtygatygagatataaagatygaggttgagatygttaggggttgagggtgaggtygygtttyggggtygttggagygygggygttatgygagattgtttyggttgygygtygttttagaggagttygagygttttttttagtygyggygygttggttttggtygggattgtagttaggtgggygtygygygtgtgagygtygygygtgtgagygtagatttggattygggyggyggaggygaaagtygttttattygyggggtgtaattttgggygyggaattygggttgtygggtgatagtgattagttgattttggagtttatyggaggygyggtatyggaggtygtgyggattattgtygaatagtygttggagattygtagagaagggygggttttgygttyggggygtttyggaggtaagttyggagagttygggtygggyggagggygggagygtaygagtgtgtgtgtgtgtgtgtgtgttygyggtgtgttygyggttyggtgtataygygygygggttgtaaagttaggagttgygggagygtttttttgtttyggtttggtttyggagtattgygggtygyggaggtgtgggggtttttgtygttgygtttagggtagyggyggaaaaggtgtgtgyggatgyggggyggggtygtatttggtggatagagtagggattygggaagagaagttayggaagatgattatgtagtttggggtaagtttttttggttgagtatygttttaggaaayggtgttttgagggttaaatatgtgagttatttgtgtaaaaagtttgatatattagaggygygaagtaagatggaaagttggataagttttaggtggatygatyggtgtatttaatttttaaattgagatttttagttaygttgatgtggaatgggatygttgtttttttygagggtttgataaggatgtttaattttatttgttagaaagtaygggagttgggtttggttygyggggagygtaagttygtttataygyggtttaatttaggtaaatgtagtatgttygatttgttttgtygttattttttygaaagygataatttttttgggttatygaatttattagagtagttatttgttttttygtyggyggtgyggggagygtaatatttgagtagtttaatttttatagygyg

SEQ ID NO: 6264 - DNA, 1545 bp, Artificial Sequence; identical to SEQ ID NO: 6263
  Description of Artificial Sequence: Synthetic polynucleotide

SEQ ID NO: 6265 - DNA, 1027 bp, Artificial Sequence
  Description of Artificial Sequence: Synthetic polynucleotide
tyggtttyggttttagtttygataaygtttttagtgttygtagaagyggttttyggatagygaggatagttygtygtygtaggtttattyggygtttgatggatatggtggttaygttttggagtataaygtattgtattttattgyggagaggaygggttagagtatttygggtttttyggttggggtaagggttagyggatgaggggaaaaggtggggtaagtygttgyggggagaggattagtgyggagggtaggattayggttagtgtggagygggtgggtagaggtggaagyggttggtgggygtgagggggyggagtygggtagttygtggggyggggtaggaggygagggagggggyggggttgggggyggagygtatttgtggttgygtagtaggygtattagygttttggygatgaygtttattttygttttgggygttaggtggaagtagagttgygttatygttattattatygyggygttgyggttttgtagtaggggtttggtgttgygtagtagtagtyggtggtyggggtttatgatatagggttttygggagggggyggtygyggyggtygtttttttagatttygygtttttggtttygtttttttttgagtygtagaaggtttttttygygtttttttttagtagggatttttggayggggagatygaygggtttgtgggygttttttygggatatatttyggttygttttgtttgggttgggtttatttaygttttgggtggggtttaggaattgygtgygggygtagygggtgagtatgttgatgatgattatttggttttatttttttaygtygattagtaggttatagagttttyggtagtttttgtgaattaggtygatgygtttygggtagatttttttaaaggttattattatattgttygttattagttggggaaagaataaagaygagagggtgaaygygaagggtggaaggtyggttgtyggttattatttttttyggagygtttttatataygtatyg

SEQ ID NO: 6266 - DNA, 693 bp, Artificial Sequence
  Description of Artificial Sequence: Synthetic polynucleotide
aygaataaaygttttattttygggtagtyggygggtgyggagygagtattygtggggygggataagtgyggaagtygttgygttttygtttttttattttygggggayggttatttttagggttttygaggagttygtttygtgtatttaggttttaggtyggtttttaagttttggttygtygttatattagyggttttttattygtaagtataaatgtgatatagatattagtttttygtgtttttggtttttagggttttttttatygygttttagtatttgtagtttttttatttttatagygttygtygtygttaaggtaatagagggatgttyggtgatagattyggygtyggttttyggygtygtaagagaagygttygygygggygttttggattygtagagttttyggygttttygaagtttttggtgtggtygggattygggagaaggagtagggttggtggggttgttgtagtyggtgagtgtgtgttggygttgggggttggaattttttaggttagtttttgggyggtgtygtaggattttgttygttgyggttttgaggyggaaataggggttggggtygagygygggttggaagttttggtttttggagtgtygtttttagtttggggtygaggyggtygtttgtgtagattygggatttttaaatagaaygaattyg

SEQ ID NO: 6267 - DNA, 1496 bp, Artificial Sequence
  Description of Artificial Sequence: Synthetic polynucleotide
aygtygagygattagatgtaaaattttttagygtttgaaattatygyggaygtygtygtygtygtygtygtygtygggtgggagtygygaggagygtttagtggygyggtttgtygggtatggtggtyggttyggygatygttgattygtygggttygggggttttggaagygaggygygtttttygatttygagattttgtagggttgtaatagayggtggggaggtaaaaaaaaaaaaggaaaaggaaaaaatggtgttaaagttattaagttttatttattgggtagaattaaaayggatatattaygtatttgtaaaatatatatatttatttttatatatatatatattyggagttygaggaaaggaagagaaggaagatgtagtaggagttgtagtagtygtygygaatggttygtygygyggttgtagaaatgtataagtgtttygagttttaygaaaygtaygggttatyggagygtttttttyggtttttttttttttttttttttttttttttttttttttttgtygyggtttttttttttygtttttygttygggttgggagyggtaggagagyggaattttttttttttttttttttttatattygttttttttttygtttgtttttttttttttttttatttatttatttatttattygttggttygyggttgtagtyggtatygttattygtagtttygyggtagttygttygttttaygtttygtagygyggygttygttagtygtagttygggggaaatygagatygaagggaaaaagttgtatttgagattgygagggtyggggttggggagggagagttggygagttggttgtaygatayggaaaggygtttttttttttattttttggttttygygttattyggttttgttgtaattyggatygyggtaggaagtgaaatgaaygtggyggaggtgattggggagtgtttttaagttttgggtggggggygtttttaagtttgggtgggtggggggygtaggtttayggayggygayggggggtgtyggagygtatagatattttagagaagtatttagagtyggggatygggatygtagaygygtagtttttggtttgaatgatatttattttygtaatttagagtttggggttttggttttggttgggaggggattgygggatatggtaygttaggtgtttttygtgttygttgygtttttttggaggtgggttttgtattyggttttgagtaggtatggatyggggaaggaagaaataggggtygaaagggttgygttggagagtygaggtggtttygggygagttgtgygtgtaagagaaatggtygggggaaattgagatgtaaggggtatattttggtaagygttaygttagtatygttagaggtyggtttttygggtttagttttygggtgagttgagttggttgtygggtgagggggygggygggttgtttttttyggattygggggyg

SEQ ID NO: 6268 - DNA, 5820 bp, Artificial Sequence; identical to SEQ ID NO: 6021
  Description of Artificial Sequence: Synthetic polynucleotide

SEQ ID NO: 6269 - DNA, 699 bp, Artificial Sequence
  Description of Artificial Sequence: Synthetic polynucleotide
tygtggtgggygaggtattyggggtttttttttttttggtttaygaatttttaatttygaaygttgtgggattgtatgggtttttgttygggttaatgaaatgygttgtygagaggaggttgyggygyggtttgaggtyggatttttataggtyggagagttttttgtyggtygyggtyggatttttygggaaatgggattagagygyggagggagtttggttaggaggttttttaggatttagtygygaygttgaaaagtatgaagggtyggaattaggtatttatttagygagygttattaattygaagttatagygttaattttttgattyggtygtttttataygtagygtygggattagaggygyggtygtygttygtttygtttttatattttaaaygygttygtttygygttttygaggttgygggtttagggttaattygtygygtygygttygtttggttygagygygyggygggtygggttyggttagttggggygagtyggtttgttygttggttygggygttyggtttygggttgggtaaggagygtttggttatgagtygygggatagtttaggygggayggatgygttttttagggtttaggygaggtygygyggtgtagaatygtygggatttttttaattygggtatgygtatttatagtagyggtttttggaggtygyggyg

SEQ ID NO: 6270 - DNA, 1845 bp, Artificial Sequence
  Description of Artificial Sequence: Synthetic polynucleotide
tygttttttygtygygygttgggggttgtttttaggtgttggtttttgtgtygagaaaattttgygaggaggygagggagttggataaagagygggygagggagggygtttgttagtttgaggggtgygtygggyggtgygygtatttttttgggtttagtttygtattyggtygttygyggtggttagagtttagtttttttaggttaggagtggygttyggttgtattttygygttttygggagttgaataaagttaggygggagaagtaaaggttagygtttggaygttggagttggtgggaggaggygagtagaggygyggagtaaagttgttaaattgygygyggagtygggygtggggygggggaagggagaggagggagggaggggtaggygggagtygggagggagygagygggttygtygygtttgagtaatttttgtttgtygttgtygttgtygttgtygttgtygtygtyggttyggattygttyggagygtagggtgtttgtttagttgygygyggygygyggaggtttyggygttygtygttgygtttttyggtttttgtttttygygtyggttygygtgggtttyggygggygygaatttattatgtagttgtagtttyggagttggatgttggtygygtttaygttgttygtggttttttttattttygtagatattttagagatygaagaagaaatygggtaaatagttgtttttaggttygtgttaygagttttggygggatttttttttttttttgtattttttatttttygattttttttgtgtgygtygygtttygttgtagtttygttggagagatggggayggtttggtagaaggtggyggygataggggttygggayggtttggggagaggagggtgggggygyggttgttgtggggtgttttygggyggggtttaygggaagtttttagttggttygygtygggaagyggattygtttattttgtttttttgtttggygtgtttaagygtagtgtygtyggggtygagggagggygtyggggagtgtttygggygggyggaggggtygagagtggagggaggtaggagtttttttgtttttagtayggtygttttttygttttggtaaagtgggtagggggygygtagggatttttgagttgggggaggggtttttggggtyggagyggagggyggggttttgtatgggttattgggaagyggaatgttttttgtatatatagataggtataygygtttttygtyggttygggagttyggygtaggagttggtattattagagaagggttygtatagttggattgagatttttygttttygtttggttttggaygtttagttaagttayggtaatttyggygattttgggtttttgtgygttygtagygyggagayggagatatttygggaaagtttgtatygtygttyggtgggtttttgggtttttaggygggygatttggygttttttttttttygatttygttagaggtagggtgggatygygagttyggattttttyggtttyggattttttggagtgygtatttgaggygygggaygtatyggttgtgtgttttaggggttgagattygygtttygtttygtagttttyggttygtygggtygggttttttttyggaatttttaaagggyggtagaygataggtggggaggtagtyggggttttgaggaggttygaggagagttttttggttttgggtaaggggaaggtgaggttttaaagagggtagaaggtttttttttttgtgggatttgtgttttgttaggygtttttttygagtttygygtygygtgyg

SEQ ID NO: 6271 - DNA, 1844 bp, Artificial Sequence
  Description of Artificial Sequence: Synthetic polynucleotide
tyggygattttttggtattttggatagtttttyggggagtagtttatygttaggyggyggttgttaagagaggaatttttttgaygyggagtttgtygtttyggggttygtttttyggtaggttyggggagaggtggggtgataatgggttggggtgygygygtgttttataggtgygagatagagygagtygtyggggtgtgagttagygygttgggggttaagaagttgggtgaatagttayggaattttatttaygttyggtttttttatttatttygtttatagygygtgttttagtttagggygtgygtgygttyggtgttygatttygggttgtgtgtgtttatttggygagatgtygagagyggggggagtgtttttgtyggtgtatttgggtttaggttaggggattttttttttttattttygygtgggtgtgggggtgtgttygggttagggygygtgtgtttttgtgtttgtgygtgygtgtgygggttagggtggtgggatygygtattagggtagggtgtttgygtttgygtttgggtttgtttggtttgtatgtyggygygatttygatttggattygtgtttttggatgtygagaggttagygtggtgggggtgtttagtttttyggaggagtattatgttttgatattttygttttatygttttaaagttggtttggggtttygtagggagtggtttgtatggggagggttygygtgttgtgtttttgggaggggtaagagagtgggggygtagggggygggttaggtttttgggygyggygygggttygggggattygygyggttgaygttaggttattttttaaatagagtyggtagygygtttygttyggtatttttygaagagttagatygyggtyggygttagygttatygttyggtttattygttagttygtatagtygygtygtygtygagygtttygtgagyggygtttygaggattaggaatggggtttygggygttgggygygtttygaattyggygtaygtaagagtttgggagygttygagtygttyggttgttyggagttttatygtttaggatygggagatgttggaaatgtaatygtttgtttttygaggagtygttgttttygggattttttggtattgtgygtattttggttagtagttttyggagaagayggygtttttaaygttygattygygtggtygtggtagygttaygygagttttttaggygatygtagggttatagtagtttagtygtyggtgttttttyggaaattatgattttyggygygggtttatggagttatggtttatagggttttgggtygygyggggttattttagtygyggagggygygtaggttgtttttygtttttaygttttygtttttttgtatttatttgtgttatagttttttgtgttgttgygaygatttgggtyggagtygttttttyggygygtttygttgttttygyggttttagygygggyggttagaaatttttttagaagtttygtttttgtgattttttygggtygaygtttagygagtttagygtttttagygygttygtygtygtygtgttygtttttygttttttyggttttaattatttyggtttatttaagttgggtattaagyggttgttttaagtttttattgtgggygtgaagaaggggggtattygggtygtgttggagtttattygagtatattyggaygtgygggttttgggtayggaattttatttttttgataggaattayggtygygggttggattggtataggtaaggattaggagtttygtttygtgygtygggtttttgatyg

SEQ ID NO: 6272 - DNA, 1480 bp, Artificial Sequence
  Description of Artificial Sequence: Synthetic polynucleotide
gygggtgyggtttttygggagttygygggatttttttattttttattttygtttgggaggttyggygtgggttggygatgggggtggaaggttttygggtttgtggatttgyggtaggaggggyggttggtagtaggagtttttgtattatttttatttttaggggygtttyggggtgggtgggggtatttagtgtttygygaaaggaagaggaggagggggygagygtggagatgagtttaggagyggaaagtagygygygttttttygatyggtagygggggtgggygttttttyggggygygggagygtttttaaagtygyggggygttygtagygggtaggagttttgttttgtatttttttayggyggggygtttygtaygtttttttatgttggttttyggtttyggaayggygygygttttttgtttyggaaygtygtttttagttaggyggagygttgggagttgggtttaggyggygggaggagggygaaygggttyggggttygggtttygatggtygygtygtttygggggagtyggagtygagttggtygtygttygygygtatttattaagttygttgagttttttttygtaygagtattagatgtyggtgtggaaatttttgaagaggaagyggtygtygtyggttttttagttgtagagygygtygttaggggggtygtttttygaggyggtggyggyggyggyggyggyggygggggyggyggtgtygttggtygtggygttggygttygagttggggtagttggygygttygttttggtygtagttyggtttggggattygttgygtgttttggtattagtgygtggtgaggaaagyggtggtggygaatagtagygttagtaggtttagggttayggttaggagygttyggtygyggyggttagtttttatgtygttygygtygtygggaygggattgtatygtyggggagtttygygygygaagttggtagttggygtttygygttagyggtygttgttygtygygtttyggggttygggtgtttgagatyggyggyggyggaygyggygygggtttatgttttttttaatttyggggtgggggygyggygyggggggygtgyggggygggttggyggggygggyggyggtggaggagyggttayggygygttyggagttyggagygygagtgtatttyggttaggagtygttggygtttggtagyggttayggygtagggaygygygttttttygtggggagatatttgtaggyggtyggygatattgtttyggagttygttygtayggggagagggggtygttaygtygggygygggygggggtttgggagtggagggaygttttygaaagaaattygagttagggtgagggtttgagaygtaaggagaattttaggtaaggygtttttgagaaaagatttttayggyggaygtggggtaataaaattygtygggagyg

SEQ ID NO: 6273 - DNA, 5065 bp, Artificial Sequence
  Description of Artificial Sequence: Synthetic polynucleotide
aygagtyggggatttgggggttygggyggtygtagtttagtgggttgaggtgtygattagggttaygtttyggagttttgtyggggtttagtttttttttttatattttaaaatgtygtttagggygtgggtatttygagtggtattyggagtygttgagatttygtygagattgttttttgtgygtttttttatagtygagaggttagtatygtgtygggaygattyggggattygagttygggygtygttatatygtttygggygttaggtttgggagttttgaggtyggtatygtgaaatatttttaggagtaaggagggattttaggtgttttttttttgtattttaattttttgttyggattttttttattttttgttatagtttttatatataaattttgttttggatttgtttagttttttygggatttatagttgtygtttttatyggagaaaataagtgtttttgttttaggggggattttattttggttggttattygtaaatttggaaaattattttatgattttttttttgatttttttggaagtagggagtattaygattygtagagggygtatatygattagaaagattttggggggtagagggtgtaagtgttgtgggaagagatgyggagataaattttgygagttagatttygatatttttttygttygtttgtatygttttyggaataattggyggttagtagtattttttatttyggtygtaattttagygggttaggygttggygtttygatattagtttttatttttttgtagttttgaatttttaaagatattyggttttgtttygtaggtygagggggagtgtgygtgggggtaggggggygtagygaatttttttaygttyggagtttagtttagygttygaagtaaatttttttatygttggtagtaaggtygggyggyggaggtygggtygggtgttttggggtyggygtygggagygttaggggtttygtgyggttaggtyggggygatttttattygtatttaygttttatggggttttygggttttggtygyggttgggattttyggaaaagtagggayggagaagttaggtyggtatgttygttttttttttttygggaggatttaataatttyggaaagattttgtygggagatgtgttygtttttttyggggtagygggggaaagtttagtaaaggtatattgaaaattaaaaagaaaaaaaaaattaygtygagtggaagaagtaatyggggtygyggyggyggtgaggtagggggygygggggttagtygygtgtgagtgggttygagtgtgygtgagtgtgagtgygtgtgtgtgtgtttayggygygggtyggagtatttattatttygtygggggagygaggttatttyggggtyggattggaaatgttgaggtttygtttgtttttttygygatatgttggtttaaatattagttggggtagaataaaaaattattaaaaaaaaatttttttaaaattayggaaatygagyggyggyggyggyggyggtttttttygttygtyggttygttygtttttttttyggtttttyggtttygggygtagygygtatgtgttttgttataattatgattattaataatgtattgygattaattatagaggggttttttgaaaggygattggtatygggttagygttatttaaattygttygttttaattaattagttygtgatttgttgtagatttttgttttttygygygttggtttaataagtyggtygyggggttggttttgygygtygygtygttygatattgggttaattttttttgygatygttygggatttygyggttyggtygtygggggtyggttttttttttattgygggttyggygtttyggtaggygtttttygttttttttttttttttttttttttttttttttttttygtttttttttataatttygggttgggtygatttaaattagtatgtttttttyggaattgagtygtttygggtggggggtggggtygggyggygagggttggggattygggttgtyggygygttgygaattttttaattygggggygaggygygtyggttygyggggggagggagtttygyggygggattaggggggagggygtttygtttygtgagtgttttttygtttttttaagagttattagaaagtagtttatttttatttttattaaaaaaaaaaataagygagtggggaagagttagttttaygtyggttygtttttygtttayggttyggtttttttttygtttggttyggygttttttygtttygagttttttattttttggatttygggttygygggggygyggagaagaggatttaggaaaggtttgggaatttgatgggtttgtggttggggggaggggtagttttttygttattttatttttttttygttaggggtattgattttttagttttttgtttgttttttygttttttttttttatttyggatatttttaggataattagggttgaagttttygggagaagtagtttygagttygtgggataagggggyggttyggtttygtttaggatttttttyggatttttttttyggttgtttyggttggttgtagggygygttatttygyggggaggyggyggtagyggtggygtygtagagtttygggygggyggagagyggggatyggtttgggtttygagtttagtttyggtyggggggaggggaggggttgyggtttatattgagygtagtagygagtatyggtttagggagatatagttygggyggattyggtattggattgggttagtttttgggatttttgggtatttygttttggggagggggtygygttttagtttttygggaygaggtggyggygtagagtyggaaagyggggtggggggagggyggtggggaggtgttttgttygaggttgtttggyggygtygaagttygtttttattttttgggtatttgtygagygyggygttygaatttttygttttattattattttttttaagttgagatgtaatttttttattttygttttagagtttagagttaggagttygatttttttgtygggtttaggygttygygaatttgagattyggtaygyggtttagtttagtttttttttttygygtttyggggttttttygttttaaggttttygaagttttgygttygaaggattaaattaaattaaatttyggttgagtaatgggggaggaggggggtgtagatatataatttttgttttattttaygattaggaaaggagagggtttataaggaygttttaattygygagygtttttgagtttggtyggtgttayggtyggttygygygaagtgggtatyggtttttygagtygatttygtgtatttyggatttgtattgygtttyggtagaggattttttttttttttttagttttttaaatttttttttttaaggtgtaaatgtgtgtgtgtgtygatgaatgtttttgttttttatttgttgattttatttttttttattggtataattttttttttttttttttttgttygttygttttttatttttttttttatttattttttgttttygtttattttttaatatatatatttatatttttttygtttygttttttygttttygttaggttttgatgggtatagtagattttgataaaaagataaaygaagttattagtggggttgatgttgaagaatgaagataataatgtttttataggtggtgttttaaatgttattattttttattgaatatttaaagagatttttyggtaaagatggatttgygtatttttggggtgtgagyggttygtattttttagatttyggggaaygtgtaygggagtaygtgtaaatttygtattygtttttattttataaataggggttttygtatatttattaatttatattgttttaggtataygaaygygtttgtgtgtatttgtatatttttttttyggaatgtgttygtgtttggagtygttygtatttttttttaataattttggttttttgaaagttygggtttttygggtatygtatgtagttaggaatttagyggagttggyggtttygtaaagttttttttttggtgygygtygygtgygtagtaggaagttttygggaataattttataygtgtttgttatttggtttaygtgtgatttaagattaagtgtaggaaaaaaaaaaattttttttttttaaaaaaatattataataaataattaaaygaaatgaatatgygaaaagtagttaygygatgtttaattaaaaatgggygagtagagaygaataaattgggggatttaaattttaataatttttttygtttttttgygttttygayggygtagaggygggygtttygatttgygtttggygtttttygttaattttttgtttgttttttttttttyggtggtttygggaaaggagatgggaggtggaggagggggggatgggaggagggggatggtyggaatggyggggagaggagaattggtttttattgttgatggtaatatattaattaygggttattgtttyggttttaagtttygtggttygttggtgygggygttgtagtgttagggygttggygaggtttygygtgtygygatgtaaagaaatatattaataaaaatagaagtagagtgggggttattttttatttttgtgygggtygaaagtaggyggygagygggagtgaggtgttatttttggagtttttttaygygttttgtttattttagagatttgygygttttaygtgyggtagtatttttttaattttgggtggaggtggggtgggggggggattattggggaattygggtagygaagtttggatttgtaggtttygttagagggtttggtatttaggggttgattygtaatagygaatggggatagttygaagtgaggyggtagttgygtyggggtygygattttattggyggagaggaatygtattygggggaggygtttggyg

SEQ ID NO: 6274 - DNA, 2372 bp, Artificial Sequence
  Description of Artificial Sequence: Synthetic polynucleotide
tygygattgygtaaatttyggttttgatattttagttttaggttttaatttyggaagggtttaggtttaagtttgtaygtygygttgttatggygatygttggttgtttttttygttttgttttttgagtaygtggtattaggatttygygttttttttagttygagagttaggtttggtttagagtygggtttattagtatttygtttgyggygttttttygatttttygtygtgttttattaggttygtttatttagtagygatagattttygtygttygygygattttatygtttttattttagttttttttygagggttygtagttygttttgttttygagygtgtttagyggttttgggtattggygyggttttatttagttatgtagtgtttttttatatattggtygyggttattggttgtagattygtygyggaaagggggygttttgagtttygttygtaggtagygygtttygagagattygttttaaggtattttygtaataattttgtgggggtatttaattttttygtgygtyggttaagatttttttatgttttttgtaatgtattagattagggaggtaaatatygaaggtatttgtattgygtttttattgggatgygttgtgygtaagagayggggatygtttgttgtaaaatyggatgatyggagaygtagggagttaggagtgggtttttttaggatttattttatgtagtttttatatggtttttagagttttgatttygtggttggagtgtttgtttttttttaagtattggtagtataygggtattttgtattgtaygtagtatatgttgtggttttttagttygtggtttgtgtaggtggagattttgygtgggtttagttttyggtttataygattttgggtygggggtattaggyggtgtttggttaggggttttyggggygggtggtagygtaggyggtayggatygtagtagaagatatygtattgttygtatatgayggtggtttttttgggygttttttygtagagttggtatttgagggtygyggttttgttttgttggtagyggttaattattttttttagtaygygatttttggggaagtygyggagttttyggttatttaggatgaggttgyggtgatattgggggtaggtgatataggagttgyggggtatyggggttagggtyggtgataagtgggtggtyggtggyggtatagtygggggaaataygyggaygtygttgggggatttttggtayggggtagtgggggygttggygaatttttygtaggagttatagtygttgttygtttygttgtataggtttattttgtttaggtttagatagttatagtyggagatttyggagttygyggttygatggttttggggggatttagattttggggtttgtattaggatgttgygggygtaygtttgatataaattgtgagagtagggtaggatgatgggttttygatagaaggagtygtatayggggtattttaattttttttttattttttttatggggatyggtttgggaggagatagygayggttgtagygggtgtttgagttggygaggtggtygaygggttygttttgtttagtattttggttagyggyggyggttgtggtggtggtgttttttygygtagtattggtayggatatttagagaggygttagttttgtgagtygtagtygygtagtygtygygtygygygttagttyggatygtttttatttgtttttttagtttygtttyggtttatgagtagyggtttattgggyggggggtaagagatygaagtttttattggttattagattygttygttttttygttttygtaggttatagggggttyggtagagtttgaggatagggtagttttygttygyggttgtaagatttttgaagggggtyggygtgyggaggttaggggatygggaaggaggagttaggygggatgatttattttygttyggtttattttygattttyggtgtagttttttaggagttgggggygtgagaaattttttttygtagygagtgggttgtyggagggggttggggtttttygttagygtttgygtttggtttttagttttgagtttygygtttatttatygygggygagtgttgygtagtayggaggaygttttttttttttygttgttggtagttttygtaggygttttattygggtttaggtttttgtayggtagtggggttttttttttttttygtgaattygttgaygtygtgttttggagtttttttatttygggagtttgayggygttggygtaagttttggygatatttttggttttttttattttgygtttttyg

SEQ ID NO: 6275 - DNA, 2372 bp, Artificial Sequence; identical to SEQ ID NO: 6274
  Description of Artificial Sequence: Synthetic polynucleotide

SEQ ID NO: 6276 - DNA, 2372 bp, Artificial Sequence; identical to SEQ ID NO: 6274
  Description of Artificial Sequence: Synthetic polynucleotide

SEQ ID NO: 6277 - DNA, 2142 bp, Artificial Sequence
  Description of Artificial Sequence: Synthetic polynucleotide
tygagggtagygtttygygtttgattttttygtaagygtttatttgtttttaggtggttaggaaggygtgggtgggggtaaagygygtagagygygggaagttagygygtatatagygggyggttaggtttagtattgygggggaggtgttttttyggtataggattyggtttttgtygtggttygtgtygatgttygttagaaaaggggygatggtygggaagtyggtggggaaattatagtttatatattgygtttttttggggaagttttgagtggagatgatgtygttggtgtttatttgggagaggagagggataaaaaggtgatagtygtttaagtttaaggaygttattttttygygtagggagggaagggaattgatttaggtaaaaagtttttttttttttttttattggttagggagtttggatttagggaaataagygtaatttttgygattgttttagtttygygttgtagtaggtttaggggttttaaaattygtttatttatttttttattttttttataatttyggagttttatgttttyggagaggaagtttttaggtttgaagagggaatattttagtttygtagaygggtatagttttttygyggttttaattgtaaagttygttggtygttttagtaaygttattttttttgtttgggaygygtaygtggttgygaataatttttgtttttttttttaggttatttttgtttttttatagtagyggggtaggtagyggtatygttttttggtygggtattatygtaagggtgttggggggttttaggagtggggtttgtttttttttttttggaggtagggttttygtgagatygattttagggaagaagttgygggaaaagtgttaggagggggttgaatttaygtagaggttgttgaatygggtttygtagaagtgtaggggattygttagttttattayggttgagttttygtygtygtttttttgtaggagttggtttttttaygatttttygtgtgggaagagttygtttgggtgtagygtygyggttygtaatattagtaayggtagtagtagtagtattggtaaygaygatagtatyggtygttyggttattyggtttttttttatgttygttyggtygtgygtttattygttgtataaygygtttygtttyggtttttagtttatttttygygtygygttagtttygaatttggattttygygggygtttgggyggggygggattttaggtttatttagtaagttaattggttgaggttttyggttggggattaattatyggttttgagaaagttyggtagtggttattatatttggttttygttaatttttttaaggtagyggtygttggagtagyggggttggyggggtaaaagtttttggttagggttgtttggagttgttttttttatttygtttttagggagttttygggttatttttttattygggttgtttygyggtttttaaggagttttattttygggattaaatggttygtaaggtttggggtagyggygttgtaggagatgagtttagygtaaagggaatttygtagyggygagtgyggttgttggtttgygygttgtggttttaataggttggtagggygygggygggtggyggggttgyggtatgagttttgttttttgttttggggtttygggygtttttggttttggaggtttggttatyggttygaaaagtaaagggatattgtygtggttttttyggtygtttygttttatttagagaygttttgaggagaagygagtttttgtaygaaggtagagggttgatttttaagttttgtttttttttygaaggtyggtygttagggaagatttggttattttttggaagtattttttttygggaaaatygtagtaggaaagattatgaaatattattgtgtgtgattygtttygtttggggagtaggatgaggtatttygtttggttattaggtagaaaggggygagtygyggggatgggaagattttgattttttgtttattgttgyggtygtyggagatgttttttttygyggttayggaggyggtaatttgagttgtttygtaggattggaaatygtataatttygaaattagttgyg

SEQ ID NO: 6278 - DNA, 544 bp, Artificial Sequence
  Description of Artificial Sequence: Synthetic polynucleotide
tygaatttgggyggtygtygggtagttttttygttygattatggygattgatagtgagtgygtttyggtygyggaggttaggggtggggggaggtygyggtgtttagggtgggaagttygattttagaygttgtttttgtgttggttygyggtagtagyggtygggttttttttygttttttatttttggttgtttggyggggtttgaaagggtaggtggttttggyggygygtttygygagggatgtggtagaagggygtgygtttggygtygaggyggagggattttygatgtygtgtggtagyggggtttgttatygtagtttttygygggtattgtttttaggtttagagttagtttttagygagtygggtaaaygaaggtattgygygtttttggygttgtgagtttaaggttygtttygagttttgggtygggtttgtgygtttgttttttggggattagggtggtttgtatggttyggttgttyggtggtttaygggttgtattygtagygggtagtataaggtyggttggagatyg

SEQ ID NO: 6279 - DNA, 2002 bp, Artificial Sequence
  Description of Artificial Sequence: Synthetic polynucleotide
tyggaggttgtgtyggggttygttaaaggttataaataaatyggaygggtgggaagtaygttttagyggygattggatttttaaaaatttgttggtagagtgaaaataaaaattgttttttaagttggtaaaatyggygttttagayggtgygtaggagggttttgygaggtttgttttyggagtttygygttagttttgtaggttyggttgggttygtagttyggtgttttattygtgggtygggttyggttgyggggttttttygtagtygggatatttaggatagtagyggttggggagtyggggttaggggtttttttgtaattttaatgatttttattattattattygtaaaggataaaygyggttaaggtygggttttatagtggttgtgttggttatygygtggaggagtgtgygttaatttaggggygaggggggygygttyggtgtttyggggagagtttagaaggaagaygttttatygtggtttttatagttagggatagtttgggtgttagaaatttttagagagaattygaggggttgatgttttgggttattagtttttggtgtttgtggggttttttgygygtttatttttatttttttttttttttttaggttygayggattttttyggaggtttaggatagtgatttatagtaagtggtgatagtggaataaygtgatagttygttgtatttgttagttggtttttgggtaggtttattygtygggttygattttagagtygagttttyggagtygtygggtaaagttttttttttygtttyggtgtagtttygygtttttygygttyggygttgtyggggaaaagtggtataataggaaagtttygttagagggttttttttagtyggttttttygttataaaaagttagattttagtygaggttttgattttttttaaatataygtttttttgttygyggttygttattttygttygggtttygggttgtgtagtttttttttaggtttgttygggtttatgtttttttygaagyggygggagtyggtgtagttttaatttttattgygtgttttaggtygttaattagttttgttygygtgtygttggttyggaggttgtygygttagtttttgygtgygtttgagygygttggagtatttgygaggttagggttgtygayggygagaggatattttgaggaatayggtgttttagtttygttttygtttttygttygagttggaggttggggygygttgagtygtagygtttggataagtgygygggtyggagtygtttaggtttgtattygggggttygyggtygaygtatgygtaygygyggtggygggtttgtaggttygaaggttyggttttttttttaaattyggagyggggaagtttaggggttgagagtttyggttygggtygtaggagttggggagyggggaygygggtaggttaggtttttttatttgtygtyggggttttttttygtagtagtaaaggggttttagtgttygtggtagtgtatgttttagyggataygttggtttttaaatttagagattagaggggyggttgagaayggggygttygttgtgtgtgatttttgatygtggaggaagggygggagtygggagtaggyggtggggttyggggttaggtygyggtygtyggttttyggtaaaggygttttggtyggggaagggggygagggtgggyggtyggtttttgtygtygtagttatatttgggaygttgaaatgggttttggggatagagtttatttttagygygttttataggagaagttygtagtttaggtttgggtygtgtagatygttgggygggttyggggttygaggagagtaatayggygygaggtttagtygygagtaataatttygatagtayggtttttygaagaygtgtttygggtatyggggttgtgagygggggagtttygggttttgggttygtttggtayggggygggggyg

SEQ ID NO: 6280 - DNA, 983 bp, Artificial Sequence
  Description of Artificial Sequence: Synthetic polynucleotide
tygttttttttyggtttttygagyggagtgggtaagggaggggggtgaggaaggtaygygatgttttygtygttyggygttttatyggtygtagyggtttatygttttygygggttgttygtyggtygtagtygygttyggggtatgttagttygtygtygtygttttttygtyggggttygtgggttygtagttgttagggagttgyggggtagygtatttggagygyggggtttgggagggagggtgtttggggttagggygaggggtttygggaggggttttttygtayggattttagaaagagggaaatttygatttagagyggtgattggaatttaygttygggagaggttyggagtttyggtygygggyggygggggatttttgtaggaaggggtaggaaggtaagtagttyggygygttttggyggtttygagggatttgggttygggtttgyggtygygtygtttgggttttttttgggttgggagygygtygggttttygttttgtaygttgttatygygggagaygtttyggtttygtygygygtagaggggaygygyggagaggttggtttttgggygagyggagagttttgtttattaagttgtyggaagaagttaaattaaaaagttaatttttaagtttttaaayggaaygttattttattagttgggagatagygtygtattgattgataagtygygtatatttattttygygygyggaggggagatttttagaaygtttttygattagtagygaggaagtygagttygtatttygtatttygtatttygtatttagagttttygagggaygaatttagatttaatttttgtttygyggttatttattttagtygttggagtttggygttygygtttttyggtyggtagtaygttaaaayggyggygygttttgatttggatttygtygagttgggagttttaggtagtaggygggygygyggtatyg

SEQ ID NO: 6281 - DNA, 947 bp, Artificial Sequence
  Description of Artificial Sequence: Synthetic polynucleotide
gyggagygygttagagygygagggayggagggagaggaggagygygggagttgyggaggygatttygygaatttattattgtaaatatattygggggtgttaggaggggtaggggtgggggtygyggygtttatattagttyggtygygtyggattgaggtagtagtgtggtttgagtagtttttagatttaygtygggygggygtagtatttggagygagttttgygttygttttygygtagygtygtaygttyggtttygagttgttygtatataygygtyggaggagagttygtttagttttttygtygagtttygggattttttaaattygaggagtttyggygtygyggggtagttttttgtygtttttttygttygttgtattttttttggggttygttggtttggygaagyggagagggggaggyggaggaggagagaaggygggggtygyggyggtygaagttaagagaaagtggtatgttygaattttggaggyggtggtggyggaggaygggggaagaygatgtygtagtttygtaggggaygtaggygagagtaagygaggygagttgggygtttyggtttyggttygttgyggggaggygygygtygttttgaggtttyggttttygtattttygygtttygaygttgygggygatagggtttggttttagtagtygtygtygtygtygtygtygttattyggaggatttagtaaaagtttggatttgggggagggygyggygttgagygggattattattagggttggaaggagatttygagaatttttgtaggtaaygygygtttttaattttttttttttatgtttygtygttgygttttygtttttttttagagttttttttggttttygygggtttggtagaaagtaagagggaggygaagtttaagatttyggggatgagtatygagyg

SEQ ID NO: 6282 - DNA, 1362 bp, Artificial Sequence
  Description of Artificial Sequence: Synthetic polynucleotide
gygttttttttattygygtttttaggtttttatgtaygttaygtgggtgggagygtgttttatatattygygygtttaaagttatattygttaygttttygtyggggygggtttatygygygtttttgggtgtygagtttttataggttatatagtygttatttgttgttgtatttttattgyggggataggggtatttagtgttttttttygtttttttygtttygygaaggttttttattttttagggttaggyggaggttaygtttttttygggttttttttttaaygyggagagggaagyggagggaggagtttggttygtagtygtyggtttttttygtattggagttttttttttttttttttttygtttttyggttgtygtagttyggttygtagygygygttagygggggtttttyggagygagtygttaggtaayggggttggtttygtagaygyggggtyggggaagttygygygygttattagtagyggygtygyggggyggggggygtagagattttttttaatttyggtttgttattatttggttygygygtagtttyggtttagaatgttttaatttgygtygattgttgtygtygaggtgttttttttttgtagggatttygaygtygttagttttttttttttttttygtaggtgygtattgttgtgtttgyggtygggtgggygtttygtygttgyggtygyggtygtygttggtaagttgygttttggggtttggggtaggaagtagtggggggygttygaagagtagggtagttayggttatygtggtygtyggatyggttatgtgttaaagtttttggggttyggygtttygttgggygygtagygyggggagtagaygygtygtgggtggggtagygyggtgttgttggygttyggttttygyggggtgtagttttgygygtttttatgttgttttttttttttttttttygygttgttttttygaggttttttygtygagtttyggygyggggtatgaggagttttygggtgtygtttagagattagtaggttgygygtatatttagttagyggtagayggggatatgagtagygygtayggggtttygygttyggyggttagttttattyggyggyggttagygggttaaygttgttygggagaatgaggtaggagtyggyggtagtttttttttttttttttttttygtttttttgyggtttyggygtttygggttygggtygggttgyggttttgttgygtgtttygygygttttttaatygttttyggatgygtttttyggtaagttaggtttttygtttygygaataaagtttttttygtagggttyggaggtyg

SEQ ID NO: 6283 - DNA, 1092 bp, Artificial Sequence
  Description of Artificial Sequence: Synthetic polynucleotide
tyggattttgggaggagygttggygtggaaagttaggttatttygattttggtttttaggttygggataaygtgttagttttaagagagygttgtttatagtttygggtgggttgggtttaattgtayggggyggggygttaatagtttaggatttgggttgtaggttggtttttgtattaattagyggggyggtttygggttttagtttttttatttygtttaygaagggaggygattgygagygtttggggtttttgayggatttygtttygggggtggggyggggagtggttaygtggaggggygtttygttygtygagtttygttttatttygtttygttygttttygtgttyggggtttttygtttagtagagatttggagttagaagtttagagatagtygagtgygtygtgyggttttyggaygttygttgtttagttygattttygttaattgtgtaggyggttgattygtagyggtagyggtagtagygaggattygagygttggttgtagygatattatggattttttttttatggtygygtaggtaayggggygttttttttaygygtttygggtygttaagtttggggaggttyggggttayggtttygttttttaygttggggttgggtagtggygttygttygygattygygtttyggttttttgtttygagtyggatatttttatttggtgtaygygtygggggyggygatygyggttttttyggggtggggygggttgygygtttygtattttygyggttygagttgttttygttygggtttttttygttggtaggaaggttgygaggagtttgggtagttygagtygtttttttttgtttattttttattgttgttttttttttggggtttyggagttttttaaggtygggttagtttagattygygygaaygtggatgggtatatagtttygtttttttttattttgttttttygaggygttagtaatttgttttttgtyggtgatttygggygttttttttgtygtygtttgaggaaggttttgagattygttttgtgatygtgattygttaagygtygaygygtygyggtyg

SEQ ID NO: 6284 - DNA, 1092 bp, Artificial Sequence; identical to SEQ ID NO: 6283
  Description of Artificial Sequence: Synthetic polynucleotide

SEQ ID NO: 6285 - DNA, 1092 bp, Artificial Sequence; identical to SEQ ID NO: 6283
  Description of Artificial Sequence: Synthetic polynucleotide

SEQ ID NO: 6286 - DNA, 580 bp, Artificial Sequence
  Description of Artificial Sequence: Synthetic polynucleotide
tygttygggttygyggattgtygggtyggtttttagttatygtataggtgttttggagagtgygattattttttgtttttygtttygygtyggttttyggtttagtgtttygttttttttggagtayggtttgygtatgygygygttttagggtttagttttgtttttgtttyggtttttgyggggatggatgttttaygtagtaagygagtaagygagttttggagatyggggttttgggtgtgyggtyggtttagtgttaygyggtgagataggtatggttattaatttaygttaaggyggttgtgtatttggtatagaaaatattgttgttgaatgttgtttttatagttattygttagygtttattgatgagaggtgttattayggatattyggttttgtttygtygaagttttggtttattaggattaaagttaggttttagygggtttttttgttatttttggayggtttygygtttttttagagtttgatttttttttatttttgtagtttaagtygyggaagygtagatattyggtttttttygygtgttttatygggtttttttggatayg

SEQ ID NO: 6287 - DNA, 888 bp, Artificial Sequence
  Description of Artificial Sequence: Synthetic polynucleotide
tygtgggaggttagagygggygttgttyggygttatttttgtagygttyggatygtttygtataggtaggggtggtgtttttttttyggggtatagaaaygttatatttygggggygtygtttagaggttgtttttgtttttgtgtttttttatgaggttttgttttataaaggtagtttgagttaggattttaaagaggtttggttatygggatyggagggagtttygttttttaggtyggttttgtaaaygygagtttgygttaaggygttttgygggtttgttggtggtatygaggggtagygyggggttagygttgggagtttygaatttataygtttyggttagttgttygggaagygtttaagtataygtttygagttttagattggattaagttgtttaattatttattttttttttttttaaggagaagtttaattggagaagattyggtttttttygttatggtaggttttttttttttgattygtagttgtaggggttgagggtaggygtaggttygttttggggtygaagttattatygggtttygaggttgtttttttaatattyggtttgtaygtttggygggggygtaatagtgttttayggttygggagttygtttttggtttttgagtaaggtattttttttatttgtygtgtgtttagttgaatttagtatatttttttygtatttttygtttttttttttttttttttgaatttgtttttttgttttgygggtttttaatttttttygaatttygggygttyggttyggtttaggygagygttygyggttggggaygygggtggggaygyggyggtttgggygttgtaggatgygtttggtygyggaggagaygattagggagygggtyg

SEQ ID NO: 6288 - DNA, 1483 bp, Artificial Sequence
  Description of Artificial Sequence: Synthetic polynucleotide
tygaatattgatatygttttaaagttgtaatttttyggtttygttayggttttttatgtataaagagagggaattagtygtyggtgatttygayggttttyggattagggatgtttygagttygagygggtagggtgtttagtagggttaggtgatgggaattatggggttatygagtayggattttggttttttyggtggtttttgtgagttttggggttaggyggggattggaggagygttygygtygggagggagygtatygygttaygtgttygttyggygtttygtttttatttyggttaygtttttygygttttttttaaagtttygttttttagtttygttattttygttygtttygtttttygtagttttaagtttagygttttyggaggygyggayggtggggtttygygttttttgtgtygggttttgatygtygygygygtttatttattttagyggtygygggyggaggggygtaygygygygtagttttttyggagggyggtggggygaatagtaaygygygtattttagtttttggttgttgtgttgagattagttygygygttygygygtttttttttygaggattyggagtygttygygtattygttaggggtygtygtttygagttttaggyggaygygtaygygttttygtygttyggattttagtyggttygtttttygtttttttatttttyggyggyggtttttaggtaygygttygygtataygtyggttygggtaygygttygttaagatggtaggggtyggggtttagttgttagtygtygtygtygyggttttttttygtagttagyggtttygaygtttattyggagaagatgagttttygttgtttttygtagtttagttagaygyggagtygtygygttyggggtyggttttttygttagygttygygtttygygtttygtygtygtygtygtygtygtygggtygtttttggttyggygygttygttttyggtagygataatgaggtgagtyggggtyggygtttygtgggaggtggtagyggttagygtyggaggggttgggttgggggttygyggtgttttygagggygggaggggggttttaygggygygggggtttttagagaatygygggggttttgtagagattygggggtatttagagygygggaatggtttygygagagtygtgggggygtttggagagtygggagggtttgtagggtttgtggggggtagtgttttgtaaggggtaggyggygttggttttggttgtttgtggggtttttttaggtttyggggggtttgyggyggtttgggaggtagattttygygggtaggtgtggtygtgtttygatygygygaggatygaagttggyggaagtttttgtgyggtgttttttagttyggaggaggttggtttgaagtttttaggygttgtygaagtttttttttgttagygtttagagtygyg

SEQ ID NO: 6289 - DNA, 3714 bp, Artificial Sequence
  Description of Artificial Sequence: Synthetic polynucleotide
gygygygaggttggggtagtttataggaggagygygggattygggtttgagtttgtatttaggtagagygtttattttygtttttagtttyggattttgaaagtaaagtygtygtgttyggtagttagttygaattttttagtttttagggagtyggggtyggggtagggaaggttaygggtggyggtataatygggattttggagtggaggygtagattgygggtttygttgygtaygtttygtggttyggttggggtgggttttggaggtttataggttaaggttgaaygggggttttggagygtgggyggggtggagtgtataggttattgggttttgagygtttttatgggttaggattttaaygygtygtgtttttaggatagattggagggggaaggggttgygattatgttttagtyggaagggttttatagtagtygygttgttttttttttgtyggatattyggtagtagatatygaygtttgggggttagygaggtaggtgggygyggatygygattygattttggtttttaattttygtttagtggygygyggggtygtygttttatatttttagttygygtggttggtgtttggttygtygtyggggyggaaggggygttgtyggygtaggtgggyggggtyggagygygggggygygyggygyggagygagygtagggttygggggygyggggygyggaggatygggggtttgaygggyggttttgygyggtgyggggygyggyggyggygggygygyggttagtgaaygygygggyggggyggyggtggygggaggtattaggggtygtttttygygttttttttttttatggygttgttttagtygttygagtygtttygyggygygtttygtaaggtttttagtttgttggagatgggggygttttgtttggattyggagattattttgggttttattagttattttttgyggygaygaggtaaggtgagggttgtygggaggggggygggyggygtaggygtygtttygttattttgtygygyggttygygyggtygggggtgttgygtygggaaggagayggtaggttyggagtygygtttygtagttygggttgggattygttgtygtatttttttttattagygttgtttaagtttttttttgtttttaaggttgtgttttaatyggatttattyggaggttgtggttagggyggagagygtagygtagggattttygggtttattttgygttttgttaggatgggygaagtagggggtyggggtttttgattgatygtgagttttygaggtgattttagttttgtgtatttygtgttttgyggatatgggatgtgagtttgtgtttttygaagygtygyggyggtagaagygttgaagttgygggtgtggttggttaggggygtaggatyggtgttttygatygttgygtgtttttgtgttgygtgtgtgggtggggggaygggatatagagagtgtgtgtttyggagtagtggagyggygggaggyggtgttgtttgtyggtagtgyggggtggggtttgggtgttgtttttagtatttagatttagatgtgggttgaygttygtttttattttttaggttgygaagagaygggtaggggaagygttttyggttttttaggttgggtggaaagygattgtaggtttayggattttagaaagagtggagagtttttgttattttattttatatttttttgygttttygaatttttaaggttattaaygattyggaaagtygggaggggattatttattttattttttggggagtgygtgygtgggyggggaggtttatttaagtaaaagggggtgggtaaaayggaaagggttattttgaygtattgagtttttgygaaggttttatygtatgtgtyggtagtygygtgttttggttttygtygggttaygattttyggagttttygagtgygttttaggtttgggaygygyggygttgtttttttagtttyggagtygtgtgygtagyggtyggtagggggtattygygttayggggagttygttygtygygttygtttggtttgattygggttttggggttgattyggagtttggttyggagttgtttgyggtygyggatgtyggygatatttggggttyggttaggtatagagtaattggtygttagggaagggygggggggyggttttttagtyggagataaataagtaattaatttyggagttgagtttttatttgttaggtttgttgataataggttyggygtaygttygtaggatttttygtttttygggyggtayggygygtatatttatttgygggtataygygyggttgtaaagataygtgtygttygtagaygygtygaggtatagataygtyggygyggtygttgttyggttygaggygtatatygyggygatattaatttaygygygatagttagatttaaagtggttygygatatgtagagtaygttgggtttgttggaaaggygtttgggagtttyggggtyggggtttygtttttttttyggtttatttygtygtgggttttgggtaagagygtttttttygtagttttagttttttygtttgtagagggaggggygtyggygttttttgggagaygygtagttttggtgtttygggagaggggygggaggygtatgygygygygtaattagattttygtygtygtttttagygttttttttyggggtagggatttatttaataggttggggtttttggagtgygyggggtygygtggggaagyggggattttattttttttaygygtygtttagtattgggtaagggyggggtattttttgggttttygtttttygtygttygtttygggagttygagtttygttttttttyggtttygttttygtttttygagygygtttatyggagttatygygtttttygygatattygtaggttttgygaattttygagyggttgggtygggttatgggggygtttyggggtyggattaygtagtygyggygttttyggagagttagygtggtygggagygtttgtygggtttttttygygtttyggttatggtyggtygyggygtttttttgtgygttgygtagttygyggtaygygyggttyggtttggagagggaggygggyggygggggttygggayggygaagatattygyggtgtgygttggatttttgggggtygggttttttgttgagggtagyggattygtaggygggattttyggggatggagggagtgggtgagygttagggtygtgtttagggtttttaattttggtaagagygttaygttggggtagggygygtaggggtttggattygayggaygttttaggtttattgttygttttygtttttatattttgtaggtggtygagggyggttyggttygygagtygtygtygttgttggaggtgttttttygaaagaggttattygtygggttygattaggatttatgyggtagtygttttgttttygaaggygtyggggtyggtttagagtagggttattyggtyggyggaggyggttggtgtygttattgttataygaagttggtggagtttaagygataggygtggaagttggttagygggttygggattatttttygggtaagtgatatttttttaggtygattttttygagtagggttaygtyg

SEQ ID NO: 6290 - DNA, 1266 bp, Artificial Sequence
  Description of Artificial Sequence: Synthetic polynucleotide
gyggygaggagggttgtaggtgaagygyggggagagggaggtygttygtttyggttttttttttaggggttttgyggttggttagygtttyggttgtattttttggtgygygtygyggyggygttataggtttttygattttttgattatygttttygggtygygygttyggtagtygggatyggtgatggygygggattgayggtygtttttttttagatttttttgtttygtttggggttygttggggttgyggygtygtttygagttgtatgtggggygggygygttygagtttagagygagyggttttyggygttttygaggyggtgtttygtygygttagagtaygaggaggagyggygggtygggttaggttttttaygygtygtagtttyggagtaygggtttttyggaggggatttggggygttttagtttaggaggaaggattyggaagtagaagyggagtygygagtygagtygagttattgttttygttgttygygggygtygggtgggggtttyggyggttggatgggtagyggyggygygggtygygggyggygatgggygaggagtagagtayggtgagyggyggyggygggttttaggagtygtagattttggttagtggtattgygggttattttgagttttygaggttttagggggatagygttygggygttttygttgygygtygttttygyggagtygagyggyggtggttgyggaagygattggggttgygyggatattagygttttagagttygygaggagtttggggttttygggttggagtaagagtygagtatyggygtagtttgygggattggtatttatygggttttttaatttttagattttgttattgtagttggagttggaggaggaagaggaggaagttggggatygaaaagagggaggggatgaatagtaggaggygtttttyggygaagagttggagtttaggattygygtgggggtygtygayggattggttttggaygtgttgggttagyggygttygtttttygttaagagataagttttttgtttygtgtattgygtggagagygatttgttygaggttttygtttyggagtagttttygtygttygygtygttatttggggtttygttagtgttgaatttttttagtattygtttttttttttttagttttygattgttttttttaayggattttttttttttygayggyggtagtatygagttggagttttatttggygttygagtyg

SEQ ID NO: 6291 - DNA, 1316 bp, Artificial Sequence; identical to SEQ ID NO: 6168
  Description of Artificial Sequence: Synthetic polynucleotide

SEQ ID NO: 6292 - DNA, 10783 bp, Artificial Sequence
  Description of Artificial Sequence: Synthetic polynucleotide
tygyggagatatttygagtttygtaggtgtttgagttgygttgygygttttagtygggaagtttttttttatttaatygygtygtttygyggaaagtttgggtattgtagaygtttttatyggtttatygatagttggttttgaagygggggtttagaaaagtaaaggggatagtgtttggagttaygatgtttttgatgtgaggyggttttatttaataattaaygaattaagttggaattgtaggttttatttttgttggggggaggattttaaggaatgttatttttttgttttttattttttgttttaygtttagttttttagaaggtattaggygtgagtagagtgygaggygtttatattttygtgttttttttattttyggatatttttgtattttagtygaggttttagtayggagtgagggttgtttggggtgttttgttgtgtgtggggygtttttgtttttygggttttgattttayggtttgggtyggygaggygtttttttttggygtttggattgtgygtttgtttygtttttaggygaygaayggtaggagtygggggttyggygggattyggatttagggygggyggaaggygagggtttttttttttyggaattttygtttyggaaatttgtaattaaatygggtttttttttygtatygttttygygttttygggtygtttttttaygygggtatttatttttygggttttygtagtatygtttttttygygtttattygygyggtygaygtygttaggggttttgagatygyggagatagygygttttggygtttggtggggtttttttagtggttagagygtttttggattagtyggttgtggtttgtgtttaaataygatggaaatyggggttgggaygggyggtggtaygtaygtggaggagaagaggtatggygggaaaattatagtygaatataggtygattygtattttttaggtattygtygtygtttgattygyggttttttttaaggtttygattygtygttattttttggtattatttatygggtttygattygggtygygagttygttgatgygtagttgttttyggyggttttygggttttgttyggattygygygtagagaygttygggaaygttgggttygggygttttttggyggyggtagtaygyggtataygttyggtttttyggttygagggggygygtggagygtaygygggattygygygygggtttgggttgttggtttatattttttygtttgttyggatggyggygttgaggtttattygtttttttattaataaygatgtttygggagggaaaaaatagagtttttaaaaattagagtgygagagaggagtgtgtgtgtgtgtgtgtgtgtgtgtgtgtgtgtgtgtttyggggygttggtgaaagtaataaaatttagatygtttttttggygagatagyggyggttataatgygtyggggggattaggggtttatttgtagattttggataaaagatgatatatygatayggtttagagtgttattgygtttggttttttagggagttataagtatatattttttgaaatatygtttagtatagtatttaattygttygttatttaatatygggaggggaattttagtagygtataagygygttttyggttttttggttttgggtggggagagtttaaatgagaaggatttggtatgtttagaygtttttttttttggtttttgtttttagtttaagtaattatttagygatgggttttaataaataygtttgagaattgtttttatgttyggtaaatattggattagttttttaatgattaggtttttgaaaaggttygagaaatatatattaggttttaattaagtttaatagttaataggtaaggaaataagttatttttttatttgaggtggggaatgttgggaagggggatttttatttttattaaattatttgattttattaaatatgatygttgtattaaataggaaagggggygtatttaagttttttattagtyggaatttttattagtttagttttgtttattaagggtygagtgattttgtggggaatatatttgggttttagtttttatttttatagagtttagtataaattatttttgtttagtatatatggtttatttggggattgtttatgggagttttgatttggtaattgtaggggagaaggtatgatttaaattattttygattgtttygygttaatttggatygtttagaggaggtaaaaaatgggtaaattttttggaagttttgttgtgtttttttggtattgaattttgtaagtaygygatataggagatattgaaaattaaagaggaagtattttttttttttaatatggggagagaygttgttggaagaagtttttgaagtggttttttatygtattaagaggttagtgggatggattttygygtataatttaaaggaaygygygygtttttagtttttyggggttggtaattaagtggttyggtygggygtaagtygttttggaatyggttgtagtttaagtttagttgggttygggattgagyggtatttttggttttttagaatttttttygyggtgagtggaagggyggtttygygygygggygtttyggggtyggtyggttgygaaattagggggtggatttttatttatttaggagtygttaagttygtaggggatygagtattatttaggttttgggtattttgagttgttttttgagttttaggayggttygatggtgtagagtttttaggtagaagttagttttttgatatatatatagtagtgagtaaagtgygtataagtgagttaaattttgaagaygtaggttygyggatttttattttagygttagagttaaggagatagaagagaggaaggagagaagtgaggaagggagagagattatgagaaaaagagattatgaaagtagagaaagagattatgagagygagattatgagaagagagaaaaagagagattttgagagagagagatagaatgagagagatttaatttttagtgttayggggtttaggyggggtaagygtttttygaagttattaaagataggggtggttttttttttttttttttagttttttttttaatagatatagtaygaatttttaatgygttttttttttatagataataatatagggtttgaaagtyggatataatttaggttttgtgygggttttttttygygttttttyggtttagttggttatatggaatttagtatggagttygtggatgataaagggatttagtgataggtttaataaaattttaaggagatttttgtttgatttygggatttattgtyggygataagygygttgaatggtgyggggtggggyggggggtggggggygggttttttttttttttttttttttttttgttttygygattttttttttgtttttttttaatatgtaygtttttaatattttyggtttttagtttttttattgtgyggttttgtatygttygttgtagattgggygaagatagattgttgaagyggatttygygtygggtgygtttttagggygttggggttagggttatatagggtttygtaggygtttttattgattttatggggattygaggatagagagaggygggygtygggtttatttttygggttttyggtyggttataggagygtatatttagattgtaggttygyggttttggttatagttttaaatttgtttttaatgagtaagtggtggaagtttgttagggtgaggattttttaygtttttttttttttttttggaaatttgagggttttttgtgattatttttattttggaagttttggggtttggaaaagttaaaatggttttaggttttttgatagtttygttttaagagatttgaaatttttatttttttttttaagaggattttgggattaggggaagttgtaagtggatgttgagtggttagtattagggtaggttgggygtttaattattgtataataaattatttgggagaaattygttggtttttaaaaatagtaagatataagtttttaaatattgttaagttagtgtggagaataaagggagattttttagtatttagaaaaattgtttttttttygaggatgagttyggagatgggaaaggatttttattggggtattagaaagattttygagtttttaattatttaggggyggtgtggaaygygggaataaagtgttatygygtttttgggttgttgygtagagtgttatygaygtatagatttggtygtayggataattatgtttgttttagatattgaattaaatttgattattaattatagggagygagaaagttagttgggatygttttttttgttyggtttttttattgttatttaattttttagttttgatggtgtagtttyggagagaatagagatataatttttaaatgygtygaygtttagttttttagygtttgtagtattygttgggttttgagttagagttttaagtatttttagaaattygygagatagaggagaaaggtttattttttagttggttaggttttttaagaygttttttygygtggttaagtgtgygttagtatttgttaaggagatttttttttagtaataagggtgggayggaattygtttttygtyggaaagatggatgygtttttttygggygtgttyggggttgtgtgtttattttttattyggggagtttattttatttttaaatttttattttttagtaatttatttagttttaygtttaagggttgatttggggggatygtatattttggttyggatygtygaaygttggagggaaggaggttygggatttagttttyggagagaggtttggaagttyggaaaggatgggagygtaagggaagggagaggtatggtttgttgggattgttaaagattttygttttttggttttttggggttaaagattttagggagggttgtagtattttttttttttttygagtttagaatttygygtattttttttaagttttttaagttaaagtttygygygttttgatygtttttatttttagttttagyggttttttaggttagtattagttygtagattttgaaaaggagtggggagtggggagaaggtagttagttttaattttagatttttatttatttatttttttagygtgaggtaagttaaatgtaataaagtgaaagttatygagtgtagtggttttaatagttttttaggttgaaggagttatttatagatttgggttagygaggggggtttgtttttttygtttttgyggttttygaagttattttttttttygtagtyggaygttgtygttyggggtttagatagygygygagattaggggagatgygggggagggtgggyggttttgggttttyggtygatygttygtaggtyggaggtygagygttttttttttygttttaattttaggygyggggtgtagtttgtggtyggaggggtttgtatygggagtttygttygttttagggtttyggtattttyggttttttygttygagaggaatygtttgtgggagtttygygggyggtygggttyggtttttaggtttaggttttyggttyggygtagtaggataaaygggagggtagggatttttttttttttttttttttaaatataggatttttattaaaatttttatttaaaaaatygaaagttttttgygttyggygttgttggggaatygygtygaatagttgagttttaagttyggggttgaaggttyggaggatagggtagagggttttttgtttatagggtttttttttttatatttgagaaatgtttgtataataaaataaaaagagaaaggaagaaagtaggggaaaaygtaaaaataaaaataaaataaaaaataaatttaaataagttataaagaaaggagttggatttagaygggaaataggtyggttttgaaggttattttggtaataattattatygatatttataaygaaaagygaaatttgttattagttgttagaaygtttatatggttataaatatttagtatttttttatttttttttaaaaaaaggaagaaattttttgtatttttaaagtgttttttatttgttttagaagayggttgataatatygttatttatataaatatattttataaaatgtaygaaagtaggggtggggggtyggtttttttttygtttttaagtgaygatattaaygttgggayggtttggttttttyggggagaggtaaagaagygaagttgygtaaatattttgtaaatayggygtagagtttagtttttttttaaggtttagaaggagaggtatgggtagagttgggtgggtggaatttgttattttaaggagaygtaggtaatttttyggygtttttttagtggagtygagagttaattygattttataataataattataataataataataattattataaggatygaggttttttygtygttatygtygtyggggtggggtttgggtttggggtygygagtttygttggggyggygtttattaagtttattgttgggtttggattagggggtgtgttgtygggtattggggggtgttggtygagttgtattgggygttgtattgtatgtgttgtagygattgygygttgtaggtagaaaagggaatgttygtttggaaggtggyggttgttaggttttgggttttgagygygtgatatggtttgtygtttttgattaagaygggtayggttattyggygyggygagggtaggggygttatttttatatttttttyggttygggygygttttattttgtagyggtggttttggaattagattttgatttgygtgggygtgaggyggatgaggttggttaggtgttygygttygggygtygataggtatygttgttgtygaaagygtygttttagttygtaggtttgygttttggagaaaagtattygtygttttygttttttgtyggygtttttttygtygttyggggtttttttgttattgttyggtgattygtyggtygagggtttyggggatttggagtttgagttttgagggggygtttyggtagttagatygtgtattggggggagggggagagagaagygygttaggygtttggaggtygygygtagtttgtattagattyggagtattttggatttttygtgygattttggattttygygtttggtagtttagtttygttgtttttgttatgatttttgtttttttttaygtttgaygaagaygtygggattttttagggtaaagagggaaattygtaggagtgggggttaggggttygttttttaaggggtttatatagtgtgggtgagaatttggggggggaagtggtattgaagattatygygggttaagggtttyggygtttttaagyggtttttttttyggygagaygtgggtagatttttaaaagaaatattttataattttagtattgatyggttyggttatttaaggtaggtttttgggggttttygtttttgttttygggttttttagatattttttgtattgtataaagygttttttatgatygygtagggggtagggtgagttatttatattygggttattygaagtttttttattttttattygtattyggaygaggttygttggttatttttagggygttaggttagttttttttagyggtyggagttygggggttgyggttggagttatyggttygggttgatattatatattagtttttgggaggtatagtttttttttttttttttttttaatttttygtattgaaaaaaattttggagattaagttttttttyggaattaaggaggtttgaagaggagggtagaggatattttatataggtgttaaaaatttttttayggattygagtgagggggttygggtttatatggttttttttttttttatttttagygtttaattygggttgyggttgtaggaatggaggggattayggtttyggtagttaagttttgttatttaygggagtattgaaggttttyggtgttggttagttagygygtgtaygggttgtygttgttgtygtagaaggggttttttaggggtaggttttgtatygygtttagggygttttgttttagyggttyggtttttttggttggttygggtttttygtttttttttttyggattttyggttatagagttttttttatygttggtgttyggtaggtttaagatgtttttgatygaaaatttygtttttgtgttggttagygatatggttygagattttaaaatttatgtygtaaagttgtagttttatttggttaattygtggygtttttttgttttggygggygggggaggggggagttggggggagggattgggggaggggaggggggaattggttttaattattgggataattattatttttaaaaagagaaagaaattggggatggggaggaaaaaaatgaagtttaatttagtgtttttttttgttttttttgaaagtaygyggaaatggaygtaggaagtygggyggtttgygygtygagygtygygggtttyggttttagtttttaattttaggaggggtgttaaggyggygttagttygggtttyggyggtygttyggygygyggtggyggttggtggygaggaaaaaatgggttattgttygagygattagtttatataaggttgggttttatttaygaatttggggaggyggggagagggggagaaagagagggagggagggaaagaaagagggagggagggggagygagagagggagygggagaagggtggaaaaaagggggaagagatattaaaaaygtaaaggttggttaygtgtgggygggttttgggagttaagtggatgaagatagtatttgtagatgtgaaattgtgggttttggggagtttygygtttttagttaayggttttttagagtaagatgagaggtgtaaygtgttaattaattgtaaagayggggygagtttttttttttttaaatttagtatttatatataaagggttatygygtygttygygagtttatatatttgaaagggtygttttaataaattgtattttaaaaaaggtgggggtggggaggaggaggggagaaaataaaatagaaattaggaggagggaaaaaattttttttaatatttatyggtttttattttttygttttygygygtttattttyggtaagtyggaaaattggygatttgtggygtttttggaaaagggggagggggygaaggtygagttgyggaaattttttttttttatygttggtggttgtttaaataagattyggtttaaatggtaagagtttaatttttgtaagttttttaggttaatattttggttgaggtttaaggatgagtgttagaaatgataaggtaagtaattgattttagttaatygygagagagtttaaaatttaggagagagtttygtttygggtyggttagagttattattaagygattygtttttttttagtygttttttatttgttaaagatttatttattttttttatttygtttttttttattttttatttttaatttttygtttttatttttttgyggttaaggaggaygygtagtttattttttgttttgygggyggtttyggggagggyggggtaagagtgaggagttttaatttygtttggggtyggattttggttttgttgtttttgggttttgygggttttttttttygggtggaggaaagggtagayggttttgtttttttttgttttttattattttttttttttyggttttttttttttttagtttttggttagaggtggagtagygggaaggyggyggggygggattgygggggtgggggtgggggttgtgtttttagtttgggtgaagatttagaaagttgygggggaggggggtygttgggtggttygaygatgtttygttttttttttagttttttttttttaygygagttttttagtgtggtttttttttggaygttttgggtgygttyggagtaygygttttaygtttttaggttaagttaggttagtgtgaagtttttagttattttyggttttgggaattgaattttttygggatttgtatttttttttyggygttggggttggaaaagattaygtygtatttgttatttttttttttagttaaaatttttttggggggggggtgtaggggtgtagattggttatttgatgttygttygttttagaggagtgttaggaaggagttttgtttgggggyggggaggggtatagaaggttatttttgyggggtttaggtttagtttttttataatttgggttttttygygygggttaagttgagygygygggtatygggtttttttygygygtagttgtagyggaygtygtygygttttagttgttttygggttgttagygttgggtgagggtattttttttygagtygttyggyggttttttgtagttttagttgtttygtttttagtatgtgaygtgggtgataatggtttaggttagagtaagtttttygtyggygygttttgggtggtyggattygggtaaatataaatataaatygattgttaagttgyggataatgagygaaatgtagataaatgtttygttttygttggaagtttttgtttyggttyg

SEQ ID NO: 6293 - DNA, 810 bp, Artificial Sequence
  Description of Artificial Sequence: Synthetic polynucleotide
gygtaygggtyggggagggggttatyggatttggatttygggatatttygggggtttggggggygggtygygygtttatttgygttttygtygtygaaggagtttatgtaygggaagtagatggygagygtttygaaggaggyggatagattgaggyggttttgygagygttttatgttygygtyggygtygggygtttyggtygyggyggyggyggyggyggygggyggtttgggtagtttggtygttttatttttgaygyggagtayggygygyggygtggtggyggyggttyggggtygggtygaggtttygttgyggggttggygggygyggyggggtyggygggygggttaggagttggyggygygyggagttygaggygygttgtgttgttggyggyggyggyggyggyggyggtggyggyggyggtggyggygtagygygttttggttygyggygtttttygtyggtagygygaggygggtttggagyggygtygtagttaattygtgtygtygggggagggggygtygttgyggggygtgggagttyggagggygygggttgyggttttttttagtagttttygggttyggtaggtgygygyggggaggtaggygtygggygaggttgtttgggttttggttygagggttgttttygatttygtttyggtttttatttttagtyggtygatttgyggagaggtyggygtttagttttttatttagataggttttttttagagatattggygygttyggaggggatgygtttaaagggtttygtttaggygggtyggtattyg

SEQ ID NO: 6294 - DNA, 1142 bp, Artificial Sequence
  Description of Artificial Sequence: Synthetic polynucleotide
tygggggagaaatttyggtttatagtygggatgygttttygtyggggttatygyggyggygaaygtttyggatttygtatttyggtgattttttgggatgaatygaagtyggattygtattttggtygtaataagygygttttaygtygttaygtattagyggtgattttygagttttttgtygttttggttttttygtaggygggtttygaggttttygtagggagtttagggttayggttaygtgtagtygttttygagttygagtttgtaggttyggggttyggttygygttttggtggygttyggygaggttgtagygygtaaagtttttattttaagttttygtygyggygttttygtttyggagttggttyggtygyggttttygtttttttyggttgtttaygggttyggggygaggaygygagaggggtttggaagtygttyggggagttygttttgtttttyggagtygtygttaaatttyggtttyggggttyggtttagttttygttttyggagttayggtygtttygtttttgtttttyggttttygtygggtttygagtgygtygggagygyggygtagtagtygtygagggagggagygaggtaggaggygggayggagggaggggattgagygyggggyggggagaaggggygggtagtygaaagygtagygtttggtttygtttygtttygggatagtggtagyggygttatygttayggggygtttaggygtttaatygggatttygtattttggattygggggttttggygygtttgttggattgygtttttygyggttagtttttgagttygygttygggattgttygygttaygttttttttttygttgttttttttttygtttgtttttttaggagygattattttgyggttttttygtttgtaygygatagtttttaaggttttygygtttygttgttttggagttttaygtattaggyggygyggtagttttttagggtygygygttttgttagtttttttygyggtgtaagtgtttyggtggtttygggttygygtttttagtagtatygttttagggtttatatgtgttagatattaaaattttatttttygttgtttyggggtygygttttaygyg

SEQ ID NO: 6295 - DNA, 2885 bp, Artificial Sequence
  Description of Artificial Sequence: Synthetic polynucleotide
aygttgtagataggygygttgtagggyggyggttttttttttttggtattatygatagtygaggaaattgggttaataaagtyggatattgyggyggggtygyggggygtaaatyggygyggatagatgggttttygggggtattttgttyggttttttggatttyggatggtggtagagttgggagttgygtaggaygggtattgygtagygtattttygtttatattyggyggggtayggggttygtagtagtttatttattygtagttyggttttttttttyggaagggagaggggatyggtggggagggggtttgttggatattagggttagayggggtttttttttgatygttagggttaagtagggygygggttgtgaggatttttttttaygtagtttttygaggtagagggttygtaaagyggtttttatttaattttatttygyggaygttttaggtagyggatggyggygggggggggaggttaggggatatttaggggataaattttttagatttygaggtagtyggygayggygtttaatttttaaataaatagaataaatttttatttggaaaaggtttttttyggggtttttttgygttygyggtttagtttttttgtagayggttatygtgggtttttygtagggttgyggagtttyggagttatygaggtgggaggtgtyggttaygygygtttttaggaatagagtattgttttgtagtttagtaygaagggtyggttggagygggagygygaggtttattgtaagaggattaggagttagtaagttyggttttttttygtttttatttttygtgygttyggggttaggatygtttgttyggaatttgattagtgttygttttygtygtggttttgggatttygyggtggtttttttttggggaygaayggtagtgttygaaggatgttttatttattttygtttttagatttgttgggtttygataatatttagtgggtgtygygagttttygggygtagagtttagygttyggttttygagtttaatttygygtttygayggttttggygtttttygttgygttaaattgtttatygygtataggttggaagygaagtygggttttttttttttggtttgtagggtttttttaggttttttttgttygggtagagagatagttataggggygatyggaggaygygtgygggagggtygggggttygygyggttayggtttttygtgatagtgtttgtaaagygyggagggygtttyggagaaggyggygtatttgttagggtagggttttagggyggygtttgyggagaaggggtatatagtggtttggtygaagggygttaagggygyggygtttaygggygyggttaggttttggttttggttgaggaaggttattaggygtygtatttygtttagggtttgygtttgtatgaggatatagtttttggygagtagtagygtggygattttggagagtttgygtatygaygggttgtgygygtaggggatgayggttygtagttygtttagygygtygtttaggtygtgtatgygtygtygttygygygygttgatgttgagtygtagagatygttgttttygyggtygtygtygttygttygtygygttttttggttygygtygtygtygtygttgttygaaggygtygttttygttttygttttgttygtygttgtttttygtygtttgagttggggygygaggtgtaggygtygyggggaggtygtygttygggttyggagtgtygtagtygygggtygtttygggttttygygtygtttygtaggygagattygtagtygtygtygygtagtygtggtttagtgttaggtaygygtttttygatagygatttgagttyggttatggtygygtygtttgggttygggggttygtygggtgggyggatgtttatgtgggtgagtagttttygaggtyggttygagttygtygttgtygttgtygttgygatgaggttttyggttttgygygtyggtttggtttgtttgygggttttagagtttyggygttygttgtttttttygtttttttttttttttttatttttttttttttttagtygygaygygtagggggygggttttatttttttttygttttygtttyggttttaagtygyggaggygttyggtgggatttygttgttgtttaattaggggggatygggtgagtttttttttttggagtygggttttattagygtygtaggtttataggtygggggtgggggttttggatygaggggyggygyggggyggygyggggyggygygygyggttttggagygttagtatttgtttttygatttttyggtygtygttttyggtygtttyggggatttygttattaaaygtaygygttttaggtgggtattygtttyggttygtttttgagtttgattttagygtaagagtttttggygataygtaggggttagagygggggggygygtygtaatagtagtagygttagygttaatattttgtttygttgaggggtygtttygggtyggggttagggtygtgggygttttggtgtagtygyggygtagygtgtattyggagttygtatattttttgttyggggygttttgtggttaggtttgaggggtagagtgagagggagtttttagaatttgttgaaaaaygttaygagygttgtaggtyggggagggygggaaggtggagggtagygyggtttggggtttttygggggtgggaggggagttttgtgagttgtaggatygttttttttttgttagtygttttttgggtatttattagygaaaygygtgaggtttggtgggttttttyggagttttyg

SEQ ID NO: 6296 - DNA, 1460 bp, Artificial Sequence
  Description of Artificial Sequence: Synthetic polynucleotide
aygygtatgagagagtagagyggtagygaygyggtyggatyggtygygggggttgygggaggaagygttgtagggattygggyggygtyggyggtttagtyggagatgtaygygttgtaatagatygygttgttggygttygatagygyggagattaggttgtttttttttgggtaggatatggygygygggtttagtttggttagtgttaygtggtaygggagttygggggygtygggtygagttyggttgtagttgaggtattggtygaattyggtgaggtttaygtyggtttatagatyggyggygggttttagyggttyggygttttttagyggyggggtttygggyggyggygatagygggtyggggtaygggtygggygtgtttagggtgtygtagtataggttagygagyggygtygyggggggygyggttttgagygttttygttaggggagtttygtagtaatygtyggggtttygygataattyggtgggygygtagggygygyggaagggtygtagygygtagttttygggygtygygggyggtgggaagaaggtagtttygtygggttttaggtygtttagaggygagygttygggygtgggtagttttaggtygtygaattyggygtttagygggggtagttygyggaaggygygagtygagttagaygtygyggggaaaggttygggyggtggttgygggggygttaatttygggagtaggaggtygggttttagtygtygggttttgygygtttgttttttgyggygyggtyggtatttgtagttggggtggtygygtaagtgttgtaygygtagtygttyggttttttttaygaagggtygttttttygtygygtttagttttttttaygttttgtttgygggtygtgggygttagtgagtggaaygtygtygggygggtgggygtygagtttttygtgygttygggaygtttygygagggtttggygtagttttygtatttygyggttygggatttttgtttttttygttttatttyggttygagtttttttygtttttttttttttttttgtygttttttygtygtttatttagtattttgttgagtatygygttgtgtaggttygggttttgttgagttagtygtttgygttygttttttgtttatattatgaaggygtttatgggtygtyggatgygygattygtttgtygtttggygtttttygyggtyggtygggttgaggttatagygtttyggttyggggttgygygggggattgygttgygggttgggyggygaggygggygyggygggygyggygagggyggyggggtyggyggygaggtygygygtgttagyggyggtttygtgtttyggggtttatgtatagtygyggygggygggygggtygttttgtgygtygtagtygggyggygatttttgtattttagttgggygyg

SEQ ID NO: 6297 - DNA, 1560 bp, Artificial Sequence
  Description of Artificial Sequence: Synthetic polynucleotide
aygttttgtagtgtygggttttgyggygattattgagttttttygttttygtttttagttttttygttttygttttyggttttygtttttttagtyggtyggggttygtygtttaygatttygtaygtgtygtygaygtygttttgtygatttygtygtaggaggtggaattgtagtggtgtyggyggttttttttttggggyggyggtggygaggygttygttggyggygggtagyggttggatgaaataygttttttttagtaggtagaaggygtygygtaygttttygtagaggttgagggyggtagtygagttgggatygttatttayggtgtyggagtagaagtagtgygttaggtyggttttyggaagyggygtttyggattyggatttgygttttaygttttggagygtgaagtygggygttaaaaagttgttgtygggtygtagttttagatttagttgttggttaaaggygtgtaggyggaggygygtggtttygtgtttyggggygygttttagtttyggtattattagtttttygtttttttyggaggggygttygagtgygttygatayggttagtagygtygyggygagtagtagtagygtgggtattggtttaaagtttygagatttyggagttygtttygygttttttatgtygttgtttagtttgygtttttygaatttttygggtatagttygttgtattggagttttaggagatatygttygtagtagygtayggagygagggatttttagttygggtygggagagtaaagtttygttggtttgttttggattgttaaaattaataatttttattattygttggaagggygygtagagtyggttatagtygaagttttyggagttattaaaaggaggygttgtagttttgtyggygygygggaagttttttttttagygtaaagttggagatattgagaggtaggygtaggtagagtggttttgttgggataagaagygttttggggygttttyggggttgaggtaaygyggagattggtgtttggygttttttttyggttttygttttggttgygatgttgtttattttgtttagggttttttttttttygttyggtagygtattttggttttgtaatagtttttggttyggagtygttttttagygagtgtaagaatygggtagtygagyggtttttttatagtggattagtgaaatttttatttttattttattttttttttttggtttttttttattttaaagaygtygttttyggtttygttggtgttaaatygygtttygygttgygggttygggagggggagggggtagttttygygttggttttaygttattgttygttaatttaggggyggaaggggygttgtgattagtattttgtattgttggggtygttttagggagaagatttttttttttatygtttttttttttygtyggttttttggattattttttttttttatygttyggttgyggtaatttagttatygygttgggttgyggtttttaggagggagggttyggttggagaayg

SEQ ID NO: 6298 - DNA, 5118 bp, Artificial Sequence
  Description of Artificial Sequence: Synthetic polynucleotide
tyggtgtygggagttttgtttttygtygttatttttggttagttttgygtaagaaygtygttttgtttggtagttaggtygagaygtagtttgaatgtgagtaggaattyggagaagggaagggagagaattagaaagaaggttygggagggattygggaagtagtgggaggtttgygttttggagtttygygagagttygtyggtttggtaygggtttttttygggtygttyggyggtttaataaaggtyggtttygataygtattyggttttttgtgggagagaaatataaagaagagggaaaaatayggaggaggttaatagtattaggaygygggggttaattaggaattttyggagtyggggtttattagtttttgtaaatgagtattttattttttaggaaggggttttagttgygygygttggtgggaatygtagtgtttgggattygtttaggtygtttatttygggygtygggygtaggattyggataagttttggggaygtttttaggaygtattagggtaagtttgggtatygggatttaatttttagttatttttgggayggggtggggaggtataggagatatatygagaggtatttagtattygattggtattagggttaagggagtttaggggygatatagattttttygattttttaagttatttyggygaygggaggatgttgagggaagtttgttaggtgaagaaggggttagtagtagtatagagttttygattttgttttttaggttttagattygygttatgttaagaygggtttttygatttttatttttgatttttaattttagttattggatygagygygtaaagaatttgagatygtttgtttttatygtygtaagtyggtygtaggatagatattagtgggtagtaataaaaaaagaaatygggtttygggataygtgtyggyggttggattaattttagyggttgtaattaaggagygygtaygttgygtttgttggtgtttattagttatattggtaggygtataatttygygtttygattggtggttttatagygygtattatatatggtttygttgttgttggyggggtaggttygaaggaggtatttataaatgttygagttttttttgatttttattttttygttttttgygtygttygagtgatagattttattaattgaayggttatgggttatttttgtaatygttggaygatataatattaygttttagttttttatgttttaaatatatatttaayggatggttgtagagttagttgggaaataygyggattgaaaaataatgttttagaaggtaygagattggggygaaggygagagygggttgggtttttagyggagatygtagagggagatatattttagaattaggggtaataaygtgggtttttttttgtatttgtttattttgtaattttgttatttgaagattaattatttattatgttaatttgtttgtttgtttttaaaatygtatttgtatagtaaaagttttttaataayggaagtaattygaygttttttatattttttaggagattgtgtgygtgtgtgttygygygtgygtttatagtgttaagtgttagtattygagatttgtagaaataaatgtttgaattygaaatgtatgggtgtgagaaatttagttyggggaagagattagggattgggggagataggtggttgtttgtattataaggaatygttaaygttagtatttgtagtttaagtagggttgttttgtaaaggtttagtaattttttttgtaggtttgttgtatayggtttttggttttttttatttgtaaaatgggtgaatgtattygtattttagttattttygtgaggtgtttttttagttygggtttaattttttatygttaagagtttttaggttttagagttagtttgtaatyggtaaaatatgttttaaygyggtygygagtggttttatttygttgtttggtttatagygtggagaagttttgtttaggtttgaaatttttttttgtagttttagaaagtaggygattgggayggaaggttttttgttaattttttatagyggagttttgtttggattatagatgttagygttgtttttgttttaaggygtgtggtgattataaagaygatattgaaaatatttattattattyggtttttttgttaataaatggaggggtgtttaattataggtaygattttgtttttgtgttagygyggttatygtgyggaaataattygtttttgtatttatattatttttaatttaaaggagagttgtgaatttttttaaaatatttttttggagttygttttttttttttttgttygttttttattttttaagtttttgtttttagttgggggygttatyggttgtygtyggagttgtagttayggttattttttagaygygygagtagagtattaagatagtggggattttgtgtttgggtatygtttatatttggggygttaaatgtttaygtgttgatgaaattagtgagatgggaataggyggygggaaattagatagaggaagagttagggaggagattttagtttyggattttgggtygttagggtttttygygygtattttaaaaggtgyggttgygtggggtattaggttagtttgttagattttgtagagtttttaaattattttattttttaatttgattttgtggtggtygtattttttatagaaatttgattaygtttttttttttttttggttttaagygygtttagttttttttttattttttttgagtygttttttttttttttttygttttttygggttttttttttagtttttttttaagaatttttyggttaygggygtttattggttgtgygtagggaggaggygtgtgttyggtttggygagttttattgagyggaattagttyggatgatattagttttttagtttttyggygggtttagtttattggygaggtagtttttttaggataygtatattgtttttygttttygttttygttatygttgtygtygtygtygttgttatygggttataaaaatyggtygagtttttaaaggtgyggatgtttattatagatygaygygatattagygttyggtgttaggtttttttttgaggtttttyggagygagttttttaaatygtatttagagtaagtgttttygttttatagtagtygtagtttagattttagggatagattttttttaattyggttgtgatttagaatgtttygatatagggggtttggatttttattttgygggttatttttttagagygattttgtttttttgttttttttatatttatygttgtattttttttattaaaagygagaagtyggagygataatagttttttttgtttaagttttagttagttggtgagtttttygtggtttttagatgtagtatatggattttgggtttygygtyggttttgggtgtatgtgygtgtgygtgtgtttgttgygtggtgtygatggagataaggtggattygtttgaggaattaaattattagttttttatttagatttttattttttttaaagaaaggtttttattttttattygtttattttagttygggggtttagtttttttatatttaattgaaagttygaagtttttagaatgttattygtatttygagggttattaaygttttttgaaataatttgttgtatgagagtagaggggagatagagagagtttaattataggtattygygtgtagttaaaaggagggttagagatagtagygagggggaygaggagttaygggttatttgtgtygggatttygygttgtggtattgyggtgtaggygggagtagtttttttgttttttattgatttatttttttttttttttttttttttttttttttattttttttttttttttttttttttttggaagttttygggttygagggaaggaggattttgygaaagttgygaygattatttttttttggggttatggattyggaygttagtttggtgtttagtygttygtygtygttagagttygatgatttttttttgtyggttyggagtaagggtagtagyggtagygtttttattgggggtatygtgttttygtttatttygagtgattgttygtyggagttgagygtygagttgygyggygttatgggttttgygggygygtattttggggataagttaggaggtagtggttttaagttattttygtttagtatttygtygtttaygtygtyggyggttgygtygtttattaagaaggataagaagtaaatgatagagtyggagttgtagtagttgygttttaagattaatagtygygagygtaagygtatgtaygattttaatatygttatggatggttttygygaggttatgtygtaygtatayggtttttyggtgygtaagttttttaagatygttaygttgttgttggygygtaattatatttttatgtttattaattygttggaggagatgaagygattggtgagygagatttaygggggttattaygttggtttttattygtyggtttgyggyggtttggygtatttygygtttttgttygtygttatygygtattyggtagtagtagygtaygtygtatattatttygyggtgtattattttattttgtygttygtygtygtagyggttgttgtygtygttgtagtygyggttgtgtttagygtttttttgttyggattygggttgtygtyggtyggttttattygtttatygtayggtttatttaagttttygtttgttgtygyggtygtttygttggggggygggggyggyggtagtggggygagygggggtttttagtattggggyggtatgttttgtttttgtagtatgtgttaggtgtygtygtygtattattaygtgtyggttatgggygtyggtagtttgtygygttttattttygaygttaagtgagtygattggygtyggygygttttggygataggggagttaggggtygyggggaagygaggattggtttgygttgggttygggagttttgtygygaggaggggyg

SEQ ID NO: 6299 - DNA, 1423 bp, Artificial Sequence
  Description of Artificial Sequence: Synthetic polynucleotide
tygtattygattgtaygygtttttttgggatttygtattggygagtygtttttttyggygttggaygttttatttgtttyggygtygtyggaagagttttgtagagtgagtttttagggttatttygttgttttttttttygttttygtagtygttgtagttagygtgggagtygggtaggtygygtggggygttggatttatygagaggttagygtygtygtygggggagggygtgtttygtaygtgtgtgttygygygtgttygygttygygtgtgttagygygygtgttttggtygtgygygtygagtygggtygtattaattttttyggygtygaygggtttagtttatggtgtgggygtygggtttagggaggtttyggttttygttaatygyggagtagggyggtygtttygaygygygatttgygaattyggagtgygygtygggggyggggtagggaygygtgggygggaatgtaygygygtggttaggtgygygtgggtgygagygygygggagttttygagtgygygygtgttygtgtgygygtgggtgtgggtgtgttygygtgttygtgygygygttttyggggttaagagygygggtygygygggtaggtttggatattaygygttttgttygggtttaggaygyggttggyggtttygggaggaagaggaggaggaagaggaggaggyggaggaggaggaagaggaggagggaggyggaggagtagaggttgggayggtyggaggagagagttyggttttagtaggaaaggaatttagtaygygattattggaggggygaggagtaagggaaggattagaggggaggagagggggttaggggagggaaagtgtgggagggggagtygygggggtgygygttttttttaattyggggtygtttttagygagaagtgatatttttttagttttattgaaaatygttgtaaatattgaaaatagtaaaagtgaaaayggttgygatattaagaygtttataaaatgatygyggattgttttygatgttgatgagaattgggaygaygtygygtagagygttyggagggagaggygyggtgttygggatttyggtygtggggaggagtyggatatagtygtygggaygyggggatgtygagggtatygyggtttggtttgatygaygtaygyggtgatagtygtttttgggagaygayggygtttgtaattagtagtttttaaagggtgtagttaggaggtttagtttgttygttttyggggttyggggttaagttttttttagaagttttygtttttaygygaatttygatygtaaaatttagtttatttgagygtygtttttttttttttatgtttttygggggtygttaygatygtttyggagygatttttaggaatttgtttygtagyg

SEQ ID NO: 6300 - DNA, 1384 bp, Artificial Sequence
  Description of Artificial Sequence: Synthetic polynucleotide
gygtygygtatagaaaaggaaattttatttygtttgttaagggtagggtygggttagtggtaggagaaggttagttgygggygtaggtaggagyggatttaggagtygygtyggggygtagagtyggaygtttygaggagtttgygygtygygttattyggyggaagtygyggtttatgyggggttttttaggtttatttaaygtttygtaggygtggttggtaggaggggttyggtygtgtttagygtttttagaygtagttttttttgtygtagtygtyggtggtygtgggtygtygyggygttgagtattttayggggaagttgaggtygggayggtyggtgtagatttaggygtygtagtataagaggtagtygtttattatgagtagygyggtggtygtttagtygatgtatagygttgygtttagttygtatttttgygataygggtatagaygggtygtaaaattygyggaygataatgttggygaattagtagagtggtaygagygttagtagttygtaaaataggtagagtaygtttttygtgagggttataygygttttggtygggttyggggttaygtaggtggtgtattgygygttygttagggttaygaagagygtaaygaaygttagtagtayggygtttayggtgagygttygygtygtttgtatttyggtgtttagagttagtatygagtygtatattttgtattgtatgtgttyggtgttttgtattaygtaygatatttatagttttttttaggtggtttgygtygttaygatgttgtggtttaggaaggyggttatttgttatatgggtagttygtaygttaggattagatttttttagtttattaggtatagtattaggtttaggatttttaaygttgyggattttatggttagaggygagaygygtattygaaggttygtagaatttttaaggtygtgttgygyggygttttgggygggttttggtgtttttgygttygygttttyggtttttggttttagttygtttgtttygygggtttgtygtattttttgggtttgttagtttttgtyggggggtattttttttgaaggttygggggyggattttgtttttygggttyggtttttyggttygaagtagttaattygtgygygggttatygtgtygtagttaattatagagtttttggtagttgaagttagggaaataayggtttttgaggggtagttgagggygygggatygtttttygttyggtagtygtttttagttttattygtygttgttttagtygyggtygagygtattttgggttggtttagggygygttttttgggtygtttttttgygygtttyggtttygttattttagaaggygttyg

SEQ ID NO: 6301 - DNA, 1361 bp, Artificial Sequence
  Description of Artificial Sequence: Synthetic polynucleotide
gygttttygattttygtygttgggatttttygtygtagtttttgttttagtttgtgttgygggtggggtygggttgagtagttyggygttttttatygygttttttatygtatygttttygatttaatttygttttygggygtttattggtttgtagtattttttttttagtttgtgaagtgagtagggggaggyggtggtyggtygtttttttttagygtttagtttggtttygyggyggaggyggygtttttttygtaggayggagttaagttggattgtygygtygygyggggygggtaaagggggygttgygttyggtttygggtagggagtgayggyggyggyggyggtttygggygagygtggttttygygtgygtataygtataygtygtygygtagggatatayggatttyggtygttagtyggttatataggygyggagattyggttyggygygygtttttyggygtataygttttttattttygygtygygygggtygyggatttgtaggttgygygttttttgyggagtttgtttyggttttayggataggtttygtagtgagtaggtaagggtygtttygtygyggttgtttttttaygtttyggtygttttttttttttttagaattttygtttagtygggatttyggatttttttttttggtttggyggttttygttagtygygatttttatygayggagagygggygagggtyggygttaggtaagttttttagatttgaaatgaagttttttttygtygttgygttttttttgygygttaggttgatattttttaatttaagtgtttggygttgygttyggggyggtygatygtygtagattgtyggggtgggggtygatttagttattttaygttttttttgatgyggagaagggagattaggggggtaggtaagttatgyggtyggagggattyggagggatatgtttttttatttttaggtggayggaygtatttaygyggatygggaaggtagggttggagggtttttyggggttaggtatygtaattygtayggggtttgaggggtgggtaagtaatgtgttaggtgggggttggggtaggggttagtgtagaatgtttttttgtggtgatatattygggattgtttaaaagagtgtygttttygtttttygtggygyggaggggttggggttggggatgttagggttttagtggtttttagaagaaaygttttgyggggtttgtggggaaaygtatyggtttttttaggttgaagtgggttygttgagatttttgtttgtygttttagaggtagaagtttttgyggyggttgyggggggyggaggttatattttyggyg

SEQ ID NO: 6302 - DNA, 1175 bp, Artificial Sequence
  Description of Artificial Sequence: Synthetic polynucleotide
aygttgtttggtyggagygttttataattyggttaatggggagggagtygttygttaagygtttgttaggtttygattaaygggatgggtttttttygttagagtatattgttttaatttaggagyggttgtaggatttgagttaatgagaygtaattttygttagtygygyggtgttyggttaataggaggtygttygtgttyggtagygtgggaggtgtggggtggygggyggygttgygaagttgagggagttgygygyggaygagttatagtttgttatagggtgggtgygttygttttgtttagttygttygtygtttttyggttttttttgygyggyggtttttggatgggggttttttttyggggggttttaggygygggtaagtyggtygtygtttttttaggtttyggggtttyggtygttgggggygygygggygggygaggttggyggtayggagygtttggttttttgtgggggygtyggtttttttttggggttttgygygtttagggttatttyggygyggtttaggttgygagttttgtygygtaygttagyggttaatatggaggtagtttyggygygtttygygggggatygtyggygttygtgggttttaagaggtyggggygyggygygygttygggttttgggyggygagggygtagygagggttgtygttttttygggtagtttyggggggygyggygttgggtygygggttygggggttgtygtgttygatygtatgygtygatttgtygttgggygttygtttttttttgttggggttgggygyggtttyggagtttggyggyggtggtgagggygtayggttagttgtagyggygttgtgtttgtygtggatttaggatattttaggtttggtggyggggttaggtggyggyggttttttgygttygggygatggygatagygataggtttttaatttygtttygggttygggtyggtygggtttygygtygggttaygygygygtatagagttttttygggtttttttaygttggaygtygatygttygttgtyggaggaygyggggaggggtatygttttttyggyggaggttggygtggttaagggtataggggayggygtyggygtttyggtagggatagtggggatttyggggtttyggtttttyg

SEQ ID NO: 6303 - DNA, 1087 bp, Artificial Sequence
  Description of Artificial Sequence: Synthetic polynucleotide
tyggtattygygtttttgtgtttttggtggtttyggygttttttyggagygygyggtatgtttgtttttataygtttagtatttttgtttttagagtaaatttattttttagggtataygtagaggggtagttaggtatygtttttattttgttttatttaggtygygygtatttyggaaatttggatttygygattagtttttttttgttttttttygaggattttagyggtagtgtgttttggatttatttgtagtttttaagtttttttatttttgygttttttttaggygtttttgagtttgtagagtttaygatttttaataggttgtttygaagtgtttttttttatatygttttaggaatgatttttttatattygtttttygtaaaaaaaagttggtttaagatttaggygttttaaggattagtttaggtttttattygaygygggttagggggtgttgttttggtagtttyggagtttyggtaaagagtaatttgtagggaggygttaygygyggtttttattattygttagagattyggtttatggggttaaayggaggggtttgtgtyggtygatattttaagttttgtygygtttttttygtygtttatygtatgggatyggyggaggagaaggygyggtygygggttttttgaggtagygtgtttygtttygggaggaaagtttgtgttatatagaggaggyggygyggggaggatttgggygtyggtgggtggaggygtgggyggtggygtygygtggtygtgtgtttgttttttyggygatyggtgygtttgtttttygtyggagttygyggtygtygygttttygttygttgygtttagygttyggygygtttyggttttagtttygaygygttttygtygtygtygtygygygttygtyggttatattttttttttttttgaatttatgtgtaaaatatgttaygttgtatttttagggaaagtttygyggtttttgatagtagtygttggagyggtgggttygtttagtttttttygygttttttyggagtttygttyggttatttttaygyggtygagttgtaagyg

SEQ ID NO: 6304 - DNA, 693 bp, Artificial Sequence
  Description of Artificial Sequence: Synthetic polynucleotide
tyggtagttaaygtttagttttygttttttttttttatttyggatttygtaatygygaggygagagagtagygtyggygaggtattggttgggttttgattgttaygttaattttttgttgttttttttagtttttagtygtttygtttttttttttttatttttagtttgggtttggaggygatttttttttattgattgagtygattgtatttttgggtaagyggygttttgttttttttttgtttttgtttgttttttttgtaaggttayggygtttggagtagggtttgtagyggtygtygtagtaaygygagttaagtygtgtttygtayggtygttyggggtygtattttygttyggtggyggygttygaagaygttagtygygttaygtattgtttgygtttygygttttagtygtygygtattaaygtygtygttttygtygggagttaagttygtygggtyggttyggttttaggtgggtagttyggtttgtagttggttggaggtggyggtygttgtagttttggtagygggtatatttttaagtataygtatttaaygttttttttttgagttaygaggatggagtagttatttyggttygggattggygtaaggtaaggtgtagtygtttgttgtttttygtagagygygggattatttttttgttygggtatttaggtyg

SEQ ID NO: 6305 - DNA, 5065 bp, Artificial Sequence; identical to SEQ ID NO: 6273
  Description of Artificial Sequence: Synthetic polynucleotide

SEQ ID NO: 6306 - DNA, 307 bp, Artificial Sequence
  Description of Artificial Sequence: Synthetic polynucleotide
gygygggggtyggattatgagtygttgagtygggtaaattttaggttatygagttagyggattttyggagygtagttttgygtygyggagtaggttttaattaggyggygaggyggttataygtatygagttagygattttygggygaygygyggggttagggagygttaygatggaggygttaatggttyggggygygtttaygggttttttgagggygttttgttttttgggttgtttgttgagttaygtygtygtygygtygtygtttattattaagtttttyggygatgtygtttttaaaayg

SEQ ID NO: 6307 - DNA, 1563 bp, Artificial Sequence
  Description of Artificial Sequence: Synthetic polynucleotide
tygggtttygaaaayggggggagggggaygaygttttagaggtttttgagtttttggtttttttygattttaagggtttttttttttyggtttttaggyggygayggygggtagygygaagtagtaggygtaggggygttgggatggggatgtttttgtaggtttaaggttttttttgggagtttaaataaagattayggtagygtygttttttttttygggaattygaygtygygyggttatagggggtttggaggggygggtagggtttygtagygtatttagtatagttygygyggyggagygggtgagaagtyggygggggygyggatygatyggggtgttttttaggtttygygtygyggttttygttygttttttygttygtttatygggtattttagtygygtagaaggyggaagttaygygygagggatygyggttygttygggattagttttaggttyggtatygtttygygggtygagygtttatattygttaaatttaygygggtaygttttygyggygtatygtttttagttyggttttygtttttgtagtygygggtaygyggaggggtttttggttgttygtatttgtattygygygtyggyggygtygaagtttygtttttygtttgygygtttgtttygttygtattttygyggtgagtyggyggygttttygtttttgagtttagggttagtttttttygtygtygyggttgttgygygygttttygtttagtttagtttagtttygagtaygattttagttttaygtaygattttagtttygygagtttygtatygattygttttygttttatttygttttygygggggyggygttttttttttttygyggttttygtttttttttttygttttttyggtygygttggggatttttagtygtygttygygattttttatygygaygttyggaggyggyggggtttttttgttygggyggygggtaygggggattattttttayggtgttatygtatttatttygygtttttttttygttttttggagtttatygggattaggtggyggygggtgtttttttgggggtgygyggttatgtaattggtggatttttttaaatygttttggaggggggagygyggygttgggggygggagagygtttttggttgtgagttgtttttgtygtttygtttygygtttttttgtygtttygtttygggtttttygygttttttttttyggttyggtygagygygttgtttygaygtygttatttagagtygggtygygtygggygtygagatgaaggtgttgggatatyggttggagttgtttataggtatygttygtttgtttygtagtyggtygttatttttygagttggagyggatttygggygyggyggtyggggattggggyggttygggtttgagtaggaaggggtgyggattttaattaagttttagttttgtgttatttgtttgtgtgyggagtttagtttygggagaggatttgaggttgtggygagtttttggygttggygttygggttgygggagtatyg

SEQ ID NO: 6308 - DNA, 512 bp, Artificial Sequence
  Description of Artificial Sequence: Synthetic polynucleotide
tyggtttaagttagygtatttygtygattttttgtttagtttaaatttygaggttgggtaaggtattggatttayggttggatygattyggggtagtttttgggtgaatagtagygtgttygtyggtagagaatygagattagygagtygattatgyggttgtatagattttaygygyggtygagygyggtggtttgtgggtttttgttgttttttttttagggttattatgaggttttygyggaggggtgatagggatygggtttagatttgttaaatgttgyggaggtagaatttgatagtgygggagggtaggygtttgggaggtaggagttggtggagatgatagygtggaattygtgagttttaygtaaygtttttttgtygtttagggtgggtttttagaagtatagaaatggtygggttgygggatattatagygaggaattagyggagtataggggttttaggagygtygggatatgttaggtygggtagatagtttygggtyg

SEQ ID NO: 6309 - DNA, 1070 bp, Artificial Sequence
  Description of Artificial Sequence: Synthetic polynucleotide
tygygagaagtataaaaggggaggggygggtygtgtagttaagaggayggttaaayggggaggttttttttttgttttygtagatgttggagtagygattggttygggagattygtgttttggagagaagtaaggagtagttgttttyggagagtgagtttttygygttaggtgggyggggggagggggatgtgttygggtttyggttttgtttttgaygttygtttatygatagggaggttggtgygygttaagttgygggaggtggagyggyggttgtattygtygtttgaggtygagggygttatggyggtgaatgaygggtgagaggggaagggaggagtgggygaggagggtaggggtagggyggaggggaattygtttaggtttttygtttygttttygattgtygttttttyggtttgtgtttttttyggygtygtygggttttygygtttyggtggtttttttttygttttttggattttygtttttttttttttgttttttyggtttttttttygtaggttgaaggyggagttggagatattyggggagtaggttyggagygttttygaggtyggggtyggygagggagaggtagggagttygaggaagggaggyggggygggtagggatygagttaggagagagygggygggggttttgggagyggttttygagagtggggtttgtggggagtagggyggtttyggggatagaggaagtygyggtggaggtttagggtagaygygggyggaygygaggagygtaggaatttggttygtagttttatttagttttyggtaggtyggatttgagttttttygygttygygaygaggaggatttygagtygtyggtggttgtttttgaygttttttaggttagtaggattygttygttttygattttttttygagattygttaagaaataaaggygatgattttygattatgttygygtttttygyggagtttgtgttatatygtggagyggggyggggygtgttgggatttygaggyggggtttttgtyggattttttttattagtygagtttygggygtyg

SEQ ID NO: 6310 - DNA, 766 bp, Artificial Sequence
  Description of Artificial Sequence: Synthetic polynucleotide
aygaattattatttaattygttggygtygttgttgttgttattggttaaggtygyggygatygaygtatagtagaggtagtatagttggagygtttgtaagagaaaaggtgatatygygygtgaggggygyggyggggttggygtygggygttttttgttattygttttyggagtttygttyggyggtatttgttttggttaygygttttagtttygttaggtttttyggygggttygaattygtagtygggaaggtataygygagtaggagggygtattttatggttaggtgyggaygyggyggttgygggtggttagaygyggtaggyggagygtaygggyggygygtatttttttygyggtttyggagttyggygttttaggtgyggttttaggtgagagtygtygtygtttatatygtagygggggygygttgggattttttttttttyggtygtttgygygtttttttttttttyggygygggtttgtygagttgtagtttgyggtattttagagggtayggggggttttttgggtygggattggagygtaaayggttgggagattgtyggtgtttgttygttygtttgtgygtttgtttgtgtyggtgtgagygtttgaggygatggggaagatagygttagttggtttttttagygygtyggagtygagygttygtttttttatygygyggtgattggygattagyggttttygggttygttygagttttygggttggtgtaagggygtgggattttyg

SEQ ID NO: 6311 - DNA, 363 bp, Artificial Sequence; identical to SEQ ID NO: 6084
  Description of Artificial Sequence: Synthetic polynucleotide

SEQ ID NO: 6312 - DNA, 2919 bp, Artificial Sequence
  Description of Artificial Sequence: Synthetic polynucleotide
tygagtyggattttygyggagtatttattagggtggttagttggaatygygtgttagatttatatgaaaaattygggagaggaygggttgtygttgttygagtygttttttyggaagtygttgtttattaatttttygtatttttttttgtaygygtttttttygygtattagtttggagattttttgtttgaggtggtygatttgttgtagtagttggttttttttygattttaggaygtgtttttgttgtatttttttgaagyggtaggattgggtatagtygyggttttttagggttygttttttttgttttagtyggattattttttttttgttgatttygygtagttgtyggtttagttygygtatagatatggttattagttgttygtyggagaagyggtygtygaagtgtaggtygtyggyggygtggtgygggtgtagggygtttttygttttygtygygttttygtygttttygtygtygtygtygtygtygtygtttttagygttggtygggttatygtygttygygtttttagygttatyggtygaggyggtygygttgttygyggygtygggygygtyggtygtygggtggtggtggtggtyggyggygtggtggtggtggtggtggtagtgygggttygygtygttttgygyggyggtygyggygattayggyggatattayggyggyggyggggtttattttttygtygttgtygtttaaggaggygtyggtatyggtttyggtygtygyggttagttgttgygtttygygygygtagttatygaagtygttttggagttggtggttgttgttgatgagygtttygatygygttttyggggttgaagtttagygtttyggggtttagttgttgygggtagtyggttatttagtagtagttttttaggtgygttttttgttygttgttygagttygggttgggygtygagaagttgggggaagggggtatygagttgtayggygtgtttatgggggtggaggatagygagttttyggygatgagayggtygtattggttgatgatgyggtyggtttttatyggttttttttttattttaaattttattagatygaagttattaatatattttatggttaggggattggtgggtaggtyggagttgtttattgttagttttgatgttatttttttgtygtygtygtygtygtygtygtygtttygttagatgggttgtaggagaggggttagygggttgtgttgggtggttagygggtgagttagtttgtygggttggggygtttttagtttgygyggyggtggttggttygaaattttygagygygtttatatatatattttttygttttgttygygtttttygygttygtttttttttttttttgtttaygttaatgtgttttttygttygtttyggtttttttttgttygttygtttttttgygygttgagtyggyggttttaggttygggaagatttttygygagttgyggtggyggyggtggtggttgyggyggygaagttggaggagttyggttyggtgygyggygtttttygttygtygtttygttgygygttttgtataaggaagggttygtttygtyggttygggttgtaggtagggygygygyggygttygttyggggttggaggygyggygggygtttgttygggyggygygggttttggtaygggggagttaatattttatgtttttygtttttttttttgtttggttttttttattatttttttttttttttttttttttttygygygttttttatttttgtgtaaagtgtaaggtagaggtgtagttygattggaggagagggaggggggagtttagtttttttttgtttttttttaaaaaagtaaaatagygaagttttggggaaagaygaggtagagagtaaaggggggagggggaggttaagtygataagtagttygagttatagttagaagatgaaaaaagattttaaagtttttgatttagtaagaagagtttaaagtaattgttgagttttatagtattygtgaygttaggtttaaatgagaaattgattggtatttygggttaatgggaggyggygagagyggtygygattagtataatagtatagaaataaggaaatttttyggagttgttaattagggtttaattagttgattgttagttgggaygggttggtttaattttttttgygtygttgtttattygggagggaaygaggttyggygtaaagtttggtgtaagaggggaaggagtttttttagaggggtttyggtaattygggyggatttgggagggyggtttgtttttttttggagygygagataggttttttattyggagttttagttygttgggggtttattyggttgggattggtttgattttttttttttgtttgttttttatttttaggattgtgaattygttttttagtttttttttttygtattaattttggtatttaggtgtttgtyggggattttttttttttgagtttggtygtgttyggygtttaaatttggttttaattttttgttygtttttygggygttygtgyggggaagggatygggaagggagggatgtagtggggtgttyggatyggggttgygggttgggygtygttyggttatgygtttgtttagaaggttgggtattygtggagagggaaagtttattttatttttttttttataaygaggtaaaataagttgtttagaggttattttttayggagatyggttgttygttggygtygygtgtttttggatagagygagygtttatgygagataatttyggggaagtttaaagttaggttagtygggtttagtttttyggtttttgattggtyggagtttggtttttgagatttatattgygygttyg

SEQ ID NO: 6313 - DNA, 2267 bp, Artificial Sequence
  Description of Artificial Sequence: Synthetic polynucleotide
tygaaaaatyggttttygttttttattttyggtygattygttygtygaggtggttgttttgggaattttttgtttttygtttaggagaggaaaygtatattygggtyggaygtatagaagtygtattttggttggggttataagtttgatagttatygataagtttttatttataggagtaygygaygtgttttttttttaagggaaaggtttttttttttgggttttggaatgggtttgaagttagtyggttttagtttatagggtgaatgaggggtgggtatagttyggtygyggttttagtatataygggyggaygtaggggygggggagygttagtttygtagtgtgttyggagtttagyggttttgagtygtygttattagtttggtygttttttgttttaygtaagtgaagttagtygtttagggttgygtttttagttatttgtttttttatagaggtttatattttttttttygttgtttttatagtttggttyggggtttgtttaatatagatggaygttttttaaaggttgtgygygttatygttgttattyggttgtgtygaggttygyggtygttaggattttagggatygtatgttaggtagggtttaggatttttagygyggattatttttagtttgyggggtagygtyggggattygggtaggagggagaggagtaggagggagttttggatttttttttttagatyggtygtygttatttttgttttttttagggtygttttyggtttttttattttygggttttygttaygygggtygyggggtttttgttaggaaaatygggyggttttaggggagttygygagatttttagygttygggygygtygtttttttygaagtttygtygtagttttygtaggttaggttttgtttayggggggttgygtttagttyggatgggtgggygttgggygggttggttttattttgtygtgggtattaattttgaaaayggttygtgygttyggygyggttgyggygtagattygggaayggtagtygygggyggagtyggggtagagyggyggyggygygyggggyggatayggtatttayggtyggggggttygggggattyggygggyggyggayggygtatattygygattyggttygggagtygttgttttttttagtttggttttygtttttaygatttaggggyggttgygygttgttttttggygtygtatygggtttaggygygyggyggggttggggygygyggggyggtygtttgggttatgtyggggattyggtttyggttatttygygygggaataaagygygtatttygttyggggyggttttyggttttygyggttygygtygggtttagtygtygygtttgtggttttaaygtygygygttygttygagagttttayggggtttygyggttttygtttygygygtttygttttygttttttgtttttygtygtygtygttgygttatttgtttttygttyggygtttatggygtttagtttygtttyggggygtyggtttggagaggggtttttygtygtygagagtygtttttaaygttttygttatyggggyggygttttaagaattggttgtgggggtyggggttgtgyggagygtygggagtagggagaggggagaggggygyggggagggggygaygggygygtygttttttgyggggggyggygyggggaggygtaggygggggygagygaagaggttgaggggtgygggygtygtggagggggygyggttttggggggyggttttygtttgygtttatttttttttttttygtaggtygygtatatttatttygtagtagtyggyggtygygggtttygtagttttagaatygyggtttttggyggtygygygggaggttgaaygggagttggggggtgtggggggggtggggaggtggggagttgggggggaggtygttttttyggtygtygttttygttttttgtttygygttygtttttagygyggygtttggttyggtttggggttattttygtgygtggtyggtaggggtygygtttttttygtttagtttttygggygggttygatgygaagttttygtttttygygggtttyggggttaggttatttgtatatattttgtatttatttgtatatygtgygttttatgtttatttgtagaaaygtttygagtygttgttttgtttttttygtattttttttgtyggtaggttttttttttygttyg

SEQ ID NO: 6314 - DNA, 265 bp, Artificial Sequence
  Description of Artificial Sequence: Synthetic polynucleotide
tygyggttygygtgggttttaggygygggatggyggygtttagtagygygggttygygtagggygygtagygttgggggtaatagygtggggttyggtyggtagtggggygygggttgygyggtaagtagtttttyggagtttagtattagttttagtattatgtagggtatttaygaggyggaggttagtaggygtygggttyggttaaagtygttygtagtttttagtattygygttttttgttttatyggtygtaggttgyg

SEQ ID NO: 6315 - DNA, 374 bp, Artificial Sequence
  Description of Artificial Sequence: Synthetic polynucleotide
tyggggagggtagtygttygtttttttyggygttgggagttttyggttggtattgygggaggagttttygggtgattygygggttttgaaatygtygttygggagttyggggtttgygttgygtttayggggygagygagggagaattgaygtttttygttyggattttttttttttttygagaattaggtaggtygygtttatttttaagttygattgttttygyggtaatatttgtgggaaatattayggtggattttgtgggtygttgagttttttgattttyggtttgttttattttgttttgttagtgggttttgygttygygttaataattygaatgggtaygtttttgygttttagaaygttgttyg

SEQ ID NO: 6316 - DNA, 1133 bp, Artificial Sequence
  Description of Artificial Sequence: Synthetic polynucleotide
tyggygygggtygttttygtttttagttttaatgttgttgygttttaggtygtttygtttttggtaggttttagtttttgatttagtttttygtttagtttttgagagtagttttttygygggattggtttgtgygygygygtttgyggtatygtyggattaggggtygttttygagyggggagtttaggaggayggttaggtggtttgaggtagaggygttagggaggatggagaagggatatttagggtttaggyggggtgggggtagggagggyggygggatagtaaggaagtgggtgtatttgggtgatttagttgygtatgagygggtaggggttyggggygygyggattttaggygttggattgyggygtggagtagygttggggaaatygygtygggtttagygaggattgttgggyggggygygygaggagygaagttggtygggggyggggtttgagtygtgtyggggyggggtttagattygggttggtygtggtgggyggggtttgagtygtgaaggggygggttttgtaggggyggggtttygaggggyggagtttgyggtgattagygagggggyggggtttagagttattaagaagygggatttagtgagggttaaaygtggggygtygggggygtggygyggggygtaggtgtaygtaggttggtygygggygygyggggttyggygggagtttyggggtggttttygygtggggtygggggygttygygygggyggggygaggtyggggagggtagttgttygtttttttyggtattgggagttttyggttggtattgygggaggagttttygggtgattygygggttttgaaatygtygttygggagttyggggtttgygyggygtttayggggygagygagggagaattgaygtttttygttyggattttttttttttttygagaattaggtaggtygygtttatttttaagttygattgttttygyggtaatatttgtgagaaatattayggtggattttgtgggtygttgagttttttgattttyggtttgttttattttgttttgttagtgggttttgygttygygttaataattygaatgggtaygtttttgagtttaagaaygttgttyg

SEQ ID NO: 6317 - DNA, 2358 bp, Artificial Sequence
  Description of Artificial Sequence: Synthetic polynucleotide
aygatatttyggtttgttgttatggaaataggggyggattaaggttggagygtggagygtagggattaggtttttyggttatttgagttttygttttagtygttttygtagggtyggggtagttagtygtaggygtygyggttttttagttttttggtygggttaggygygggggggatttyggyggggygttatagtttgttygggtttgggaggggagaggtagaygtagaggttggaatagttggtggyggggttygtgggttttyggygtgattatttgtttttttagggttygggggayggygtttygygtggtaattaygtgggggygyggygggattttttyggtgttygtattaattttgtygygtttygtatygggtygggttgttggggygtttagttayggtggtygygaagttagttgtttttaagttgagttgtgtatyggtygygtatattggyggtayggttttygygttttttygtttttagtataatgaaagtttgaggaattggatattaggygttggtygttttttatttttagtygttgggtgtttagagtttatttttagygattagagtagaattgtagagaagaygttygygttygggtttygtttggggagttagggygygyggggagygttygggtygygyggttattgatygttggttgtaygggggygtygtgyggattyggtttttataaagyggtagaagtaagggygtgtgttygygtagggaatggaggttgtaagtgtaaaattttattttagtaaagtaaaggttttaggaggtyggttttttttttattatyggtygtttattttggttttygattgattttttygggtyggatttttaggtttggttattygatttatggagaaaatttygtgttttataattggtygttgaygggagttgagttttagtagtagtttttyggygggtgygttyggtaaaatttattagttygtygggggttattttttagatygggagtttyggygtygggyggygttygggttygyggtttttttyggagygtatttaattttaatttgtttttgyggttttaatttatttttgygaagtatgttggttayggggtygtygtttygaggtyggtttaggygtattttttttyggggtttagatttaaatttttgggygttagttgtagttaattygagygygtygaggygggggtaagtyggggattygttygtgttyggtggttyggtttygtaggggtatggtgagttttagtttygygtygagggtatyggygttygtaagtaatygtggtgttgttyggtagtttygygygtttgtttagtttyggggygagyggtttgtttygyggagtyggyggtttgtttttgttattyggagtatttygtaggyggttttgaggggggaygtygttttttggtyggtyggtygtagttttttttttttygttttttyggattatygtygtygyggttgtagtaaaagggygttygtaygtatygtygagtttyggggaaagygttyggygygygtttgtaggatygagygatyggyggagyggggygttttttttttttttttyggtttttttttttttttttttttttttttttttttgttttttagttttttttttttygtttygtttttygttttygtttayggagygttttttatataaaatttatgaaagtgtttttagttygtagtgtygagygtygttttatttttaaggtagtagygtttagtygygyggygtygttttttaaggtgtttttattgygttygttttyggggaagatgttyggttygygttygtttaggtatttgtttttagtttttaagtyggttttyggattattttaygttttttttyggtttygtaggttttttggagttygaattygtagtttagttttygttygttygtttttygyggttggaggttatygggagaygyggttgggaygygaggatygtygtttagagtayggatygygagttygttttttgtttygttttttttttggttagygtttttttttttagtttygayggttttttttygtattgaatagttttagygaattyggttgtttygtatttygagttttaggatattgttttttygtggggagaggaggggagtaagtattyggaaagggttagttgtaaattttagggagaaggaaggattygtgygggttygggtgggtygttttygtttgggtggggtggyggyggggggtttttgattttttttggtttatatagatttygtyggggggttygyggaaaatggaggaggygtygtttggaaagygggtttyg

SEQ ID NO: 6318 - DNA, 1050 bp, Artificial Sequence
  Description of Artificial Sequence: Synthetic polynucleotide
gygygygtttygggagagttgtgtttttygygaaattygtgygttttagtttagggttttygggatyggtgttygttagtgggtataggaygtygggtgttygaagggttgtttggagatgtaattgattttggygggtattagaatgaygagtggtagtagtaggagyggggtgaygaataagattaygaaggatttgaatttggagatatagtttagygtygaggttatygygygggagggagattggygggygagaygagtgaggggtagttagaggygtygygggtttaagaaggggttatagttttyggggattggggagggggyggtgataatttygtttygtaygggggygttttttygyggttttggggyggggttatttttyggggtttgtgggaygygtttgtttttaattttgttattyggyggyggtgggaggygtttttggattttaaygtttygggttagttttttaggggtagtttgggttttagtatttygygttgtttaagttttttttgygttgtygaggtagaggtgygtttyggggttgttaagyggggygtgttttggttattggtgttgttygttttggygtaaggygttttttygygttygtatttgtttttttttgggttttgaagggtttyggatgaaattttttgtaggtttttgggttttttaggtttattttttygattttttttttttttttatttttttattttygttttttyggtgttttttygagaggtgtttttttaygtttygygtttttygtatygygggtttygtttttyggttttttttggttttttygttaygttygttttattttaggtgtaggatttttttttttygttygtatttttyggttyggagtttttgggygatygtatagggaagygaggttattgtttttttttgttttaggggttgtygygttttagtggaygttgtatttygtagaygttyggygggtagatgyggataygygttttggaggggttttatygagttttagtagtygtagttgttygttyg

SEQ ID NO: 6319 - DNA, 1731 bp, Artificial Sequence
  Description of Artificial Sequence: Synthetic polynucleotide
tygggttygtttygtttatyggtattaggygaggtttttgtygtagttgyggtygaagaagtggggttyggygtttayggygygtaygtyggggtgtaygygtaggaattttagtagygttygygtgtygtttttttttatttygatgatgatggtttgyggtagttgtttgttgttttygtttaggagtagygttagggttttyggyggggtttyggttayggtgttttyggtttyggagtygttyggattttttgataggttaggggatttttttttttaggtygttttttygtygtygtygyggggygygggyggtyggygttttygttattgyggtagttgtaggaggygttttttttgtgtygtygtyggttatatygttagttttttygggttttyggttaggaygtygttattaggggttttygttttttygtygtygtyggatagttttaygayggggtyggatagggtttggtagygttyggttaggtagtagaagaygtaaagggaygtgagtagggagtagagtattagtaagaattttyggaagatgttgygggatagyggttyggtygaggtggagagggtattggtygggttyggaggggttattttagtyggaggygaygtygggtaaygygtyggttatgttaggtttggatttygataggtgttagagtattttttyggygggttagygygttggayggaggttatatygtygtgygtttttgtggtygtgygaattgtttygggaggtagyggtyggggtttygyggggaaayggaatttygggggtttygygtaggatttttgtttttagtygagggagygggaaggggaaygygggttygtgtttaagaaattatygttttagattygtttaagttttgagtttggggtagttttggtttttyggtttttygtaagagtygtyggaatyggggttttggtagyggtgtygaaggygtgygttttagtttyggtttygagagatttttyggygyggattttygtttagygattttgtattattggttyggttttygtgagggtaygygyggttgtygggtttttgygtttygtgygttttagatagtggygagygatagtgatttttagtttyggttttttttggtttttttgttygtttgggygygtttttttygttygagtttaggtttttttagttaaggagygaggttttttygagtttttttgttygagygggagataggaggttygtgtagagtygtttattttttttygtagygtygggttgttttaaattgtttttggattttatttgtgagtygygtggttgggttgggttgggttgygygggatttgttagyggttttygttattttgttygtaggygtttatyggttgttttttgggtygtygttggtygtygttataygtgggaygtygagggtagtaaatttgttggtgaygttaaaggttygggtyggattagttttyggaygagygtagyggggygyggattagyggttaggyggggttagaygggyggggtgggatggagaaaaggtggygygggtttygtagtagtygtttaatggtattggagagggygggggyggtaggggygaygttttttttttagtgttttttattttttttygyggtttygtttttttttagtggattyggtgtttgyggyggtttyggggttgtttgagtgatagttaaggtyggtyg

SEQ ID NO: 6320 - DNA, 3535 bp, Artificial Sequence
  Description of Artificial Sequence: Synthetic polynucleotide
tygtttttttgggttygttttttgtttygaagttaatagtaatttttgatygttttatatygtttagaagtttttttatattttttygttttgggagygggttggttgttgagttttyggagaagygtttgtatttgtatggygttyggggtttttggtaggtagagtagttygttattttggaaggtygggatygtttattttatttyggtttatagttttttttttgygtagttygtttttgtagtttttgyggggaagtgtyggggttgttygaggtttagtttttaggattgtaaggaggtagtttyggygtgyggyggtgygtatagtttagagtggttagggygygagagtgtaaygtttttttggtttygagygygtygtygygtttygggagtagattttygtttagtagttatygtygtttygatttttygttttagttgtagtttttgtygggtaatatgttaagagtygtygtygttatagttgtygtygttatttggggaagagtagtagtagtagyggyggtygygggtataygggggtaataaatygagttattygggygtttagygtgtyggggaattttttttgygtttattgttyggygggatttaygttatgtgttgagttatgtttttggtygygttygygggtagygtatggggtagygtttgagtggyggtagattttgtttygatgttttyggtyggtttttatygtagtygtygtygttttygtygtyggtgaggaggaagttygygttgtttttygttatgttttgygtttggttttatatgtttttgtattygtgygtyggtttttgygtygtygygtyggggttgttgtttttgggttttgggtttygygtygtataygattygttagttttggttatagtttyggaygggaygttttttaggttgtygtttygggygtygttagttattttattggttttaggtaaggagatggtygagggygttgygagttyggaggagtagagtttygaggtgtyggattttttaagttttatttttagtttttttagtgggtttgggagtaagtagttgtygtaggttattattatyggygtgaagaagggyggtaygygggygttgttggagtttttgygygtgtatttygaygtgygygtygtgggygtygagttttattttttygatygtagttaygataagggtttygtttggtatyggtgagtttttttgttaggggtagggtttttatygtygatttagattttgagttaagggagatatggygtatgatagggaattggtagggttatagtttyggattattyggggtagggtagggaaattayggtagattgygtagygtattttgttygggtgyggtgagggttgygtttygtttggttttygttataatttatagaaagttttygyggagtattggtgtttttgaatttattaggygatttygtygtaaagaagaagggtagygattgagatygtttttagtaaagygagttattttttaattatgggggtattygattygaatygtattttatgattygttttaaatttttttttttyggagttygagaygttgggaatgttttgagtttttttggtyggttttygtttttaaggaatttttagagtagtttttgttttttagatggggagagggggtgggggtygyggygtttyggygaggtygtagagtttgttaattttttgttatagttygtttggttatyggaattttaagggtgttagattygtttygttygygagtygtttgggttygggagggtgagtygggygggtggttyggygttttygtttggygggygggyggygygyggagygtggagttgtgttggtttttgtygggtaaaggygygtattgtaatyggttggagyggygygaggttttgaaggygttygggttttygggtatygtygttygttttygtttttttgttttyggtgttgggatagggaaagtaaggaygygtgttttygyggggtttttataygttyggagtaaagaatattyggggtttattgattgagaaatgagggttgtttygaggtygyggttttyggaaattttgttttygagtygggttgygggttaggttttaaagggatagtggtttyggggttataattattatttttgtttattgtttttygtagttgttggtttttggggtgagttgttgggttgttygagtttygggtaaggygygagtgggtaggaggtttagatttyggttttygataattgttttygattaggggtttaggtaaygatttttatattttygttggggtttttattygtaattttagttagtaygatatttagatatttttttaggtttaattagttttatagaygtttaagatttgggaaaataaaagaggagaagataattgaatttttttttttgtgtttattttattgtygggatttgggtgggttggagaataaaagagggttgatttygyggattaaaayggttttttttttagtttygttttatttttttttttttgtttttaatggttttttattattgttaggagttgtttaagtttygaggtttagttaatygtgatagttattttttttatygttttygggttgtgatttattttygggatattggtggataagaatggggtttttggagttygaygtttggatttaygttttggttagtygygtgaattttggtgtttttatttgtgtagtgggaataatgtaggttttgggtagggatgggaagagtgaatgygttggtayggtaaggtgtttygtaggtaygtgagggtttttttaatygttagttattgttatygattgtattgttatgatttttattattattattttttttttttttgggatggtgattttagggttaggyggtaggttataattagygtttttttaggtggaattygttagagtttygaggtagtttaggattttttgagattagatatatttgggtygggttgggaggaattggtaggaaaaggattgaatttttaatgttaggyggttttgaagtatttggggtaagttatggaaatttttataggaaggtttaygtagttttttaggyggttgttttttatttgttaygttttttttgattgattaaaaaaygttgaatgaagaaygaagtygygtggaaattttygtygygygtttgtagyggatagygtagttygggaggttyggttgtygatttgygttygggggttgygttgygagyggttaygtatggyggttggattygggyggtygtaagggtttggttgggtygygggaggygggaggtttttygttttttygagttatttttttgaattgataagtaggattttygggtttagggggtatagggttyggggyggtgattyggyggatygggttgtyggaggagtttattgtaaatgtygtaattggttttaaatattgygtttttggattgtattagtagtttttggygyggtyg

SEQ ID NO: 6321 - DNA, 2896 bp, Artificial Sequence
  Description of Artificial Sequence: Synthetic polynucleotide
gygtgggyggtgagyggtygggagaggggygggttagttgagygtttaattatagtttyggggttyggygttygttagttgtatttagaattttttttatygtggttttgttttgtggygtttaattaygtgtttttagggttttggagyggttgttgggattgtagygaagaggggttygygttattttygttaggttttaygygtyggttttgagtgygtttttttyggtygtygggaaatttagaggygyggtttggttttaaggttttyggtttygtttttttttgtttyggtttagttttyggttgttttygggtygygatttattttttttggyggtttttgtygtatgtttttgtgttgygttagaattatygagttttagttttygttgttttttyggttagtaggygttttttttagttggggagggttttttaaattttgtgtttttaggatygyggggtyggtaagyggtaggatttttaagttgygtttttgatgyggttaggggaggygygygatgaaggtttttttttttttygttttttttttaygttttatygttattataygtygygttgygtygygatttyggygttgtttgttggygttttaagyggtttttttgtygyggtgygattttygaygttaggaggattaatttttattygttaggttttagattttaygtagatttagttatataygtaatygtttgtagatatttattatagttttttaagttaatttaaagtttygtataggygtattgtttttatatgygtagttttayggttttatatatttattagtttattygtaaataggtttatatggttatataattgttttttggatatttagttttaygtaggtataattttatatatatataatygtatataggygtaattttatttaygtagtattttayggagttatataatttttttataaataatygtatagatatagttttaygtagygttatattatttagttaaattgagatttagaaatatatttattagtttgtatttagatttttttttttaagtttygtgatatttattygtaggatagattagaaatatatagttatattgatatatatayggatttaaaygtatagttaagattttattygtaggttygtaagttattggaaaaatattaaagygttttttttttttttttttttatttttgatatatataygtttgygygygygygtatttttatatttatatttttygtttttaagygygtyggagtttygtagygggtgatttygaggtttygyggtgagagttaagggagygttttttyggygtttttttttttygtttttttttygagtttatttttygttttttygttygttttttttttttttgtttttttttttttttttttttttttgagtttggggygygggttgygygtagttaagtttttttatygygygttttttttygygygygtttygygttagtatygygtttatygagtggatgyggttayggggtygtttttaattattttttgattttyggyggtttgtgaataatggttattgagggygttygtaggggttgttaagaaggaaaygyggggygygagaggygyggygygygygggagygygagggaaaggagygagtttggggtygttgtaagyggttggygagagaaaggattygtgygagygtttatatttgttttttttaaggattttatttggttatygygttttggaagaggygagagggagagygtgygygagaggagagagayggygggggaaagggagayggygagaygygtagygtyggygttygggagatttaggaggagttygtaggtattgttggyggyggagttttgtgttttyggygggttgttgtgggygttagggtttttygagttttyggttygtygtygygygtagatttgttyggagttyggggttgtaggttggggtygtygttygtygyggatatttttttygyggygttaggattttggttggagttgyggatttgtatgtttgggggttttttaygttggttgagggaatyggttttagaagaaggaattttttttttttttttttttttttttttttttggtygtttttggttatagtttggttgtgttggggatttttttttttttttttttttataaagtattggtgagyggttttgaygaatgtggtattggyggaaggtatggggttgagatggyggggttggtggttayggatggggaggygagagatgttagagaaggaaggagttttgtttaagttygtaatttgygtttygaagttggtyggatyggggagggygattygygygttygattttgtttygggtaatygatgggaaatttttygagagygyggtttttttggggattyggygtttttgaygtttttaggygttttttygggtygttgyggttttttttygtygttygttagygtttaaggtygygttttttttattttygtttttttttttttttyggyggttttyggatttggatagagttgtaggagtggttttaaatattttttttggagatttttttttatttttygtaygagagtttgtttagtggtttttttgttttgygttttagttttaygygyggtygagtggttaggttgataatgaaatttygtatttttgtyggggggagtggggtggggaggaggttttttttggggttgttgattttgggtttygggtagggggagggggtttttgggggaggggtttgttttggttagagaygtygatttgggatggygtyggggtagggagggggttggggggtgggygyggygaaggyggtaggtttgggttygyggtygggggtyg

SEQ ID NO: 6322 - DNA, 2567 bp, Artificial Sequence
  Description of Artificial Sequence: Synthetic polynucleotide
gcgttgggcgatgagggatcgttgggtaattgggggtataggatcgggtttcgttgggttcggggtagaagcgtcgaagtttcgattcggaacgcggtgattttattaacgtagaagttcgcgtagtcgagtagaggagtttttcgtaggcgattttcggatagacgtttttgcgcggttcgcgtggtttagtttcgttttaggaaatttttcgcgtagttttcgttttatgcgtttttatttagttttttttcggggtcgttttttttttaaagtagtttttcgggtttattgggcgttttcgtaatcgggtcggaatttcgaacggtttcgcgtgttattcggttattttggtaatattattcggcggcgttcggcggtttaattttagtttgcggtttttttcgagtttttcgtaaggtggggatcgggacgcgatcggggatggggaagggggttgtaggaggtttcgtttgcgttgtcgtttttgttgggtatagcgttttttattattcgcggcgatttcggttttcgtaaggtggggcggcgagtaggagtcggggttaggttaggggttcgagttttcgttcgaggggcggggaaggcgggtgacgtgagtcgggtcgggcgggcggagttgggatcggtttcgggaggcgggggcgagcgcgcggagaggtagacgcgaggagggaggcggttgagtagcgcgggcggttttgcggcgggcgcggtgggcgcgggcggcggggtttcgggattttcgcgcgtttttttcgcgcggcgtcgtcgtcgcgcgtttttacgtttcgcgttttacggcgttttcgtttcgcgcgtttttcgtgttcgttttttgttagttttcgggtcgcggtcgtttgtagagcgagcgtttagacggagttttcgggtaatttgagtggcgtcgatcggcggcggagtttttggtagagtttttcgattcggtagcgcggaggggattcgcgttcgttcgcgtcgcgttattttaaattttaagtagcgtcgttttatcggcgcggagtttcggttggaggtaagagtcgcgcgtcgggagatacgtatcgtgagcggtagcgtcgtcggttttttttttcgtcgtttcggagggcgaagtcgcggttttttagttttttgttgcgtcgcgatagcgtcggaatacgtttcgtttcgttgtcgttttcgttgtgtcgtcggcggagggggtcgcgagtttcgcgtttcggtcggaggatgtgcgttttcgcgggtcgtttagtttgagttatgcgttttaacggcggcggcgcgtcggtcggtatggagtttcgcgcggtcgcgttttgattcgttgtgcgtttcgcggtcggcgggcggcgggaggcggcggatcgagagtcggagatcggcgtcgcgggacggaagcgagcgggcgcgggcgtcgcgtagatggtttgggcgagttaggtttgaggtttcgtttttcgaaacgtgattatgtggatttaatagtttttaggatttaggtgagcgattcggtcggcgtcgggtgcgtgtgggcgcgtgggtgttaggttgggcggaagcggcgtttttttttatgttgtaaattaagggattttttttcgtttttcgtaagcgggtaacggggtgtatcggtagtcggaaaggggcgttcgttcggagtttggagtagtatcgcggttttggcggggagcggtcgggtttttagggtttcgcgcgttcggggtcggggtagcggcgttcgttttagtaattcgggaagtggggtcggttaggcgcgttcgtagttttaggagttagtagcgtagtgttttggtcggttgtttcggcgcgtttttttttcggggttcggggcgaggcgtcggtcgttgggcgcggcgggcgcgggggtcggggttgtcggggaaagttaaagtttcgggtttttagcgagagtttcgtaggcggagttggaggaaattatagttaaatagttatttcgttttttttttttttttttcggggtttcggggttgagtaggggttttttaggtttttagttgtcgatttagttgtttgcgggtgattttcgggttcgacgggcgtttatagttggcgggtagttggggcgggagagttggggtttttggggagtttcggcggttatttcgttgtaaatatatacgtatatacgttcgtcggcgcgttcggggtttgtttgtgtttgggattttagggttagatggaagagggggttcgagtttagagttcgtggtgggggtgtttagaaagatttttttcggtaaattttgttagttcgtcggggttttcgggtttttttggtttttgtttggggtggtttagggtttattagagtatagttgtcgtttttgttgggtaggttgtttttgagttttcgtttttttgtcggggtatttatcgagttcgtgtatttgggtttcgggttggaatcgcgagcggggaggatagaggtggaggcggagagtagcgtgcggttttcgagtttgtttattgggatgtattgcgttttcgcgttggggacg

SEQ ID NO: 6323 - DNA, 573 bp, Artificial Sequence
  Description of Artificial Sequence: Synthetic polynucleotide
gcgtttaagaagtcggggttttttttggttacgcgttttcgggggcgttcgcgttttttaggttttggttgtttgggcgtcgattttcgggacgcgtcggtcgatagtaggggaggcggtagtagggatcgtagtagttttcgttttcgtacggttcgtcgggtcgcggtgagtaaggcgggtaggcgcggcgggaggcgttcgacgtttatttcgggtttggcgttttttttcggttattacgcggcgtcgtttttcgggattttttagttttcggagtttcgcgcgtttagagtcgttcggagcgcgggcggggttagtttgggtagtcgcgggtcgttgttgcgtcggaagttttcgtcgttagggagttttttgggcgttaggttttgggtttttgggcgaagtcgacgttagaatatgtttggtttcgtatttagtttatcgtatttttagcgcgcgtgggtggggggcgtcggttgaggtggggagggtatagtttagttttaggttatagtgtttcgggcggggtagcgcggtgcggggtgaacgttatcggttcggcggatagcg

SEQ ID NO: 6324 - DNA, 383 bp, Artificial Sequence
  Description of Artificial Sequence: Synthetic polynucleotide
tcggtttttatagcggtttcgggttttcggatggcgtgacggtttgtggggtttgcggggtgcgttgttttcggatttgcggggggaggcggttgagttggcggcgttcgcgggtttagtggtgagtgcggcgtttttacgtttagttcgacgttttcggagcggtcgtcgcgtaggggtgggcgcgggtttttaggagggagggcggttgtgaacgcgttttgtttttcgcgttttcgtagttttttgcgtagttgatgatttttataattagtttcgttagttttattttttgtggatatttgggtaaggtcgagtcggacgttgttacgttcgtcgttacggtgggtgtttgatttcgtttttgtaggagtcgacgggcg

SEQ ID NO: 6325 - DNA, 853 bp, Artificial Sequence
  Description of Artificial Sequence: Synthetic polynucleotide
tcgttttaggggtatttcgtaggcgagatttttgtagattttagttaggaaacgttagtgaacggtagcgtagggaacggggcggggtcgttggtttcgtttatcgtcgcggtgttgggggttgggggtggttttcgggattggtgtggagtttgggtttgatttattgatttggttgagtggggagattggagggtcgtattcggagttgggttcggggacgttcgttggtgggaagggtgtgcgcgcgtcggaggtcgcggttgattttgtttcggcgttgttaggtacggtattagttcggatagtattattttgtatcggtagagtatcggtacggtgtttatcgtggatttggtttcgcgttacgagtgtgtcgcggtggtgttgtattcgtcgtttatttcgggtatgcgcgtcgttttttttgatattaagacgatttattgtttcgacgttttttttaagtgagcggtttgggcggggacggaggcggggcggggacggaggcggggcggggttcgggtcgggcgttaagttttattcgttttacgtttttttcgtagtatcgagaaggtgttttagattacgtcgttcgtgtttattatttacggtacggaggacgaggtgatcgatttttcgtacgggttggcgttttacgagcgttgttttaaggcggtggagtcgttgtgggtggagggcgtcgggtataacgatatcgagttttatagttagtatttggagcgtttgcgtcgttttattttttaggagttgtttagttagcgcgtttagcggcggttttaatcggtcggattttagtaataaggcggttttcggattttatttcgcgtcg

SEQ ID NO: 6326 - DNA, 1062 bp, Artificial Sequence
  Description of Artificial Sequence: Synthetic polynucleotide
tcgggatgaatgtagttacggaacgcgttaatgtaggaggtttttaggatattttgagcgttcgggagacgttaggcgcggtagcgggtacggatagcggaaaggggcgcgatttcgcggaatttttcggtagggtagggtttttgggtggtttcgggtgtttagaggaaggggtgggttcggggacgcggagggaaattggggacgcggagggaaattgaggtcgcggaggacgcggtcgttggtagttcgttgcgtttgtcggtttcgcgtgggtcgttttattcgggaggacgcgggttttttttgtttgtagcgttttcgtcgtcgtcgttttcgtcgttttttttttttttttttattttcgtcgcggttttcgtttttttttttttcgttttttattgtttttttttttttttttttttatttttttttttttttttttttttttttttttttttttggagcggttggggttgcggcgtcgttgttgatacggatcggtcgcggtcgttatcgggcggaggttgcgcggcgtagatttagacgggcggtttcggagggcgcgcggcgatggcggcggcgggtaggcggcgggcgcggcgggcgaggggttcgggttgagttgcgggtcggttcggatggcgggcggcgcgggttggtcgggcgttttcgcggttttgttgcgtttcgtgcgtcgtttgcgcgaggtgttcgaggtgtgcggtcgcgatttcgacggttttttgcgcgtggagcgcgtcgcggcgttcggattgcgtttcggttagggcgaggaggtaagttggttcgattttagtttcggttcggggattttagtttagtttcgtcgttttttttttagttttttcgtcgggttattcgcgtggttcgaggcggtggttttttttttaatttttttttttcgtcggagtttaggatttcggtttttttcgggtatttttggtttagtcgggttttcgtttttcgtttttcggcgttcgtgtttcgagcgttacgcgttacgtttagggtggtttttgcgtttatttttttttttcg

SEQ ID NO: 6327 - DNA, 918 bp, Artificial Sequence
  Description of Artificial Sequence: Synthetic polynucleotide
tcgtcgtttttatagcgcgtttttaatatcgttgtttttgtttcgcgttttagagcgtttttagtttttttttttattttttttatgagtggagtcgggtttggggcgttttaggcggtgacgatttgtagaagtttttgagaatgtaagattttttggagttttcggttcgttagggtcgggtttagttaggacgtttcgtttagatttttttttagtttggggtgggtttaggttcgtttgtttttattgttttgtgttttaggagttttcgttcggagtttagattcggtgttcgaagatgagagtgtcgttttttttcgtcgggtgagaagttagtttacgtttcgtcggttaggtacggtgtttttcggggcgttttacgggaatttttgtgtttttatcggcgttttcggcggcggggtagttttggcgtttttttttcgtttttggtttaggttcggttcgcgggtgtagttttttttagggttttttttttttttcgggtcgcgcgttcgtttcgtatcgcggcggtttttcggtagtgtttgtttttattggacgtatagtgatcgtgacgggtacggggcgcgagtttttattattataatgggtgtgtatggcgcggggcggggggcgttgtcggtttcgagcgagggaggggagaggagggggtgcgttcgtgttttgttcgtttcgagttttcgagttcgcgttttattatcgtagcgagtcgtttttttgggtcgtttttttgttttttttttttattcgttttttttgtttcggttgttcggagatatgtttggtggcgatcggggatttagagttcggtagtcgtttttgtttttgtttttgcgatttttgttttttttttttgttttttcgcgtagcgtttttcgtcgcggaaatttcgcg

SEQ ID NO: 6328 - DNA, 865 bp, Artificial Sequence
  Description of Artificial Sequence: Synthetic polynucleotide
acgtgcgcgttcgtcggagattagggatgaggttattaaatgattgtttcggttaatttttatttcgtttttattcgtatcgttttttttttaattgatttaattttttaattttagtttttcgtttttggtatcggtttttttttaagtttttagattttaattttggttttcgattcgtttcgttatagtttgggaagcgggagaagtagcgcgcgtttttttgcggatttttttttagggaagattgtggtgttagttgtttagggggattagggggttatcgggatttagcgtaatttttgtttcgttttttaattttcggaagcgttaatagtacggtttttacgtaatgtcgggtttttaagtatttttaattcgtatagttttcggggaggtcgcgtagatatcggggttttttatagtttattattttggtgtttgaagttattttggagtttttatcgtaggggcggggattagtgttaatgggtagcggggtttggtttttttaattagtattttagaaagagggtttaggggcgggggcgggtggatagggagggaacgggtttgggtgaaaggggtttgtggagtttaaatttagtgaatagggttttaagtgtcgtgttaggacgaaaagaaggcggaggttttgggataggagttggttcgggggtcgggggacgtttatttgcgtttcgggaagtttttagtttcgggcggttttagcgtagtcgggcgtttagcgtttattgtttgttaatcgttagttcggtttttaaagcggtaaggttttttcgcgagggggcggaggttcggaggagaggggaggtgaggagaacgcggaggtcggtataattcg

SEQ ID NO: 6329 - DNA, 408 bp, Artificial Sequence
  Description of Artificial Sequence: Synthetic polynucleotide
gcgttcggttgttaggtaattcggttttcggttttttacggcggttttttcggtgtgttttattaagagcgatagggttggtgattcgaggggcgcgtgcgcggtcgttagtttgggatttgtacggatttttttttttttagtacgttcgttcgggggttttttttttgttacgtcgttggggttcgttcgttatttatagttttcgtagagtttttcgggtatatcgcggttggtcgttcggggttaaggatggggcgggagcgtttatttattttcgcgtcggtcggggtatttaagaggcgcgttcgtagttatacggcgtttcgtttttcgtttcgaaaaagtttttgtttttttggcgcggtgtggcgttttcgttagtttagtcggatttttttcgtttcg

SEQ ID NO: 6330 - DNA, 2245 bp, Artificial Sequence
  Description of Artificial Sequence: Synthetic polynucleotide
acggtttcggggtttggcggggaggtttatcgttgtttagagggttcggtcggtcgggagggggcgttgtgttttttttacgttttgttcgcgggtttttagtagcgttcgtcgcgttgtaacgtaatgcgcgttcggtttttttttgggtagcgtttagtgttcgtttgttttgtagggtatcgtcgttttttttttattttggggtttttaggtttaaagggtttttagatttagttttttgtttgaattaaagtggttaggtatttagtttgtaagatgaataaatgaaggaaagaaggaacgaatgaataagggtttattttgtagagcgttcgcgttttagcgcgtattaggtatattagtgttaaaggtgttgggggtcgggtttagcgttcggcgcggttggaatgggggcggcgaggagttttttttagttagtcgtagggcgggaattgtttaaacgtaggtcgtagttttattgggtttcgcggcggtttcgtttagtagggatcgttttgttttttagtttttaatagtttcgtttttataaatttatttgagtattttggtttaagttattttagatttttgggattttttaggtttcgatttcggtcgggcgggaggttgattttttatcgcggttttttttttttattttcggttttttttcgggttgcggcggtcgttattgttgttagcgcgtttcgaggattgtcgtaaatttcgggcgtagggaaaggggattttggcggcgggatatagagagcgggtcgggggaaggggagggaacggaggaggcgaggaggagttgggagggagtcgaggggcgaggcgcggaggagggatcgaaggggagcggaggggagagggagggggaggaaggggaggggacgagttgggcgagggggcggggagtcgaggcgaggagcggcgcggatcgtgggggaggtggcgggggcgaggtcggtaagaggcggtcgcgggtcgggttgcgtcgggaaacggcggttagattttttcgggaaggggcgagcgagagtcgggtcgggtcgggtcgggtcgcggggtcgggaagcgtcgagtcgggtatttttttattaggtagcgatcgaggagttcggtcgtttatttcgtgtcgttcgagttcgtagtcgttcgtcggtttttttgggatgttcgtaggattcgggtatttaggacggtagtcgagcgagttcgaggatgggagggtattcgtagtttcgtttcgttaaggtaatagttcgtcggttatttttcgagcgttggcgttttcggtttttggcggacgcgggacggggttgggttgtgggtgtgatgggggcgggggcgttgggagagtcgtgtttaggtcggggaaggttgggtttcggggtagtttaattttttggatttttggagttagggttgggtaggtagggggagatttaggtgagaaaagaaatcgtggcgaagtcgtcgggatgttggcggaggagggggttcgtttattcgggtagtcggtttcgcgttaagaatcgttttaggttttcgggtagacgtttaggggaggggaggttttattttttacgttttttttgtagatttcggtttcgggattggagattttgaagcggggtttttatttcgttttagcgtttttaaatagtttttcgatttcgtacgttttcgttttagttttgggagcgcgttttgttttttttttttcgcggcgagttgcgagttcggagagatgaatgtcgttcgcgtttgcgagtttttgattaatatcgtagtttcgggggaggagacggtgtttttggcggtagtttttgtttttcgatcgcggttgggagcgcgacgttcgtttttcgagtttgggtattcgcgattttcgcgttgcgcggtcgattttgcgacgcggatcgggcgttggagtttaggaaagtagttagatcgtacgtttagcgtttgttcgttgaagttcgtgggcggtgggggcggttcgcgggttgtgtgagttagggaagggtcgggaggtcggtagttcggttcgtcgttcgtgttaggcgttatttgtagttttaagcgttttttagagcgttttggttttgtagggtataggcgcgttcgttgtagtcggtcggagaggcgggtgggtttttgcgttgttgtcgggatatttcgtttcgcgttagtttgggtatcgttttattcggggttcgggatttcgtagggttcg

SEQ ID NO: 6331 - DNA, 2972 bp, Artificial Sequence
  Description of Artificial Sequence: Synthetic polynucleotide
gcgggtcgtagtcggagaggaataggaatcgtagtggggacgttttggttttcgggtttatagtattcgggacggacgcgtagtagcgcgggtcgggaattgggtattagggcgggatgggtgagaggttttaagggataaggtagggagaagcgtagcggggtgcggggaatcgtacgttttttttttgtttttgttttttatttcgaggcggtagggcgggcgggcgcggtttcgggggtgggcgggttgggcggggcggaggcggggtcgtagtattggttttatttagtttttttcgttcgtagttagagcgagtcgagtcgcggttagtttcggcgggtagggggggcgttggagcgtagcgtagcgtagttttattagttcgtaaagcggatcgagttggaagtcgagcgttgtcgcgggaggcgggcgatgggggtaggtgttatcggtcgcgttatggacgggtcgcgtttgttgttgttgttgtttttgggggtgagtgttagtcggagggggttcgttttttttttcgggattagaatttcgagaagagtcgggcgtcgttattaaggaaatagaatagagtattggggttttagatattgagggtgggtggtgggaaaggatttttgatgtcgggattacgaaggagggtttagggttttcggagcgtagaggcgattttttagggtggagatgagggtaagatcggagtacggatgtcggtttttaggtatcgtagggggcggtgggggagttgggaggggttttttaagagggggtatggggtttttcgatgtttaggtttttcggaagaggatattcgaatgtcgggatttcgaagggattttttttttagtatttcggtttttggagagtcgtgggatagaattaaggcgagagaaggagggggaattggacggggattagagatgagaggggcgagttgggttggggcggggagttcgggacgacgggatggaataatggaggaggtcggagggattggaggtagaggggattcggtaaggataatggggatcggttagataatgggggggaggggcgtcggagggagaggttggggagcgggagagaggttgagaagtgggttagggagggtagaagaggggcgacggcgagggcggtagagagatggaagtagaaggaaaggagatagagcggggcgcggattttgaagtggtcggggtttcgtttgttcgttgagggatagtgagacgagaagagagagtagaggtttggatatttttagcgtttgttttcgcgtttttgttcgcggttttttttagtttcggaattggggttgcggatttaaggttgggaggggagtgtttatttcgtcggggcgaattcgttttcggggtttttttacggtcggcgggttttttcgacgcgcgtgtttttacggtttgaagtagcgtagcggatcgcgagggacggagcgggtgtgtttttattcgggttggcggtggttacgtttcggggtgtagagcgtcggggcgtattaggcggggattttttttggtcgcgcgtagttttggttacgtaggcgggaggcggtaggtagggggcgttgcggggcgaggtaagtgtagttcgtcgttgtttgtttgcgagtttggggttgcgcgtcgttttttatttagttgcgcgattcgagcgtcgcgtttatcgcgtttcgtgggttttcgcgtttcgaagggtcgggattcggtttgagttttttttggttttcggtgtaagtcgttgggtatttaacgagacgggggcgttcggacgtttcggattttgtagcgcggtatttcgggttatcgattcggtaaaggtcggcgggtttttcgggtggttcgacgagattgttagatgtggtttgttttatggttatgaatcgaatgttttggaaggtttggtaacggaggaggcgtttttatttttttcgttagtattttttattagagtattgcgttttaaatttcggttttatagatacggagattgaggttttgagagtttaaacgatttggttaagattttatagtaagttgggttagagtcgtggttagatttttcgatttgatttttagttcggtatttttttatttttttagggggtagtcgttgttttagttcggggttacggttgcgttttttagtagggcggggggggttgatattgtttttagagttcgtcggcggtagagtttgcgggtgaggtgggtagagattttgttcgggtgcgggttttagttcgaaagtttagttttagttttttggagttgttaggatttgtggttgcgttcggggatttgggagcgatcgcgggtacgtttgttgattaacgtcgttggttagagacgttgtttagacgcgggtgggcgagcgtagattaggagagcggggaggagggatcggattttagaggggtaacgatttgggtttcgggtttgggtaagagcgagggttttcgcgcgaagatttaaggaaggaggggagttgggcgtggaggatttgggcgtttgggaaggtgtatttcgataggaatttgtcgtttgtagtttttgcggttttcgttttcgtttcggcgcgcggttgttcggtttgggatggttgtgcgcggttcgagtttttttttgggtcgcggtgagagagagagggttgaaattagagcgcgtttcggcgggtcggttggcgggtcgcgtcggtaatggaggtattttgttatttagacgtttgtaattagagtcgtcgggttggttaatgcgtttaatagggatggaacgagggtagtaaatgggcgtgcgtgagcggtcgggttgagttgggtggatggtggatggggaggtagtttcgcgggggacgggtttttatcgtattgttttagtttagtttggtttaagcgtttcgttttttttttgggggatcgcgtggggaggcgggaataatcg

SEQ ID NO: 6332 - DNA, 1026 bp, Artificial Sequence
  Description of Artificial Sequence: Synthetic polynucleotide
gcgggcgagtggagtgttttttagatttcgcggattcgacgggagggattttgtaatgtttaattagaatcggttgttatggcgatagtttttaggtagcgtgggttgagtttttcgtaggaataaagggtgggtcgtcgttggattttgcgcgcgttcgttattaattttttttttagattcgagaggggcggcgcgtttcgttttcgggtcgcgtacgtcggtgttcggcggcgcgtacgtttgcgggagttttttttaggtaatttagtgttgatcgttcgtgtcggtgcggtcgttaatcgtttttgtcggagttttaggtttaaaagtagttttttattttttttgggttttttttaatttttttttcggtttgttttggggtatgagtagcgatggtcggttgtatttttgaggagaaaatttatcggcgttttttggagttatttttgggcgagtttcgcggatcgtgcggcggcggcgagtcggagtcggaattcgaattcgaattcgaattcgaattcgagttcgagttcgagttcgaatttgaattggtagaagttgaggcggtcgaggtttcggtagaggaattcggggaggaggcggttacggtagtcgcgatggaggagggggattaggagtaagattcggagttcgaggaggaggcggcggttgagggtgaggaggaggaggagggcgcggcgacggcggcggtagtttcggggtattcggtcgtgtcgtcgtcgtcgttttagttgtcgtttttgttttcgttttcgcgatcgttgttagagcgtattattcgcgaggaggtggagggcgaaagtttggatttgtgtttgtagtagttttataaatagttaagtagttgggtttggttggtggtgggttcgcggtttttatcgcgtcggtttcggacgcggttttttcggttttttaaattgtttttttttttgtttttttttttcgtattcgcgtttgtcgtcgttgaaagcgttttcgttgttcggattcgggcggtcg

SEQ ID NO: 6333 - DNA, 10207 bp, Artificial Sequence
  Description of Artificial Sequence: Synthetic polynucleotide
gcggaggcggtatagttggagttcggattgtggtacgtcgttatcgtgttgtttcggggaatttcgattcgttttttgcgaaagcgttttcgaacgcgaatttagagtttgtgaacgcgtcggtaagttttttatttttttatcgtcgttcgtcgtaggtgggttcgttttaggggttttttttgcgttttatttcgttttttaagttatttagtcgatcgtttcgtttacgttttcgtgattttagatatttataattacgatttcgtttttatgtatatttaacgtacgacggtgtatagacgtgtatttgatttttgcggattaggtgttttaagcgtatagcggttattcgcggaatcgcggttcggggttagtgagtcgtttgtagtttttcgggttaggggattttttagaatttcgggaaagttattcgaagtttattcgggatgcggttttggttttcggtcgcgtgatttcgtttttaggtgtagaacgacgtttttttagggtttatagttgttaggttgggttttgttttcgtatttttcgggaagattagggacggggttatataggtcgtggttgcggagacgttttttcgggttatttcgcgattaggagggagtcgagtcgttcgtttttttcgcgtttttcgttttattttagttagttggttttattttgcgcgggataattgggacgggagggaggcgacgggagggcggcggttttagagagattgcgcgtttgttagcggtaatttgtttaagtggacgggacgggtcgggtcgttgcgggttggggttatcgaggtcgcggtttttattttaattagatttgggatcgcgggggagttcggttcggtcgttaaatcgggttggttggcgttagggtttcgggaggtgcggttcggcggggaagtcgtgatgggaagcgattttgtttagggagtgttttttattattatattttttacgtttaggtagtgatcgacggtttggcggtatttttatagcgggtttatagtacggggttatatacgttttttgagtttagtttgggtatattcgtttgttatcgagggtttaagttagtttgtagttcgcgtttcgttattcggacgtaagttcgtcgttcgttttgttacgcggtcgtatagttcgagttttttgttgtttattgttcgcggggttacgtaatttcggttttgtatatagaggaggaagcggcggggattttttgttatttggaggtttaattcggggaaggttttagtagtgttttttaattttgcgagaggtgacggggtcggaggacggaagggtagttacgttaggtttaggatcgcggttttattcggtttaggtcgttttcgttttcgttttattttattgttgcgggaagcgcggggcgtatagatcgcgcgttattagtttaagttcgttcgacgttttggtcggagatcgtttgcgagagggaggggcggtcgagcgcgcgtttttcgtttgtttgcgggatttggtcgatgcgaagtgataggggtcggagttttgttgtggagtttcggtcgtttggcgttagtcgttttcgttcgcgttttttttttttagtttcgggcggttcgcgaggcgtttttcggggttttttaaaggaatacgtatattcggttttcggggtttcgttaggggagggggtttttgggaagggggagggggtcggtttaggtgggggaggggtttagcggaggttttacggcgtcgttttagggttttttaggtttttttagcgttagttttcggtgagtttcgggtatttttagttggagagtttggttgggggtcgttatagattttttagagcggttgtagtaggattttagggtgatcgcgggatcgcggggcggggcgagtggtgggattttggttcggatagagtttcggaaagttagagggaaggtcggtgttattgtaggtggggtcgtcgtttttagatgtagtcgttgtattgtcgtcgttaggtttttcggttaaataatttaggtttgagtgttttaaattttttaggtttcggatttttggattagttatggatggattaatgaaatggattaatgtttaaaacgtatatatttagatgtatatatatttttataaggataaaagtatgtgtttatatatatatatatatatatatatatatatacgcgcgcgcgcgcgcgcgcgattttgcgaatgtatttacggatttttaggtcggtatttgggttttcggttaaggaaagttgttttggttattatttggttattttatcggttgcgtaaacgtgtttataacgggttttttttcgagaggttatatttcgtttaaggtggagttagtaggtatttgtttgtggaaaattgtagtggattttgtttcgtttgcgtagattgcgtagttcggagttaaagattcgttttggttagagaggaggtattaagagaggtgcgatttagttaagaacgaggtcgtggagaaaattttgtgggggcggcgtttatatatgcggtgatgaggagttgtgagggttttggggtcggtttcgaaaagtagggataacggtcgtagaggttatattgttttcgtcggtttcgaattcgtattgttaggagagattcggtttttaaacgttgtttttaacgtttaataacgaagtgttttgcgatcggtgtgcgtagtgggcgggcgtttgtatgggttaatgttggatgtacgcgtttattacgcggttgtacgggtgggaatgttattcgtggttagtgtatgttttgtttttttttttagaaaacgatttttaggaattagtttgagtgttcgcgttcgagttcgattggaagtaggtgcgtggtcgttttatttttttcgtgtatattttgagttatagttttcgttgcgtatagagggtattatacggggttcgatatatatatatatatatatatatatatatatatatatatatatattattattttatgggggggaaattgaggttgtcggaagatagaaaacgaagattgattatagaagagggggttttaattataggtgttcgtagatattttaatttttttacgcgttatttagtattttttaatttaggagacgtgcgttttcgagagatgagaagaaattaaaaaagtggttggtagggcgaagagaggaagtcggtatttcggaagaaggagattttcgttttcggtatcggatagggcgaaaattcgttgggtcgcgggtggagaattcggggttcgttcgcgcggtgtcgttttgtgtttagcgaaaggtgcgtttatttttttggtttcgaggattcgtttttttcggtcgttggaaagtttagggcggggttcgggtttgcggagaattttaggtttttttcgagtttttcggtgaaggcgggcgcgggtagggggttttcgcgtttttttagcgtaaggtcgcgtttcgttttcgttcgcgtcggttttagtagggttcggttatggttttatttattagttttcgttatttgggattcgttttcggatttcggtcgttcgagtttttcgattcgttcgtttatcggtttcgttttttagtgtttgttgttttttttcggggcgtagggatttttaggcggcgttacgattcggagttgggtcggaggttaggttggggttcgggttagagcggtcgggtttttgggcgcgggagaaggagggcgtttttttttcgttcggggtcgtgttaatgttttgtatttggggtcggcgtgcggttgcgggtttttttttaaggtttcgggattcgggtttttttcgttttaggttttttcggcgggttaggtcggtttttcgcgttttttagttcggcgtaggtagtcgtaggcgcgggcgggcggtgggggtcggggtaggaggaggggtttcggggttcggcggttcgttattggttaatattttattttgttgatatgtttttttattgttgaggttttcgatatttttttttaggttttttttttcggtcggagtttggtttgagttgttaaaatttcgttttcggagatttataattggtttaaaaagcgtaaaattagtaattaaggggggtttggttcgttagcgtaggggattcgagttgggtaggatatgtgagatagttatagttttttagagattacgataagatttaattagtcgcgcgtggttttcggcgtcggagcgggttagtttagttcggtttagttcggtttcgcgtagagttttcgtcgttttcgcgtatagagtcgggtgttttttgcggtgcgtcggacgggaagtttcgaggagtagttgttgcgttcgttattcgggtcgttcgtttatcgcgcgcgtcgtcgttcgggtcgggggttcgagtcgcgcgttttcggtttcggtttcggttttcgggcgtttgggtcggatgtttcgatgagagagtcggcgttggcggttagcgttatggtttattattcgttttacgcgttacggttcgtcgatttttttatgttcgtttttttggcggcggcgtagtttttttttttttcggtattcgcgttgtcgttcggcgcgttggttaagtcgttgttcgattcgggtttggcgggggcggcggtcgcggcggcggcggcggtagtagcggtcgaggcggggttgtacgtttcggtattgggttcgtattcgttcgtcgcgtatttgcgtttttttaagagtttggagttcgaggacgaggtggaggacgattttaaggtgacgttggaggttaaggagttgtgggattagttttataagttaggtacggagatggttattattaagttcgggaggtagggttgtcggtcggttggaaggcgcgcgggcgggcgggcgggttggggtacgggattgtacggattagagtagagttggggattttcggttttcggttttcggttttaggttttggttttgacgttacgtttcgtttttacggataattaagttgatttttttcgtttggtatcggagcgatttttttttaaaataaaaacgttaaaatttttcgaatgaaataaaacgaaaatatattgttaaagaatagttttaatcgttttgagttttagcgtagaggaggtttcgcggtttggttttggcggtttttttcgtttcgcgttttcgtttttttgcgttcgggttcgttttcgagttcgggggaaatttagttttttttagattttgtttcgatttcgaagtttttagtgggatttgggtttagttaattttacgttggttgttcggtttttggtagcgagtttcgggttagtcgagtttttcgttttatcgggttgggagttttttttttatcgcgggtattcgagttttggacgtattcgtcgttttaggttttaaagtttgaagaaagttatagtttcggtttttttatttttcgatttagttatcgagaatttaggtttcgggtttatttttttttttcgaattgtacggttaggatgttttattaggttttgtagtttagtttttaatataaatattttttagatttatttttgggagttttcgttttaagtgggtattttttttgaacgaatttcggggagattaaggagaagcgagaatatttttagagggtttagattttttttttgggtattagtttttattttagattagggagaaagagggtttttagatttgagtataaggtttaaaggaggttgtttaggagagggtttgataggtagaaatgggattttttgggagtaataattataggtggggtcgttcgggtagtgatgagagggtagagtagtcgattataggggaaatagttaggcggtagcggtgtgcgtaacgaggagggataaataaaggaggagtggggttttggaatttagaatagtcggttttaatgggattttttttttttttttttttttaggcggatgttttttttttttaaggtgcgagttagcggtttggataagaaggttaagtatattttgttgatggatattgtagtcgttgacgattgtcgttataagttttataattcgcgttggatggtggcgggtaaggtcgattttgagatgtttaaacgtatgtatatttatttagatagtttagttacgggggagtagtggatggttaagtttgtggttttttataagttgaagttgattaataatatttttgataagtacggtttcgtgagtgttggggtagggtggggacggtgtaggagtttgttgatttagtattgtagttgagtaggagagtagggcggtaggattttttagggggaagcgttgggtaaatttttagagtgtttttgttcgggttattgttttgtggtttacgtgggttgggtttgggtttgggttttagcgtttttttttgtaagtttgggaaatggtggggttagtggttggtagtttataattttagttttttaggtcgtggagggttttttgtatcgttaatagggaggtaggtgttgttaggattgggtttgtagtgttggattacggaggttattttgtttttggtttgtaggtgtcgagtttggaagatttgtttatgattttaatttgtttattatttttttgttaagattcgcgtttttggtttttttttaagattaggggatttaaaagttaaattattttttttatttatttttttagtttttttaagatttttttttttttttataggtagatgtttaattaggaggagagggtttgggggttttttttatttatgtttgagtaaggttttagcgaacgggggtggtgttttatagggtaaaaggaattgtttattttgaggtagggtagttggtgagttttcgaaggttggaattttttttttgtggggttagggggtttattagtgttagaaaggaagagagtgttaagagtggaattgtagggttttgttttgttttattttgtttgggttttttttgtggggaggggttgttttttggttggtttttttgttttgttttttgttttgttttgtttttgttttgttttatttttgtttttaattgggaaattttttttaatggtaagagaaaaagaagttgtgaaaagagaaaagcgagaggaaaagtagaagaaaaagaaataagggtgagaaaagagtagagataggagaaaatggggaagaggaagaatcgatagagagagagagagagagagagagagagagagagagagagaaagtggagaggaagaggttaggtatttaaagaatagaaaagttcgggtcggggttggtggttgtcggttgatttttatttttttcgtagattattttaaattttatgtataagtattagtcgcgtttttatatagtgcgagttaacgatattttgaagttgttttatagtatttttcgtatttacgtgttttcggagatcgattttatcgtcgttattgtttattagaatgataaggtgcgcgcggcgggcggtgggttaagtttttgtattgacgttttttaatacgtgtaggtttaatcgttcgtttatcgtttttcgaagttttttgtacgggattcgcgtttttgcggttcgttttcgagtatcgagtttcgtatttatacgcgtagtatttacggaagtttttaaggcgtttttttaattttatcgcgcgtatatataggtttttttggggcgagcgaatagttgggtcgtcgttttgatggagatgtttatttaataattagttgagatttcgggttcgcgttgatatttttatattttattcgtttattttttggtttaggaatgagaatgtaagtgaagagagggcgttcgaggtaatttgtttaggttttatcgatgtttagaattcggggtttagtttttattttttcggggggagttagagggtgggataggtgatatagttttttaaagtatttttggttattgttttgggttagtttaggttttagattttttgggaggcgtttagagaattattttttaattaaagggttttttttgtttgcggtttttttatttttgttttagtggggtagagtattatttttttaggtttgtgtttttgtgcgttattgtcgagtgaaagagagggtacgagtgttcgtgtcggtcgttgtggttttgtgaattaaggtgtacgttgggttgtgcgtgtttcgtttggggtgtgttggatatttgtggaggtatgtgaattcgtttggtttcgtaggcgtttgttatgtttgtgtatatttgcgtgtgtgcgagttcgtgagtgtgatttggttttgtgtgtatttgtagttttgcgtgtgaattgtagtttttgttcgcgtttgttcgggtgcggagtcgtttaatttgcgtaagttcgcgggcgggtgtgtatgtttgggttggtttcgatattgtggtattgttttaggtttgtgtggggttgtttaggtttgtttagggataatttttcgaatgaagtttttggaggatagatttcgtcgtttttcgcgaggtttttttatcggttttagttcggggcgttttattttaggcgggtgggtattaagtggacgtttttcgggttttttttttgcggttagtattcgttgatttcggggtgttatcgattacgttggaagagttacggtttgatttagcgtcgtttttttggttttcgtagattatatagttgaagatcgataataattcgtttgttaagggttttcgggatatcgggaacggtcggcgggagaaaaggtgagaggtcgaggatagtagttttgtggcgggtgttcgcgggagtagcgagtaggagggatggagggatgggtttttcgttgatttggtttattcgtttatttttaggaagtagttgacgttgtcgtttttacgtttgtacgaggagtattgtaaattcgagcgcgatggcgcggagttagacgtttcgtcgtgcgatttttttttcgcgcgggaattatttattttttcgggcgtagcgtttagttcgttgcgtttgtatcgggttcgaggtgagggtcggatcggaggagggatagggaggtggcggcggggggtttttaggtcgttgggttggttttttgttgagttattcgttaatttgaaaggttaggaaggaaacgtcggcgagtgtttgggatggggttttcgtttcgggatttttttacgagggcggttttcggtagttagaagattcggtcggatttcgagtttggttttttgggcgtcgtgtaattttatagttgtagggttttttttttagggttgggttttttttattgtaaatttggggttttggattaggtgatttgtagttgttttttgttcgattttagtagttttttcgatttggttttttcgagagtagtttttttcgagtgtttttgattttgttcgtcggttttcgtttaggtttttgtaattcgcgcgtttttttttcgtagttgaggagaagtcgtgcgtcgcggatagcgattcggagtttgagcggttgagcgaggagcgtgcgggggcgtcgttaggtcgtagttcggttttagatagcgttagttttattcgtttgatcgaattcgagcgcgttcgggagcggcgtagtttcgagaggggtaaggagtcggtcgagagcggcggggacggttcgttcggtttgaggagtttggagaaggagcgcgtcgaagttcggaggaaggacgaggggcgtaaggaggcggtcgagggtaaggagtagggtttggcgtcgttggtggtgtagatagatagtgcgttttttttgggcgtcggatatttgttcggtttggttttttttagttatttgtacgggtagtagttttttgggtcgttgggagtcggttagtcgttttttttgtattttggatagtttattatgggttttggcgtttttttcgttatgggtatgggttatttattggtttcggtggtaggcggcggtaacggcggaggtggcgggtttgggatcgtcgcggggttggacgtaggcgggttgggtttcgcggttagcgtagtaagtatcgtcgcgtttttttcgttttattttttttagtatatgttggtattttaggtaaggtttgtgatttcgcggtagcgttagcgagggagaaggtttagggagttggcggcgaggttagcg

SEQ ID NO: 6334 - DNA, 2392 bp, Artificial Sequence
  Description of Artificial Sequence: Synthetic polynucleotide
tcggattttttgttttttcggtgagtcgttttttttttgtcgtcgggttttttttttttttttttgtttagttaaaattcgaatttaggcgttaggggagaggatcgtcgttttagtttgttttattgttgggggtacggagtttttgtttttttaaggttacggttttcgttttcgcggatttcgttcggattttttttggttatcgggacgtttcgttttttttttttcgtagtaattttttatattcgggttgtgaagttcggggtatttttaggtcggcgataaataatttatagggaacgtggtattaggtttttttcgcgggaggagggggcgcgagtagcgagagttatcgttattcgcggtttaaggatattcgcgatgcggcggcggcggcggcggcggcggtttcgggcggggattcgcgttacgttttttggcggttaagttgagtattacgtattcggcgtttttcgttttacgttgtttttcgtcggcgttcgcggtttcggggtttttatttttatttttttaagttgggtcgtgatttcgagtttcgtagtggggggattaagttagtttggtaggcggttttagtattattttaggttcgttcgggggttttgggcgaatttaggtgtttcggatttgtttatttgtttttggtacgtttttatttttcgggagtttagaaataggtttaaagttattagtatcgttaagatttggacgggttttgaaatatagttagcggaatggtattttttttaaataagtgttttttttcgatttttttgtggttcggggttagggattgaattaagataacgttattattcgagggttgggggatcgagttagaagtttttttggacgattagggttgggaaatcgagtggacgaatggggtgggtattagggtttggcgggaattttcgttttgtttatttagtagttttttgtagggtcgcgggacgtatttgggggtttaggttgtcgggtgtttttgtttcgcgtgttttcgttttgttcgcgtaggtaggaaataggagattcggggtttttttttttcgtcgtcggggattttgggcgaagtttttagagatcggcgtaggcggttggtgcgtagttagggtttagcgttaggttttgttcgtttagtgttttttttgtttatttttttttttgcgttttggaagttcgggagtcgggtacgggttagtatttgtaagatgttattattttggaagtttatttcgatttttttaggtcgtaggaaggagagagttaggttggggtaaaggagatggggtagagttggaaggggaagaagcgggattcgcggcgggggaaggggtttgggcgtcgaggcgagtgcgtagtaggtgtttagtagatttagggaaattggggtattgggttggggagtcgtatagtttttttttattttttcgatttttttttaatttttcgttttggtggattttagtttcggtttttattttcggttttgtttttcgtttttcgtttcggcggtttttagtagtaatagtttgggttcgcggtagtttagatttttttggtttcgcggtgttgtcgcgttaagcgaaggaggaggagggttcggcgattttggggacgaacgttttggacgtttcgttcgcgtttttttttcgcgttcgtcgcgcgtttgtttgttcggtttttttttcgtttttttttcggtcgttcgggttaaaatttaaggttaggtttttgagggttcgggttttttagtcgttttttttttgagtttcgagagttttgcgtgggtttaatttttcgggtgtttcgtttttgttttcgtcgtttttgttcgcgcgtcgcgggaatttagttttaagttggcggcgaagttggtgtttttcgttcgtcgttcgttatttatcgaggggaaggggcgttgcgttcgcgacgagagttcgcgtcggtcgtttttttcgcggtgtttgttttagagtttcggtttcggagggttggcgcgtttagttttagtttcgcgggcgtcggagttcgggcgcggtggggcgggggcgggggcgggtggcgcggtttggttcgttggtttcgattcgtttttgcgtttcgcgattttttcgaggttcgtacggcgttcggtttcgtttcgggttgggttgcgtatcgcgttttttgtttttagagttcgtagtcgattgtgcgggagtttttatcgtcgttcgcgagggttcgtttcgtcggggttcgttattttcgtttcggttcggttcggttcgttgtttttcgaggtttttttcgtcgtattttcgggtttttttttttttttcggaatcgcgtttttagatttgatattcggggtaagtgcgtttcg

SEQ ID NO: 6335 - DNA, 564 bp, Artificial Sequence
  Description of Artificial Sequence: Synthetic polynucleotide
tcgattttttttcgtggtcgttagggtaggggtgggaggaatttggaagttacgtgcgatgttcggagttgcgttttttgttttggggcgtgggttcgcgagcgtcgcgtagtttttcggatcgttttgagttgttgcgttcggcgttgtttttttttttttagtttcgcgtttttttttcgcgattttttttttgttttttcggttttggaagcgttttaagatggggtgggggtatggagggagagaggggaggagggagttgttcgggggtagtgtcgttaggaagtgggacggggattttggcgtttttttaggttgttgcgcgcgggttggggatcgtgtatcgttttgcgcgttagacgatgtattttttggaacggtagttgaggtaatgcggggtgtgaagtggcggcgggtagaggggttcgtaggggttgggattcgcgtgtttttttttgtttcggtgcggagtacgatgtgttcgggcgggggcgaggacgttcgggaggggttgggttgcgtacgttcgcggggtcgtcgtagatgggcggtttggaggcg

SEQ ID NO: 6336 - DNA, 3277 bp, Artificial Sequence
  Description of Artificial Sequence: Synthetic polynucleotide
gcggttgtattgttgcggggtgtaagggcgggggaaattatatcgttaggcgaggcgcggggatcgtgttggaaggttcgcggcgcggttttttttgggcgattgcgggggcggtttggtagggagttggggcgagtggtcgtcgcggggtttcgtaggcgcggggaggtatcggtcgggtattcgcgcggttgaggcgagggcgggggatgtttggtcgggtagggaacggggtgggggagggtagaggggcgagcgagtcggagggggaatcggagtcgagggcgcgcgcggatttcgaggttttttaggcgggttttgagcgattgtaaagtttgttcgagttggttgagcgtttcggcggtcggtgttcgggataggtcgtttatggtgtttttgttcgagtcgggttgtttgcggtcgtcgttcgttcgggtttcgtcggtttcggggtttagcgtgttttggttttcgtagcggtttagtttggcggttagttcgcggatggtttttttttggtttaggatggtttttttttgttgtagtatcgtttcgcggagttgtagtacgttgtttcggagtttttcggcgtcgtcggcggttacggacgcggcgtatatgtcggcgtttacgggtatcgaggtgtagatgaagcgcgtcggttcgaaattttgggtttcggcgtttaggaggtagagggcgagtagcgtataggtgcgcgcggcgcggtcggtcggtatggttgcgggtatcgggcgtttcgggttcggttcggttcggttggggttcggtttcggttgggattcggttcgggttgtggtttcgcgagcggttcgcgttttgggcgtcgcgtttttcggtcgcgcggtttatatcgtcgcgttattaggtttttattgtcgtttgcgttgcggagttcgcgttttttatgtcgtcgcgggaggggtttcgagtcgtcgacgttagcgggggaggaatttcgttttaattgttcgcggttcgggttcgcggcgcggcgggggttttacgagcgcgttatcggggttgttttcgttcgcgtttttttcgtttttttgggagttgtcgcggtttttttttttttcgttttcgtttgggtcggcgttgttgtttcgaaggtttcgagagtttagggggaaggaagtcgggtttcggtttcggattcgaggatggattatttgcgtggtgttttcgaattttcgacggggttttaggcgggcgggaaattatcgcgttcgggagatagaattcggttcggtttttttggttgtattgaatatttttgggtcggggtcgtttggagtcgggttgggtgtttaaggatttaggtcgttaatattcgagtgttcggtggttaacggttcggagtggggtttcgcggcgttattaagtttagagcgggggttatcgggtcgtttcgcgttttttagatgttcgtgtgttattgagaagtcgtcgggtagtttgggtatagggattttttacgggtcggggttttcggcgtttttttttttttagttttcgggttttgtggattcggtttcgttttcgggggattgttagtttttatttcgtgcgggcggggcgttggggatttttcggaggtagatttagttgatcgagttttttttgttcgcggcgtcggttcgatcgcgggtaggcggcgtcgtcggggttggacgttcgtagcggcgtttcggaagggggtttcgcgggagtagtcgttcgcgtttttagtagtttttttttgttaggcgtcgcgcgcgttcggtattttcgggtgtttatttgtgcgtggggggttgtttttcgtttgtttagtcgcgtttattttttaggtttaaaggttagtaggaagggtttcggaggtggttgggggcgtttatttgagaagtttcgttttcgtttagatattttattcggtattcgcgtattcgcgtttttatttggatcgcggggttcggttttcgagatcgcggttcgggtttcggcgtcgggttgggggtttaggattagggttggcgtagtcgtttcgtttcgtttcgtttcggggttattagagcggttaaagtttcggaaattttttcgtttacgttttcgtggtatagagaaggaaattgaggtttcgagattgcggggtcgggttatagtcgtggtttttcgattttttttcgtcgttttcggtttttttggtttttgcgttttgtagtttttttttgcgcgtagtcgggggttgggggtttttagttagtagggatttacgggtagtttcgggtgtcgggatcgggcgttcgtttttcgggcgggagtagaggtcggttcgatggagatttttttgagaaatggcggtttttattcgttttttagttttcgagcgttcgtcgtttgcgtttagtattttagtttttaagtttttttgagtcggggttgcgttttcgttgtttttttcggtcgtcgttttttggcgttagagggatttcgcggttcgtacgggtttgttttcggtttcgttcggagggtgtgcgggttttcgtttcgttggtttcgtttgtttattacggcgcgtttaaatttacgcggttcgcggttttttgcgtgttttgtcgatttcgggtcgtaggaggggttagtttcgtcggtttttacgcggggtttgcgtcggtagcgttacgggttggaacgcgtttcgggagaaattattcgcgcggggtcgcggcgttttttgttttaattttcgtagggagtcgttaggcgggtgtttttttggttttagcgttttggtttcgtcgttttttcgtacgcgtttagtggggaggtcgcgttcgttaggtttggagtcggatcgtgtttagtcgagagcgcgcgggcgcgggagaggagttttgttttgtttagggtaggttgtttagacggggcgggaatttttagtttggtttcgcgtttttatttttagtagtcgtggagtttttttagtcgtttaaggttagggattttgtttggttttttttttagggtagtagattttagcggtttggtatttcggtatagaggagcgtgtttttttttcgtagaggaagggagtggacggcgttagaaagggaggggagtttggggcggtgtttggggttagcgggatttttgggtattgtggggttttaggagaggagattttcgggtttagtttgtaattgttgtgtaggaggcgttgggcgggatatttgtaggcgttgtatatatacgcgagggttattatgtcgcg

SEQ ID NO: 6337 - DNA, 5692 bp, Artificial Sequence
  Description of Artificial Sequence: Synthetic polynucleotide
gcgcgttttcgtagttcgtcggttacgtatcgtacgtacgcgtttttttcgcgcggggtggcggtcggcgggagttacgtggagtagtcgcggtgttttcggttacgtttggttttcgatgtcgcgaagggggttttggggtaggtttcgtttttcgaagttgtcgttgcggtttttgttagtcgggagacgacgaggggaaggggtgggtcgcgttgggtttttcgtttattcgtttttttttagttttgcgggggttaaattcgtttttaataaatttcgcgaaaaagtcgagggggggacgcgtcgttgttggagaataggttagaagtgatagtagaatgggtcgttgagattttcgttttcgtttcggtttttcgtcggtttggcgggcggcgacgtggggaggggtcgtttagaagtcggggtcgttcgggtcggggaattttttcgcgtcgacgtttattttttacgggtcgtattcgtcgaggggtcgaaaggggttttagtggaggacgcggtgggagttgggtttcgttttagttgtcgacgtcggcggtgttcgggttttcgggagcgtagtttttggtataaagtagcgtcgaagattttgtcgggtgtttcgtcgcggttgtcgttgtgttcgcgtagggtcggttcgtgaatgcgtgcgggggttttcgagggcgttttttttattttgcgcgttcgggggagttgttcggtcgtcgtcggtaggtagaggtttcgggttttatgggtgttttcgagatttcggatcgtgcgttgagaatgtcgacgttttaaacgagttagtagagcgggtcggagttttggtcgggaatcggcgtcgcgtgcgtattggtcggcgaggtttttggttcgtcggggaaggagtttagagcgtttgttttttcggtagaaattaatatatataaataattattcgtattttttatattgggggattgggagtaaggagtaaggataggggaggggataggatttaattcgttggttttttattttaaaaattatatattttatgttacgatcgtttttcgttaagattataaatatttaatttggtttggcgtaataaaattagtcggagtttttttaaacggagttatttcggtgaattaagttgtgaaatttaatttattatatttataaaggagaatgtttttattgtaaatttaggttataaagaaattatatttgggtcgtcggtttttttttcggatttattatttgaaggtttattaaattattttaaaatgttgggttattttttttatattttatggtaataaaaattaaacgtggtaatattttttttaatagtaggaaaggttaaaaataatcgttataataaggggatataatttttaaaagatatttttttttatttcgggatgtttttttcgcgtttggaagcgttttttttatttttttaattaattcgagtttttaaaatatttaaacgcgttacgattttttttaggttttttttcgttttacgaggcgtttgaggcgtagttttcggatggatcgtacgtggggtcgtagattttgggcgttcggacgttagtcggaggcgcggggatttcgtggtttcgttgcgaatttgcgttttatcgcggttcgtatatttgggtcgagtcggggtcgtttcgggagtttttcgttggtttttgggcgttttattcggtttagtaatgttcgggttagataaaggagtcgttagggaggggttaattcgttttttattttttttcgttttttttttcgttttttttttaggcggcgcggaggagagaagatgcggtttttaataatgtgtttggtttaatttgcggggtgtgggtatttgttgcgtttttttgggtgagggttgggtttttttttttttatttttttttatttttgtgtatgatattttggttggggtttggggcgttttgcgttggttagaagttagggttattagggatttttcgttttcgttttcgaagaggggatttgcgcggacggcgaggaggatcgatgcgtttttgagtttttagggaaacgaggtcgcggttgttgttacgtcgcgaggaagatttatgaggcgcgggtcgagtatggttcggttcggcggaggtcgttcgcgtatttaggttaatttttgatttttatttgattatttttttttttttgttatttttaagtcggcgttcggaaaggcgaataaagggaggaggatgggggatgggggcgttaagcggtggcgagggttcggttcggtaatttttttttttagtgggggtttttgggcgttttaggttcgcgtttaatgcggggtttaggagggcgtagtttgaaaggtgatcgggttggggttgtcggagattcgttttgcggggtggtttttttagtcgttaggtttacgataggatttttagggaggggtttttgtaaatgtttttgggcgaagagaggacggaaagaatatttttttttaaattgtaattaagggtgtgcggggcgggggtgtttggggggtgttgcggtaggtcgggttcgtttaatcggaggtagtagtttagttttgggtcgataaggtcgagggaaacgggatttttttgtttttcgtacggaaaagatttatttaagcgggtaagagggaagcgaagtttgtattttttatgttgaaaaaaaaatttaaaatggaaaattattttattggttattatttataagtaaattaaaaatagggataattagagtgtggggatttggagggattataaatttgcggcgttttttttattggaattaggagtttttatggtttgttgttttattttgagagaaatgagatttttggttttggtgtaggcgggtgtgcgtttcgagcgtttttcggcgggggggaggggggagtaggaggggcgaggagatttgcgtagttagggagtcgcgaatttcgagtttcggttttcgaaggcggtaggagaaatcgcgcgttgtgtttcgatttttttcgttttggttaatcgcgatttgggacgagttggaggagtttttttcgggtttcggacgttcgcgtcgaaaatcgggttatgggtattaaattcgattttaggcggttatttattttgtttttatttaaattttgatgagttatttgggagtgcgcggggattgggaagtgagggatttttataatatttttttttcgatttcggttttcgagtttattatttattttgtttttttcgttttcgttttttgttttaaattggggaggggggaggggggagagaaaaggatataaaattatcgttttttcgttaaatttttaaatttttaatttttcgtaaaatggtttggaatttattttattttataggggttttattttttatcgggtggaggttagttttttaattttttatataagtaggatttttttttatttttgaaagtttttaaatttagttattttaaatgtaaatatcgtgtgaaattttattaattaggtaagaaagtagggagagttttgatttagttgtttttaattttgggaggagaaagagaaagtgagttttttttttattaagtattttaaaataatagcgttttttttttttagttcgttttaatcgtagttttgtttttgttgaaagatttttgttttttttaggaaggggggcggggaggataggtttatatttcgaagagttttgtttttaaaattgttcgaagatttttttgtttgacgtgtatatgggggaggggaaggagttcgtttaggttattcggttttttcggatttcgtttaggttattcggttttttcggatttcgtttaggttattcggttttttcggatttcgtttaggttattcggttttttcggatttcgtagaatatttttaaagtttatgggcgttttttaatcgtgtaagttcggggtttcgggggttaggaggggttgttttaagataagggaagttgttcgttagattggggttaatatcgggtttttttaatttaagtttttttcgaaaataatttttttaaaattgagtatttttattagaaaaaattcgtattttttaggaggacggggtgggagagtttcggggaataaagttcggtttttttagttttgaggtcgaggtagggcgtatttttttttgggcgaatttaatcggagttgtagaagagataagtatttttaaattggtattcgtttcgagtttaaggtgagggtggagaagggtttttggtggaagttgtaggaatattttgggtcggggtttatttcgcgttcggcggtttttcgaatttcgtagaaagatacgtttgtagcgaaaggtttttatatattagtcgggattttattcgttttttatcgagagtgcgttttgggagcgcgggaaataaggaaaacgtacgtatttggcggcgtttcgagggcggtttcgcgggtttttcgttggcgaaggtttttagaagttatttttcgttcggttgttcgttttacggttagttttttttttttcggcgacgtatttcgtcgagttagtttataggaagcgttaggagtcggagatttggttcgttttttcgggcgttgcgttcgttttcgatcgttagggttcgcgtttttttttcggttacggtttattagagggatttcgcggcgggttttggttcgggcgcgtttttttgcgttcgagtttttaggttttcggtcgagttgcggagacggacgcggagttttcggggaagacgaggcggcggcggtcgtcgttcgggtaggagtttcggggcgggaggggtgtagggcggaggagcgggcgggattttagcgtttcgcgtttcgcggtcgtcgtttttcggggcgtttagttttatttacgtggaatcgtttcgttttcgtcgtttcgtttttacgagggaaggtattcgagtttcgtcgtatattcgcgtttttcggtttcgggttcgaaatatcgcgttttttttttagcgtcgtgtttttcgtttttttagcgcgcggttttcgttcgattcgcgcgttcgttcgattcgtttttaatttcgtttaattatcgtttttcgcggttgttttttttgtttgagttttcggcgtaggttaatggaattacgcggaggcgcgggcggtttggttaatggaaggtttagggggcgtggttggcgggaggggttgcgggcggtcgggttttatgcgttgagattcgagattgcgtcgtcggcgggtgcgtttaggtcgtttagttagagtcggtaggatttcgtcgtcgggttgtgggtttttgatttttttttcgttgtcgggagaagcgtttgagtggggagggaggtgggaggaggtggtttcgcgtcgggggtgcggggagcgggacggcggtttggatggatacggttagtttcgggtcggagagggttcggtttagagtagtttgggttttgtttagagttttattgtgtacgttttcgcgaggatttgcggagagacgtgtaggcgacgtaggtttcgggaaggaaggagggtatttgggttcggacgagcgataacgttgtgttttgtgatttcgtataaacggattttggagtttagggaaagcgttttaggtttttagttcgggtagggttcgtgggattggcgttcg

SEQ ID NO: 6338 - DNA, 7937 bp, Artificial Sequence
  Description of Artificial Sequence: Synthetic polynucleotide
gcgtcgtttgcgaggggcgttttgcgtggattcggggtttcggggcgcgtttatttattcgagttaggagagattgggttttacggtgttagtttcgcgttcgggttcgcgcgtcgtttttagttcgcgttttttttattttcggagggtttcgcgggttttcggcgacgggtttttgtttagggttcgggaattttttttttttttttttttttaagcgttattttttcggagtcgggtcggtcgttttcggtgtacgcgggaagcgggtagttttcgtttgtattcgcggggtcgggattcggaggtattcgttttttcgatatattcgttggggtcgttgttcgttgttttagtttttcgaggttacggtaagagttcgggggtcggcgttatatatttttagtcggcgatcgcgtttagggatttaatttaatcgtttttagtttaatgaatagtcgcgcgttaatcggattttcgcgcgtttcggggatttacgtttttcggttttttttttcgtgtttcgcggttcgttagacgtcgttttcgaaggcgtcggtttggggtttggttaggggttcggtcgcggggggtttcggtcgtcggagtcgggagacgtcggagacgggagtcgggttcgcgcgatcgttattttcgagttagtcggggtgggtttcgcgttttgttttgcgttttcggttcggttcgcggagcgtcggtgtttatttgcgagtttcgggtttttcggagttttttttcgggtcgagtcgttcgaagcgggcgtcggcgtaggtttcgatttaggtaggcgggaaatttcggagttttcgttcgcggttcgtagttttttattttaggtcggcgtggtttgcgggggggaaggtcggtcggggtcggtcgttcgttttttttttttttttagatttttttgattcgcgggtttttcgtcgtatttcggttttcgggttgtttcggtcggttcgcggggattttggaaacggtttttagtttatttttttttattaagcggttttgggtcgttttgaaatcgcggagttagtaattgttttttttaggaggtttagtgcggattggataatagttaattagcgttttgtttatattcggtgatggatagtttattggcggagtgttaattaattttagcggtttcgcgggagcgggagtgggggcggggaaatagagagataataggttttgagtttaattttttcgtgtttttgtcggaatgagacggtggagaatttcgaatgcgtgtgaatttgttagttggtttttagtttaaatattttttttttttttagagggggaggtagagatttatatggagaaagaggagtaaaaataaatgtatttatcgttattaagatattatttcgattttttgagaataaatagtatttgggtgggaaattaaattttaatagaaatatttgtttgcggaatattttagaagtggtttgtatttgattacgataaaaattgtttagtggtttgttttagttggagtgaggatttagtagataggtagatagggagtagtattgagaaatattatatatggtttattatattatattcgttttttttattattaaattgaaaatattttttaaatttaggtgtagatgaagaaagggtaatttttgtttttttaataaatttttgatttttattttagtagttgttttgttgtaaagtgtggtagagggagataaaattgagagttagtaatgtagacggttggagatttagaatttattttttagggtttgatttttaggttatggggaggagagagtcggacgggttatttaaagtttttgttgtttaagtagcgggcgtgcgtgcgtgtattcgcgagttcgggttcgggtaggtagtagttttagagcggtagatgggttaggtaatttggggaggtttttgggtttggaggtttggtttatttgttatttgttagatagattttagggagaaaaagtagttatttttaaggggtggtggtgtttttttttttggttttttgtgcggtagaagttaaacgttagatttgttggattaaatatatatgtgtgtgtgtgtgtttgtgtttgtgtttacgttttttttttcgtcgggatacgcgtattcgttcgttttagttttttttttcgttttgcgttattatatttttatttagtagtaatgatttgcgtagaggagttgcgtagtcgtcgggtttgaattaggcgttatcgggtttggtagtagtttcgttgttttttgattggtagttttttggttcggcgttagtttattgggaggtttgtttacgtcgaatgagtggtacgagttttcggtcgtggagggttgcgcggttaattagcgcgttggttgtttcgggttgagtggtacgagtttattagtatgtagggttcgtggttcgtcgcgttaggttgtaggtttgagagtcgttttggatgggttcgttagagtcgttgttgtggaagcggtgtatttatagtgtaatagttagtatattgaaaatattaataggaatataaaataaagttatatttattgatttaattgtattgtatttagttgtatttaggaaatagtttttagtaagtaattgaaattgtttttattttttttttgtttttgtatttttattattattttattttttattttggttttggggttttatattttttttagtaaaagaaatttaggattgtgatgttaagaagtatatatttttttttttaataaaattcgttaaaatgttgaggttttttttttttttaaaaaatatggattatgagcgatttttttttttttgaaaaattttatcgatcggtttaaaattattttcgtaatgtatttttgttttgttttgagcgtttgttgtttcgatcgatatttagtattaaaaataaatattcgaagataggatagggatcgttaggttgcgtttggcgcgagtcgcgcgggtggtatcgggcggatagtaggcgaagttcgggcgtcgttagcgtgcgtttagttttgggtgatttacgaacgaattttaatattcgtttttttattttgttttttttttcggaatagttttgggttggttttgttcggtcggttcgcggcgaggggaattggtcgggtcgtggtatttacggtcgttgttttgaggggtttttcgggtcgaagttaggggtcggggaggggaatggttatggcgagtttttcgggttttcgtttttaatttagaatttttttttttcggagaagtgggggtggaggagggggatcgagtaaggtcggcgtagcggggcgtttttatcgcgcgcgttcgggacggcgcgcggggttcgggttacggttcgtgtggcggggttcgcgggttggtttttttcgggcgcgggggttaggcgcgattttagtttttatgatttttttagggagcgggtgcggttgtttcgtagggagcgggttttgcggcgacggtcgagttattcgcgttttaaggcgcgtttggttttagttcggtttgtaggttttatcgcgttcgcgttttcggagacgacgtcggagggaggtagacgggttagagttttggttttcggtaggcgggcgaggagagagcgggtttttagatgtaaaagtaggaaataaagtaaatttgtagaagttttagattttggagcgcgttagttacgtttggggtcgcggtaagagggatcggcggttttagggttacgttttgttttttcgggagggagttttgtgtttttaggtttagtttttttcgaaatgttttcgttagcgatttttcgttcgttcggggttttttgttcgtcgttatttttcgttttatttttttttttattttagttcgatttggcgttgcggcgtcgttttcgcggtttttcggcgcggttttttttggagttgggttgggagtgggtttcgggtttcggtattcggcgggtggcggcgtcgtcgttgcgggattgtgggatttttagttcgggtcgtgtggtcgttttttttcgttttattttttggtcgttttaggttttttaggttttcgaagttcggcgcgggtagacgcggaggcgcggcgcggttttttttcgggaggagagaatataaagaaaagttttttttaattcggttagagtcgtggcggcgtaggtaggcgatagtaatttattttttgtttgtttaaaaagtcgagtaggttggtgagaaaggaataatcgggtttgcgattcgttcgtagggggtgggagattaaaattgttgtttcgtagtcgagttcgcgtttcgagaatcgtcggtagttcgcgtttttttaattttgaaattttttattggagagaaaaaaaaaaaaaaaaataattataaaataaaagtatagtatatacgattttttggaggtcgttaggaagtttggtattttcgcgtgcgtagttttcggttttttttcggttttcggcgtttttgaagttgtaggtttttgatttttttttttttttttttttttttttgtttcgttcggcgtttttcggggttcgggaggcgtcggtcggggttgggggtttttacgtttttagtttagttcgggtagttttttttttgatttttgcgttcgtagttttttcgttagagtatttttcgggttttggcggtcgggcgttcgttttgtaggtcgggatcggggtttgggagtcgagttatttgttagattcggggagagagttggcgatttttagagggaagggagttttaaacgtttttgtatgtagttgttagataaagagaattttttgtgtagatttatttatttataatgtaaaagtttttcgaataaatattaaaaaagtttattagttgagtaaatatgtatttatttaatatattatgttttcggttatagattaaattaaatataaaatagtttgtaaataagacgttttagaattcggattataaaatatcgtaatttaaaaaggtatttagtagatggaaaatattttaatcgttttgttgttatggtggaatggttataaaaatataaggtttttcgtaaagtttttaattaggaatattaagtttatttattttttttttgttggaggtgataaatattaaaataatacgtatttagaagatgaggagtaatatgtgaagtgcgtttagggagcgttttcggagggacgtttgggagtacggtggtgtacgtagtttttattattggtttcgatttttcgtatttagagtttaaaattgtttttaatttcgtttgagtggatgtttcgcgttgggtgggggtggaagaaaatggaggtgagggttattttaggtggtcgaggttcgggtagggtttgttggtagaaggttgtgttgggtcgggtttatttttttcggttagagggtcgagttgggcgtcgtagatttcgcgtatttaggtcgttcggtattgttcggagcggagatcggtttttgttcgcggttttcggtaggcgttgaaggaagaaattttagggtcgatttgggtcgttgagagagagtattttgattttgaaagtattttttttatatatatttttaagtttttaattcgtagaggaagattttgggcgaatttgattggggggcggggtgattgttatagttttaataggaagttttcggtttcgggatagtaggtcgggtattgcggcgtggcggtttaggtgatgtcggtggcggttgcgggttttcggggttttgaggagtcggtttggggttttagcgcgatgttggggataggagttggtttcgttggggttggggaggggggattacggtggatttagaagaatgggtcgaaagatgtatgagggggatgggagtggggagaaaaggaaggttattaaaaaaaaaaaaaatttttgagttataattaataaaattattcgtttaattagtatggttattcggttaagcggaatgtagtaaaagttggatttcggtatgaggtggggagagggggagagttagtgtggattttaggttttttttttcgagatatttttgggtagcgggggaggggagagggtgtgcgtgtgagtgtgtgtgtgtgtgtgtgtgtgtgcgagtgtgcgtgatggtttcgtagatttgggtttttattatttagtagagttagtagttttttcgtcgcggcgttttagttgtagggattcgcggggacgagaacgggaggcggcgagtagtgcggttgggttttttcggttgtttcgggttaagcgtggtcgggacggtgcgtgcgcgcgcggggtttcgggtgttgggttgcgcgcgcgtgcggcggggagatatcgagcgtttcggtttcgttattcggtttggtcgtcgttcgttcgggtcggcgggggtggggggtggggggagtgggtgagcgggcggggcggggattttcgggcgagtcgagttttttagttattcgtgttttttttgtttttgtttttatagattatggattcgtatagcggtcgttggttcggtgcgcggtcgttcgtcgagaagtttagttttttcgcgtgttgatcggtttcgtcgttattatcgtttgtgatttcggacgtcgtcgtttttgcgtcgttcgcgcgtcgagtcgttttcgggtttcggtcgcgttgtttcgaggaagcggcggcggatcggggtcggggttcggtatggatggtcgcgattttgcgtcgtcgtcgtatttgttgtcggagcgcgggagtttgggttatcgtagcgtcgttgtcgtcgcgcgtttcgtttcggttgggttcgtcgcgtagtttttcgtatatttttagtcgggaaagtatttttcgtcgtcgttgtttatggtttcgtatataggttagtgttcggtcggggcgggcgcgggacgggagcgttcgagagcggaatagggcgtttattttttcgttttcgggagtagagaagttttggttttatttttcggtttcggtcgcggtggttgtttgggcgttgagcggggtcgcgcgtttcgttagttttttaagttgcgtcgtcgcggtttagagaggtttttttttggttattttttttcgggggtttcggaggggtagtttcggagtcggttgaaattaaagttttttcgcgtttcgttattttttttcgtttttttttgtagatttaaattttacggaaattttttttttgtattttgtatttatttttttaagacgtttcggggttgggataacgaggcgttttttgcggaaataaaacggttgttgtggcggggggaggggattagggtacgtcgcggtttcgcggattagagtggtgtgtgcgtcgggcgagcgttaatagggattgttggtgtaagacgagtaaattttgtttttatataaagttttaaagtgttagggcgagaatgggtttgtagggatgtatttgttttaacgagtgtttttggtatttcgttaaagtcggataaagcgtggttagagtgcggtttagttttttagtttgcggttcggggaggagggtagcgcgggcgcgggttgggggtggcgcggggcggcgtttaggatttcggtgtaggcgagagtgcggcggatttgttttaagaggagagcgaggcggatttgttttaagaggagagcgtggggcgtcgtgttgggtttcgtagggacggattttttcgggcggttttttttgattttttgttcgagaggattagtttttggtagagcgggtttaggtttttagggtagtttttttttcggtggttttgatatgagtgtcgagggaggttagggtaggggtagttattacgtttgaagttttagaggttattaggcggcgcgggtagattcgggggaagcgcgtagggttgcgttagggattcgtcg

SEQ ID NO: 6339 - DNA, 1408 bp, Artificial Sequence
  Description of Artificial Sequence: Synthetic polynucleotide
tcgaggtttttcgacgtggatatttaacgtttttggaaagggagtgaattggtaggatattatcgtttcggttagtttcgcgggagttgttttttagaaaaaaaattttttagagttaaaagttattttttaagcgttttggggtttttcgggcgtttttttcggacggtaattttagaagttaaagcgattgtatcgttaggtttgtggcggttggaagcggggtgatcgcggttagatggtatttcgtatttacgtagggttgtgttattttagtatagaattagtaatttttatacgaagttttgtgtaaatattacgcgggtttatttttgaacgattttttgatgttttcgttgcggttatttattttatatataaattaggatttcgttgataaattttcgtgtttttattaaatagaaggttgttttgtagtttttttcgtgtttttttttaaagtacgataatatttgatatttttataaatcggtttgtagaggatatcgcgtagggggcgattaattagttgaggtgtgttattttaaaatattagtgggtatattttaaggcgggtacgtggaagggacgcggaatcgagggtaattattttttagtcggtgaatttgatggagaaagatgttaaatgtatttttcgagttagttgaatttttcgggtatttaattattgttagatgtggcgagggcgtacggagaatatttttagtttcggagaaaatattcggtcgttagcgcggggatcgttcgggtcgggaaacggttagaggcgggaggagagaggattgggcgagcgtggggagcgttgcggcgtggaaaagcgatcgggagggatggcgatgtttttatttttttcggtaggtttttttaattaaaaagttggaaacgggaattcgtaaataacgatttagggttttaaattatttgtaaagacgcgatggggaggggaatatttgcgcgttttaaaattttaatttcgaggtttttagtcgcgtttgattcgggagtcgggtgcgtttttagtgttcgcgtacgaattcggcgttttggtagtttcgatttttcgggttcgtagtttaagggaaggttcgcgcgggaggtattttcgtggtttttcgcgcgtttcgaagttcgtttttttcgtttagagtttcgcggagttgtcgtcgttttattttttatggtgatcgtggggacgtatcgtcggtcggggagtttcgcgcgagcgtcgcgtagtcgaggaagtcgtttcgagcggttgtttatcgtacgtttatggtagtcgcgtcgcgcgtcggtcgtttgcgttttcgttttttttcgtcgtcgtcggttcgcgtttttcgcgttttcggtttcgcgttttgttgtttcggggttgtcgcgcgcg

SEQ ID NO: 6340 - DNA, 208 bp, Artificial Sequence
  Description of Artificial Sequence: Synthetic polynucleotide
gcgggcgtgggggggaaggggaagaagttcggcgagattagaggggaaattcgaaaaagtaagtttttgcggtagtagttaggaaatattcgttaggaattggttgcgattttaattttagcggttcgaagttttagtttttttatttttatcgcggtagagtcgttttcgtagatatttttcgaggagaatcgcggtttcgagggcg

SEQ ID NO: 6341 - DNA, 805 bp, Artificial Sequence
  Description of Artificial Sequence: Synthetic polynucleotide
tcgttttttgtttttcgtattttttcgggggaggggtcggttcgcgttcgtttttagttcgaggggtaatttaaaatatggcgtttcgggcgggggatttgtgtaaattggcggagaagggacgcggggatcgagtcgttttttcggttagggattttagggaggtttttaggtcggaggtcggggtttaggttttgcgcgtcggtttagttattattgcgtcgtggcgggcggagcgggcggggggcgcggcgcgtaggttcggttcggtgggggtttcggcgagcgggagggcggttggggatttcggtcgcgtcgggcgcggggttcgggattcgggagatcgcgcggcgtcgaagttacgcgttagttttattgtttcgcgcgtttcgttttaggtttcgggtttttttttcgtatttcgtaaagtcgagattttttcgtagttttttatttcgagaggcggaaaagttatttgggattagtagggagttcgggcgcgtcgcggcgtggggattaggttcgggcgcgcgttttcggcggcggtgcgtaggagattcgggcgtggggaggaagtcgtagtttagggttgttcgtcgttgtttttttcgttttttgttgtaggagatatcgaggtttcgcggagttgcggcgggggtttacgtttagagatcgtgcgaggaaagttaatttcgttttgtttgtttttttagtcgcgggggagggggttatcgtagtattttaggatagttatatgggtatagtttttttcgttttggcgtagggttaggtttcgcggacgacg

SEQ ID NO: 6342 - DNA, 2462 bp, Artificial Sequence
  Description of Artificial Sequence: Synthetic polynucleotide
tcgcggtttagttttaatttatcgtattttagagggaattacgagggagttgcggattggcgggggcgggggtttgtaattaatattaggtgtttgtgagagagttttaagggcgggggtagtattttttggttgggttgggttcgtttggtttcgtttcgttttcgggatttttggcgtttagcgtcgttttttcgttattgcgttattcgttagagttcggcgttttttttttttttgttttgtggacgtcgtttttcgttttcgggaggatttcgtttttagtattttaggtttttttggcgtaaaggtcgttagttcgagcgagtttaggcggcggttttatttttgtagagggaaagcgaaagacgcggtcggcgggtcgagggggcggtcgaacgcgtcgcgtggttgttgttttcgaattcgtagcggcggcgttagggcggttatcgagttttgcggatttcggtttaatttttagcgttattcgggtgtttcgagttcgtcgtagttttcggcgcgttttttagtcgcggtacgtagtttttgacgcgttcggggcgttttttcgtagtattagttaggttattttatttttcgcgtcgcgttttttcgttagtcgtcggttaggagtttttcggtttttgagtaggacgcgttaaagggagttgggaggtttagtagtttttagcgtcgttttttcgggtgacgtgacgttttttttggagcgcgggttcgttttcgttaagtttttatcgtaggtttttatagtcgagttacgggaagatgtaacgtcgggcgaggggcgtttttcggattttgaaaaatagttttattcgtttcgggaacgtttcgattttttattcgtattttttggttagatgattttaattttgggatttcgcgttggtcgtgggggtatcgggagttggagttggaggagaggagtcggtagcgcggagttgtcggggtgtagttgcgcgtagttggcggcgaggggaggcggtttttgcggtttcgtcgggttgggggaattggtttttgcgtttttgtttttcggaggatcgtattcgtttatttttatatattatatatatatatatatatatatatatatatatattgtcgttagcgttttttacgttataagtcggaatgcggaggttagagttattgtttatttgaaagtaggaaagtaggggttgaaacgttgagatggaggcggaggttttggttttatttgcgaggttcgtattttttcggaaggtttttttttttttcgcgtttttttagggcgagtaaggtttagtttttgagatttcgttttttgggttagcggttcgagttgtaggggggcggggacggattcggagggagtattagagagagagttcgcgtttatttttgtttttttcgtaaagaattggttagttttattcgcgtttagtttataattaggttgtcgggatcggggagttagattttaggtcgttttaatttcggcgagggcggggaggggagtgatagtagtaattagcgcgcgttggtaaaagtatagagtttcggaataggttaaacggtcggcgcggaggggtggaggtaagagggggcggaggaggagttgttcgagcggagagggatgacgttttttagggttttgggtttcgaggaatcgaagattggtgcgttcgtcgggtttcgcgtattagttttggggttcgtagaggcgtcgcgttcggttttcgcggtagttttaatatagcgcgtaggcggtcgatttcggttagtttaaatcgggcgtaagttttttgttttttttaaagtatttttttgttcgtttttagtttttaggtgttcgtttgagagtttttgtcgttttcgggcggattcggttaggtagttttcggtcgggttagtttcgtttttttttcgtttttttttttatcgatttcgagttaagggtaggcggttcgtattcgcgtttttgtttacggggttaggcggcgttttcggtttacgttcggttgttaagaagagaaaggcgtttatttgagttatcgaagtttttttttggggtttttttcggagtttgttcgtagttcgtaggtataattttttttggagaaaaaaagtagcgtaagggtagagagaggtagggttgtttataggttttttcgtaggggttttttttttcgaatttttcggggtttagtttcgggttcggcggcgggaaagagtttttggaggttggaaggggtcgttagattcgggtttttttcgtagttgcggtggcggtatttttaagttgttatttgtagcgcgtttcgggcgtttgtgatagttcgcgtcgtttagttttcgcgggttcgtttttttcgttcgttcgttggttgcgttcggtgttcgggcggttttcgcgttttgtttcgttttgagttcgttttttagtcgcgcgttcg

SEQ ID NO: 6343 - DNA, 990 bp, Artificial Sequence
  Description of Artificial Sequence: Synthetic polynucleotide
acgtggtgtgtgtgtgcgcgcgcgagtgtgtgagcgttaggggtcgttcgttcgtcgcggtttttcgtgggttggtcgggttaatgagcgcgcggttgtaggggcggcgggcggggagggggcgtcgagttttgcggatggaggcgcgggtagcgcggcgcgtttatttcgcgcgggcgttgttggcggggggcggcgtagttattggattcggatcggggtcgcgattcggggtggcgggtggcgtgggcggcgttcggggttgggatgcgtcgggggtttagtggcggcggcggcgttggcggtggcgtcggcggttgtagggggacgagttagcgtcgcggcgttgggagttagttgagttcggtcggcgagcggaggcggtagcgtaggtagagcggcggcggtagcgggagttcgagcgttgcgcgtttattatggtcgtttagggagagttcggttatttggcggcgtagtcggatttcggttttaatagcgagcgtagtatcgattttttagtgttcggtttcgaggacgatttggtcgtcggggcgattttgtatagttcggagtggagcgaggagcgttttcgcgtggataggaagaaatttgaggttatgttataaggtaggtatttttcgtgttttcggatttttcgattgagtttttaattttttttcggatatttttatcgcgcgtttcggcgttcgttattttagtttacggtcggtcggtttagttttaggttcgttttttcgcggagtcggaggatatttagggattggagatttcgcgggattttttatttttttacgttttttagatttttaggcgttgggggttttgtgcgaatttgattggttttagaaaagtcgaaggtcgagtttgtattggcgcgtttaagttgcgttttggattttggagatgttaattttagttcggatatttgggttgtgttattcggattattcgggtcgtatagagtatgcg

SEQ ID NO: 6344 - DNA, 2274 bp, Artificial Sequence
  Description of Artificial Sequence: Synthetic polynucleotide
tcgtttttcgtgtattgtttgcggttcgtttcgggtttatacgggatatcgaggtatgatgaggacgtagaatagtagaagcgcgttttgtttttcgggcgttagtgttcggggttagcggcgtgtattcggcgggttcggtcgggagcgggttggcgatcgcggggttcggcgttttcggttttcgcgttatttttcggcgttcgttaatttcgtttcgttcgcggcgtagagaagttcgtagtttttcggagttttagcgattttttggttcgtttttttcgtagtcgtcgagtagcgtaggttcggcgatttcgggtgtagttggttttgtgcggtgatatcgtcgttcggcgttaggttcgaagtcgtttggtcgcgttcgcggggtcgtaggtcgttggtttcgttcggtcgcgtttataaattattcgcggttcgtgattcgggataaatttttggcggcggcgtagttttttttatagttattttttttagagttagttattaaaatagaagacgcggtcggggcgaggaggtgggcggggggagttcggtggtcgttttttttcgcgcggttgacgttcgtttcggcggcggtagtggttgtggtcgcggggtcgtttttagtcgagttttcggaggcgttcgggcgcgggtcggcggggtacgggcgtttacgttttttagcgggtcgcggcggcgtcgggcggtcgtgacgtgagcgttttttttagtcggtttgcggggtatcgttagttagtcggggagtaagagtttcgcgcgtagtcggcgcgggttcggttatcggcgcgtcgtcgttcggggttgggtttggggttgtttgtggagaggcggcgggcggaacgcgcgcggttacggttacggttatcgttacggttacggttggtagttcgggtttcgggtttcgggtaggggaaggggagaggcggcgagtttagtaatcggaatcgagggaagattttggtttcgcgggttcgtttttcgttttttttgttagcggcgttagacgtcgagtggggttagggataggggaggaggatttaggattttgtgttcgcgtttttggagtcgttggagttcggatttttgtaattgttggtattttgggggtttggtttagcgttttgttgtttattcgttttttttcgttgtttcggaattaaagttttcggtttttttcgttttcgcgcgtttatttatcgtcgtcggggagcggttcggttcgtatttagtattatgaggggatttgggatttgtttggcgattttggtcggatttttgttaattgcggcgggcgagacgtttttaggtaagcgggatcgtttttgtcgttttcgaggcgcgcgggtcggcgcgggacgttcgggacgtcgatagttttttggtggtagagttttaaggttggcgtcggggtcgggcggggggcgcggcgggtcggatatcgtttttgtttgtgagtcgggcgttgggcgaggggtcgtggggttggtaggtatttagttttcgggcgggcggagcggacggatttcgagggcgagttttttagtcgggattgttagttcggtcgtcgttttttcgcggtttgggttagtgtttaaggttgggcggtttgtatttttgagtttttggtcggttgtaaaaggaatagtagaaaattttgtttgaagtttttagttgtagtcgtcgggtcgtttggcgtaggcgttgcgcggttttcgtcgatttcgagtagcggtcgggtttaggtcgttggtgttcggttgcgttcgtagcgatcgtcgggaattggcggtcgtttcggcggcggcgatttttcggtgttttgttttttttgtcgttttttgttcggcgcggttggcgatttcgggaggttttcgcggtcgtgtagcgtttgcggagaggttggggggagtttttcgtcggttttagcggtagggtttggcggtcgcggagggaagcgggtaggtttttaggttttggttacggttttgcgtttcgttgggttttttttttttattttcgtttttttagcggagcgtcgcggttagttgtaatttgtttatttagttcggttgttcgggggttttaggtgggaaggagaggtattggcggtgtgcgagtaagcgtgtgagtgtgtgcgcgtgtgtgtttgtacgcgcgcgcgggggcgttttaagtttagaggaattttttacggagaggatttgtggatcggagtcgggggttcggcgtgggggcgaattcggtacg

SEQ ID NO: 6345 - DNA, 882 bp, Artificial Sequence
  Description of Artificial Sequence: Synthetic polynucleotide
gcgaagtgattttttacgtttggataaagcgttcgaaagtttaggttcgcgggttagttttagtcgttgggtttgataggggttagggaggcgggtcggttttatagttaagttatagttttagggtttggtcgtatttgagtagcgcggtttcgggttgttgttggcgttgtaggtttcgcgtttgattttttagtttgcgtagcgggtattcggtcgggaagaatttttttagtaggcggtttagtattacgtttacgcgttcgcgttcgcgttcgcgttcgtggtcgcgcgggttttagttttacgtagcgtttatagatcgtgagttcgtagggtagtgttatcggtttgtgtagtagtttcgggtagttaagtaggtcgcggggcgcgtcgggcgttagggtcggttttttttagttttgagttcgtcgttcggttttttcgttaatagtggtcgttcgcgtaggtcgggatatattaggtcgttcgttagtttttttagttttttcggtcgtagcgtttttagtttttcggttatacggaacgcgtttagggttatcgggaggcggtcggcgcgggttagagcgttttttagttttaggtatcggtcgcggtcgggttgcgttagtcgggttagtatggagcggaagagttcgattgttttttggtattcgttcgcgcggaaggtttcgtcgtttttttttaagcgttgggcgattggtttttcgtagtagtagttcgttattggggcggcggcgggatcggtttagtgttgattttcgcggggttgagatcgtgcgggtttggagcgaaggcgcggagtaggggcgatgagttgttgttgggaattggtcggcgggagcgcggttatagttttcg

SEQ ID NO: 6346 - DNA, 4359 bp, Artificial Sequence
  Description of Artificial Sequence: Synthetic polynucleotide
tcgtgttttacggaaattattattatcgtatttataggtttcgaggggcggatataaagttttttgggggaagtggggtcgtagatttttttcgattcgaatatagattcgtatagggcgcgtttgggcgtagtttcggattttacgtcgggttcgatttggttgtttttggggaggatgtaagtgttttttagcgagggcggttgggggcggtggtggtgggagggatgggtgggggggtggtgggagtggtgtcgtgtcgtttcgtttagagtttcggcgtagtagttttgcggggcgggcgagtttagtttggtgttaatgttcgcgatgttgttgagcgtggcgatggagacggcgtcgatgtagtggttggtgtaggttttggagagtttggtcgttttggagagtatttgtattcgagtgtttagtaagtttttgtcgatggttttgttttcgtattaggttatatcgttttcgttgtagtggtttcggggtcgttggaagaacgttttgtagagagggttgcgtttcgataggtatttgacgaagttggcgtaggggtagaattcggtgttcgttttatatatgcggggtaagtttttttcgtcgttgttttcggcgcgttttttgttttacgacgacgagcgcgatttgtggtagggttcgagggatttgaagtagacgaatttgcgatcgttttcgtttatggttagtttaaaagagtttttttttaatttacgttggttttcgcggtcgcgggtatagaagtatatgtacgtttcgaattagattttgttgagtagttcgaagggcgtgttggtgttgaagacgttggaggtgtatagtttgcgtaggtcggcgcgcgtgatggtttgtttttgtattatcggttcggcgttttgtttttcgagtttgcggatgatcgcggttagcgttaggttggcgttgcgtagttcggggtttttggtgaggtcgagcgtgcggtagtacgggggtttattgaggtagcggttgagggagttgcggatgttgatgagcgacgatttgttgtagagttggtcgtttttggagcgggtttcggtatagaaggagcgtagtacgcggtatagcgtttttttgtttatggtttcgaagttcgggttttgcgttttttcgtttaggtattttcggaagatgcgtacggcgtagcgggtggttagtcgggtgttttcgtttagtcgggttcgttcggggcgttgtagtacgtcggggtttagttcggagtcgttttcgggcggtttatcgcgggttcggggcgttagtagtcgcggcggcgtttcgggttttagcgcggcgttttggtttatattgattatatggatcggttcgggttttagttttttttcggtcgagttttcgggttttaggggttcgttttagtttagttttattttttttttttttttttttttttcgtttttttttagttttttattttcgttttttttttttttttcgtttttcgttatttgtattttttggatttcgtttttttttttttttttttttttttttttgttcgcgttgtagtagtgcggacggttgtggcggcggtcgcggtttttcgcgtcgcgttcgttttcgtttcgttttttattgttttcggcggcggcggcggtagcgttggcgttgtcgttcgcgttggtgttatagttttcgttgttaggtattttcgttatattgtcgtttttttgttagttttcgggtagggcgtatgcgttatattggatcgtagcgttgagagtttttgtgtttaatgatttttagttatcgggaggtaaagtcgggtttttaaaggagtcgcgttttaattgttattttcgagcgtagtttcggaggggtagcggcgcgtaggggatggaggggaggggggagggggggataagttagatcggagagatagggtaaaggacggaggttgattagatttttttttttttttattcggtttttatttttaagaaaattttgaaggaaaaaaaaaaggaaagggagggagagttgtcggtgggggcgaaatatttttaatttattttttggcggagaattgcgcgggttcgggcgggagagagggagggtcggcgagagggcgggacggtttcgtttttttaagtaatgttcgaggagtagtgttttttttattgtttttttattgtttttcggagtcggggggtcggggcggcggttgcgtcgggcgggtcgcgggtgttgtcgcgggaaattcgtgtttggggtcgttcggagcggagcggagtaggtaggttaatgagtagggtggaggaggtacggcgaggtttcgtattttttcggcgttcgcggttagggcgtagcgggcgaggtttgggagcgggatggggttggcggcggcggcggtttttttatttatttgttggcggcgaggcgcgggggtttggggttagtcgcgcggtttttaatttttttttcgatttttgtaaaggagcgaaatacgttttacgttagttatatttttttcgatttttttaatagttatatttaagttgttattaaagatttggggcgtttttcgtaggtttggggtaagttcgcgtcggtttagttagtttcgggaaggagcgaggtagagaagattgggaggggtcggtgggaggggagacgagggaagaggcgtttgggattttaggggttatagggatttttttttattcgtttagggcgtcgttttttttgtttttgagtaaagtgatataattttttcgggcgaggcgttttattaagttggagttgaagtttttttaaggtttatcgggtaggcggaaaaagcgaatttgtgtttcggtcgattttgtcgtagttataattcggtaattcggattcggagcgtatttttatttaaagtttgttaatcgttattcgttcgtttttcgggttgcgttgttttaggcgcgcgggggcgggtatttcggaaattggaaaagtagttaaagagttcgtcgggtttcgtttttttataggagatattgttttatttttagttaaacgttcgttttcggcgcgtttaggtttcgggcgcgtttttgcgtcgtcgtttttcgttttttcggtttaggggtagttttttagagtcgtcggggatttcggttgtttttttaggaggtatagtttaggttattttcggagttcgtgttgtattttaatttttattttttttcgtagttcgtgtgtattttggcgcgcgggttagttgcgagtttttggggtgaggggatacgagggagttaggtttttagtagtgcgtttcggtgttaggtcgttttgttgggaggtagtttcgtttgtttttcgggtgcgttttcgaatttatttttaagttcgaattttcggtagttaggttgtgagagttatgttaattgtttgttttttttttttttggtttttttgttttgtttttaagggaagtattttacgtattaattgaaatttatttattaatttgtattttttttttttaagaaagaatgaaagattaggttttagggtagtgtgggtttttgagtgggagttgacgatgtttttttttgtagcgaacgttgttggtttttcgcgtgtttgttcggttttggacgttattcgagtttcggggaaatcgcgttaggtgtgaaataagttagagtaagtttttgtttcgcgggtcgttttcggttttttagggaaatataagatatatagatatatatatatatatatatatatatatatatatatatattacgtttttattcgttcggtttttcgcggagaatcgttcgggaatcgttttcgaggtgcggcgcgggaggtggtcggttttgtttataatgtattgttcgtcgtattcgttttggatacgtgtagaaaggcgtgttcgttttttcgaggttgcggtgagtagttaagttagttgtatattgggatttttatatacgagttggtatatattagttatatacggttaattttagagggttggttttttgttttgggacgtttttaggttttcgggtcgcggtgcggagaatttaggtgggtgttcggtaagttatttattaggggttgttttttcgcgattttcgttataagcgtagggattcgggggtcgcgttggtttcgggttgcgtttttggtttggtaggggattaggtttacgttgtagtttgggagcggagtcgttttttaggtttttttatttttgcgggcggcggggtttattttttttttattagtttttttttttattgggcgagttgttttgaattgttcgtagtttgtcggaggcggtgtgttgggttggacgtttcg

SEQ ID NO: 6347 - DNA, 2762 bp, Artificial Sequence
  Description of Artificial Sequence: Synthetic polynucleotide
acgattcgggaggagagcgtggagtcgggtagggataggcgtgtcgtattatggcgtattatggatagggtttcgcgcggcggcggtttacgatcgtttaggggttgcgggagaaagcgcgagagattgcggaggttagtttcgtttagtttttgttttcgttttagtagtatttatttttcggcgggtcggagcgcgttaggttttgattcgtgaagattacggagcggggtaatttatattatttgtttttattttcggagtaggtattttcgagttgcgttcgtatttttcggggttgttagttggtagtagagtatttttttttttgtttcgagggcgataggtagggggatttttcgtggatttttttgtttcgcggcgagggtgggtacgtttttttttcgtaattttcgagggattttacggtaggcggagatcgatttgggattagggtattgtattcgtttagttagagggtttcggtcgaggttgtgtgaagtggtttttaggtttgggttggttggtcgggaggagtttgggggtattttcgggttggaggcggcggaaagttgggttgttttcgggttgggaattcgtagcgtgtagtggcgagggaatttgcgttcggattggagtaggtgttttttgtcgcggaggagttttttagtagagattaaatgaaaaggttcgttggttttttttcgagggtatgaaaagtacggaaggttttaggtaaaggcgttttcggggcgtatatagggtataggtagtcggatagagaaaggagtagtcgcgtaacggaatttttcgttcgggggagatattaggcgtgagaggttagattcgttttataggtaggcgttgatcggtagagattttttcgggtaagagggttagattttttttttaggtgggacgaatatagaatattgtgagggtaagagaagaagaaaaggaggtaattttagattgggataaagataataggatagtagagtttttgagtatcgggaggcgtacgggtgtagggtggggtaaggtggaggtaagtttcgtaattaagatattagagtgagaatttttattgtaaattcgcgatttatttttgtagaaataaataaaaaaattggagtaaagtattatgcgaggggcgaaaggtatagaaaattgtaaaatttgggagttattttgttttatttttttgttgtttggggatatttttcgcgagtttgttcggtttcgaagaaggagtagaggggattcgtaatttagtttttagagtttcgttaggaaaggcgcgagagatttattggtttcggtaattttgtttcggcgttcggacggagttcgatgtttgcgtagttatcggttgcgcggcgcggcgcggcgcggcgtggtattttttttttcgggtgcgtagttcggtttcgtagcggcgcggggaataaagggattcggcgtcgttcgttttatttcgttcgtggttcggttcgcggggatcgtcgcgtatttgaagtagggtcgttagtagcggtagtagggttcgtagcgttttcgttattcggtatatggaggcggagaggggtcgagcgaagagtcggaggaggcggcggcggcggcggcggcggcggaggaggaggaggtagcggtagtattaatagcggcgcggagaaacggttttaggtagtttttattttttttttttttttttttttttttattttttttttcgttgtttttcgtttttcgttaatggagagcgagttgatgataaatagcgggtcgcggagttcgcgggattcgtattaggagtaataaaatagatttagagattaaggagttggggagggggcgggggaatagggagggagagcgtgtgagcgtttgcgagtgtgtggaggcggttgttgtggtagcgtaggcggttcggtttcggttcggagcgtagcggaagtcgcgagggatgtagcggcggggattttggtcggtggaggatgtggaggtggaagtggagcggatggcgttttttaagagtttcgttacgcgaggtttcgggttcgtggttttgtttttttcgggttttcgttttagggtcgttcggcgcgacgaagacgtcggggatagcgtcgcggggagggcgtttcgggtcgtgcgtgttgtatttataaagagtagtagtttcgttatttcgcgttttcgttgcgtgggggtcgaggggcgtttttcggttttttttttcggtttttcggcgagttggagattgtttttcggtttcggtcgtaagggggtgaggcgaggggtcggcgcggtttttttcgtcgcggtttcgtttcgcgtagttgttgtcgtagtcgtttttgttgttcgcgtatcggtattcgttcgtcggttttcgttttgcgtcgtttattcgcgcgcgtcgtttttcgtcgtcgatcgcgtatttcgttcggttttcgttgcgcgatttgggcgagtcgtcgtcgtttttttcgcgttcgttttacgcgttgtttggttgcgcggttcgttttttttttttatttttttcgtcgtcgtcgtcgttttcgttttcgtttttttttttcgttgagttttttcgttcgcgtcgtggttaatcggaggttattaagttgcggttgtagtcggtcggattcgcggtagtcgttcgttttcgtttcgtcgaagcgtttcgtattttgttgtagttcgcggggggtcgtcggagggaagtttagagtgcgtcgagtatcgtttcg

SEQ ID NO: 6348 - DNA, 338 bp, Artificial Sequence
  Description of Artificial Sequence: Synthetic polynucleotide
tcgcgggagtcgcgtaggcgggcggttagggggagtgggcgtcgttcggtagcgtttcgcgtcgaggtataagcgttcgcgtcgaggtataagcgttttcgatttatcggtttcgcgcgttttttcgcgcgtttttcggattcgcgtttgtttattttttcggttttgttgcggtcgaggttttaagtcggttatttcgtgtttaggtaatcgcgggggcggcggcggcggcgtgaggagcgggcggttgttgtttcggggttttttggttcgagtttttagttttcgattttcggcgtttcggcgttcgattagcgttttaggtcgttttcgtttcg

SEQ ID NO: 6349 - DNA, 1435 bp, Artificial Sequence
  Description of Artificial Sequence: Synthetic polynucleotide
tcgcggtaacgatttttgggagtgatcgaggtattcgggttgtttcgtgtttttcgggtagcgatttaacgataaaatttgatagtgttttggggaaaattttatatttatcgttagcgttatattcgggttttatgttaataaggagatattgtagattatcgattagattcgtttgtttttagagcgtgcggtcgggtttttagtttggtttttaggcgcggtggcggcggtgggatacgcgttaggcgtttagagaaggatatgggataatggtttagttcgaggacgttagacgtcgtcgttcgattcggggaaggaagtttttgtagtcggttcgggaattcgaggcggggagggaggttagttttggaggtgcgttgtcgttttaaaataaaggattataaagattgtatagtggggaaaacgcgtttggttaatgcgagtggggacgatttggggagggggttgaggaaggtagggggtatacgagttaacggcggtttacggttttttttttttttcgtttttttttttttttttttttcgtcgggttgtttcggtagataaataatagaggaaggcgagttatttatcgtggttttgataggtacgtagagtatttgtttggcgtcgtcgtttttttcgcggatttcgttcggttggtttagttggaagtttttcgatttgatttagaatttaaatttggcgttgttcgtggagttcgattcggagttattgaggagttggacgattcgttcgtattttttacgggttatcgttttggttttgtttgagttttcgtaagttttgaggtattagttttggaattggcggtatatgtcgcgttcgttttttatgtttttcgcgttcggtcgttggtcggatgtttttagcgtatttcgtatttgtttattttaggtttatgaaaaatgtagtttcggttacgttgtagggatgcgaggtttcggtcgtagcgggagtttgttttgggtgggggaagggatgggaagaggggaggagggttcggttgggtattagtaattaatgtttcgtgttattaagtttggtttattcgtaattgtaacggttgtttcggacgttttttttgtttttttagcggtcggtttttttaatattttgtgattaggattattttaatattattttggtttagaggagttgggtttttaataattaaaattttattttttggtttattaaaaattttaatattgaattggggtggtttttagacgtttcgttttcgggttgcgttcggggttgggtaggtggagcgtagcgtcgttttttcgcgcgcgttttagaagtttttttagttattggtttcgtggtttaggagtgagggttgcgtttttttcgaaagtagtcgttcgtttagcgtttttgagtttcgaagggtatacgggtttcg

SEQ ID NO: 6350 - DNA, 510 bp, Artificial Sequence
  Description of Artificial Sequence: Synthetic polynucleotide
tcgaggcgcgatagtttattaaagacgagggttggttttttaaataaatcgcggtgattttatttgcggcgtttttttttacgtcggttttttttttttttattagagcggttcgcgtcgattcgatgggcggattcgatcgcgtacgcggttcgcgggttcggcggaggtagttttcgtttcggggattcgggacgcgtcgttttttcgttttaggttgttcgcgtaggaattttacggttacggttaagtggggtttttgtttcggatttcgttgggttcggacggtcgagagtttagggatttgggggggcgcgcgggttttcgagtttaggcggggcggcgggcgttttgtcgtttttttttcgcgcgtcgcgtcgtcgttcggtttttcgaagtcgttttttgtcggcgcgtcggtcgtttgcgttacggcgggcgttatttatttcgggtagagttttttgttcgtgtagcgcgttttgggtttttagcgttgatttacgttcg

SEQ ID NO: 6351 - DNA, 2722 bp, Artificial Sequence
  Description of Artificial Sequence: Synthetic polynucleotide
acggcgatggatagtattttcggttttcggtcggttaggagttcgcgagttcgttcgtttagcgttttgggttcgatcggtgtagttttttttatttttattttttaggtcgttgtatttaaaaatttaagtttcgttttttcgattttttttttttttttttttatcggcgttcgttgttttttttatggtatcgtttttattagtatttcgtttaaaatttagttttgttttagcgaatagttttttacgtattttagttttggttttcgttgttcgagcgtttttttttatcgcgttcgttcgaggttttttttcgtttagttcgtcgttcgttagtcgtcggtcggtcggtcggttcgttagttcgtttttgtttttcggtaaagttgggagggaaaggtgtatttatttttgtgtatgtttgtgaatttgttttttagaatcgtaagttcgtagattttgttaaatttttcgaagaggggtttgaggttttttttatttaggttgcgggggatttgtttaatgaatagtttgatggtatcgtggttttttatgggaatggtcgacgggtttttcgggttgtggtttaattcgtttatgtgttcggtattgttcgggttgttgtcgagttcgttggtattgaggtttgcgttgttagtttgttcgtttgttaacgtggttatttttatatatatagagaaaattttttttttttttattttttttcgtttatattttttcgtttttttttttcgttcgttcgcgtttatatacgtatacgtatatatatattcgggttttttttttttcggtttttttatatttcgtttttcgttcgttttttgttttttttttttttttttttttttcgttcgttcgcgttcgcgttttttttttgttttttttttttttttttttttttttttttttttttttttttttttttttttttttttttttttttttttttttttttttttttttttggtttgatttgatttttttttttttttttttttttttttttttttttttttttttttatattgaatagataggatttttgtttttttcgtttaaataggttggatcggtttaagtttttagttagattaggggtgggggtggcgagtgtgcgcgcgcggaggagggcgcggggggtcgggaatgggcgcgttgtgggggttcgcgttacggcgggcggcggtcgggggtagggcggcgtggggcggcggttatcgcgtttttttcgtcggcggtttcgcgtcgtggcgatggtatagttcgagacggttttcggttataaatagcgttaggcgtatggtttttcgggaggcgttgagatttcgggttcggcggtcgcggggagcgggtgttcgtgaggagtcgggtagtcggttttttttttttgttttttgggggttttttttgtaatagtagtaggtgtaattttttgtattttaaaaatagtgatttttattttcgtgtgggtatgtaggggggttttatttattaagttatgttttattagggcgttaggcgggcgaagtaaaggtagggatggcgggcggggcggcggcggaggtggaatgggcgttttttttttttatttggttttatttatttatttagattagaaaagcgagtcggtttggagggagttcgttcggggattcgagcgcgtatttattagtgtcgagagaaaaaaagttatataaatatatattatgtggataaatttatagataagagttttttcgcgcgcgttttttttttgtttttttgtgtgtgtttttttttgttttttttttttttttgtatttttaatttgttagagtagttttatatttttttttcgttcggtatttatcgttatttaagttatttgttaggatggggttgggagttgtcgggtcgcgtcggggggtagagggacggggagtagagattcggggttcgattttcgttttaattcgttttcgaaggcggaaggtgggggttttcgtttcgggcggtttttttcgtttcggagagcgcggttggtttttcggtggttggcgggaggaaggtaggagtcgggcgtttttgttcgttcgttcgtcggagggggaggaaggcgttgggcgcggtggtcggtgagttagcgcgggggatggtttgatttgttttcgtttgttttacgggtttaaatagaatatatttttttaattattattaaaagaataaagtttttgaatcgttatttgggttgtcgtcggatcgagattcgcgcggcgtgcgttgttttcgcgggtttcgttttcggtatttatagttttcgaggtgcgaggttgagtcgtttttgtcgtggggatcgggggtcgagtcgttcggttcggatttcgtcggatttttcgttaggtttattggggttggtatttcggttgcgcgggaaagggagtggtaggcgcggagtcgggagtagggttcgagcggtttcgtttgtaggggtgaatattggtggtgaatttggttggggtagtagatttttacgttaatgatatttatttgtatttcgtttttttttatgtttgtttttttagggtagttttttcgttttagaagtttggtaaattgaaataacgcgttcgttttttcgcgggttgcggggttggggagttggggcggcggggttgagcggttggtttaattttcgtcggttttcggttagttattttcg

SEQ ID NO: 6352 - DNA, 1133 bp, Artificial Sequence
  Description of Artificial Sequence: Synthetic polynucleotide
acgacgcggtgcgttaggtagagagtttggggagtgtgcgtgttttatttgtgtttgtatcgtgtgttttttttgtgtgtttttgagaatgcgtttttggtacgcgttttgcgttaataaggcgtttggtgtgtgtatgtttgtgtgatagtgtttgggttttgtttgcggttgtttgttcgtattttagttttttttgtgttcgtagttaggttttatacgtgcgttagttttcgagcgtacgttttcgagtgattcgtgcgcggtgtgtagggattttagggtcgtgtgtattaagggcgttcgtgttcgtttttttgtattaaggaacgtatttttatatgtttgagtgtacgtttttttttatgtgtgtacgtttcgtgtttacgtcgtttatgtttgtgtaggggcgttttacgcgcgtttttttcggttcgcgggcggttagggattcgcgttgggttttacgtttttcgtggggttgatttttttttcgcgtttcgtagcgggtcgtagcgattggtcgtcggtttttttttagtcgttattttttttttttttcgttattcgcgcgttcgcggttttcgttgtttttcgcggtttcggcgaggtcgcgtcgcgttgcgtttcgtttttattggttgcgcgcgtttttgtgtggcggtagttgcggttttagcgtttttgaatgtcgagaggggtcgggaagggagtttttttatgggttatttgttttttcgttagtcgtcgttttatcgtcgttcgcgtttcgcgtttcgtttttcgtttcggcggttttcgtagtttcgtcgtcgttcgcgttcgcgttttggagtcgcgttataaagggttcgcgcgtagtcgtcgtcgtcgtcgtcgtgcgaggagttaggatggttttggtttacgtcggttatttcgtgtttttagtgtttggttttgtgcgaaatagaggtatcgtttttttttttcggggtttgtttcggagcgtggatcgtcgtaggtatcggggcgggggcgggcgtcgcgggcggtcgggggtttagggtatattcgcgaggacgtagggcgagcggtggtttttttttattttattttagggggattttcgagggtgggggcggtcgttttcg

SEQ ID NO: 6353 - DNA, 2401 bp, Artificial Sequence
  Description of Artificial Sequence: Synthetic polynucleotide
tcgaaggtgtcgttagttttagtgtcggtgggcgtttgtattaggaatagttaaagtcgacgatatttagttatttcgagcgttagggaagacgtttcgcgtaaaatcgcggttttaggcggattttcgttttagtttcgcgttgttggtggtattttcggggatttaaagtgggtggtttgggggtaaaggaatagaggtcgaagaatttggggtatgttttattagagtatttaagggacggagtgggaggttatattagatatgcgatttcgatatattttaaaagtggtagtttcgtgggttatttttaatagtgggatggatttttttaatttttttcgtttttcgaagtttttttgttatttcgggttatgtttttttttcgggatttttttgtgtaaaattatttttttttttgtttaaaggattttttttttttttttgattttacgaatttatttttttaataggtttttaaagtatgggcggatgtgttttttttcgtttatcgttaggagtcgagtttcggtaggtgagcggtgtaaaatacgtatttagttgtttttagtttttttcgttttcgttgagttggttgtttttatttcgtattacggtattcgagtttgtgagttttcgatttcggttttagtcgtagtcgttaataattttataataaataagaggataggattgagcgttcgcgtttcggagcgtattggttgggggtaattttttattttcggcgcgtcgttcgttgtttcgattcgagagtatcgggagagtcgagggaagggaaggcggcgaggggaaggtaggcggggatggagggaggtacggcgcggcgcggagcgaggaggtgggttgtaggggacgtcgagaagcggtggggttggcgtagagggcgggcgttcggggcgcgcgttattttcgttttgttttcgtagtggtagtatacggtttataggtatttgagcgttcgttagagtaagatgatgaagaggttttcgaagaaagttattatggaggaggttaggaaagtttattatatgcgttggtttcggttgtcgtacggtatttttatggttatcgggatgatgagcgtatttattttgggttcgtggattgaggacgaggaggaagaggaggaggaagaagaagaagaggaagaggaggaggaggaggaggaggacgcgtttaggttgagatggttcgcgtggatattgttatttattttaagattgttgttttcgtcgtcgtcgtcgtcgtcgttgttgtcgtcgtcgtcgtcgttattatttgttatagttagtaacgggtagtcggcgtaggggttcgggggagtttttttcgtcgttagcgttattttaaatatttattaatagttatattgttgttattgttgtcgtcgtcgtcgtcgtcgtggagcgcgggaggggggcggggaggcgtttgggttcggggcgttgtgcgcgatttggcggggtgcgtcgagatatatatagcgagtcgtcgtcgttcgttcgggggggagggggatggagtgcgcgggtagtttttttttttcggttcgcgtttcgttcgtttcgggttgcgttggtttcgagcgtcgagagttagggggcgtcgcgggtcgttcgcgttcggggtttgcgtcgttttcgggttcgtttcggtttcgcgcgcggtttcgggtgttttcggcgtcgcgtcgttcgtcgtgcgttacgggtgtgcgttgcgttcggtcggtgattttttttttcgagcgtttttcgcgcggttaacgagtcgtttttcgtttattaggtggtaattcgttaataatggataatcggtttttttcgttcgggcgtttttgcgttagtttttttttttcggttgcgttcggtttcggttcgtcgcgttagtgcgcgttcggtcgcggtaggtttatcgcgttcggtcgtcggttcgtggtcgtttgttagtttatgttttcgggattttttagttttgtcgttacgtcgttgagtttttcggttttcgttcgttttttttttttgtcgttttcgattttttttcgttttcgttttcgtcgtttaagttttttcggcgcgcgtttcgcgtttttcgtagtcgttagtagtagtagttgtagtaattggagcgggcgcggatttaggacgatttaggcgggaggggaggaggttcgtcgcgttggttcgtttgggtttcgggttgggtaggggtgggtagggtttttcggtagcggttcggtaagcgtttttgatttttagggcgtaaggtagagcgtttttagtttaggcgcggggttaggcgtttttttttaaggtgttgcgtttttagtcgagagcggtggggtatattgggaggacggcggggcgtttcggttaggtcg

SEQ ID NO: 6354 - DNA, 769 bp, Artificial Sequence
  Description of Artificial Sequence: Synthetic polynucleotide
tcgggaacgaacgtgcgtggggtagtttaaatttttgagtttagatttcgtttttcgcggttagatggtgcggtcggtggggttcgagggatgcgtatagttgtgtttgagaggtgttgttttttcgttatcgaagtcgttgggaaattttgttgtattgagatattttaatgtcggatgttttaattttgcgggtaaaaaaaaaaaaaaagtttgaattaggtattgggtttttgttacggtgaattttattcgcgtttcgcgtcgtttttttatttatttaggcgaggtggtttggatttgtatttcgttgaagaagttttttatgcgatattttcgttagtatttcgcgcggatttggttgggcggcggcggggagttagtttgttatcgtacggcggtcgggatcgtagtttttgggtgcgtagtgcgtttttcgttgcgtttttttagagcgcgggtttcgtgtttgtgttcggcgcgacgcgatttttttgttagtcgggtttcgcgtgtttttcgcgtttttcgtagttttcgcgtagttcgtagcgttttttagtttcgtttcgcggtcgcgggaattcggcgtttgtagtttcgttcggaatcgatcgttaggcgttgttgtcgtcggttacgtaacgcggggtttttgtttggtattagttttaggtgttttgtttcgggtcgtgttgtcgcgcgatattggggatttaataggtcgtcggttatttagttggtttcgtagtttttttgcggtttagcg

SEQ ID NO: 6355 - DNA, 1169 bp, Artificial Sequence
  Description of Artificial Sequence: Synthetic polynucleotide
tcgtgtttttttcgagtggatttggtttcggttttaaatttagtcgagggtcggttcgtttttggggattcgcggatgtcgcgagggggcgtcgcgttattgaaggttgggacgggggcggtgcgcggggcggcgtcggagttcgggatgtcggttttagagacgtcgcgtttcgtttcgaggaggtcgtcggtcgggtaagcggagttcggagttcgcggagtttggatcgtaggtaaagttgagcgcgtcgtggggtcgggggtggggggttcgcggcgaaggagtcggggtcgtagtgggcggtggggcggggggcgcgggtttttgtttgatggtttcgcgcgtagtttttttttcgggtgcgcggtgcgcgcgggcgcgggagggtcgaaggggattttggaatttttttgttcgggttaagggggcgggggcggttcggggtcgggcggggttggtgtttttttttttcgtttagcgtttagagttcgggagtcgaggggggcgtcgggtcggaggcgttcgtcggtttggtcgcgtcgcgcgcgtggatggaggtttcggtcgcggatcgtttcgtttattcgcgttggttttgcgggagttcgggtgagtcgaaggcgaggaaggggcgcgggtttcgggaaaattcgattttttcggcgttcgtttcggttcggttgggggcgtattcggttcgcgcggagagcgggcggggtgtgggcgaatgttcggcgcgttgcgtttttttcggtttttttttttttcggagatgaacgttttattttcgttcggatatacggtcgtatttttattttgtttttttcgattagtcggggcgcggttcgaattgggggagagaagatttagttttcgtagtcgcgaattttgtaaattcggagtttatgcgtttcgtttttcggttcggggagtttttagttttgttcgtcgagcgtagttcgggttcggattgtggttattggggacgagaagggttttttttgcggggttttcgggttcggatggacggagggggcgttcggtaggtgaattgggttcgtttcgcgtttcgaacgtttttttaaatttataagtttcggagattttggggtattttgcgatttcggagtgatcggtggagttttcgttcgcgcgtttggttttcg

SEQ ID NO: 6356 - DNA, 6036 bp, Artificial Sequence
  Description of Artificial Sequence: Synthetic polynucleotide
tcgtatagtttgattatcgtgagtaacgcgtgcggtacgttttggaatttgtcggttcgtagcgttcgtgattaggagttgttgtgggatttgggcgtcgtgggtatgttgcgtaatttggtgtattttaagtataagatgatcgttatgggtagcgtcgtcgttttgcgtaatttgttggtttatcggttcgttaagtattaggcggtcgttatcgtcgtgtttttaggtagttgcgtgtttagtttgtacgtgcgtaagtagcgggcgttggaggtcgagttggacgtacggtatttcgcgtaggcgttggagtatttggagaagtagggttcgtcggtagtcgaggtcgttattaagaagtcgttgtcgtttttgcgatatttggacggtttggtttaagattatgttttcgattcgggttgttttgacgacgacgatgtatcgttatttttggttgcggtcgcggttatcggggagttagttagttttgtcgcgttgtttttttttttgggtagtttttttttgtaggggtaggcgttggttcgtatttcgtttattcgtcgaggcggtaaggaggtagagaaggatattagtggggaggtagtcgtggcggttaaggttaaggttaagttggcgtttgtagtggcgcgtatcgattagttggtggaggatattttcgttttgtatatttcgttcgacgatagttttagttttagttttggagattcgggataggaggcgttacgggagggtcgcgtttagttttgttcgttatgtcgcggttcggagggcgggcggcgagaggtaggaagtcgggcgtattcgttgttgcggtttaaggcggtttacgttagtttttttaacgatagttttaatagcggtagtgttagcgacgggtattgtttacgcgaatatatgttgttttgttcgttggtcgtattggtttcgcgtcgcgaggattttaggtgtgggtagtttcggtttagtcggtttgattttgatttgttcggttgttaggtcgagttttcggttcgcgaggttattttcgtcgacgttcgcgtgcgtattattaagttgtcgtttatttattagtacgtgttattgtttgagggtgttttaagggcgggtgtagagtttttcgcggggtttggaatttttttaggggttcggaagtaggtttggttgtcggtagattatttgagtaaggttttcgagaagttggcggttgtttcgttgtttgtggttagtaaggtattgtagaaattggcggcgtaagaggggttattttcgttgtttcgatgtagtttttttttttcgttgttttcggtcggtcgtttaggttttagcgagggtggtgatttggatgatagtgatttttttttggaggggttggaggaggtcggttttagcgaggttgagttggatagtacgtggcgggcgttcggggttatttcgttgttcgtagttatttcggtttttcggcgtaatcgaggtcggggtttgggggtggaagacgttacgtcgtttagttcgtcggagaattacgtgtaggagatatcgtttgtgttgagtcgttgtagttttgtgagttcgttgggtagtttcgagagttcgtttatcgttagttttatttttagtgaattttgtagcgggtagggtagcggtattattagttttagcgagttgttcgatagtttcggatagattatgttttttagtcggagtaagacgttatcgttggcgttcgcgttatagggttttttcgaggttatttagtttagtttgtagtgggagagttacgtgaagcgttttttggatatcgtcgattgtcgggagcgttgtcggttgttatttgagttggacgtaggtagcgtgcgttttatcgtggagaagttagacgagaatttttcgtgcgtttttagttttagcgcgttggttttgtacgagtattacgtgtagtaggacgtggagttgcggttgttgttttcggtttgtttcgagcgcggcgggggcgtcgggggcgtcggtttttattttgtagggtatcggcggcgggaggaggggtcggcgtttacgggttttcgttttcgcggcgtcgcggattaggagttggaattgttgcgggagtgtttgggagtcgtcgtgtttgttcggttgcgtaaggtggttttcgcgttggtgttaggtcgtcgcgtatttttcgtgttcgtttatatgttggtgttcgtttcggtttcggtttaggaggacgatttttgtattgatttcgcggagggtacgtcggttaatttttttagcgtcgtttcgtttagcgacgagacgttgtagggattttttagggattagttcgggggattagcgggtaggtaaagatttatcggtcgttttatttttgttagataggttatggggtatcggtataaggcgggaggcgtcggtcgtagcgcggagtagtttcggggcgcgggtaagaatagagtagggttggagttgtttttgggtcggttttcgagcgttttcgtagataaggacggtttaaagttcggtcggattcgcggggacggggcgttttagtcgttgtgttttacgacgtttattgaggaggtcgtgtattgtttttacggtaacgattcggacgaggagttttcggcggtcgcgtttacgttaatttatcggcgtatatcggttatttttcgcgtttttacgcgggagcgttcgtagggtcggaaggaggtttttgtttcgtttaaggttgtattagttgtttcgtcgttcgttcggatttagtttagttttattgttgacgagatttcgttttgttattttttgagttttttcgttagtttttttagcgagttcgagttttcggagtcgtcggtcgtttatttacgaggtcgggagttcgcggttattaaggattcgggtttaggaggcggacgcgatagttcgtttagttcgcgggtcgcggaggagtttttgtagcggtgtattagttcggttttgtttaggcgtcggtttttcgtgtttggtttgcggcgtcgtaagtttcgagttattcggttggatgagcggttcgtagaggggtttcgggaacgcggcgaggaggtagcgggttcggatcgggttttcgatttggatagcgtggagtggcgcgttatttaggagggcgttaatttaattgttacgtggttgtattaggtagtagttgttacgcgggaggtttcgttcgagttcgattttattttgtttttcgtattcgggttgttagtgggatttattttatagttttttaagtataggaagggacgataggcggagggagaaatgggtagtgttcggcggttagagaaaaggggcgtagttttagttaagattagcgggagttttcgtttttttgtaggtttcgagaagttacgtggtatatagaagattacgttcggggtgttagttgtgtttcggggacgaatagtgatttacgtttttagttcggtatttcgtgtttagtttaaagggattttcggttttcgcgttatatcgcggaaggtggcgtttttttgtttggtatagttcgcggttttagttaaagtttcgagtttcgggtagtagcggtcgcggagtttatatcggtttgttaagatttcggagttggcgacgttgagttagttttttagaagcgttatatcgttcgttcgtttcgttaagatttttttttttagttttttttagatttcgttcgttttttagtttttgtttagaaagcgtttttcggttatttaggttgttggggttttgttcggtttcggagttttttcggtgtttaaaacgtcggcgcgtatttttttggcgaagtagtataagacgtagagatcgttcgtgcggatttcgtttatgtagaggtcggttcggcgtgggtcgttatcgttggttcgggtagtttcggagtcgggttttaggggtcgggcggggatcgaggcgggttcgggggcgcgcgggggtcgtttgggtttggtgcgtgtggttttagttttttttagcggtagcgagtttttcgatcgttcgggttttcggcgatagttaatttttattaaggagtcgtcgggtttgcggcgtcgtcgtttcgagttgttttcggtcgagttcgcggtttttgttttttagggcgtttcgtttcgtcgcggtcggttcgcgttgttcgtcgtttttttttgtttttcgcgttgcgaagagtttcgagcggtatttcggtagggttcggtttcggttcggtagcggtttttcgcggttcgatttagttttggcgagcgttttgttcggtgtattattttcgagagttcgtttcgtttgtttgtgcgcgcgttcgtcgttcggtcggagattgttaagcgttacgcgtcgttgtcgtatattagcgtggttcgtaggttcgacggcgtcgttttcgcggtttttgttttagtcgacgtcgcgcgtcgtagtagcgacggggagtttcggtcgttttttagggtggtcgcgtcgggtacgatttggcggcgtattcgagatgaggacgtgttttatattttgcgtagtacgtttttcgttacggttttgttattgcggggttttacgttcgaggacgtttcggtcgggttttcgtcgcgtaagattagcgacgtcgtggtttagatcgaggaggtcgtcgtttttaagattaattttagtacgttttcgagtttggagattagggagtttttcggggttttcgtcggcggttagtttttttttttcggtagcgacgtggacggttttagtttcgttaaggtttttattttcgtatttttcgtgtacgagggtttgggggtcgtcgtggggggttttttcgttagtcggtacggtttttttagtcgttcggttcgagtatttttttttaattatgtgtttagttttatggtggtcgtagttattatcgattcggtcgcggagaaagtttcggttattgttttcgttatttttttggaatagtggtttaggtcggttttttggaacgttttttttcggttttgcggcgcggtttggttgttttatgggtttgcgttgtagacgttttttataggtcgttttagggtttttgtttattcgagttttattatttttagaattttcgtttagcgtacggcgatttcgcgttttatcggaagattttgtttttgtgtcgcggaggtttaggaggaaacggggcggtcgttaggttttaagtttcgatcgtggagcgttggtaagggcgttttggtttagttttgagcgcgcggttttttttttgtcggaagtcgttgtttgatttcgggcgagggaggcggtagttttcgggttcgggtttgggtttgggttcgttgtttcgtagggatagcgttggggaggtgacggcgttcgtcgtaggtggggcgaggttgggggagggcggcgtcgcggcgggtttgttagttgggggtttttgcggcgcgtaggggcgaagtttgtaattattgtagtcgtcggtaattcgttaatgagggttttgtagggattgtttttatttttagttttagttgtgggagtgcgggtgggggtgtggtcgagtttcggtaggaagtttcgtttagacggtgtttagggaattcggagtttaagcgtttcggcggagtttaaaagggtgggggtgggaggggtagaggttaacggatttttttgtttgtcgtattttttggcgggagacgggaaggtagcgggttgcgtacgatgggattttggtgtagacgtcgggtcggttgatatttggattttattttagaggagatgttggttattagttggggcgattttaagggtcgttggagttagtatcggttcggcgtagtcgcggcgggcgaggttaatggaaaggagattgaggggagtttcggtagtgagttcgaggttttgggatttggagttcgcgttggtttttttttagcggagtttgtacgttacggagattattatatgtgggcgtggttagtgtttaggatcgtatcg

SEQ ID NO: 6357 - DNA, 3400 bp, Artificial Sequence
  Description of Artificial Sequence: Synthetic polynucleotide
gcgtagaattagtggcgatgggaggaaggggatcggtagagcggggttgggtaagtttttatttagtcgggttgagttttggttttcgtagagtttttgtttttttcgagatattcgttatttggtgttagcggtggatcgttttgcgggggtttggcgcggtttcgggttggttttgattttgtagtttcgcggagagggtaggttcgcgtggagagggacggggagtcgggtcgattgttttcgggtttttagtttttgagttagtcgcgtgtttatttatcgtagattttcggttgagtatcgttcggttgtaggtattgttgttcggcgacgattatcgttgttttatacggatgatttcggttttgtttttgttgtcgcggttcgagttcgcgtcgttgtttgcgtacggttagttggatatcgtgtttttttcgtcgtttaggtgcgcgtaggtatcgggatacggggtaggagcgggcgggggcggcgtggtttcgtggtcgtttttaatttttttaattgcgggttttaggttattcgcggaattcgaggagtcgttatttagcgtagatttttttttggagacgtttacgcgtttggtgcgggcgttgcgggttttttcggttcgggttttcgcgtcgcgtttggttttggattcggacgcgttggtcggtttttcgtagggtttagttaatttgtcggatttcgcggcgttggagcgtttattcgacggcgaggagtcgttgttgttgttgttgaggtttattgcggttattatcggggattttgcgtttttgtacgattttacgtcggcgtcgtgggttacggttttggcgcgtcgcgtggttgttgaattgtaagcggcggttgtcgagttgcgaagtttttcgggtttgttttcggttatagtttcgttgttggcgcgtttgttcgcgttttgtttaggtggtttcggcggtttcggcgattttttgcgagcgttgttgtttttgaaggcgttgtagggtttgcgcgtggagtggcgcgggcgggattcgcgcgggtcgggtcgggtatagcgtagcgcgggggttatcgtcgtcgacgggtcgtgcgcgttgcgcgagtttagcgtagattttcgcgtcgagcgtttcgtatttattttcgagatttattaggttaataattgttagggcgtgtgcggttggttttagttcgatcgtaattcgcgttacggtaattacgtggtgttgttgttgaagatgtaggttcgtggggtcgttttggcgcgtttattttgttgcgtgtttatcgtttacgcgggtaagttgtttattagtttgtcggaggagcgtattagcgcgtattacgtgtttaatatggtggttatcgagtgtggttgtcggtgatttttgcgtcgcgcggatttttgtttcgagggttcggacgcgttttagttcgcgtttttttttatatttattcggattttaagtatcgttttaataaagattagtaagtaatcggttggggtgttcgtgcgtgttagggggttcgtgggattttttttgtcgttttttttcgcgtacggttcgggttcgttttgtagcgttcgttgttttttttttgtttgaagcgttttattatcgttttttaggtttcggatttggtgtcgggtttaggcgtaaaggagtaggtgattttgcggtcgtagtattcgttttatttcgttagagtcgcggggcgtttagaaggggtttttggatttcggcgcggggtcggtttagtttcgttttttgtttgcgcggagtttttggcgatttttaggtcgttgtttttcgtcgggacgtttcggggatatttaggtttgtttttttttgggttcggcgtttttggagtttcgtgtttacggtcggtggtttttttcgcgtgatttttagcgttggggtagggtttttcggggttttttggcggttcgtggtttttttttttttcgcggttttttttttttaggtttttttttttttcgcggttttttttttcgcggtttttttttttttcgaggtttttttttgggttttcggtttgcgagggttatacggttttttcggacggttttttcggtggtttcgtcgggttttttttcgtcgttttttgtagtttttcgattttcgggaattttgggtttgatttttgtttcggttcggggcgtaggcggcgttgatggaggcgtttgggtttcgaatttaggttgtaagatagagtggggttttggggtaagcgtttatttttttttcggttcgggttttttttttttttggggatgaaggttttaatgttcgcggttagtggaaggaagtttttattaggggcgacgatggttttttcggggttgagtttggcgggatttagggttcgggtatacgtgtttggagtgttgtttttttagggacggcgtttgtagcgatagggtcgggattcgagttagttgggtcgaggtacggtttatattgtttattttttttttatttttagagtttttttttttggatagttggagtggggttttttcggtacggttgagattaaggatgttttcgagtcgtgggaagggatttcgggatttcgttgtcgcggcgtttttttttcgaatttcgtttttttaattggttattttttttttcgattacgggttgtaggaggtttttagtaagggaggggtcgtaggagtgttttcggggggcgtttacgagttgagcggtttttagagagggcgtaggggaaaggcggtagaacgttacgaggtaggaggggttgtataaggtttattcggaagttagaatttattcgcggcgaggggaatgggtttcgtaaaaggtttatatcgggtgagaggggcgcgtaaggttcgttatttaaggggagatgtataaattaattttgggggcgtgtaagatttagttttggagaggaggtttttagattttattttggcggtatagcgtttttttttggaggaataggcgtataggtggattttagtttcgttttatttttggggagtttgcgtttatcgcggtatagttggaaagtcgagtttagtagcgttattagcgaggcgagtattaggtatttgttgagcgataggtttttttagggtagtttttcgtttagggtcgggggcggcggcggcggttgtaggggcggcgcggtttgcgtttttttgcgcgcggggacgtttcgagggtttgcgggggtaagtgcgcgttgcgttgtggttattggttttgtgtcgttttttttttcgggcgtaggggataagagataggtttgtgttttgaattcggttttttttgtttgtttgtgcggtttcgggcgtaggtgaatttagtttcgggtgtttcgtagttgtacg

SEQ ID NO: 6358 - DNA, 1143 bp, Artificial Sequence
  Description of Artificial Sequence: Synthetic polynucleotide
tcgatcgttagtggttgggaagtgggcggtgttggggggtgagtttcggtttttttaagatgcgttttttatgaaattttttagttttacgtgtatttatacgtatacggatgtatgtatacgtatagaaatatatagggttcggatatagttgcgcgtagataagtaaaggattacgtttacgtggaaataggtgtgcgtatacgttttcgcgtattcgcgcgtataagcgttttatatttgggaacgtgcgtatttgtttttcgttttcggtatatatatagtcgttttatattggaatatttgggcgttagcgtcgggttattcgggtacgtagggcgttacgtagggtcgcgtatacgtttttcggttatacgcgtatagttttttacgtggacgcgcgggtatatacgttcggggttcgtagtcgcgtatattcgtatttaggaaattttagttattattacgcggggttcgatcgtttttgagtatttttcgttttagtcgcgtattcgttgcgcgttcgggacgcgtatattcgcgtatatatcggttttttttgcgtacgtttcgggtttattttcgtttagagttttcggggtttttttttatttcggtttcggggtttttttacgttttttcgtcgacgtgtttatttgtttagggggcgttttcgagtcgcgtttcgcgttcgtttttaggagggttttcgcgagtcggttgtatatttcgaggcggtttcggttgtataatttggagcgagttgtttcgtttttttattttgggggcgaagaagggtcggggagtgggggaaagcgggaggcgtcgcggtttgggaggttttcgcgggttttagcgtcggtcgtattgcggtttttttcgcgcgtcgtcgtcgtcgtcggttttttttcgtttcgttttcgcggttttcggcgtttttcgcgcgtttcgggcggggtttcggggcgtacgcgggttttacgtttggttttgatttggttttgtcgggcgtgtattttttatttattttgggaagcggggtttttggagcgtggaacgggcgtcgttagtgcgcgcggcggggatcgggggtgagggagagtgagttgttcgttcggggagataagtaaggcgttaagttcg

SEQ ID NO: 6359 - DNA, 220 bp, Artificial Sequence
  Description of Artificial Sequence: Synthetic polynucleotide
acgtgtcggtgacgtttcgtggagttggcgagtttcgtttgtttcgcgattgagtttgcggtcgtttcgattttttagtagattttggcgtggggtatttgagattttcgttattgaaaaggcgttatagaaatgtaaggaattatgattttaataaaattgttttatttaggagcgagtttttgcgttgtttttgtcgtcggagttcgggtttgttacg

SEQ ID NO: 6360 - DNA, 1860 bp, Artificial Sequence
  Description of Artificial Sequence: Synthetic polynucleotide
tcgcgatgttagttacggttcgcggcggttacggagttattttagtatttcgcgatggatagtgattttcggcgtggcgcgagttttttgcggtttttacgcgggtttgggcggcgggtttttttacggtttcgtttagatattcggaggtatttgttaaagttgcggaggtggacgatcgggcgtttaagtacgaattttttcgtcgaggtacggttgtcgggtttcgttttgagggtttggggcggcgaggatcgtcggggaggagggcgcgcgagtcggaggttagagtcgggtcgggtagggcgcgtttaggagtaggggagacggcgattcgggtcgaggcgggacggggatacgttatttgttcgtggagcgcggggaaggggtgcgcggcggcggcggcggcggagtttggcgtagagggtagcggtagtagcgggagtatcggttcgttcggggtcggttagtcggggagatcggggagtagcggggtcgcgggcggcggggtcgaggcgagtagtatcgggggaattacgattttcgcgttgagtcggagtagttcggtcgagttcggtattatttagatttagggcggcggcggcggcggttttgcgtttatcggttagaggagaggttgtcgtcgtcggggttgttgttgttgtagttgtcgtcgtcgtcgttggaatttggcgttcgtttgtattttatattttcgcgttgacggcggcggcgggggcggcgggcgttcgagatgttgggtcggcggcggcgcggtttcggagcgaatttatttggtttcgcggcgcggtcgttcgtttcgtttttgtttcgcgcgggaagtttttttttttttcgttcgcgtcgtcgtcgttttcggattcggttttcgtttcggttttcgttcgttcgcgttttttttcgtcggatttcgtttcgttttcgcgtttttcggttttggtcggggtttttttttcgttgcgtttttggattcgggcggtcgcggaggacgtgggtgggagagggtcgagggcgcgttcggttgggttttcgtcgatgtcggttttttggtggtttttggttttttgggatttagcgtatcgcgagggaggtttcgggtttcgtatttaagggtaagcggaagtcgaggtggcggcgtcggagttaggtatgtttcgttgtttagcgcggggttgagggcgtagacggggatcgcgcgagtcgttttttatttggttttttcggagtttagggcgcggagggtattgggttgcggattcggcgtaggcggtttcggacgttgttaggcgcgggcggatttttgttgtataaatgggttaaataggttcgtaaggttttcgcgggttttttggttcggaagttgagtcgcgggtgtttggtttgaagtttcgcgttttatagtggttcgcgggtttcggcggtttttgttttacgttttttaaggtattaggtaggtggttttagggtttttgtttacgatattttttgggtggggtaggattatttttttgtgaattcgttttggatgtttttaggtatagtttgtattttttttttttttagtatacgcggtttttgacgttgtacgtcgagttttttgggatttaggacgaatcgggttttaaggattttcgtttcgttcggattatacgtaggtagcgtcggtcgagtcgagtttgggttcgtattggttacgcgtagttatcgttagacggcgttagttttttttcgttgtagattttgtttcggaggtcgttagttttttttttatttcgggtttatagttttagtgtagtttttggcgacgcgcgttgatagttgggtagagattttcgtgcg

SEQ ID NO: 6361 - DNA, 441 bp, Artificial Sequence
  Description of Artificial Sequence: Synthetic polynucleotide
gcggggttttaaacgttatttaatcggggatattgggcggggggtcgtttaattaggttcgtagttggagtagatagggcggttttcgggatttggcgcggtttttgtttttcgttgtcgtcgaagttttaattttcgtttgtttgttttgtgttttttgtacgtagaagtttagtttgtgtggttttgcgatttgcgggtattgggagatttatagttaagacgttagggttttttggaagtttagaaatggtgagagtgtcggttcgatatttcgagagagggaacggggttggttggaatcggtgggaagcggttgtggcgggatttaggttttttcgtagttagttttataatttgcgtttagagtttttgtttagttcggttttagttttttttagttatacgatggcggtcgcgttgatagtcggggtttcggcg

SEQ ID NO: 6362 - DNA, 5587 bp, Artificial Sequence
  Description of Artificial Sequence: Synthetic polynucleotide
gcggtgttttcgggaggttggtagtcggggaagtaggtacgtgaatttatcgggttgttttattttaatttgaggttagagttgaggcgtaggggtcggggtaggggtagaggtgtcgaaacgtattagttggggattttcgggggaaggagataggagagatttaaggcgagttttaggattcgtttttatgattatgattacgcgttgcgttcgaattatatgtttatttcgtatttgttttcggggattagatcgcgtttttttagatggttggggagggagtagatttcgggtgaaggttgggggaggtatcgggatgtcgagtacgttagagtaggcgggggatgggtttcggttttttgtcgtttcggtatttcgttttgtatcgggtaaagaaggggttacgatcggcgaagagcgcgtggagatatagggattcgcgatttaggggtaggaatttcgttttttttcggaaatttttcgggttttgagtcgtgttcggcgttttttattttattttattttcgtcgtttttgtcgttatttacggtcgttgcgggttggttagcgtgtgcgtttttcgcgtcgtaggtatttgttcgttgggcgttgtgcgtttatttttttttcgcgtattgtagattttcggcgttgtcgtcgttatttagcgtagttttcggttgggtatagcgtttcgtttttttcgcggtttcgggcgtttatttattcgttatggtttaggtttgggttaaatagcggggtagttggttgtttaaattggggtaaggagttgagggttgggagttgtagagaggatcgagggatatacggggagtagggatgagcggtcgtttcgagtcgtgtagattgggaagaagttagggagagtttgggtgggaggatttttaatttaagcgggtgcggggcggggttgtattttaattagaaagacggtggttttttcgagcgattttcgaggagagagggggagcgttttggggcgggggcggggcgggttgtggtaggagaggggagggcgggggcgatgtagcggtggaggcggtttggcgtttagttattgatcgttttttttttttttttttttttttttttttttcgttttttttcggtttcgggttcgttacgtcggattcgtttttttcgcgttgcgttgggtcggacgttaggtttgcgcgtcgcggttgagcgtttattcgttttgcggaaagagtcgcggaggaatcggcgggggcggttgcgggagtcgaaggaggtggtaatcgggagtagaattagaaggagatagggaggtagaagttcgcggtttcgtggtacgtattttttcggttagggatgggtttcggcgcggtttagtttttgttcggttcgtcgggtagagattgaatcgcggatttttatcgttttgtggacgatcggatagagagaggtattgatcgatcgttagtagtttttcggtgggatcgcgttttttgtatatttcgcgtagcgtttttcgtcggagtcgtatcgggtaagtcggcgagggagcggggttgattggcggtcgtcggcggttaggggagggggcgtcgcgcggggttatggtaggttcggaggcgttttagttcgagtcggagtcgattcgagtttacgcggtcgtcgttttttcgttttcgggttttcgtcgttatcgcgtttttcgcgggagatggaatagcggaatcggttcggtgttttcggatatttgtcgtttttgttgttgtatgttttgttgtttttcgtggtcgacggtgagcgcgggaattttgttgtcgttgtggattcgggggggtttttgttggggtcgttatcgagaagaagaagaaagagaacgaatcgggaagtttcgcggtttttagtaatttcgttgtgtagtttgggttcggaggggtagggagaggcgagcggcgaagggtcgtcgtagtagtagcgtcgcgttcgagtcgtttttagtttcgtcggggtttcggttgcggaaaggatgtttgcggggagcgggagtaggcgcgttttagttaggttttggcggtgcggttaggggcgggggagaagtacgagtcgtttttgtcgtttcgttttattcggagggaagtagtaggtagtcgatggtcggtttttgtttcggttttgtagtcgttttttcgaattttgttagttttttcggtcgtgcgttagggagtagttgcggggtggggggtataaggttagttagttagagatcgattgtttcgttttaggttgttttaggttttcgatttatagttggttacgtttttttttttttttttatttttagttgtatttatagaagtttttaaagatgtgatagtacgggagggagacgatatcgaaatgttttgcgcgtttcgggttagcggagttatttcgtattcgttggagatttagtggtggtattttaaggagttatttcgggagttgttgtacgagttggcgtttagcgtgtcgggcgttcggagtaaggtaattcgtcgtttacgcggtatcggcgcgcgttcggttcgcgttcggggcggcgaaggttaatttagggagggaagtagcgggttttattcgcgtagggcgtcgttttgtggcgtagtttattttttattttcgtattttaaagtatttttaaagttagtagtggttatttttaaatttgttaattattttgatagtatcgttgtttttattattttttagaattttatttacgtttagtttttaaagagttatattttagtttggtcgtttgttcgtgttcgttggttgcggttttttgatgggtgttgggtagtgaaggaagtttttttggttttattaggtttttttcgttttttgttattttgaggattttagggtttttacggttgcgttttagaggttattagaaaatcgagtatcggaaagtcggtaggatttttagtttttaggggtatagaggggttatttttttgtggtcgaaaataggtttacgttgtttgtttgttttaaaatttatatttttttatatattttagtgtgttcgcgtgtatatatatttatatatatatttatatttatatatatttatatttttttagggttttatttagagttatttttattgagtttttcgttgggtgttgtttagatatagcggttttttttttagttttttacggtttttagtgagttgggggaggattttgagttacgcggtagggtttaaggatgtttagagggaaggagaggggtttttttttttattttggtgtttatttagtttttttagtttagtcggtaggtgtgtattagggtagttattcgttggttaggtattatgttagttttaaagttcgtttttttttgggaaatttttggaaagtcggacgttttttgtgtttttaatttttatttttcgggcggtttcggttttagtttgtcggaggagggtgtttttgtttaaaggcggattcgagtttttttagttagaaggtcgcgagttttacgtttttttttttttttttgtattttaggtaataaataaggatgtaattaaaattagcgtaagtgtggagtttagcgcgggtcgcgggagattttttttggtcgtttcgggtttcgtagtttttttttttagtaagtcgcggcggtcgcgtatgtggggtcgcgtaagtagggtagcgatcgtagttttgtatcggtggttgttcggcgtgttcgggcgttatttgtcgtcggttgtagggtcgggtttttttttgtgtaaattaagggtttaaggtttgagttttttaattcggttcggcgttgatttgtaaaattttttttggtcggattgcgcgtttagggtttttcgcgtttgttagttttcgttttgcgggtattttttttagtatcgggagcgcgcggttgttcgttttcgtcgcgatcgtggcgttagtttttcgttttttttgtttcgttttgagtatttgttttgcgtttttcgttgtaattttttatttttcgtttggattgcgggtttgggtgcggggtgttgtaggtttgtaggggacggggtagggggtggttgtgttaggttgcgaggggttcgggttatggggttgttaattttgggaggagatgcgtttaagttttttatttggagcgtagaaaggtttggagatgacgaagttttttcgtgggttcggtttagaggtgagggttttttgggtgtttgttgagagtcgtagagtagtatttttcgaagtttttatcggggcgtaggggaggagtatttcgttggggggtttttggagatttcgcggaaaggcgggttggtagtaggtggttagggagttaggtagtagttttagcgttgtttgtttttttaagaaagtatagtgttagttgtaaagggcggggttcggtgatagggtggttttttttaggaagcgattcgggtaggtttttcgtgtttcgggaggtgaggagggtcggttggggcgggattgtcggttggagcgcgtcggggcgggaaagacgtggggaagttaaggaataaggaatttagtttggggttttttgaaggtgtaggagggaggaaggagaggtggattttgtttttttgaagcgttagttacgggaagataagtagtgttggtttgtatgggcggggtagatgtaaggtgggcgtttggttaacgtgatggggacgtggggatatagtttaaagagttggttgtttggcgtttacgtagagttggaagttttatgttattgggtagacgcgggtgaaagggaagtcggatcgtgatggtgggtaaattaggattcgggaagtgttggggtgcgcggatgagggggcgcgacggttagggtggttagaagagtaggtttgggagttgtttagttcggtttttaattttgtttttttgtagatcgtacgcgtttagggtaatgatattttatatcggtttcggttgtttgtcgtgcggttgtaggacgagggcgtgtacgagtgtcgcgtgtcggattatagcgacgacgatacgtaggagtataaggtttaggcgatgttgcgcgtgttttcgcgtttcgcgtcgtttaatatgtaggtcgtcgaggtcgtgttttatatttagagtagcggttcgcgtcgttacggtttagttagcgtcgttaacgttaataacgcgggcgtcgcgagtcgtattattttcgagttcggtcgcggcgataagagttcgtcgttcgggagttttttcgtcgttatcgatttcgtagttttcgaggtcgcggtagtttcggcggtttatacgtttattattatagtcgcggtagttgttgttgtttcgttagcgtcgtcgttatcgggataggcggttttgttgcgttagaggtacggttcgggtaagggatcgcggagagggggcgtacgcgcggggatggcgtagggttagggttgcgtcgggacgtttcggggggtttcggatttaggattcgttttttgggcgtatttgtatatgtatatttttttttagttaggtcgggagcgttttttttagggtttttttttcgcg

SEQ ID NO: 6363 - DNA, 3643 bp, Artificial Sequence
  Description of Artificial Sequence: Synthetic polynucleotide
acggggcgattttgaaaagaggttgatgaaaatcgagttcgttttgtttcggttgggttgggaatagttcgtagggttttgtcgagtgggcgagtgaggcgcgcgagtagggcgttcgtttttttttagtttcggaaaatgattaagttaatcgtgtgggtatgttttattatttattgaatataattttttataacgtttcgtttacgtgttcgagtttgtttttgacgttcgcgttttaatgtttaaggtaaggaaaataaaggtgggggggggattgcggggcgcggcgcggtgcggggggcgcggcgcgggggggcggcggcgggtgggggggtagtttcggcgttcgggaggtggtaaagtgagtttggatttttggcgcggttttttcgttttttttttttttttatttcggcgaggtttgtcgttcggttttttttcgttttatcgcgattaaaaaatacggtttaattaaatattcgtggttgtgacgttggcgagagaagttgttagcgggtggggggtggggggaaagaagaggaaaatcgagtcggcggttgcggtcgggtatcgtatggcgttagagaatttcggcggcgagcgggatttgcgtttgggtcgtcgttttttcgttcgcggtttcgggatcgttattttgaaaaggagtttcgaggtttggcgttcggcgcgcgatcgggatttcgcgtttagtttcggggattcggtcggcgttttttattcgcgagcggttcgcgagttatttttaggtttcgggaaatttttaagagggtttggggggtggggggagtaaaaaggggagggggtaggttggggtcgcggaaatttttgtttaagtgattttttttatttttttttttgtttgggacgggggttcgttttgcgttttttttttggttcgcgtttattgcggggtttcggttttttcgttcgtggagagagggtaatttgtaatttttttttttttttaattaaagttagttgatgtttataatgtgttaaatttgcgggcgtcgagagtcgttgagatttgttattttgtgattgtatcggttttttgtgtttcgggagtttggttaggttgaggtcggagagttggttttagggttgaggtgttagggttcgaattcgcgattttaggaaaggtcgtggcgtttgtaagcgtaggcggcgttcgtagtatttgttttagtcgggtttcggtttgggggtttagtcgggggttaaagaggaaataaataaataaataagtaataggttatggagggaaaagagtcggttagttttaggttggagaaatgaggttaattagagcgaggaagtgcgggcgtgggggttttggaaggtagaggagaggtagggtttgcgcggcgtttgggaagagtgtaatttggggggacgtttttcgtttttttagcgtagatgtatgattggggtaggaatgatttttgttgataagtttttttttgtttgttttaagatattatttttcgaagatgaattgaggaaaatagtcgtaggcgagattcggggtgtattttaggtaaaaaaaaaaaagttagggttgggggagagtttttttttgatgagtaggaaagtgtttagatttcgacgcgtttatttgttgtagttttgtaaataatttaaaatatagatatttttatatagacggatgtatgtgaagtggaggaaggtcgaaacgcggggaagttagggaaaaagaaagaaaaagggttgggtagagagagatttgtgttgtttattttttattttgcggagtgaatttcggtagggttttttttggggataggtggaaagttaagtttttttttttttatttttgtattgtgagtggtttttattgtgtgtttgttggagaatatgtttatcgttttcgagttaggtggaggattggaatgttggggggcggggagcgttggagttgaggacgtagtggttaggggttgggggtcgagaaagagtagggcggggttttagtttcgcgtgcgggtggtagcggcggtcgggttttgtttgttagatattgttatgtttaacgggtgtttcgtcggagacgtgatttgttagtcgttttcgtttttattttagtagaaaatacggtagttgcgaggtgtttcggtttgcggggttcgggtattcggtgcgttttgggggttgggtcgtgtgcgcgggtgggagtcggcggtcggcggggtcggggcgaggggcgagcgggaggggcggagtgagcgagcgcgcggtacggtttttcggttttttttgcgttttttttcggtagtcgtcgtcgtcgtcgtcgtcgttgtgtaatttagtagaaattcgataggggtcgcgtttgttgagcgtattcggcggtcgggtagttcgagcgggtcgtcgggtttggtcggtcggtgtagaggcgcggagggggtcggcggaggggatcggcggggatgggcgcgggaagtacgtttgattagagtacgcgtcgttttttaattttggtgttttcggcgagttgggtagtttcgcgcgttttgattttgacgttttagtttttagttagggtttaggtgaatttggggtggggtgtgcgtgcgtgcgtgtgtatgtgcgtgcgtgtgtgtgtgtggaaggggtggtgagattgggaacgcgttgtttttttttttagtttgatattagtaattggatttttattttaagatcggttttgttttttgttggggttgggagggggggcgatttttttttattatttatatttttgtttattgtttattgagtggaaggtaggcgatttaaagagacgaaagagaggaaaaaggggtgagagacggagagaggaaaaagaggggggcggttagaagagggaaggagaggcgtggggatagggttttcgttttcgtcggggtcgggtttgatggtgaaatagtaaatttacgtacggagggtcgttaggaaagtggatattatcgttttaattaatttcgagatgtttcggcggcgggatttggcgtagtcgtgacgcgtttttataaatttgttcggttcggggttgtttcgagaattcgtatagtagcggcgttagatttatttcgcgttttttagttcggagtttatttgtataattggattttttttttttgtttttttttttttttttgaaatttgtttgaaaatttaagtgaaaatcgcgacgatttgtatatttaaaagtaagtgttaagtaagtgttttgcggtggtttcggcgcgtttcggggtgagcgcgtaaagtcgggagcgaggtgtcgcgagttgcgcgtcgtttcgggtcggtttcgcgtgtgggcggttgggcggttgggcggcgggaggacggttttcgcgggtttcgggattgttcggttggttgttcgtataattttttttttttttttcgtttgttgatttttcgggttaggtgaagtgtttgggttacgcgtgtatttgtggcgagattcgggaggcgattttggggggcgcgcggtcgtagttgggtattttgtttgggtcgggggcgggtagtcggttttagtggtcgtcgttgagggtagagttgcgagcgagcggggtcggttgttggtcgcgtcgcgtcg

SEQ ID NO: 6364 - DNA, 808 bp, Artificial Sequence
  Description of Artificial Sequence: Synthetic polynucleotide
tcgggggagttgcgaggttatttttagtcggcgttcgggcggattgcgagttttcgcgggttcggtcgggggagcggagattggtttttcgttcgggttggggcgtttgtcgttcgcgagtcggaagagcgttttatttacgagtaggtagttttggtagagggttaattgaggattattgttgttggttttaggaggagcgaagcgtttggagatcgggcgcgcgggcgcggttttgggagcgggggaaggtgaggggaaatgggatatgatggtattaataatcgttattaaagacggtgggagtaataaaggaatgcgttttcgagacgtcgtttagtttcggggtgttttttggcgcggtcgcggtgtaggaacgcgagtttcgtcgtcgagtttttcgtcgtttgcgttcgttggcgcggcgttcggcggtagtgttatttcgaggtcgagcgttgttttcgtcggttcgcggttgttagtcggttttgttcgcgttcgggtttcgcgagcggtcgtattttattttacggaggggagataatgagattaattagaggcgtcgttatcgcgtcggagatagttgtcgtcgtatagtaattattcgcgggttgggtgcgcgggggtttttcgttatttgcgcgtttgttgtttttattacgcggtatcgattcgggcgcgttttcggtttttgttcgtagtttatagttatatcgcgtattttatattttttttgcgtttttgttggggagtttattttttttattcgtatagtgcgttgcggttcggggtgtgggaggtttcg

SEQ ID NO: 6365 - DNA, 3415 bp, Artificial Sequence
  Description of Artificial Sequence: Synthetic polynucleotide
tcgaggggatcggttcgtttattcgttcgcgttttttggttcggcggatattaggtagtttttcggcggtcggtcgttcggaggacgcggaagatgtttcggggaatttaggtgatttcgttcgttatttatagaaagagttaggtcggggttgttttttattttttttgtagtcggagagttgaggaggtagggatttggcgcggtttagcgcgtttcgcgagcggttttttaaatgggtgcgagagggaagagggtagagcgcggcggggcgttcggggggcgttcggtattcgaggcgggcgtacgtatttaaataggagagcggcgttcggagttatttagtgcgggtagaagagcggggcgaggagcggggtcgcgttcgttggaggcgcggggcgagtggaggaagaggaggaggagagtagaaggaaggggaagcggttcgtatttgttgcgcgtcggggcgtttgttgtttttttttcggtatgatgttttttcggcgattgttattgtcgtcgtcgtcgtcgttgtcgggttgaggatagggagggagggggcggcgggttcgcgggggggcgaggcgggtttgtttttagtttttttttcggagagcggtcgttcgtaggatgttgttgcgtttaggtttttcgcgtttttttcgcgtcgcgtttcgtcgcgaatttcgaacgtgcggagggaagaaggagggcgggcgagggaggttcggggagggaggagtacgggggggaggaggaggtagaggaggaggaggtggaggaggaggaggaggatcgcgttgtcggcggaatgggaagtttgataaatcgttttagaggttagaggaggagggggcggggaggagcggcggttttgttttttttcgtttcgtttttagacgaggtgcgcggggttcggggttggggggcggggagagggcgggtagagcggtgggaggaggagcgcgggagcggttcggatcggtattgtttcggttttcgtttttaggtcgggggttacggtattcggggggacgcgtagtcgtcgtcgcggttcggggttcggcggtttagttttttgttcgtggcgcggttggagcggcggcgtcggtaataggtaagtttaaaggaaaaggagatgatcgtgttaatcgttcgttcgcgggggcgtcgcgttttcgttttcggttttaggttcgcgtgggattttcgtttcgttagcgaaaggggtgtcgttttttcgttttcgtttcgtgcgtatacgcgggggcgcggcgttagtttcgtcgagttcgtttcggggcgttcgttattttttatttttatttttatttagcgttcgtttttagttattttttagttgttttattcggttcgtatttttttttattcgtcgatttcggagtttttagcgtggttttcgggtcggggttggcgtttttcggggaagttagagtttacgggtaggttttttttagggaggaggcgggcgcgggtcggggcgggtgggggtagtttttagatttcgcgttatttagttttttttttaggattcgtcgtagttattttttttaatttttttttttcggataaatttttttgggttcgtttcgggggtcggtgtgggagggggtttttttaagtttttttttttgattttgggatgattagggtttttttatttcgtttttcgttttcgggagtcgggtcgcgttttttatttacggcgcgggtcgattttagggcgggacgggggcgggagaaggaaatcgggtttttttgtttatttttcgttaggggtttttttcgagagtttagggggtcgtcgcgtcgtgtttcgcgttcggtttgtcggggttgttggattagagggattgattattgattggtgatcggggtcgttgaggtttcgggtcggttcggtcgattggtcgcggtaagaaggagttggttgggcggcgtgggcggcggggcgacgcgggtttatttacgggcggcggtgagggcgcgggtgggtcggagtttatgcgggcgattttcgggcggcggcggttgagcgggagtcggagttcgagcggcgcgggcggcggcgtatcgatgcgttgcgggttcgattgcgtttttttgggttagtttttaggtcgggaatggggcggtcgcgtcggggtcggtttcgggcgttgtcgggcggcggttgttggagcgcgggggcggttttcgggtttattattttcgaggcggttttgcgttcgggcgcgtcggttggggttttggcgttttcgtaggtttcgaggtcgatagtttcggcgagggcgggcgtttcgcgttttagtatcggttgtttgagcgtttttggagtagtaaattttagatttttttttttttttttttttttttttttttttttttttttatttttttttttttttagtttttttttttttttttttttgttttgtgttttttttattttttttttacgattgtttttgtaagtttgttttaaaagtttatagtatgttttttttttttttagatcgggagatagtgattttatttatacggtaagattaaaagttttcgttcgtttagtttgcgggtttgggttgggtttagacgttttttaggatgtagatgcgtcgtcgttggttttttcggttataaagtcgtttttagcgttttttcgcgcgtaggagcgttcggagttgtggggtacggattttaggcggggtagggagttcgaggcgggttgcggcggggttttcgggttggcggattcgggggttgaggcgtcgtgcgcgttgggtgttcgcggtcgtagaggttagaatcgttatttttttaggtcggggagacgcggtcgtggagcgtgaaacgttttttgtaagcgaggaaacggtgagttggtcgatatcgtcggcggttttattattttggtggtcgcgttgagtttttgtcgtttggaggcgggttgcgtcgtacggggttagttttcgtcggtttttagtttattttcgaagtttttatttaggcgcgttcggtgcggcgtgtgtatagcgcggggcgtcgtatacggaagcgtgtagttttttttggtcgcgtttttttttttttttttattttttcgttgtttttgtaaatttttgttttttcggtttttttttattgcgggtcgcggtttgaattcgggttttcgcgtagtcggtcgtcgtcgttgggtcgttgtttggttttttttcgtttaggcgtcgagcgttgtgcgattcgttttaatatttgttcgtttaattattggcgtatttattagtgttaatgggttgtatattgtagcgatagttcgttacgtataatacgggttatgcggagtgtacgtagtaattatattgttatgtcgggatacgtaaaaaggttttcg

SEQ ID NO: 6366 - DNA, 3415 bp, Artificial Sequence; identical to SEQ ID NO: 6365
  Description of Artificial Sequence: Synthetic polynucleotide

SEQ ID NO: 6367 - DNA, 1592 bp, Artificial Sequence
  Description of Artificial Sequence: Synthetic polynucleotide
gcgaagcgatttagcgcgaggattagtttttaattaattcgtttttagttttgggcgttttttttagtagttagatgggggttttagaggtcggtgcgcggttatatggtttcgggttaggtagggggtcgtggggacgtatttgcgttaggcgtatagtatttttgggcgcgggacgggcgaagcgtcgtgggttttaagttgagttgggtcggttttgtagcgtcggagagtaaggcggcgtagggaagggagatggggcgggatgtggggaaagttgtcgattgtttggattttttcggttcggatggcgttagttgtttttagtttagtttgcggaaattcgagttttttttagcggttcgacggttcgggcgtttcgtagattttgggtttttttcgcggtgttttcgtcgttcgtttttgcgttttggttcggtttttacgttttttcgaggtttcggcgtagcgcggtcgtcgttattttttttatattttagaggtcgtagcgtcgttttttttttcgtatttttgttttcgtaaaggagttttttcgtttcgcgcgaggtcgcggcgaggagggggcgcggttcggcgtttgggagtttatattttttcgtcgcgcgcgtcgtcgagtagggcgtcgcgtttttcggttcgcgcgtggtcgtcggaacgatttcggttcggcgtcggtttcgtttcgtttcgcgtttaggggtttcggggcgggtttcgggtttcgggcggacgatgcggcggttcggtcggagcggcggcgggaagcggaggcggaggtgacgcgttagggtcggcgggtcgggttatgtagcgttttagggcgggcgcggacgaggcggttttatttttggtcgggttggttttgcgggagttggagttcgggtgcggttttttcggtcgggggcggcgggggtcgcggtttgggtttggagacgaggcggcgttcgcgttgggtcgtagagggaagggtagcggcggtttcgaggtcggggcggacggattgagtcgcggggagcggggttttcggcgcgcggcggtttcggagtttagcgcgtagtttgcgggtagtttacgggttagtttggcggggttcgacggcggcggcggtggcggtagcgttcgatttagcggtattagtttgggttacgattagcgttacggtagttcgcgtttcggtcgttcggattcgcgtttcggtttcgggtcgttttcggtgggtagcgttcgttttagcgtttttagtttcggttttcggggttcggtcggcgtttacgttgattttttttcgttcggcgtttgtttcgcgttcgttcgtttttcggagtttgcggggtcggtttttttttcgttgtttgtattttcgttgttttttggtcgggagggcggtttaagcgcggtcgagcggcggttggaggcgtttattcgggagttggagcgggcgttcgaggcgcgtacggcgcgggattatttcggtgagttcgttcggttcggtagttttttgcgcgtatggttggggttcggggtttcgagattgtttcgggtaggcggtcggattagcggaggagagtacg

SEQ ID NO: 6368 - DNA, 903 bp, Artificial Sequence
  Description of Artificial Sequence: Synthetic polynucleotide
gcgattttagaattcgttttttatttcgagttcgtttttcgtcgttttttcgtttttgggagggcggttttattaattttcgcgattcgggtcgtttttggcggttttgatttcgttatttcgtttcgcggcgggggtttgggggtgaggggcgcgttttggggtagaggattgcgcggtagggtttgttatagggtagaggttagggtttttcgggaaaaaggtaggcgtatatatgtttttttttttgggaaaagacggggaggggggttttttttgggagattttaggtttcgaaatttttcgttttttatttttcggttttcgtattttttttttttttcgttacgtatttttttttttttttagttatttgttttatttcgtagcgtcgcgataaatacggttttagttcgttttcgtttttgtttagttttttttttaagtttcggggagtgggggagtgagtagacgttttttttttaggaggtcggaatttttgtttttattttttatcggggttcggttggttagaggtaagtttcgagattttttattaattattattatcgttgcgagggtcggtgaggttgtagataacgtttgtaaggacgggagtcggggagggtgtagggcgagtttaaaggacgggtagagtaagtttcgggaagaggtaggggttttttttttcgggtcgtcgtttttcgtattttcggagttagtcgtagttacgtagcgtcgtttgtcgggtatattaaggatttggcgcgtacgtggcgtttatttttattttcgggttcgtttttggttcgcgtttagtttttttagattattcgtaaattgaggatttcggatatagagtgtagagatttcggtaagtttattgaaagttagtcgaattcg

SEQ ID NO: 6369 - DNA, 1592 bp, Artificial Sequence; identical to SEQ ID NO: 6367
  Description of Artificial Sequence: Synthetic polynucleotide

SEQ ID NO: 6370 - DNA, 382 bp, Artificial Sequence
  Description of Artificial Sequence: Synthetic polynucleotide
acggattgttcgtttagtaatatttgattacgttttttattggttatcgttttcggaagttcgttttttcgttttcggaattttcgtaggcgttgggtttgtagatggcgtttaggtatatagtggcgagtgtgatttcgtagttttgggttgtttggttaagcgttcgtcggatatggtacgtcgaagggttatcggcgtggagttttcgtttttagcgttcgcggttgggaaatcggttatcgttacggcgggaattgggattcgggttgcgtttcggtttttttatatcggtttatcgtattcgtgggcgttcgtattggtgttgatataattttttgatttttgattcgtattgtttcgcgattaaaggtaaaaaacg

SEQ ID NO: 6371 - DNA, 665 bp, Artificial Sequence
  Description of Artificial Sequence: Synthetic polynucleotide
gcgtttttacgaaattcgtttacggatacgatttcggggttatatttagttagacgaatgtttggtaaatgatagttattttacgttagatttttatagttttttatacgttatttttattgttttagggaattataagtataggtatcgtttcgttcggcgtttttttttaaagattggggtattaggatcgcgggtttttatttttatttagtataaagagttcggcgtttagagttagcggtttttcgaggatttattattaagttcgcggatataggtttcgattttatatttaacgttgttaaagtggtagagtcggcgcgggttgggatagaggcggtattgaggtcggcgttgtcggtggttgagagcgttataagtttcggttcgttatattaggggcgacgttttttagaggttttcgcggtttattcgggcgggattggttttattgtttgcgcgttttgagaagtagattacggtgttttagggtttatagtttcgcgtaggggagtttagtttaggttttgtacgagcggtttttcgcgagtttagttttgagagattgggagcgtaatttggtgttgagaagaatcgaatcgtttcgttgttttttgcgtcgaattatattttttagaggttttcgcggttttattttttcg

SEQ ID NO: 6372 - DNA, 764 bp, Artificial Sequence
  Description of Artificial Sequence: Synthetic polynucleotide
acgcgttattagcgcgtttttacgtataaattttttttttgcggttaatttgcgatttttaatttttcgttttggttgttaagggaggcgcgtagagcgtttgtgtttgcgtatttttatattagttcgtgtagtgtgacgttgggtttcgtttttgtgatcgggttaggttcggagttgtagggaattcggattttcgggttttttggaaggtcggggagaggttagtgtgggaggatttggtggggaggaggtcgtgttataaattttgcgcggagttgtatcgttgttgttagatattgcgacgtcgcgattttttttatttcggattacgttttttagcggatttcgcgggagttgggtcggcggtttttttgtgtttttcgggggcggaggtagttgaggcgttttttttcgggttcgtaagggttgggttttatttaattaagggtagcggtgagattcgagtgtagatttttcgagttttcggggtaggaaggagattttttattagttttgttttgtaggtcgggagtgggttgaggagtggcgtgtgggttttcggaagttcgtcgtaggttatttgtgtgatttcggtgcgagtggaggttggtatcgtttagtgcgaggttgttatttcgtgtgtttgtttacgttttgtgtgattgggtgcgaggaagttaatggtatcgtggaatgtgaggttgtgagttgaggcgggagcgggcgattgttcgttgtattttgttgggtcgatattcgcg

SEQ ID NO: 6373 - DNA, 1394 bp, Artificial Sequence
  Description of Artificial Sequence: Synthetic polynucleotide
tcgcgtttgggttcgtagtttcgggtacgttgtagtttcgtattcggttgtttacgttcgggattatttattgtgttttttcggaattgtttagcgtgtttttttagattttagatatttattttaaatttaggttttagcgttttgtaggggatttttattttggggcgtttatttttgattttttttttgggttttttcgttacggtcgagtttaagtggttgaagcgcggacgaggatgcgcggggtttcggtttttaattgtattataggtcgtatttacgaatttggttcggtatagttattatcgttcgggtttttaggttttagggttgtagaagtttagtttcgggaaaaaaagtatatcggtttgaggttttataggaattttttttttattttggttcggtttgtaaaatttggtttatttcgcgttttttttttttagaaaagtagcggttatagtggcgttcggtttttagttttagttttattcgatttagaggatagtttagttttgggagttagcggcgttagaatacgggagagcgtttgttttcgtcgcgaatgcgttagcgcgcgggggggcggaggtaagtttcgtagttgtttcgggtcgggaggggcgcgtggggtcgggtttcggcggggatagtcgggtcggggagacggagttagaggggtcgtagtgtttttcgttttaggtttttatttgtaatggtcgtttcgtgattgattagtgttattaaagataatttaggtttgtttttttgtggatattgcggtttaaaatttaaaaaaataatatttcgtttttttattttttatttggttttcggttcggagataggcggaggttgcgagtttcgtttcgtttttagcgacgttttatcggaatttttggaaatcggtttttgtttcgagtgcgtaagcgcgcggggggcgaacgttggggttttttagggagtaagggagaagtgtggggtcgtatttgtcgaggggtcgggaggtttggaggagggtggaggttggttataggatttcgatggggatggagtgtttaaatttaggtttgtagtcgtgattttggcgtgagttggatggaggaaattttagtatcgcgagtttggattaaggcgcggcgcgtgttgtttgtggtgtttgttgagtgacggtcgtcgcgttttcgcgtatttggatcgagtgtttggtcgttggcggagtagtgttttcgtgtacggggttgttgcgtgcgcgtgtgtcgttttttagcgggggattaggatggtgtcgtagagaaggttgcgcggtggtgtttgattttgacgttggttgtagcgggtttttggggtttttgcggtttgtgtttgcgtttgtgacgtatttgatatcg

SEQ ID NO: 6374 - DNA, 949 bp, Artificial Sequence
  Description of Artificial Sequence: Synthetic polynucleotide
acgtcgtgtttcgttattttaaaaaagaaaagttattttcgttaggtttttttttttttttattttcgtgtgtgtttcgaggtcgagatgtagagagtaagaaaaaggagcgaaggggatttttgcgcgttttaagtatttattagcgtttacggtgtgagatgaaggcgtattttttgggcgcgaagtttttaaagtatttgtttagggagatatttttgaagttgttagggttttttttttgtttttttttagattcgggttttgtataaattttggagggttagcgggcgaggcggttatcgtagcggtcgttaacgagtagttgtacggaggtgtagaagaaggaggttattgttatttttttgataagttgggggcgtgggaggtttcgggagttcgaagtcgtttcgagcgggggtgggcggtgagcggattttcgggtgttgattaggtgtttggtggtagagtagggaaggggggaacggacgtcgattttagggattttttattcgtttacgttttttggcgttggttatacgtcgtcgttttagtattaattggaggtttttagtggacgagtagtcgttcgagggtagtcgtttgagtcggtagatagcggttagttggggtagcggttcgaattgttttcgtaatacgttttttagtatttcggtttgcggggtgtttaggagcgcgggcggcgcggcgcggggatttaggacgtcgggcgcggggtttatggtagggtcgaggtcgttgaggtcgggtttttatttgcgtattcggggtcgtacgaggtttgggcgggggcggggcgggggcgggagttggattatttgtaattatttttcggttgcgtattttaatttcggttttttttttggaggttgcgtttaggtatcgcgttgaataagtcgtataggtgtgattcgggagcgttggagcg

SEQ ID NO: 6375 - DNA, 1365 bp, Artificial Sequence
  Description of Artificial Sequence: Synthetic polynucleotide
tcgcgcggttttaggtgaatttggtcgaggtttttgcgttaaggacggcgcgggttagttgaggttaagatcgtaggtattgttttatcgttttttagattatagtttcgtttttgtaaggtttcggggaaacgggtattttttttttagtgagtaaaggagaaagacggagttcggtggttgggtgtttcgtttaggattattagcgagtttagagttttttttacgatcgttttagggtgggtatttttaaaagcggaggaagggagggaatatattttttggtgttgtgtttattttgtttcgtatagagcgggcgtttataggttttgggggtttcgttcggatcgtagtggggagaggtcgttttatgtttcgtttcgttaaatttaagagttttcgtcgagcgttaggaggtttttagataatcggttttgttcgttgttttttgtagaatttttttatttttttcgagtttttttttttgcgttcgttcgggtaacggtcgcgttatgtttagttttaggtcgcgaggtagttcgttattcgttttttcgggttttcgggttcgattttcgcgttttggtcgtttttcggcgtttaggttttttattggttcgaatacgtttcgcgttttcggacgtttcgagttttttttttcggtcgaggttattttggcgaggttcgatttttgcgcgtcggcggttttttagtcgtcgggtttcgtttgcgtttattcggttttttggatcgttgtttttttgtgcgttatcgggggtttgttttgggtttgttcgatatcgtggttgttcgtttatttgagcgtaggtttttattttgtgttagggtcgcgcgtggttttcgtttgcggtttgttgggtttcggcgttataggtattgcggtttcggcgttcgtacgcgggggattgggcgggggttggagagtttaggtcgttattgtcggcgttttagtgtaggagagggtattgagtgtgagaattatatacggttggagtgggaaggggttttgttatcgtttattttgtagttgaagtcgaggatcgcgatagttttgttgaaaaagatttcggcgcgaggtttttttcgtacgttgttgaggtgggagagggtgggtgtgagggcggcgtagcgtttgaatgcggtgggtaggaggttagcgttggggttgtaaggggatttagttttgttttcggttttcgcgttttttgattttttcgtatatttcggggtagcgtttagtgatagagacgttttttaaagcggttttcgattcgaattaatggttttgttttttttttttacggggtagggggaagtggacgtttcgggcggtgttgttgagcg

SEQ ID NO: 6376 - DNA, 2638 bp, Artificial Sequence
  Description of Artificial Sequence: Synthetic polynucleotide
tcgggggtcgcgttggaattttataggaaaaaggcgcggaaagtcgtcgggtatttttcggggttttatagatgtttttagtgttttagttcgtgtattagttcgcgtattcggagggattttaggtagggggagggtttcgcggttagtatgtgcgttcgaggttttttcgtagggggtagtgtcgttcgttcgcgcgtcgatacggtgggagggggtgggaatttgcgcggagttttggaggttttttgggagaaagttaggggatgcggaggggtgggcgtaagatttttaggattttagggaggtcgtggggagggtcgtcgagggtgtagtgtgaggcgtaggagggggttgggggcggtgtacgttgtagggagacgtagtttttggaagatgcgagtgtgaatgtgtgagtgtgagtgcgtgtgtatgtgtgtgtgtgcgcgcgtatcgtagtttttcgggtttcgcgaggcgcgcgggtgttagtttgtagtcggggttttttttttcggtttttttgtttagttcggcggtttttttttttttttttttcgttcgttttttttcggcgggttaggggttgggacgtttcggcggagtaggcggcggcggtggcgagttggggagttttaggttcggcgttgtcggaggggttcgagtcgagtcgtttgcgtttcggtcgggtagcgtcgggttcgtttttcgcggggttacgttttgttaaattttgttgcggcggttagcgtagcgggttcgtaagcgggcgggaggggcgtcgggtcgggtcgggtagggcgcgggcggttaggggtttcgagagcggcggtttcggttcgcggttttattatgttttagttcggcggcgggggcggcggcggcggcggcggtagcgggggaggcggcggttttagcgtcggggcggtcggcggaggggacgatttcggggcgaacgacgagttgatttttttttaggacgaggggggcgaggagtaggagtcgagtagcgatagcgtttcggcgtagcgggatttagacgaggttaagtcgtttttggttaacgagtcggagaattagagtagtagttcggattcggaggtaaggaagtatcgcggttattttcgggggatttcggttttgcgttcgtttattcgtttttgtttttgtgtttttttcgtaggcggagaggcgttcgtagttcgttcgggatattttttagaagtcgcgggattatttcgtcgaaggtatgtgttcgttgggatagttttttattttcgattttcgttgcgtttcgttgtttagttcgggcggtttatcgttttttttgtttgggtggacgtatttttgtttttcgtttttattggcggtagttttcgtggggcgcgcgtggggggcgttggggtttttagttttcgtttcgagttttttgtcgcggcgttgttagtttcgggggtttgggttttatttcgttttggttttgttcgtagtgagaaggttttaggatagcgcgttttttaaaggattttcgtattttgggtatttttttttgatgatttcggatttgagtagttcgtatttttttaacggatttttgtttttcggaggagcgcgtatcgtgagtgttcgtcgggcgcgtcggggagggtgggaggtcgcggttcgtaggatgcgttttcgggtttggttatggagtgggggatggggttttttgcgtcgattttaagtagaatttgtttgcggagttgaattattttttggcggtcgagcgcgaggttgcgttggttagtgtttggatgaaagtaaagttattttaatttttttttttttgcgggttgaggttttggagtttatttttgggattttttttggtttttagaatttttcgtttgtatcgaaggaaatttggatttgtgttcgttttgggggggtttcgtttttttttttggaaatcggttagttttttttggtagtggggtaaggggtttagggagttgggttggcgacgttgtttttcgatttcgggtttattgggcggttgtaggttggtttttaagaaatttagttttcgtggcgggttatttatagttttcgtttttatttttagttttcgtatcggggttttagtttttttgcggagttagtttcgaattttaaattcgcgtagatgatttcgaggcgatttaaggtattttttaagttgaggaatttggtttttttttttttttgtcgtttgttttttttatttaaagcgagcgttgcgatattttaaatttgttaatgggcgcgtattgtgtgttgttcgttggtatttagagcggtgattaagtaaattgatcgggttttagacgacgtgtaaatgagggcggattttttcgttttttttttttggttttaaattttcgtttttcgcgttgcgaggggcgtagttgggggttggcgaggtttttgtgttttttaagtcgttattttatttttaggttttttgtttaggtgttgggttcgatgatagatgttgggtgaacgtttatttattgtgtgttaggttttcgcgtgttgttgtttgggcgcgatgtgaatcgtagtagttttttgtttttcgtttagatttttattgtttgttatttcgttgtcgacg

SEQ ID NO: 6377 - DNA, 1531 bp, Artificial Sequence
  Description of Artificial Sequence: Synthetic polynucleotide
tcgtatatcgatttttgcgtcggtttttgcgattcgcgttcgtttttttcggttgggaagtatttgttagcggtttttatttgggtcgttttcgtcgcggggtatttttttgaagtagtcgttgagcgataggttgtggcggatggagttttgttagtcggttttgttgcgttggtagaaggggaagttatcggcgacgaattggtagatgtggttgagagtgagtttgcgttcgggcgcgttttgaatggttatggcgatgagcgtcgaatacgagtagggcggtcgtattatttttattaggttttcgcggttggttatggatagttagtttagtttttcgggtttcgcgggcgcggcgggcgaggcgggcgcggcgggcgcgggttgcgcgaagggtcgttgagagtagtcgaagtgtcggcggtaggcggtggttgtagaaagggttcggtcgcggtttcggggggcggcggcggcggcggagcgtttaggtacgcggcggcggttgcggcggcggcggagggcgggttttttacgtcgggttcgttgagttataggtaggggttggcggcggcggtcggcggcgcggcgtagtcggttagttcgtaaggcgttttggttgtcgggggggcgttcggggcggcggcggtggcggcgggcgggggtaggtcgggttgcgaatatatttcgaagttgtcgtcgtagtagagggttatgtcggcggtcgtgggcggttgcggcgcggtcgcggcgaggggcgagcggggttggtttcgtcgttcgggcgagagtatttttttgggggttaattttgcggtttcgtttttattcgcgttgggcgttcggtgtttcgggtcggggtcgggcgggtgttagcggagcgtttgttagtcggttttttataatcgagttcggcgcggttttttttgggtcggttcggagcggggcggtggtcgcgggtttgggttttttacgttttcgttacgttttatttgttcgcgcgtttaaattcggagttcgttcgtttcgtttttatcgtttttttgttcgggttcgggagcgtttgggaggtcggcgtttttaggtttcgggtaaaaagtagtattttatttttagtttacgttttttaatattataataagtaaagttacgaatattaaagagaagataattcgaatagtacgaatgatttttaaaaagttaatttggggtggtcgttcgggttatttgtttagttatttttttggtttttttatttttttttttttaattttttgtgatcgagtcgcggaatttacgtttagttttaatcgatcggtttttagtcgaaaataatcgatgtgatttataacgttttggggtatacggtagaggttattaataggttcgtttggcgtgttttttttttttcggggattttgtgattggaggaacggaaattagtgttgagtttttttaattaaattgtaggttcgtttatattcgggaagtatttattcgttttttgtgcggtttgtacgggttttcg

SEQ ID NO: 6378 - DNA, 2045 bp, Artificial Sequence
  Description of Artificial Sequence: Synthetic polynucleotide
gcgaaacggtagaggtcggtagttcgcggtttacgtgtatttgtttagggaatcgttttagcgaaatttgattcggatcggaattttttcgtagtatagcggtcgtgtttatcggaatggaacgttataagttgttatttgtattttttttttagttttgatagggaatacgcgttgtttttacgtttatatcgatattcggatttttatttagttcggttagagttttaggggttagggattagtgtagggagaaggttttttattttagtttttaggatttttaattatagtttattcgtttttattttgttcggttttaggtttagtcgaatttatatgttttcgtagtgtcgagcgttattatttatagtcgttttttaaattgtgatttttatttgggagattcggaattatttaggattttggtgtggggggtagtattttttatatttgtttttcgaaaattgttatggagtagtcgcgtttcggcgggtaggtgagggggtcgagtttattagcgtcgtagtttcgttgtttattttttttagcgtcggttgtcgttttcgggtagatatcgtcggttttgattttggggttgatatcgttaaagggtagttagtgttcgtttaggttatttcgggaggtttaggggtacggcgaggggtcggggaaaggcgatcgtttattatagttcgcgcgtttagattgagggaggagtcgggttgtagaatcggcggcggatggagacgggagggaggttgcgaggtcgttcgaggagagattaaggttttagaaacggagaagcgggcgttttgcgggaggcggcggcgttgtcgttggtcgttaagggcgggaagtgttttgggatttttattaggggtcgcgagtttcgagcgttaaattttcgcggcgttcgtttagcgcgttgttgtggcgggcgcggagggcgcgcgtcggtagtgggggttgcggcggcggagggtacgggttttcgtttagcgtttttatttttttggtgtagttgtttttcgcgagtcgagatatttttgttagggaagaggagcgtttcggttgtttttttagagttttttgttggggggatatcgtttttatgaagaaaatttttaaataaattttagtttaggaggaggttatacgattatgttcgcgggttgtcggtcggaggggcgaggacgcgcgggcggaggcgcggttgtcgtgtttaggtagggagtcgagtttcgggtgttcgtcgcgcgtttttcgtcggggttatgtattttcgtttgcgttcgatatcgcgggttggaggcgagtgtagcggcgatagttcgttagcgtcgcggttcgtttcgtttcgggttcgtttttttcgtttcgggcgttttgcgtcggggttcgttttcgtagttttttttagtttttttttagtttgggtttttttagtttcgttttagtttgtggcgcgtttggcgggcgtttttttatatatgttagtatatcggttatcggttgattttttcggtttgtgatttcgcgtgggtgtagttcgtaggagtttatcggtttgtgttacgtacgggggtttttagtgtacggatacgcgtttttttcgttatttgtttatttttattagattttattttttttcgcgtcgtgttcgcggcggaaggcgtttttgtagcgcgtgtattcgcggagcggtggcgattttagtttgagtagaggagttgtagtgatttttgtttcgtttttagcggattgcggagggaattttttattttattttattggggatagggtggtacgtcgtagagtgtcgtagttgtataaatttggaagtttatagtatcgtttgattttttgtgtaatttcgaacgttagtttgttcgggtaattttgagtgggtttttgtagtcggttatgttagcggtttttgtatatttgtattcgcggttttcgttgtttgtaggttgtagagacgggggtattttaaacgtgaaagagtaatgaaggaaaatgtagatagagcgaggacgtcg

SEQ ID NO: 6379 - DNA, 476 bp, Artificial Sequence
  Description of Artificial Sequence: Synthetic polynucleotide
tcggttcgcgcgggaggagtgtgatttaggtgtcgttttttttcgtcgtcgagggttaggagttcgggagcgcgattttttttcggttcggtttggttcggtttggttagttttcgcggtttttgttcgggttgacgtttaggaatgtggtcgacgagaagttttaatagtacggcgtggttttttagtttcggtgagtattcgtcgtggggaagggttttggggatttattggaggtcgcggttcgtagtagttaggggtcgagttacggttacggacgttttggtgtttcggttcgtgtcgggtttttaggcggaggaggcgttcgttgggtttagattttcgattttagtttcggtttttcggcgtttgggttgcgcggagtttttgtttcgcgtttcggatttttacgcgtagtttttacgcgtttcgagttggagaagtcgttagttcgtttttttagggcgtgtcgttcg

SEQ ID NO: 6380 - DNA, 455 bp, Artificial Sequence
  Description of Artificial Sequence: Synthetic polynucleotide
acgcgggcggcgttcggggtttgcgggtaggtaggcggtttggtcgcggaggttttttcgagttttgcgtttttttagagagggaggggtttatatcggttggtatagttattacgggtatcgaaatttggggacgtgttcgattatgtttttttcggtggttcgggggttatttcgtattgtttagaagtttcgtttttcgttttttttttttggtttagtttattattttttcggtgattttgggtatgttacgtttattttttaggttttagtttttttatttgtgttgtgaggagtggaaggaacgggatgattaggagttttttaagatcgagtattcgaggtttttttcggtttcgcggagttaggaggtgttagtcgagatgcgcgtgtcgcgcgcgttttttagtgttcggttttcgtttttgtacggttttcgttgggtaagggcg

SEQ ID NO: 6381 - DNA, 749 bp, Artificial Sequence
  Description of Artificial Sequence: Synthetic polynucleotide
tcgggcggcgcgtttaggtgtaggttcgttttgcggaggagggcgggggtcgggtaagtagagggcgtttagttcgggggcgtcggtttgggttgggcgtttagagtttatttcggcgcgcgggtcgcgggcgcgtggggtagtggtttttttagtcgggaagttgttgtttacgtttcggtggttgttgcggtttcgttagggttgtatcggggtttcgcgtagacgttttttcgcgatttgttgtagtttaggcggtggcggtggcggtagtagcggcggcggtggaggtggcgcgggcgatagttcggttcggcgcggtttttgaattgtttaatttttgttcgcgtcgggtttaagcgttcggtcgttgttttcgcgttgagcgtttgcgtatcgggtttcgtttaggtgaggggcgtgtgttcggagttcgttgggcgtgttcggttcggttcggtttcgtcgtacgttcgtttttttggtttggttgaggatttcggggtttggacgtgttaacgttattttcgcgcgtcgaagttgtgacggtttattaagtagagatttgcgaggtatatagagagggaatgaggcggaatcgttcgggggttcgttgatattgtagagtttttcgtagtatcgttgttttaaatttcgtttttttaggcgtgcgcgtatagcgagttagaggaggtttcgtttcgatttggggtttttcgcggtttttagttcgggggttcgggttttcg

SEQ ID NO: 6382 - DNA, 1134 bp, Artificial Sequence
  Description of Artificial Sequence: Synthetic polynucleotide
tcgaaaaatacgttttaggcgtcgggattttagatatttgggaaatagagtgtacgtagttgttgagaggtttcgcgtttggttttttttattattgaggcgtagaggtgttgtggatagtttagatttatacggcgttcgaggtgaaatagaatttttagtttttttatgaggttattggtattttcggttgtttttagagtttttcgatttagagttgaatgtaaagtaagcgttcgaaatgtagaagtagtcggggtcgtttacggtatttgtttcgttcggggcgagagaagacgttaggttgaggttttagcgattttaggtattagtttcgaaggagggcggggagatcgtaaaggggaagtgttcggagggttaacggttttcgcgtattttgcgtttttttgaagcgcgtcgttttttcgcgtcggggattgggatttgtttttggggaattcgtttagaagacggcggcggattggggtcgggtattttttagggttgttaggttttttttagttttgtatttgtcgcgtcgttttatttcgttaggaagttttagagatttcggggatggggtgggagcgtttttttatcgcgggtttaaaaagaaggaaggacgtttttaggggtcgtagaaggaggattagttttaagttataatttttttcggatttaaggtaggtcggttggggtttcgcgtttatacggtttttggcgggggttcgcgcgtttcgggagtttcgcggttcggggaggaaagaggagataagagataggcgaggattacggggttgatttagtcggggtagggattatcgtggaaaaattttggcgaggtggggggacgcggaaagagagcggttcgcgttttgtattttgcgtcgggtatttcgcgttagtgtttcgtttttagtgtttcgcgtttcgcgtttcgcgttttgtttttatttcgggttagttgtatcgcgttcgcgtcgtaggaatcgtggagttggaaagtgggggcgtcgcggttggggggttgttttagttgcgtttcggttagcgatcggcgggtcgggtttaaatttagttaggttgggtaggcggtggtcgcgcgattggggatcgggcgtttcgtttttttcg

SEQ ID NO: 6383 - DNA, 1645 bp, Artificial Sequence
  Description of Artificial Sequence: Synthetic polynucleotide
tcgcgtatcgaattcgagttaggtttggttttagggtagatttaattatttatttcgatcgagttttcgaggtcggcgttttagtttttatgtttatttttcggagacgtttcgtggagattttggcgtttaaaattgcgggagtttatttattgcgtttaggtggttagtttttgagttttttttattcgtggttttttgtcggtatgtaggtatgtataagtatatcgtcgagtaggaggatttaacgaatttagtttgtggatatgttttaatttttattttcgttttttttaggtttgtttaggtgaggatgatgggagggaaaagcggtgtatagtcgtaatattggtattttgtaagagtcgtcggggtattgatatagagggatatcgtattggagatgcggtgtttacggagatttattgcgcgcggtgaaatattttaagtatcgcgcggaataattgggtttagtttttttatttcggattttttttaggattatacgttattttttattttcgaatttaggggtttttttacgttgcgtttatttgttttgtttcgtaatgattattttagtttggtggcggtggaatttgagttatagaggtcggttgtataggtagacgtgggtacggaagttagaatttggaatttttaggttttttagtttttcgtaagatttcgtcgttgcggttttagggtacggttcgtagagcggagttttttggttgtattgataggtgttcgggtcgtcgttttcgtcgttgttatcgttcgcgttattgttcgtatcggtttttgggtcgaattgcgttttttcgggtgggtatatagtcgcggggaagtcgtcggggggtagtatggagtcgtaggggtagcgcgtttcgttaggagtcgggtatataggttcgtggggcgttttagtcgtcgtttggtacgggaagagtgagtagggcgtagttagtttcgatttttgaggatcgggggattggaggtagtatcgttcggagtttaggttgtttatggagtagcgtgtagtggtcgtagtcgcggcggcggcggcggcggcggttgtagcggcggagggtagtttttttttttcgtagggggagtttttgcggtcgttcgggggtttcggtttggttattgtcgtagcgttggtaaatgcgttttcggcgtcggtgttattaagtatggtcgcgggggtttttgcgttggcggttgcgggtttttcgtttatcgtttcgtaggagagattgtcggaaaattttttggacgttttgtttaagtttaatttttgaggagagggggtcgcgttggggaggtggttagcgttttcgtcgttgtcgtttcgcgtattttttagcgggtagaagtgcgcgttaggtaggtttattgagtttattaagagttgtttttttaattgtatgttttgtaaagcgtagacggtagttggttgttttttttttttcggtggttttattataaaggtaggatgggggagttagcgttttttttcgaggggaaggtaattttttttttttttcgcgtcggggttatttatttgtcgattcgcgggtcgttattgcgcgtattggcgcgttttgaatttagcgtttttttcggaaggaaagcgtcg

SEQ ID NO: 6384 - DNA, 4698 bp, Artificial Sequence
  Description of Artificial Sequence: Synthetic polynucleotide
gcgtttcgggaacgttttttcgttgtattttataggaggtcgtgggcggtggtttaatagttttagtgtagagtttgaattttatcgtttagaaggaaaggtgagtgggggattcgggcgggaggtgaggtttgtcggtagcggtttttaggcgtgttgggtagtacggttagtagaggcggcgtttggttttggatgttgtagcggagacgttaaggagattgaatgtagggagcgaggcgtagcggtcgcggagggtggggtcgttcggaaatttaggcggcgttagttttgtagtatttgtaggtcgggggcgcgtatacgaggggtacgtgggtgtggaggaatcggcgcggcggggttttttttttgtagcgtcgcggcggtcgagtgttcgtgttggaggaacggcgagtggggtgtttgtttcgcgtaggcggtattcgtcgttttagtttcgtatatagtaggtacggttagggatcgggatcgtggtttagcgtttggaggcgttttttacgcgtatttttttcgatgtcggggcgggaagtcgagtggttttgttcggagatgttaggggatgtgggtaggggacgaagaggttttttaattggttaaattttggtttgaggaaagattgaggtggttattgattcgtgggagcgttttggggtttcgagggaacggtagtcgagttcgggagattggtgttgggtattcgcgggggtcggcgggttttacgtgggtggatttcgagttgagggtagggtagggtcgcggatcgttgatttatgagtttttttattttcgtataaggatatttgtatatggattcgggtttttattcgtttttggttgggttggcgtcgggagcgcgtaggggagggacggcggcggagtgcggggtttggcgggtgaggtgggtgaggtgtggtcgcgggggagggggcgaaggtattagaaggttgcggtcgcgttgtcgttgttgtttttatcgtcggcgcggggcgcggagggggcgaagaggtgtttgttagtcgtattgcggtttaggggtgaaaggaaaagggtttatgtaaaggagaaagggtaggtagagatttttgttggtgttagtaggtacggaaggatgtggtcgcggggatttggagtttagagggtaacgttgggtgttataatgtcggagatgatttcgggtgtagaggcgattttagttgggtagagttatagagaacgtggttcgagaaggggagtttttttaaattagatatattttgtgttgttttaaatttagtatttatttttttttatttcgtttttataatttttagggttttagcggagttatttaagcgtttagtattattagttttattttaggtaaaaattaagattaattttgtattttattaattttttcgtatttaagttattacggggtagttttttatagttttaaggcgtggttattttaagtttatagcgagttgttcgtgttttcggtttttgtttcgtaaatttcggacgatgttatcggaggacgttgaaggtaaaggttggtggggttaggcgtcggcgagattgtcgcgttagtatagttttcgcgggagtcgagtgttgacgggtttcgcgattttttttcgagggtaaacggttcggttttttagggatatttggttagtgttattttttttttatcgggtgtcgcgtatttttttaatagaacgtgatttcgtagacggatgaattcggaatcggtaaaattcgtttgtttttgtttagtttttttgttttattatattattgttttttattgcggattgcgtcgtgtgcgtttcgggatcgtttttgtatttttgtttatagttttttattattaaggtagtcggaggaagattttttcgagttatttgttttacgttagtagttatatcgaggcggtttttttcgtattattttttaagtgtagagtttttgaaagttcgaggtttttgtgttacgtatttttttttttgcggggcgatttcgcgtatgcgtgtgtgtgttacgcgtttaatcgtatagagtaatttttagacgtgtaagataaagtattttaagtaaagatggtttagagtttaaattggaaagtatatttcgaggcgttgaatttgttttcgtcgtttgtttcggtttttggggcgtcgtatttaggagaagggttttaattttttgttagattcgttcggaattagtttttttggcggtgtagtaataagtggtttcgtcgttttttttgtgtattcggagggattatatttttttttttttttagtttttagtttaaacgggagtaggtaatggcggggaaagggggaggtgacgagagcggggagaaggaagtatatattttttaattgtgaaattgtttgtttgcgtgttgtgttttgggatttttttgttttaattaattttaattttaacgtggtcgtaacgttaagattaagatttagaaatgaaaacgtatttattttttttattataaaggtcgtttgttgttgttgtttttttaaaatattaagtaattttttttttttttttttacggatttatattttgtttatgagatttttttaattttggtggtttggagaaatgaggtgggggaggggaggattaagggtagtaagacgtttattacgaaaataagatatttattaatttaatagggtcgtttttttttatataagatgtttttttattttttattaatttataataggtaaattttgagtttttttaaagtttcgttatttagcgtttatgttcgaagttttacgaataaattttttttttaggtaaatttgtttaatttttgttttatgtttagcgaagtttaggtacgatgggttaaggatttttggtttttatattgtttgagttacgttttagttggaaaggttattttgggcgagggacgtgttgttcgattggtttaaataaggaaagaaagtggagtattaaagaattaagggtttttgtttttttttatttcgttattattattatcggttttcgggttttgttgagcgttgcggcggttttggttgaaaattgcgttttcgtttaaatcgagcgtaaaatttttttggatagaagtttgaaagaatttagtgtagaaatagattttttcgtttaatttggttttaattagtaattatataagtatatttatataattatttaagtggagagtagacgtttagatttacggtttttacgtgttgttggagttggcgtagacgcgtgtgcgggtatagcggcggacgtgatatcgtatttttttcgaatttttgttatttagggtggtgtcgttttaagagggggtcgtggggaggtggggtaataggttgcgtaatttatttgttttgggggagtttagggtttagagtagagcgtaatttcggggggttgtcgtatagttttatttttttatattagaagagtaatgttttttatggatgattaatagtcgggttttttttgattatgcggcgcgtttttgtcggtattatttagttgttttaatttgatttttattagtaacgtgtttttagaggttgcgagttggattcgtattacgataacggttttttttttttttattcggtcggttttttgggaaggatcggggattgtagttttcgcgacgttttttttttttgcgtagggagtaggtttgagtttttttacgtaatgatttgggagattttaggtatttcggggtttggtcggagggttttcgggttttggagttgggcggtgtttgtagtgtatcgtcgtgagtttttttcgggtataatgtgttggtgtgtagagaggaggaaaggaaaaaaaaaaaatttaatattatttttaagtggtattggtatttatgaagtggtagtggtttatattgagcgtgtttttgtttggaggtgtagggggcggttattgtagtcgaggggagggtattgcggttaagggtagggcgagaggatagttaaggtcggttggtcgcgtgggagtttttttttttcgggtttagcggtcggaattattagtattgcggttaaaggggttggtaggtttttttgtatttcgcgtgttttttcgttttttttgtgtttttcggtttttttaggaggaagatggggtgtttatcgcgaatggggcgcgtcgggtcgtttggtcgggcggttacgtgttttttttttttcgttattgcggcgggagttttaattagagcgcgttagggggtttttttcgggtaggaattattcggttcggcggcggagggtgggtcgtcgttatttgatcgttcgttttcgtttttcgcgagtaaggggcggtggtagcgtttgttcggttataaatggtttttttcgttcggttcgttcgttcgttcgggttcggcgcggattcgtttgggcgtgtttttttcgtcggttttaggcgttttatcgttttgttcggcgttagttcgcggttttagttatttttgagggcgcgtcgggtatttagcgcgtaggttcgtttacggaggtcgatacggaagtttggatcgtcgaggcgtgtggttcgtttatcggtaggtgagcgtgtatcgcgggcgtgggatgttgtggggatagtgcgggggacgtgtggggttttcggatgcgaacgcgagttcgtgcg

SEQ ID NO: 6385 - DNA, 462 bp, Artificial Sequence
  Description of Artificial Sequence: Synthetic polynucleotide
tcgttgggattttgtgcgcggggtacgttagcgattataaacgtgttttaattttgttgagttaaagttttggtgttaggcgttgttttttttttgttcgttcgagtttcgtattttttggtttttttttagttggtgttgtgtttagttttttttgggtaatttatttaggaattcgttgcggttatttttcgttttttttttaatttgggtcgagtaataagtggagttagaattaattttatgggcgagaggagtacggaggcgagtggagcgcgttgtcgttagaggttgttaaggaggcggggtggttagcgcggggggtggaggatgggggtaggacgcgggagggaagggtagggggtggggggcgaggtttcggggattagcgcgcgagagtgtttagttgggaaatgtagtttcgaattaatatcgtatgttttataattagtttacgagtcg

SEQ ID NO: 6386 - DNA, 300 bp, Artificial Sequence
  Description of Artificial Sequence: Synthetic polynucleotide
tcgaattggtttgttcgtggcgggtttgtttaaagtataggggttttcgttttcggtgcgcgttgtttttaggattagtgttgttgggagataaagagttttagatattcgaggttgggagcgtcggagagtttttaggtttcgggtattttttcggagtacgtaagtatagttttaggtttttagggatagatgggttagagtcgtttgtatttgttcgtattttttgggaggttgcgatgatcgtagttagggtggtcgagcgttcggtttattgtattcggcggttgttttgtagcg

SEQ ID NO: 6387 - DNA, 554 bp, Artificial Sequence
  Description of Artificial Sequence: Synthetic polynucleotide
tcgagatatttcgggcgcgagcggtagtgttgtttgtttgtttttttttttttttagtttttttttttcgtgatttatttattttttgtagttttcgttcgtattttttttaatatttcggtatttttgtattatttgttcgggtagtttcggcgggttttgggatttgttgtgcgcgtcgagaggaaggtaagttttaaatttttgtttggaagacgggttgtcgcggttgtattattagtaggaggaggaggagaagaaattatttcgcgatattttattttgcgggtgttttgtcgttgtcgtttttgttgtcgtcgattcgagttcgcgggttcgaatatcgtagcggtggggacggtgggttcggcgggcgtcgggaggaggatattagcggagttttgtattttcgtgtttcgtttattagtatttatttgttttttcgttttttttttagttttttagagaagggattatgatttggaaacgtagcgtcgtttttcgtttttatagtgtttgcgggtttttgttataaggtaattttcgtttcggcg

SEQ ID NO: 6388 - DNA, 1153 bp, Artificial Sequence
  Description of Artificial Sequence: Synthetic polynucleotide
tcgtttttttcgtagagatcgttagttgaggttgtaatatttgtttcggtaaagcgttttcgtagttttttcggtttgttcgattcggtttttttcgtttttgtttcggttgcggtattattttttggagttacgtttcggcgagcgggggtcgcggagcgagggggtcgttgtgtcgttatttattcgagtcgttcgggttggtcgcgagtcgggattcgcgagggttggcgggttttggttttcgaggacgtagatatgtggtttgaattttcgtttttttagtcgttgtttttgtgtatttttttgggcgtttttagcgaatgcgagcggcgaggcgagggcgagcgcgtcgaggaagggcgggagaggcgcggagtttggtcgcgtcgcgttgcgtcgagcgtcgggtttttttcgcgagtttttcgggttcgcgcgcgcgttttttattgttttcgtttttcgcgcggcgcgtgttttttatttttcgtcgcgcgttttcgtattcgttcggttttacgcggcgcgcgtttgttttggcggtagcggcggcggcggcggcgcgttttttttcgaacgtcgtttttagggttgttggttgcgttttttattgtttcgcggttgttgttcggggtgggcggcgaggcgggggggaggtgtcggtttggtcgtcggggagggtttatcgttcgggcggatttttattgcgagagcgatgcgggtttaggcgcggcgcgcgggggttgtagggcgtttagtattgggggttgtcggcgcgcgggggtttttttttggtttttaggtattcgttgttgttgggcgtttttcgtattttcggttattatggatatttcgttttttcgtcgtttttttcgcgtatttcgggaggtcgtcggggcggtagtagcggcgcggtttcgcgggtgtttaggtgatcggttcggtagcggtagagtagtggtagtagtcgttattgtcgttgttattgcggtcgtcgtcgttggagagaggaggacgaggagggtaaggggtagaagtaggttttgttttgtttgttttagaggttatttcgggtttttttttattaattaagcgatttcgtgtttatttcgtaggagacgtttcggtagtttttaatttgtgtgcgtcg

SEQ ID NO: 6389 - DNA, 1603 bp, Artificial Sequence
  Description of Artificial Sequence: Synthetic polynucleotide
gcgatacggtttttttgacgcgtttttaattaaggcgttaagtttagtttgatagtattttttttttttttcggtttttggtttgatgagtcgtttttatttgcgagcggtgtaggtatttttgttgtcgattaattttttttagcgtcgaattggcggtattcgagtcgcggttgttaggtcgggagaaggttgggtttggtcgggttttgtagcgtttcgggtttcgtttttgttttgggcgttcgttttcgtcgcggggcgaggtggtggagatcgcggacgtcgagggtttttttagttagtacgtcgcgttgtttcggttttggggcgggggtcgcggagttttattaagtggttcgcgtttcggttttcgggagattcgagcgcggggagggagtgggtgtcgcgagggggcggttcgcgcggggagagtcgttagtttacggcgtttttgcgttgttgtggatgtggttacgcgttattcggtttttggattgttaggagagcgcggttcgacgttattacgtcgtggacgttcggggatttttgaattttagcgttaaggttgcgacgatgttcgtgatttttatcgcgaagttattttcgtaaggcgacgtaaggatttcggcgatttcgggcgtcgtatattcgttattttttagttttatgtaattttttttttgttgttttttttcggcgttttgtttttttataattggaagtcgcgaaggcggttattgcgttgagtcgttcgttttgttggttaagtttgggcgattcgcgcggaggagggtcgggttgattgtcgtcgttgagttgttttcggacgggagcgtttgtttacggtatttattttttttagcggtggaaatgtggagaagtaagtgggaggcggtgtcgggaattgattttttttaaaacggtcggcgtcgttgttttgaaatgggcggttaagtgtttgtgggattaagggcggttttagagatgttcggaaaatcgttgttacggttagagtgcggcgtagacgcggtagagttggaggtgttcgcggtgtaggttgttgtttacgtcgtttaggttaggtgttgagggtttagttcgcgtttcggtcgaattatttttagtttcgttgagttatttcgttcgttcggtttttatcgtatcggttagaggaaagttttcgcggtttttacgtttttttatagttgtagcgttttttttgtttttggtttcgtaagtgtttatttgagtcgggagaggttttcgggtcgttttaattgttcgttttatttggtagttcgttttcgttttcgttttcgcggtgaggcgtttttcgttttttcgttttttttttttaaattatagttcgagttcgtttttgcgcgcgcgcgtttttttcggtttaagtgaatagttttcgcgtaagcgggatattgtggtggatgtaatttttttcgtttttagtcgcgaggagtttttcggcgtcgtaggtagcgttttttttcgaagtagttgtatttgtaattgggtagtttggattttcgtgttttgttttcgggatttcgcgtagggggcgtttcgggatattttttgcgggtcg

SEQ ID NO: 6390 - DNA, 1411 bp, Artificial Sequence
  Description of Artificial Sequence: Synthetic polynucleotide
acgattagcgttttcggtgcgaggatggaaagaaattttagaaaaattttcgttagataattcggtagtatttggtttcggaatagagaggagagaaagatttgatcgtcgtatttagggttattcgtcgtattaagtttgagggttttttttgtttttaggtttttgtcgttcgagtttaggtttttttaggtgttttagggtcgggttgtattcgagtttcgaggaggttttgttagcgttagcgcggcggtgataatcgagggaggtgggtgagaggtgcggttgtcgaggtaaacgtagagtattcgtttagttttttaagggtcgagagtcgggagtttcgaacgtcgtttaagtagttttttgtttttcgtagttcgtttatatttttgcgggatttttggacgtttcgttcggggatttagggaggagggagagaggagggagggagtgggtagtttgggcgtacgttatcggttttcgtacgttcggtatttttcgtggcgcggcgagttaatgggatttgtatattcgaggtgtaatagtattattgtattaattattatttttattttacgtttagattgtttatttatttgcgggaaatatatgtcgggagaagtttatatttcggattttgtttcgttgtttaaggtgtaatttcggggaggcggcgaggggggaggggagggttttagattttttattatattttttagttttatttgtcgttgtaaattatgaggattttttattgagcggtatatggagattatatatttttttgaatatcgttttttaaagtttgtagatttttattttgaaatgaaataatttttcgttggttttttcggggataggcgttttttgcgttttttcgcgcggtttgggggatttttttcgtagagtaggcgcgtattttaatgtcgtggtcggcgtttagtggagattttttttatagggtttagaataatttttcgcggaatatttatttatatgtagtgtttgagaattaaggtagtttttttgttttgtttttttgcgtttagttttcggatttttgtgtcgtttgtagtttttttttatttcgaatattcgtatagacgcgagtttatttttgttttttttttacgttgggcggttttaaattcgtcgcgagggttgaggtgtttatatttgtttacggtagtttgtttcgtttttaagcgttttaaagttttttaagcgtttatattggttttgggatagtcgattttggtttttttgtttgtttgagggatcgcggaagtggcggggaatgtgttttcgtttgagatcgtttattgtgagtttttaacggaaattttgtacggaaggtaatcgttttttcgttcgcggtaagtaggatttattcgagtagcggggatcg

SEQ ID NO: 6391 - DNA, 2629 bp, Artificial Sequence
  Description of Artificial Sequence: Synthetic polynucleotide
tcgtcggggttcggaggtgttcgaagcgacgggattgatagcggaggaaacgtagttttttttcgcgttcgttcgcggtgtaaatcgagtataggtcgtggagttaggttgtttcggttttcgttgggttttaattttcgtttcgtttagtgggtttcgcggtaagcggtttttgaatagttttaagagggttcgcggagtaaatatacgtattggttcgtttttttttcgggtagcgcggtttcgttattagttttgttcggcgcgtttagttatggattgtacggtagtcgggcggggaacgcggagagcgagcgtatcgatttgtgagagaaggttaagaggtttgcgttgtcgacgttcggtcgtattttcgtttcgggtttttttcgcggtgaatttgggtaggagacgttggggtttcggaaagagacgagtttagtagaaagcgcgtagagaggtagttttaggttaggggagtgtaaggttatagaggttagggaggtgagtataggaggatataaattgaggggataaagaggagcgataggagtttaggaaagcgaaaaagtatagagggattttgggcgttggttttagaggcgggtttagagggtgtgaggttaggttggcggcggcgtcgtcggttgcgatcggggtcggcgtcgcgcgtttttgtattttcgtattcgtttgtatcggtatgcggtgggtttttagagatcgaggcgcgaatgtagcgcgtcggttttgttgtcgtggttttagtaagagtaatgtattatggcgagttcgggttgtcgggtataagcgaattgtaggttcggcgtattggtgggcgcgggcgtcgggggcgcggcggtggttgggttggtagggttgagttggttcggcggcggcgcggcggtttcgtggtgcggtggggtaggcggcggtgcggcggtcgcgtgtagatggtgtgcgtgcggatgcgggtgggggtgcggcggaggcgggggtgcggtcggcgggttttttaggttattgtacgagtttattacgtcggggggtagcgttatgttttgtacgcgtgtgtacggttcgtacgaggcggtcgggttcgttagttttttgattatagcggtcgcgttagggttatcggggttcgcggttgtagtcgtagttgttgtagtcgttgcggttgtcgttatttggtaggaggtatagggtatgggtgagggaggttgcggtagcggttacgagttgttgaggaagttagattgtaggtatttggggggcgttaggtagtcgtagtcgtcggtttcggcgttcgttacgtcgtattcgtttgcggcgttttcggtttcgaagagttttttgtcgggttggaagtgcgcgggcggcggtcggaagggtttttttatgcggcggcggcgtcggtagttgtttttttcgaatatgttttcgtaggtcgggtttagcgtttagtagttgtttttgcgttcgtcgtcgttttcgcgcggtattttgatgaagtattcgttgaggttgaggttgtggcggatgttattttgttagttttttttatttttttcgtagaacgggaatttcgcgatgatgtattggtagatgtcggatagcgtgagtttttttttcgcgttttcgcggatcgttatggcgatgagcgttacgtacgagtacgggggtttttgcgtcgggttcggttttttcggggttgtttcgtcgttatttttatcgtttttgtttgggttcggcggcggtttttttggttttttgattgtgcgatcggtttttggggttagtagggttttcgtcgcgttttcgggttcggggtagttggttattatgataaagtcggcgcgtcgcggtcgggtcgtttttgtttttcgttttaggcgttggcgcggtaaagagttggggcgtacgagttcgtttacggttaagttttaaatttttggagattgcggatgtcgttcgcgtttgtttgttggaggtttgtcgttgttttttttttttttttttttttttttagggagcggtcggcgggagtggagtttagtttttggttatggggagttcgtttaatagagaggggtttcggtttcgtcgttttttttcgtttaggttagttttcgttttggtgggtttttttttttgcgtttttttttttttttcgtttttcggtttttcgaagtacgattcgcgtttttggcggagttgttttttggagtttttagtgcgttaggagtttcgttttgttttgattcgtatgggttttatcgagtttcgtttgcgttaggcgttttcgtttttatagcggggcggttagtcgcgtacgggcgagtttatttttaagttattttttgtaaacgtttcgtatagtttggatcggtttgttttcgtttagcgagttttaggggtttagtcgatagttaggtttacgcgtttttgaaatttgtcggtattcgttttgcgggttgggttgggagatgacgaggatttcggtggggtttgttcgtattcggttaaagtttaggaagttcgggttttagcgaggaaaggcgttttaagttttttcgcggtttttaggtgaaagaaaacgatttttttgttttgtcgtttgttgtcg

SEQ ID NO: 6392 - DNA, 1686 bp, Artificial Sequence
  Description of Artificial Sequence: Synthetic polynucleotide
tcgcggttgtttttgtttttcggagatgacgcggagttttgttattgttatttaggtttaaggttatttattttgttcgataatttttagtattattaggcgttgttttagtgtgcgtttggcgttttttttagattagtcgacgtagaacgtttagagatttagttaagggtaagatttttagcgacgttcgttagtttttttcgtttagatattagtttaaagggtatggtaggttagggtttttcgcgttattttagatgatttttaggtttcgggtggttattttttgggggagttttttattttttgcggtagttttttcgagagtcggagtggaggcgcggggttggagggtttttcggagtcgtttattagggttttttgggggttcggtttcgattgggtagggggatttggatagggtttcggagcgtggagacggttgaggaaagttgggggtcggggttttggggcggggagcgcggaattcggcgtcgatgttcgcgtttatgaatatgtacgagttattttttttttttcgtgacgttacgggtcgtttcggggtgagcgtttgagtcgtttcgggttcgcgttagtgagcgcggttgttgtcggcgagttagcggcgtagcggcgggaattcgaggtcgagcgtcgcggcggtagcgttagaagcgtatttatcgggtacggcgaggcggtttacggtgcggtaggtatcgggaggcgagagtcggcgcggatagtaggcggcggttgtagttcgttggcggttgttgcgaggatgttgtttgggcggttgtgttgggtgtcgtttttgttggcgttgggcgtggggagcggtagcggcggtggcggggatagtcggtagcgtcgttttttcgcggttaaaggtgggtgttggggaagtttgttttttttttaggagggaggtagggtaggtttgagggtgaaagcggtaaggatttaggtttaagttggatttgtttatttttttttgtcgtagtttttttggtttttgtgcgttttggattttcgaagttagttttttgcgtagcggattagagaggtttattcgcggacgttaatttaatttttgggcggggttcgggggttgagtagaaggcgaggtttggggagtacggataattttgagggttgtttgtgtcggggtgggagcgtagtgggtgagtttcgagttttggtttagggacggttagagtagggcgttggcgcgtcgtggggataagtaggtgtttgtttttgtttgggggaaggattagcggcggtgtttttaaggagggagtcgagttgtgatttgttttttagttcggggatggagtggaaatttgtaggttttagggaaggtttcgttgatattttttaagtttttttagggcgtttttgatttttcggggaacgtgtatttttcgggtaggcggcggggttcggaagaagcgcgggatgtgaggtttttcgttgttttttttatttcgttttgattatcgaggatcgaggagtttaatttggtattatttttttgtttattttgtttttttgaagagtttgattttttcgcgtttttcgttcggaaggaagttagatttaagcgaacgtttggttttgttaggcgagtttggaagtcggcgaatttcggattttgatagttgtttgggagcgtcg

SEQ ID NO: 6393 - DNA, 1686 bp, Artificial Sequence; identical to SEQ ID NO: 6392
  Description of Artificial Sequence: Synthetic polynucleotide

SEQ ID NO: 6394 - DNA, 2132 bp, Artificial Sequence
  Description of Artificial Sequence: Synthetic polynucleotide
tcgagaaagtgggtgcggtaggcggcgtttggaggaattggcgtaggtttttttttacgtagtatatttggtcgtagatgttgaggaaggtgaagatgtggaagagttggtggttgtggtcgataatgtcgaaaagattcggttggatgcgttcggggattttgtttacgttgaagaaggcggttattattagttagaagtagcggcggtagaagtgtacgaagagtgtggggttttttttacgtaggtcgaagagttagttttcgagtataatggggtaggttatgttgagcggtatgacgaagacgaaggtgcgtagcgcgaacgggtaggtatattagtcggtacggtttttgtagtaggttatagtgtaagttatcgttagtacgaaggttataggtagtattagggcgcggtaggcggcgataaggcgcgtgtagtttacgtgttagtttaggcgttgttgtaagtatggagttatgattttggtatttagtaagttgaggtttggtaataggtagtagtagtaggttatcgtgttgtcgaagtcgtagtagttgatggacgcgtagtttaggtagaagaaggcggcgcgtagacgtagcgataggtagttgaatacgtgcgtcgtgtagtttatggcgaaggttagtagtattttcgacgcgtagtattataacggtagtagttacgggtggtggaagggtacgtcgtcgtcgtttaggaagaatagacggtagaatttgtttaggaatagtagtagcgggatgaagtgcgtttagaagttgagcgtttcgttggtaggttttagtatcgaggttaggtatttttgggtcgtgtacggtagacgtcggtagttcgataggatgaagtattttacgaagtcgtcgggtatttcgttttagcgtagtagcggtttggtagacgttggggggtttcgggaggcggtagagtgggagtttcgggcggttttcgaagttgtcggggtcggggtcggagggttttttgtgttcgcgtttcggggttgtaggcgtcgcggtatggtgttcggggttcggttagggcgcgcgtaggcgatttttggcgtcggttttcgggcgttgggtagttttcgtcggtcgtcgtcggagtttttgtgtttacgtcgggggcgtcgttgtaggtttaggagaagattcgtgttttcgagtagtcgtttttaaaaattaaataaattaataagagaattaattaataggtagcgttgcgatcgttaggagcgcggagcgcgcgaggtttagcggttttttcgttaagtttttgttatcggcgcgcggtcgttcgcgttgcggtagcggcggcggcgcggttgattgcggcggtagcgcggtagcggtgattgggtatcgcgcggtgcgggtgttttcgtcgtcgtcgttttcggagcgggaggtggggatgtgcgagtcgaggcgcggagggagggacgggcgtatcgaggaagggcgggggttttttaggttagggtttcgcggtcgtttcgggggatagagttgttttttgtttcgagtttcgtattattttttttttcgggtcgtcgtagttcgggtcgtttcgttaatgattgatgcgggggtcgtaggttggtcggcgacgcggcggcgcgcgcgtcgagtattagagtcggttttggggttcgaaattcgatagttacgcgggcgttttggaggatattggggagtcgcgttcgcggggggcggggagttgcggttgcggggggaggggagggcgtcggagtcgggtagggcggagagatgcgttagcggtaattttcggaggtcgtcggggaggggggtatttcggaagtcggggggttttaagttcgcgttcggatcggggtcgtgttattgttagttatttggggatgcgtttttcgtttttttattgtttttgcgtgtgtgttagtgtgtgtgtgtgtgtgtgtgtgtgtgtgtcggtttgtttacgtattatacgaaggtttagttggttttttttcgtttagtgggcgtatttaggtgcgttattattttgtcgtttttttcgtttttgttttgttcgaaagaatcgttcgtaagttgttttgtggtcgcgtttattagtttttcgagtcg

SEQ ID NO: 6395 - DNA, 2954 bp, Artificial Sequence
  Description of Artificial Sequence: Synthetic polynucleotide
acgttaattatagtggacgtagtatcgcgagcggaaatgcggagagtatcggggtttcgtatgtggggtataatgaaataagagtagtttcggttagaggtttagtaaagcggaaagacggtttcgttcgtatattttttcggaaaattgaagcgttttttttgatttttaaggttagaaagatttattatttttttcgagagggcgtagttatagatttattagagagggcgggtagggtgtcggaagttagagaacggcgtttcgcgtttttttatcgttttagggcgtagaggtgtttttagtgttcggagaggttggtagtgtcggtttcgagggaagcgtggagcggacggtcgataggggatttttgtttaaattttattattaattttttttgagagtaaaaatatggggtcgagttcggtagttgtacgtagaatttaattttttggtagttttcggtatcgacgagttttagatttcgcgttcgtatttcggcgttttgcgcgtagagttaagttttcggattcgtggattgtagttttcgcgcgtcgcggtaaagcgggtcgcgtttttagttttcgaggcgtagcgacggtgggagtcggttcggcgttgggggcgggggcggggtcggcgaagggggagggttgcgcggcggaggggaggagtcgcggcgatagacggcggcgcgtattaatcgggcgtcggttggtaggagtcgcgtagaggttggttcgagcgcgttgcgggcgttcggcgtaaggggagtcgggtagtagtatttttttgggcgtcgttttcgcgcggcggcggcggttgcggcggggtttttttttgtttaaatatttcgttggttagaagcgttggtatcgggggcgggttgggtcgggtcgggtagtgttgtatatttgggtttttttgtttagagttgtgtgttcggggttttttggtttagtcggaggttgcggagcggcgggggttgtttgcgttgttcgttcgggtattttttcggtgatggaagtagtcgtcgtcgtcgttgcggggtcgcgttgtgttttatttatcgttgttagagaggtgggaaaattcgtcgtacggaggtcgaaagcgagaggggttgcgtcgttatgtcgggagttgagttttatataagtcgtttttagttatcgtttttagtcggtttcgtttttttgagcgagataggaagttgcggtttcgagaaagcggaggagacgtcgttggagtcgggaggcgtcgggttcggcggagcgcggagcggggttttgggtcgcgtgaaagttttttttttcgagtcgtagggcgttcgttgttcggaaattgtttagggataagtcggtcgattttttagatttttcgaaggtgcggggatttttagcggaagcgagagggagcgaaatcgaggaacgagtgatagtcggatagttcgtcgggcggtgattcggggtcgttttcgggcgcgttttcggttttaggtgagcggaggaatcgggtagaatcgagggtgggcgttatttaggaggaggaggttgggagggagattggggcgtattcgtttatttcgttttttttcgtaggttttattcggagtcgttgttatgggagagttagttttgggcgttggggattagtcgtcgcgttcgtttcggagtcgcggttcgagtttcggcgttagtagttagttcgttgcgtttttttttcgggttgtagggttgttttcgtcgcgtcgtcggttcggattgtgtttgtgatgagtcgtagttcgtagcgagttttgttttcgggcgcgttttttcggttgttttaggttgcgtttgtagtcgcgtcgcgtgttttgttttcgtagtggtttcggcgtttaggacgtcgttggttcgcgttttttttcggaatgaaggtgtttcgtaggaaggcgttggtgttgtgcgcgggttatgtattgttgttggtgtttattatgtttaattttttggattataagtggtataaggagtcgttgtagtagtgtaatttcgatgggtcgttgggtgtcgtagcgggggtagtcggaggtagttgggggcgtttagggtcgttttcggtcgggtcgtttcgtgtttatgttcgtttggattttcgtattttttatcgttttttcgttgtcgtcgtcggggcggtttttgtagtcgcggtagggatggcgggggttgcggtttttttaggtaatggtattcggggtatcgggggcgtcggggataagcggtagttggtgtacgtgtttattacgtggcgttttggttcgtcgtttttcggcgagttatttaattagaatttcgaggtgttttttttttacgagttagtgtggtatgtatggtaaaaattgtattcgggggacgtcgtttttttgtagggggtagcgcgggatatgttgagcgttttttatcgttgcgatttttttgttttttagttgtatagtttcgcgggtagcggggggcgtaattttattacgttgggtattttcggcgtagttattaataaggtggtgtgttcgttattattttgtttcgtttatcgtaaggaggtcgtggggttggtggacgatcgcgtgtgtaagaagtgttcgttatagcgtttggcgcgtttcgaggaggagtgtcgtaagtatcgtatattagttataaagggtgtgcgcgttttcgacgtggcggttttggcgttattgttgcgagattcggttttggattttaaggttatttatttggtgcgtgattttcgcgcggtggcgagtttacggattcgttcgcgttacggttttattcgtgagagtttataggtggtgcgtagtcgagattcgcgagtttatcgtatgttttttttggaggtcgcgggttataagtttggcgttaagaaggagggcgtgggcggtttcgtagattattacgttttgggcg

SEQ ID NO: 6396 - DNA, 2954 bp, Artificial Sequence; identical to SEQ ID NO: 6395
  Description of Artificial Sequence: Synthetic polynucleotide

SEQ ID NO: 6397 - DNA, 885 bp, Artificial Sequence
  Description of Artificial Sequence: Synthetic polynucleotide
gcgtacgtttgcgtgtttattttttagagtttttggtttcgcgatcgtgtattgattttttttagaattttaggttcgttttggacgtggaaggtagtcgtgtcgtttgggaaagtggagtcgagttcgggacgttgtcggtttaaatggaacgtcggtttcggggttcgtttttcggcgggttttcgagttaaattttttaattgttttatgacgttatcgggttttttttttttgtttcggttcgcgcggttttagcgtggcgttaaggagtgtggcggttttcgcgcgtatcgtgggttatttttaatttaggatttggttagtaggttgtttttcgagtcgaggttgcgttgggcggaattagggatttatagttcggagtggggttgaaatagagtttttggttcgagtagagagcgtgtatacgtatgaaatcgtgtttttgggtgcgtcggcggttaggtgttcgatgtcggttttggaagtagcgtcggagttcgtttgaatttaggttcgggaggttagaggttgtcggttacgtttaattgtgttttttttgggaagataatttttttagttttggtttttttttgagttacgggtggttggttggtttggtggaaggtaggtgtataggtaatagagataaggttaggaggtaaagtatatttatgtgtaaatgagacgcgttagggaatttgtaattttttgtattttcgtttttgatgtttcgatttttataattatagaattttaggtagaggtcgtcgattttttcgttttcgttaagagggattcggagtatcgaagttttttagtcggtgtcggcgttttcgcgtttttttttttttttgcgtcgtgattttaaaagggcggcgggcg

SEQ ID NO: 6398 - DNA, 2174 bp, Artificial Sequence
  Description of Artificial Sequence: Synthetic polynucleotide
tcgttttatcggttttttgcggtcgttgtagaagcgtattttgttgaatatttcgaggacgtgtttttcgtatagggagcgttcgtttttgttggggttggagcggcgtttggaggtcgatattcggtcgttgttggattttttcgtttgtcgtttttgtcggattaaggagttggttatcgtcgtagttatagttgtttagcgagggttttaggttttagtttttattgcgtttttcggtttgcgtttcgtcggggcgagggtaggatttgggcggttagggaaagggtagtcgcggggaggtagtgttaaaatttgaggaggttgtagtatcgaaaattcggcgtttataaggttagttaaagtttgggtagtggcgataaaatgtgtgaaaatttagatgtaaatttttttaatttttggcggtcggggggcggggcggggcggttttaggtttttttgcgaagtagacgtttgtattttaaatttgtattttaaggcgatcggcgtttaaggggtagtggggagtttagttatattgcgttcggggtattaagtggaaggggaagaacgatgtttaaaataataagacgtgtttttgttggagaggcgtaagcgttgtaaggtgtttaaagtatatttatatatatatatatagaaaattcgtttataaagtagagtttggatttaggcgggtagcgcgttttcggtagaaaatattaaaaagtgaataaaacgtttttttagaaaataagttattaatcgtacgagagaaggagaggaaggtagtaatttaattttttgcggttcgcggttttgaagattaggaggttcgttttagtagggtgaggtttatagaatgtatcgcgtcggttgcggttttttaggggtcggttattcgagttttggaatttcgagaggcgcgaagtgggagcggttattcggagtttgggtaggggcgcggggcgggggtagttgtttttagttgcggtgagagtaattttcggttagtagtattgtaaagagagtgggaggcgagggaggggggagggcgcgagggagggagggagattttcgagggttaagtatttttcggggagaaattagcgagaggcgatttgcggggttttaagagtgggcgtttttttttttttcgtttgtttttcggtacgagacgggtatagttggtgattatttagggaattttaaatttggaatgatttagtagtttaaataagtttttttaaaaggtagcgatgtcgaaggtgttttttttagttcggcgtttatacgtttttaattggagtttttcgttatggtttattcggggtcgtcgtatcgagttggttttcgtataggtttagagggagcgagggaagggagggaaggaaggggcgttttggcgggttcgggattaggttatcgtcgcgttgttgttcgtgttttttaggttcgcgcgtttcggtagttagtagtttataggtagtagattagatggggattattcgtcggacgtaaggtcgattatttagtttcgcgtcgtttatttcggtcgaggaaggaagtgattcgcgcgttgcgaatattcgcgcgttcgttcgggtggggcgggggttggttgtaggcgatgttggttcgcggcggttgaggtttttggtcggagttgtttattatggtttggcgttaggggcgtaggcggggtttttaggttttttggggttatttcgcgaggtagtcgagggcgtaattcgggcgtttggggtcggaggcggaattaggggtcggggttaggaggtaggtgtaggcggttgttaattcgtttaatttgttgcgcgggtggtcgtttagagtcgcgggtttgcggggcgtttttcgtcgtcgcgtcgtcgtttttttaggttcgggagggggcgtttagggtggagttttatttatgggttgaggttttgggcgcgcggagtcgtcgtcgttttttcggttggtttagttggagtgttagtttcgtaggaaattcggggttcgggcgagagttatcgagatggtaggtgggacgtagagttcgcggtagttagagtttttttcgtacggttcgtcgatttacggaagagcgaaagagcgtttaggtggggtcgagttgggggtcgggtttttggagcgttgggaagtatagcgcg

SEQ ID NO: 6399 - DNA, 873 bp, Artificial Sequence
  Description of Artificial Sequence: Synthetic polynucleotide
tcggagagttgttatcgatttttttaacgttttaagttttagttttgtcgttcgcgtttttttttttttttgggttataattttggttttttcgggtcggttttacgtagttgcgtaggagttcgcgggggaagatttttcgtggggatttcgagtacgacgtgcgattttaaatttttatattttttttgtcgtttcgtaggttatatgtatcgggagtcgggcggggtaggcgcggttcgtaaggattttcgcgatggagacgtaatattgtcgcgattgtatttggggtagtttcgtcgcgttttagtcgtttttcggtaggaagcgtaggtgtgtgagtcgattcggagcgagtcgcgttttcgggttagcgtgggtagggcgtcgtagtttgcgtagtttcgaggatttcgcgtcgttttttcgagttagggtttttaggagcgggtcgcgtaggagacgttagagggggttgttagcggttgttgggagaacgggttacggaaatagttttttttaaagtcggggttatcgtggggtgggcgagttcgtttttttaggtcgggggcgcggattagaggggacgtgtgtagacggtcgcggttagttttatttcgttcgggcggagacgtatagttggagttggagggtcgtcgttcgttgggtttttaggggtttgaacgtttaggggtcgcggcgagtttattcggagcgagttaggtgagtaggtcgttatggcgatgcggtttcggagagcgtacgtttgtcgcggtcggtatggaaacgttttcgttaggttcgggggcgtcgttgattggtcgatttaatagacgcgggtgggtagtttagtcgtatcgttaagttcggtcg

SEQ ID NO: 6400 - DNA, 2174 bp, Artificial Sequence; identical to SEQ ID NO: 6398
  Description of Artificial Sequence: Synthetic polynucleotide

SEQ ID NO: 6401 - DNA, 510 bp, Artificial Sequence
  Description of Artificial Sequence: Synthetic polynucleotide
gcgggtatttcgtacgttacgtaggcgttttttcgatgagtttttttttattttatagtttagggaaggtgcggggttgcgggcgtagagttgtataagtagggttgtaggttgggttaaagtcgttttgcggggatcgatatgaattcgggttttttatcggaagggattaaggattgagggttgagcggcggtagcggagatttcgttcgtagatttcgtttcgtcgtcgttatttttcgtcggttcggatgaggtttttttagttttgggacgttttgtttttatatttattatttttttattttaggggtgtagcggagttttagttacgaattatttaatattcgtaggttatagagcgacggaggttgaggttgtgatcgaattatcgacgtttttttgaggggtgaaagtacggtcgtggagattttaatcgagtttacgttggcgtaaaaggtaaaagtcgcgttagatttcggatgtcgttttttttttttcggttgcgcg

SEQ ID NO: 6402 - DNA, 511 bp, Artificial Sequence
  Description of Artificial Sequence: Synthetic polynucleotide
tcggagtttggggtcgggttttttttatttgcgtgttgttttcgggtttcgtttcgtttcgtttcggagggatttttaggtcgggtttagatttaggagttatttggggatttcggggtggttgcgcgtcgagggggcgttagcggggacgtgagttggcgtcgagatagtttcggttttttagcgttagggttattgttaggagattttcggttagtatttacgtggggcgttttcgggagttcgaggggtttatcgtttgtcgggattcgttattttaaagcggcgggtgtcgtcgagtcgttggagttttcggattttaggttcgtttcgtcgtcgagtatgtttagtgcgagtcgtcgtcgaaagttttttggaataaatattcgtatttggggtttggcgggttaggaggtgtcggacgggcgtgggagggggagagcgagttggcgcggtttaggcgttcggcggttaggtttgggtttgtttgcgtttaaatcgaattagagcg

SEQ ID NO: 6403 - DNA, 417 bp, Artificial Sequence
  Description of Artificial Sequence: Synthetic polynucleotide
tcgcgtcgtcgttttggcggggacggtgtagtaggcggcgggatgcggcggggcggtagtttgagcgtttcggatggttcgcggcggggcggtttgtaagagcgacgcgcggttgttgttggggcgggacgcgttgcggtcggcgttcgttttgttggttttcgtcgtgttgttgggcgtcgcgttcggtttcggtttcggtttttggtttggttgtcgcgcgggtcgttagcgtacgcgatattaggtgggtcggtcgagtagatagcggcggggcggggagcgcggggcgcgtggtttttgggttttgcgggttcggagtttcggttttgcgattttttgagtttggttgggaatttcgtacgtaatcgtttaggcgtcgggttttttttttgttttaggagggaggtggcggcg

SEQ ID NO: 6404 - DNA, 1748 bp, Artificial Sequence
  Description of Artificial Sequence: Synthetic polynucleotide
acggaaatattcgaatcggtgaaatgtaaatcgtgtttattgtataagggaatcgtgtagggagagtcgttttttataaggagttaattagcgtttgtttcggatattttcgcggggtttttagcggggtttaaattggcggcggtttagtagggggcgaggggtgttgggaaacgtcggggttgcgaatttacggaagaaaatgtattcggtgtagttgttttagattttgtcgtcgcggtattggttgacgaaggcggcggtgttcgaggagttatacgttattatgtggaagtcggtttcggataggcgattaaaggtttgttttaagtaggtgaatttgaggtagaagcgggacgtgtattttttcggttgtcggtcggggtcgcggttttcgttgagcgtgttttcgaagatttttttggttagcgcgatgcgttcgtatattatgatgcgcgttatacgtcggaatttggcgtcggtttggttgtcgcgtacggtggtgtaggagtttcggtagtttagcgtgaggaagttcgagcgtttgttttgcgcgtcgtcgtcgtcgttattatcgtgcgttttcgggttcgagggtacggcggtcgtcgtttcgcgtagtagtagcgcgtcgttgttattttgcgagacgttgttttttaggtcgttttggtagttttcgtcgttgagagagttttgtttggtgattttgggcgatagtagtttgattaagtcggtgagttggaaatattcggtttcgcgtagtagtcgttttttttcggggaagtgtttcggtagcgcgagttgtttgtttcgtagataatttagtacgtatttgaaaaggaagtcgtttcggtcgatgaagaagcgcgttcggttgtttttgggtagttcgtttcggcgtcgggcgtcgttacggggattagagggcgagaatatgttggttaaagtattgttcgggacgttgagtagcgtcgagtgtttggttatataaatttggtcgtttacgtttagttttattattttagggaagggcgagggtgcgtagggtttcggggcggcggcggtcgacgcgtcgggcgagttggacgaggaaattatttcgttaatgggtaggatggtgttgtcgtcgttgttcgtgttttttagagttatagttttttcgtcgtcggtttagtgattcgagagagttgtattttttcgttttcggagttcgcgttttagtttttcgcgtgtttttggcgttttgcgttttcggattgggcggcgcgttttttcgatcggggcggtttcgtttagggttcggggtagcggcggcgtcggcggcgttcgagttttatcggaggagagacgcgcgagagaggagtttcgtcggtgcggcggcggtaatggagaggtaagaaggagttgttgtttttttggggcgagggcggggaagtgtgagagagatttgcgagaggttttagggttgttgttcggtttttcgtggggagggcgggaggaggggtcgaagtaaagaaaattcgtcgtttcggtagtttgtaagcgtgtcgcgaggtcggagcgtcgacggtggcgttaattatttttggtagtacgggaggaggtattgacgttaagtttcggattgggattcgagttttagttgttatttaaagagataggttgtagtcgcggttttcgggtttcgacgttagggggcggggtcgagagtcgagtttgtaagaggtgtagtttttcgattcgcg

SEQ ID NO: 6405 - DNA, 1748 bp, Artificial Sequence; identical to SEQ ID NO: 6404
  Description of Artificial Sequence: Synthetic polynucleotide

SEQ ID NO: 6406 - DNA, 648 bp, Artificial Sequence
  Description of Artificial Sequence: Synthetic polynucleotide
acgaaacgttgttatatcgagcgaatgtaacgcgtatatacgtttatattcgaatagtataagtaagagatcggttgggtgtggaatagaggcgtatatcgcgtaacgtatttatagtatgtatacgcgcgtatttcgatttcgttttttttcgcgcgtttttatatttcggcgtttaagattttcggtttacgaattttattagatagtcgggtaattttttaggtgcgtagtttgttatttcggcgcggtcgtttttgcgttttagcgtttttttttacgtcgttttttttagtcgtttgcggcgtcggagtttagcgtaggttagtttagttagtttcgtcgtgtatacggtgcgtagcgtgggttcggggttgtcggtttagtcgtttcggttacgtgtgagtcgggggcgcgggttagcgcgatgcgggtaggagttgcggcggcgtcggtgttgtcgtttggtttcgcggcgggggtcggtgtagaggagatacgtagggagggagggaagagaggagggaaggaggagggagggggttagtcggggttattgtttggatagttgggcgtcggtttttttaaaggtggggttattcgcgttcgtacgtatattagttcgaatttttattttcgatatagtcg

SEQ ID NO: 6407 - DNA, 863 bp, Artificial Sequence
  Description of Artificial Sequence: Synthetic polynucleotide
gcgtataggaagggcggaggcggtattcgggggggattgtttttagaggaggtcgttgtgagtcggcgacgcgaggttgggggagtgggaggtaaattcgttaatttgtcgtcgaatggttatttttagtttttcgtttacgagggtggaaaggtagaaggtttgaaggtaaggcgtgagggagcgtttaggacgttttcggaggggtcgggtcggggtttgcgttgtagttcgtacgtattttattttcgcgtcgcggcgttcggtcgttcgtttttttttttgggttttttttggtcgtcgtcgtttttttttttttagtttttttttttttttttttttttggtttttcgtttttatcgttgatttgttagcgtttttgttcgtttttttttcggcgttcgttgttttttttgtagcgtgtttttcgtttttatttcggatggggatggggtagggggcgcggggtgagttattaattttagtcgtttgtttggtcgcgtaaggcgggaaagtgggggcgtttttgcgttttacgttaagtttagggttacgagtatttttgtggagatcgggagcggttgggttagggatgatgttttttttttttttttttttttttttttttttgttttcgttttttttttgggttttttcggggattattttttatttttcgttagagtcgttttgggagagtcgagggtttgagggtcgattattaagggtagagtttattttttggggagttgttggaggagataggtagcgtcgggaggtggtttatatcgtatcgtcgagagcgttttgttttcgtatcgttgaaatttaattacggttataggttataacgttaggggtcg

SEQ ID NO: 6408 - DNA, 1288 bp, Artificial Sequence
  Description of Artificial Sequence: Synthetic polynucleotide
gcggattcgagagcggcgattttcgtttggaggtcgttggtttttatatttaggtataggtaagatattacggttattattgataggagggtcgttaggacggtatacgggggtatggttcgggtataatgttgttcggtaggggtcgggttttcggatttgggttttcggtttttttttttttttgcgtgtttttttagtagtatcgtggcggggtcggtcgtttcggtttcgttttttattttttatattttaaataattttaaaaggaaagaaaaaggtcgatttttttaaagtttagtttttgtggttgtataattagttggtggagttaagtttacgagcggatacggatttttgttttgtttagcgtttagattcgtaggcgtgtattattttcgtttttttttttttttttagttggaagtgaaaagtatttttcgttcggggattgggtggcggtggggtaaaaagtaagacgaaatttatttagatagttttttcgatttttagaggatcgatatttttttcgagggttttaatagtggtcgtttagggttcgagggtaacggtcgaggcgttacgcggggtcgcggttcgttttggttacggaggatcggatttgttgcgtttttgtgagtttgttttatttttatttattcggtgtttttcggtacgtcgatttgttttttatttgtatttagtttaaggtaaaaaggttgtgagagtacgttatagcgtagcgcgaaaggggcgattaaggtggagaagagagaggaaaacgaaataaatttaaggaattaatgttattcgcgaagtcgaagtcgcggttgttcgaaggattttcgtagtttcgcgtgcgcgatttttaaatatttttcgcgatgttcgcgtgagtgtgtgtgtgagtgtgtgagtgcgcgcgcgtttcgagtacgacgtttttttttcgattttttttcggcgttcggcgttcggtttgtcgttttcgttgttgcgcgtttttttttcgaaggtaaagtaggagttcgttttattattataatgtatttattttggtttagttcgcgggtcggttcggggaatttttaagggaggcgggaagtttgggtgggagcggggtaggaggtttgttattagtataatgtatgtaaatagttggagcggttatcgtgattggagaggagtttggcgatttttttttttgcgcggagtaattttagtattttcgagggttatttttttggtttgggtcggggtcgaagcggggtcggttgcgtaagaggcg

SEQ ID NO: 6409 - DNA, 1275 bp, Artificial Sequence
  Description of Artificial Sequence: Synthetic polynucleotide
acgcggagtaaaatttaatcggtttagggaatttagatacgtttttcgcgtcgtacggattttttagaaggagtttggaggtaggcgttggatttttttaggtattttcgttttcgtcggtttttttttttcgcgttcgttgggttatttattcgcgtggggtatggtgatggtttcgttggtgttggagtttacgttgaagatgattacggttgaggcgttttgtaggaacgcgtttcggattttatttttgtacgtgtagttgtttttggggatgagggttatttagtttttgtcgcgggtcggggcggcgaatttggtgttggggtcgtaggttaggcggtcgtgggtcgagttggttatgattattttttcgcgggcgttttgtttgggcgagtgtttttcgtagcgttcgtatttcgtttttttcgtgtgtagtttcgcgtcgtcgtcgttcgtcgtttcggtttcggggttcggcgcgggttcggcgtaggtgatgtttacgaaggcggtgtattatttttttttttcggttacggtaaagtttaggtagagtagatgtacgaaataaaaggaaagtagttatgttgagagagttagattgtagtacgtttggatgagagatattgttatttttattcgtcggggtttttttttcgttttcgcgtttttttttcgtttcgttttttttttttagtttcggttaatttcgggtcgttgtttttttttttgttgttgtttattttcgggtcggaggggtcgcggtcgggacgcgtagtcgtcgcggggatcggatttcgggcgagcggatggcgttggttttttttttttttagttgtagcgcggtggttgtattttgttttttgggcgttcggggggcgcgggaatagagggttcgcggggtttgcggaggagttttgttgtcgagcgttttgttttttcgttcggtttcgtttttttttataagggtggtcgggggtttacgaatttgtagggtggcggttttgcgttttttagtttcggcggggacgggtacgattgttcgtagtttggggtgttgcggtgcggggtgttgtttagggtgtttcggtcgtcgttattgagcgttggggcgcgcgaatttagttgtagtcgttgttgttttgcgtcggtttttttaggttgcgggcgttgcgtttttgatttcgtcggtggttgcgtttgggtacgtatttgtcgcgggcggggcgggtttggggatagtgggagcgagtaggtagagcggagtaagcg

SEQ ID NO: 6410 - DNA, 1071 bp, Artificial Sequence
  Description of Artificial Sequence: Synthetic polynucleotide
gcgagcggtggttcgatttcgggtgtggtaggaaggggtgtttcgcgttttagagttagtgttagtttttattttttcgggaagtcgagatttagggggaataggttttttagagtttagtttgtagggacgcggagggtaggagtcgtcggcgaggagtagttaatttgttatttttggcggttgtatttttcggcggttataggttgttcgatagcggattttagggttttcgcgacggtatttagagtgtttagaagggaggtcggggtcggggtgggtcgggaaaatcgagggagggaaggagtttggagaagtttcgtttaggcggggagggggcgattcggggcgtatttttcgattatgatttttatagattttggcgtcgtaatttgcgttttttgaggtcgaagatgcgtattttggagaagatatttattaggttgtcgttgtagagttcgcggtttttgttggggttgtttcgttttttgttggtagacggtcggttttagtgttgttttcgcgtttgtcgtttttggcggattaagtcgttagcgatggtcgcggttatggtggtttcgggaacgggttcggggagggagggcgcgggaggacggcgagtcgggggtatcggaggggaaggcggcggcgtagatcgtggttcgttttcggggtagaggagggggtgttaggcgggattggggagaggggaaggggggtttagttttgatcgggatttatcgtttttttcgcggggcgcggggttaggcgcgtagatgcgtttagggcgtagtcggacgatttcgggaagtcggacgtcgtggtcgtcgtcgtttggttacgttcgagtggagagcgggatcgcggttgcgggcgttgttggttatcgttcgtcgtaggaatttcggcgggggtcgttatcgttattcgcgttgttttttcgttttgttcggttttcgggcgggaggtagagtcggtcggcggtttttcgggcgtcggttggagggcgggtttcggtagggtttttgcgcgttcgtcggttcgggtcgcgttgggtaggatttagcgtcg

SEQ ID NO: 6411 - DNA, 694 bp, Artificial Sequence
  Description of Artificial Sequence: Synthetic polynucleotide
acgttttcgaatttcggattttagttgttattttatttgcgtcgtttcggacgttatttggttgttgacgtggtttcgagttagtaaataacgttagtagtttttttagatttacgtcggttcgttttttcgtcggtttttttttcgtagtggttttttttgtagtttttttgggtttcgcggttagtagtgtagttcgtggagtcgcggttttgttcgttttttttgggtggttttagtgcgcgggttgatatttatttagtcggggaaggtgaggcgagtagaggttggtgcggaatttgtcgtttttagtagcgtcggcgggttaagtttagggtcgggtagataaaagaggtcgttcgcgtaggaaggtacggtcggcggcggcggagcgtagcgatggtcgggcgagggggtagcgcgttgttggttttgtgcggggtattggttgtttgcgggtggtttttgggcgtcgaagtttaggagttcggggcgttcgcggcgggtatgaggcggcgtcggcggttgtagtaagaggacggtatttttttcgagtattatcgttatttcgagttgcgcgaggcgttcgtgttcgtgtggttgtagtgtatcgttattagtaggatttatacggtggggcgtagtttcgagggtcgggagtttttggttatcgagttgttcgataattttggcg

SEQ ID NO: 6412 - DNA, 694 bp, Artificial Sequence; identical to SEQ ID NO: 6411
  Description of Artificial Sequence: Synthetic polynucleotide

SEQ ID NO: 6413 - DNA, 1424 bp, Artificial Sequence
  Description of Artificial Sequence: Synthetic polynucleotide
tcggcgggtacgttggggatgtattcgcgtagttcggcgaaggcgttgttgatgttttgagttttgcgtcgttttttgcggttggcggtgtttcggcgttttatcgggcgcggtttttttaggttcgggggttcggcgttcggcggtattttttcgtaatgggagtggtttaggtcggcggcgtcgttggtatattcggggttgtaggatagggttatgttgtagtcggggggcgatatttcggggtggtcgatgagttagttatggaagtaggggttttttttatggttgtagcggttggcggcggcggcggtagttgcggcggcggcggcggtaaacgggtagttttcgtggtgtattatcgggtggtggggaaaattatttattagatttatttcgtttttcgcgtttttttacgcgttttagcgtgcgcgtagtttcgtcgcgttttcggttcgggtttttgttttagcgttcggcgtttttttttattttttattttttagttttcgggcgttcgggttcgttcggtagtcgtagagggggttgttgtagttcgggtttcgttttttcgtttggttagtcgggttcgttttagtagcgttgcggtcgtcggttttttatggggcgcggcgagttggttttggtatcgtgcgtttttggtcgtcgtcgtcgtcgttttcggttttcgttttgttttacggttcgcgtttcggtttttgtttttcgggttgttgcgcggaggtagaattttttcgtgtttatataaaggtgtcggggttttcgcgaggttggtacgcggagtttcgggaatttaagttcgggtcgcggttttggtatcgaagttaattcggaatttaggggcgagtttgagtcgcggttggaggagtcggtttagttgtgtcggggggcggcggggtcgattgtttattgtaaagttattttcgtgcgattttttttttttcgtttttttttttttttttattagttcgatttgggtttttgggcgtttattgttttaatgaaatttttggttgttgttgttttggtttttaaatgtgattttagttgcgagtaacgtgttttcgtttttttcgcgttttttcggagggtttttagagaggttttagtgtatttatttttttagatttttttttttcggggtaaggatttggggttttgaatgagttttggagttcgaagatcgcggttcgggttttcggagggttttgcgcggtggtcgaggaagtttcggggtgacggcggtggtttttttgggttggacgacgtgaggggagtaagcggatttttttagtaagatttttatgtatagttatatttttagggtcgttcgggttaatatatgtcgttagaggttttttacgttaatttcggggcggtaggggcggcgtttcgagttttcg

SEQ ID NO: 6414 - DNA, 1215 bp, Artificial Sequence
  Description of Artificial Sequence: Synthetic polynucleotide
tcgcgtaggttttcgggttcgtcgtagattttaacgtaaattttcgggtttttcgtaaattttaacgtagatttatcgtggtttcgttcgcgtcgggtttcgcgttcgagaggtcgagttcggattcgaaggcggcggcggcggcgggcgtttcgcgaggattcgggagtagcgtagcggcgagtagagaatacgttatagagaagaagtttagtaagtgtatggtggaaggatcgggggtgggggatcggttcgttggcgggggtaggggtgggggcgcgggcgtttttgcgaggtcgcgggttttttttggtttttttttttcgggtttttttcggcgattttttttgggcgagtcggaggcggcgggagcgggttcggggtttcgcgtttttaattttgtagggcgtttttttagttagtgtcggggaaaggcggcgggtgttaggtaaaagttttataggaaatcggatattcgagtttttcgtattcggagttcgcgaggtgaagcgagggcgagggaggacgtcgtcgcggttcgcgtcggtgtagttttttggagaggcggggcgggggatattagaatatttcgcgatgtttagtttttttaaattcgttagagttttcgtttttttttttttttttttttttcgaagtgagaggagtcgggtcgcgggcgttgcggcgggggcgttggcggcggtgtcgggggcgggaggagggcggcggggcggttggcggcggcggggttcgggagcgtcgcggcgtaggattttttagagcgcgtcgggttgagcggcggcggcggcggcggcgggcgtaggggtagggtatgattgacgcgttttttgtttgcgtttatgtgagagaaagcggtcgagggagggagcgtgtcgagttcgggttgttttttttttttattttttttcggaagtcgtttttttggagtttttcgtttttttcgtttttttttcggcggttttatttttttcggtttttttttggattttttttttttcgtttttgttttttgcggggagcgggcggtcggaggggtaagtttagtttcggggttggcggttggcgggatcggttttagaggtgatgcgattattttggattacgtgtagcggggagaaattgggtatcgtggggtggagggagttttcgttttattttcggttattttcgagtttttgttttttttttcgtacg

SEQ ID NO: 6415 - DNA, 1184 bp, Artificial Sequence
  Description of Artificial Sequence: Synthetic polynucleotide
tcgtttttttttttcgggtcgcgatattgattcgttaacgttaatgggggttcgcgattgttgcggggacgagggcgtagagtagttttcgttacgggtcggtttacgtaggggtcgagaaagtggcggagaggcggtggtcgaggtttaggggcgagcgcgggttgagttggtttttgttgcgtttacgagcgatatttattttttcgttgcggacgtttcgcgggcgttaggttgggggttttgcgatcgatttttttcgttttcgaggtatcgtcgggttcgtttggtaggtagcgcgtttcgcgagttggagggtcgagtttcgcggggtcgtggggcgtgtgggtgaaggcgatatttcggatgcgggacgtatgaatggtggtagagtaggggtcgggattcgtttatgggttgggagagagatgtttttgtgagtacgggaaagtagcgttgtcggagaatagttttgaggcgggattaaaagtcgtcggcgaagtttcgtcgaggaatacggtcgttgttcggggcggttcgcgagcgtgcgtgtgtggaggggaggatgtcgtttcgcggggttttcggagggtgtcgggagcgggtttttagtgtagttttttcgttttcgttgggggtacggttgtttataggtttcggttcgcgtgtgtggagcggggcgagggggtgaggcgagggggtgaggcggcggtcgagtcggggcgttgggcgcggggttggcgggaggcggcggtggcggttcggcgcgaaggggttaagcggcgtatcgttttttcggcggtcgggtgtaaatagaggagttttagtttattatgtttggtcgtcgcgcgtagttcgagttcggagttaggcgttgtaatacgatacgttttagatttaggtaatttggtagcgttgggttcggttttttacggttatagcgagggcgcgtcgcggtaaggtgggtgagcggcggcggcggcggcggtttggggcgggttggcggagcgcggttttcggtgaggtttttcgcgcggtagggtcgttcgttcgtttcggggattgcggcggtggcggtggcggtggtggcggcggcggcggcggcggtttcgttttttttttttgtggtgtcggaatgggaggaggttcggcgcgggtttgaatcggtgcggaggtaatattcg

SEQ ID NO: 6416 - DNA, 5820 bp, Artificial Sequence
  Description of Artificial Sequence: Synthetic polynucleotide
gcgagtagaaggcggacgttttcgagtcgtaggttacgtagttgttatagttttgcgattcgttatagggatttttatagacgtttagcgtcgcggtcgagttgagttcgtggcgcgcggtggttagtagtcggttttcgtagatcgggtagtagatcggcgtttgggtcgaggcggcgggttcggagttcgttagcgtgcggttttcggattcgtagtacgtgtttagggagttggtggttattaagaattgtagagagaggtcgcgaggattggcgggaagtcgggttggaggttggggttttgggttttgttaatttcgcgcgtcgtttacgagggcgtgtttcgagtattttcgggtttttcgtcgtttatattaggatgttcgtttttttttattagtttgtgcgcgtttggtttttttcgttacgtggggtttagtcgagtatttatattttttttcggagggtttttaaggtttttgacgttatttgcgcgttaagtttttttttttaggggttttttggggttttaggatttttttggggtatagtttgagttttgtggtttaaatattagggaattcgggttcggttcgtcggatttttttagcgtttcggttttttttcgggggtttggggagtaggggttgggcgtgaggggcgcgcgatttaggttttgttagttcggaagtcgtaggtagtcgtaggtcggatattttttatttttcgttttcgttttattcgttttatcggtatttgcggtggtttgggcggggcggggtttcgtttatttggggagtcgaggagtaggggtatttaaattgcgggtaggatatggcgggcgcggttcggggcggacgggcggggtttgtagggttttgcgcgttggggtcggcgtggcgcggttattgtttcggagttgtaggtttttaggcgttgggagggcgaagtaggagagtcggttagtttattttcgcgtttcgtaaatttttttaatcgggtaataaagtgagtagcggtggtcgtcgcgatttttttaatttcgtatttcggaggttcgagggggttttgggatcgagcggtttcgtagcggcgatagaaatatatattttacgaaaaagaaaaaaaaaaaaacgagtcgcgcgaattcgttaagttagatgtgcgcggtttgaagcggaggaggttttgacgttagttttatttcgcgtagttcggtttggtcgtagattcgtcggttattcgtcggcggtttaggtcgggaggggttaggatagtttcggtcgcgcggtggacggaggggttattttttcgggcgttagtaaataaattttattcgagttaatatcgtttagcgaacggtgtttttttttagttattcgagaacgagaggtatttttaattagaaattaattaatgagtagttgttttttttcgttttattgtaattattcgttttaattataaatgagatttatgaaaggatacgttgaagatgtaattaatagttaaaattagttcggcgttgcgtaggcggtcggttcggtttcgcgttggcgcgttttgtttcgagtggtaggaaggggttcgtaggcgtttcgtacgcgtttcgttattattgtttaatcgagaattagtaacgtttttcgtcggtttttattttacgtcggaatggatttttagaatttattgcggtcgtaagatagttcgtaagagttggttaaaatgtttttaggtgcgtgggggtttcggggttttagttggagttcgatattttgagattggcggttcgagggttgtagggtcgtttcgggcgtgcgtttatcggttttgtatttttgggtagtcgagtgtcgcggagaacgttttattttttttatcgcggttttttaagttttcgtttagtttatcgtttttatttcgttttttcgattttttttttcgatttttttttcgtcggtcgtgtttcgtcggtttttttttgtttttcgcggttaagtcggggattgtcgggcggttttgcgcgttcggaagagtaggttttttaatttaggtttcggtttttttcgttaagttcgtttttttcggcgtttcgtagggttggttgcgagggagggggcgttgggtgtttggcggaggcgtttttttttgtttattttgtttagttttttgtttggggcgtacggagtaatcggaagaggggatcgagcgtttattttaggattttttcggttagtattttttttgggattttgtttaagtttaaagcggaggttagtgagtaggcggtaagggggcggtaagggggcgttcgggttatttcgaattcgtttttcgttttttgcgttatcgtttttcgggatcgggattcgtttcggttgttttcgttttttgggtcggtttttcgtggtaagttgggaaggaagtcgtgtaaggtagcgttgtgtagatttgtttagaaagatttttgggtttagatttgtgaatcgttttagggttattttttaattaatgatgacgttttcgttttttttttagttgtaagtttgttttttagaaacgaaatttgtttgtttttttgatagttcggttgaaggtgattgatgattatttggagattatagtatatattatataatatttgttgcgtaattgttttaatttatagatgaaaatacgagtttttcgatcgcgttggatcggagcgggttacgttcgagttgtttgtagagggaaattatcggaaataatgaatagtcgttttatgtaaattatttagatagtttagcgtcggtagtcgcgagaaatatataaagaatacgagttaaatgatattaataattgtttttgaattttgtattgatttcgcggtaggtcgcgttttttttttttttatttgaatcgttaatattatttttttgtaaataataagaaattagttatcggggtttttcgttagaaatgaattttttaatttttttttttttttttttgtttttttttttttttatttttttttttttttttttttatttttttttttttttattttttgtagttttttggtttttttcgagtatttttttattttttattatttattgtttataaattattcgttttttttaggtaatgaggttcggttgaaggaggggtgtgagtttagtcgggttaagggttgggatggggagtagagatttttagaggggaggtatttagttgtggtttgttttttttttatttatattcggggatttggtttcggcgattgtgagtatttcgtcggttgagggggagagttagggtttaggggtttagttatttatgttttgtatttttgggttttagtgtaatagtttagtttatttagatttgaggttggtgtatttttttttttttagattcggcggggtttaattggagtcgaagttttagaataggcggttatttattttttgagtagagtttgggagaagtagtttttattttttagggtagttagtacgtgggggttttttcgggggttttttttgattattatcgttatttttttttgtttttttttgtttttttagtttgtgtgtataaatcgacgttttagtttttattagcgggcgatttttttttcgtgatttagaaatttggtttttgaatcggtttttttaggtcgtcgtatatatacgttttattttttgttcgttagtaggttttagcgtttggggttcgggtttagttatagttattttgtttcgggaagttcgtaattgtttaggaggttttttgattcgttcggttttatttaggttttattatttattttaggatatagggttaatttagtttgtggattggcgattatcgggatattttattgaaattttgtagtttggtttaggttcgtttgtttaaatcggggatttttattgggttattttttttttatagataatattggaatattttttaagtgtttttattaaaaggttaagtttggagcggaggtatttagtgttttttttattaacgataggacgtttagtattttaggtattagttgaacgcgtttgtatagattcggagtgttgagtttttttttttttagggattttcggtattaaatatattcgtgagtaggtgggttagaagttagtcggttttcggagtatatagtatcggtttagtttcggggagatgaggtgttttcgttggtttggagcgtttcgaagagcggaggattagggtcggagtaggtcgtaggggaggtaggggatggttagtttttaacgcgaagcgtaggcgggtcgtttattttgacggggttatcgttggtcgtcggaattatggaaggttttcggggagataggtcgggttttgattttttttcggttagtttagttttggtgttttaggagttattttgggggttattagtttttcgtattaagagttcgttcggagggagttttttttagtttagagaagttaattttagttaaaggcgaagtcgggagttcggggtattaggtaagggtttttttttttgagatttggggttagagattttgggggcgtttgtgttcgtttatcgttcgggatattcggttggggtgtgggtttgagaggttttacggtcgttgacgtcgtattggcgaatttcgaggttggtaggttatttttttatagtttcgaggttttttcggagttagtggtaggagaaggagttatagggataagcggtgaatttttggatttttaatcgttttttatgggggttcgcggtttttttttttttttttttcgttgcgttttcgtcgtttgttttttgggtacggtttgaggttggacggagcgtcgttcgggcgtttaggatttaggtttggttatttcgagttttttatttttcgtttcgcgtcggttcgcgtattttgtttttcgtaatttgtagtaaacgtagcggtttttggagagtttagcgacgggtagtaaattttgtttttttaagcgtaagagtaattttcgtaaagtttgtgcggcggagtttattttttatttgagttggggaagttttcgttcgcgtcgtgtggttgtcggggtcgcggggagtagttcgtagttcgggacgtatcggggagtcgtcgtagtcgtcgtcgttcgtttttttcggcggtcgcgcggagttttcgttttttcggaaggggggaggggtttcggaatttcggggcgggggcgggagcgggggattttatttatttgcggtggcgttgggtcgttttcggtagttcgcgagggtttcgcgcggaagttcggcgcgcgcgttttagcggggagtcggcgataattaatggagatatttttaggcggagtatttggcgagcggagcgcgtcggcgtttttaggcgtcgcggtcgttagtcgagttcgtatcggcgtgacgtgggcgagcgagcgcgttgtttttattcggtcgtttattaacgttttttttcgcgggcgtcgcgtttttgttaattttttttttcgttcggtttgcgcgcggcgcgtcgggtgtaggagttggggtgagggcgtttcgggtgttagtaggggcgttgggagttgtttgggcggggacgtagggtttcgggaggttatatagttttaataggatagtgggaaggcgcgcgagttagatttggttaaacgttaagttcgttgcggtttcgggttttcggtttacggggttttttttttcgtttgggttgttttatttagggacgtttgggtcgggcgcgaagagttcggaaatagttatttttgtcgtcggttcggttttttttcg

SEQ ID NO: 6417 - DNA, 1233 bp, Artificial Sequence
  Description of Artificial Sequence: Synthetic polynucleotide
tcgcgttgggttgcgtttttgtaggagttaggtttttttatgttttgcggcgatagtcgttggggtggggttacggggaagtcgcgttgtttttcgtttgagcgtgggttagggtttaggtggtgattaaggttcggcgtagtggtttcggagcgtggaggggtagttgttgggcggtttttcgggggagggtgacggttttattcgttaacgttgttttttttttgggattaggtcggaggaattttggatcgttcgaggttggtgtttagttttttttttttattttatttttattattcggcgattttcgtagatttgattggtaggttttgtttcgatttttatttttttaggttttcgtttcggtgtttcggtgttcggtttcgggttatttttgtaggttttgtttagggtagtcggcggtgtttggaggcgggttcgtttcggttgttttacgtttaggtcggtttttggtattttagttagtgggagggcgttttcgtcgttttcgtgttttttcgtaggggttgcgtcgcgttttcgggttttttttttcgtcgtggtttggtttgtttgttttagggcgtagttgcgttcgttttagcgtttttcgggtttgcgtggtttgttcggtttagaggtttttattacggttcgttttttgtcggacgtcgcgttgttgtggtcgcggtggttttgtggttgtgagggtcgtttttgttcgtttatatcgttttttttttgtaggtgaggaatggggtttgtttcgtttggaatgtgtttttgtcgggttttgtttgatttttattttttagtcgggacgcgcgagttttttcgtttggttgagttaaaaagggatcgcgcgtatttcgtcgttttttattacgaagcgtagatataggaggttgtagggttagtgttgcggagaattttagacggttttatagtcgtcgttattcgcggggtattcgttcgggttttgtcgaggatgtgggggttttggttttcgtagagttgggattttcgaaggttttattagaaatttaggagtagttttagttttgtagagttcgcgagggtggagacgggagattcgttgtggggtttgaggttgagatgtcggtttgcggtgaagtcggcgggacgttttaattcgtttagattcgtttatttcgtagggttcgggtttatttttcggtttgtggtttgtgttgggttgcgtagtcggcg

SEQ ID NO: 6418 - DNA, 2865 bp, Artificial Sequence
  Description of Artificial Sequence: Synthetic polynucleotide
gcgagttttagttcgttgttcgtttagagtcgtttaggtgcgagggcgtttttattagaaatcggtgttttcgcgcgttttatttttcggggttttgtagatgtcgggtcgggggtcgttagtaggttttttggtttttgttggagatattggaagattaggcgattaggatagcgggtcgggttagtgcggtgtgatacgagggttcgagcggtttcgtagtttaaacgtgtttttattttatattttttacggttgtttcggattcggtgttttcgtgttttttagtttgtttagcggtacgtgggttttaagtttggtttttagcggttgcgttagtttagttgtgtttattttggggtcgcgagggttttttatcggttggtagttggtggatacgttgttaagatcgggggaaaaaaaggaaggaaggaggttagggggatatagggttggtggttttcgtagtttttgatttgcgacgggcgcgagcgtattttcgcgtttttgcgtagagatttttttttaagattggtttacgacgttttttatttcgaagttaagggttttttgtggtaaatttttatacgtttttttttttttcgtttattttcggcgttaggattgacggggagagggtaaggtcgggttagaggggttgtgggtttggattgcggttgtcgttcgcggttttgtttttttgggtagttagacgtggggttagcgtttagtcgtagttttcgggggtgagttcgtagattttcgtacgtgatataggttaggtatggggacggggagtttttcgtcgttcgtttttatttagatgttttttgaggtttcggaatatttcgttttttattttaggatttgattaatttttaagttacggtcggtttcggtttcgcgagacgggggattttgaggattgttttttttttcgggttgggatttttttatagtagtcgatcgtttttagtttagagtggttcggttcgtagcgtttttcgggtataggttttaggtggacggtttcgttttcgcgttcggtttttttgttcgttaagcgtttcggggatttttcggtttttaagcggtcgcggtcgggtggagttagtttcgaagttcgggatttttcgaagggagaaaattcgttttgtttttttgaagcggcgggagaaatcggttttatttaggttcgggggttcgacgttttcggcggaggtcggttttaggggttcgaggttttcgaagttggaggtcggtttcgtttcggcgttttttcgtcgttattttcgtttttatttcgcgggtcggcggagggaggggcggggtcgtttgtcgttcgcgattcgggttcggtttttttagtgattgtttttgtttttttcgcgttagttgtttttagttttggggtaacgttgttaggtgtttagttttcgcgttcgagagagcgtttgtttggttttgaattttggttaggaaggggcgcgaggggaaggtttcgggggaaggcgtgttttcgcgtttcgtttcgtttcgtttcggaaagttttcgcggtttcgtttattttaggggttcgtttagttttcggagatttttttttttgagcgtagtcgtttggtgtcggttttcgtcgagttggagcgcgcgggttacggtttttttggggacgtagaagcgagaagcggggatttcggcgcgcgtttcgcgtttcgttttttttgttcgcgtttcggttttcggttcgcgtttcggtcgtcggtatggtgttgttggtcgggatcgggtcggagggcggcggggcgcgttgtatgattttattatcgtcgtttttatttcggggcgcgtaggtcgaggaggatttcgttgattacgaagagtttgaggatttttcgagtttgttagatattcgtagtatcgtttcggacgattttttttattttttcgaggacgaggaggagtacggcgtcgagagcgcggagagcgtttcggagggcgtttcggaaagcgtttcggagacggcgatttttttgcgcgtcgtttgcgttaataacgtggggttgttgcggacgttggtgcggcgcggggtgagcgtcgaggaggcgtaggagattgatcgtaacggtagggtaagcgggcgttttcgtaggatttgagtttttttattgtttttattttttttttttttattatattttcgcgttttttagtttttggtttcggatcggtttttcggttatttagtcgtcgtttagagcgtttttttttcgttgtttgggagcgcggtgttttgggtggttttttcgttttaggttgggggacgcggtgcggggagggagtagtcgaggtgttagcgcggtagaaacgttagttcggcgtttttatcgtatttttttttcgtttatcggttttcgtggattttttgattgaattcgcgttggttgttcgtgttgtaatttaggatgggttttttgcggttcggtttttttttgattattatttttttttaggtttttggtaggggattatttttttttttttgtaggagatagttttttttgtttagcgttttatttggtttttgggtttttcgcgtcgtttttgttttaatacgttggggcgtagatcggtttttttagtcgtaatgatttggaagtaatagttttttttttcgtcgggatagtttggttttttattttattttcgttgagttttgtggttcgcgtcgcgattagttaacgtgatttttgattggtttgttcgtaggttattttcgcgagttaatgttagtcggggttttttagagttagggtatagggagagttttagagtcgcgggtatttattcgggtagggtaggaggcg

SEQ ID NO: 6419 - DNA, 1154 bp, Artificial Sequence
  Description of Artificial Sequence: Synthetic polynucleotide
tcgttttttttcgtatattagggacgttatgaatgtatcgagtatgtttttagggtggcggggagtagtattgtcggtgttgttttaaatacgttttttttcggggagatgggtggtagggagggggagtacgtagggtagttatttggtaatcgttttaagaaaggtattaatttcggatttttttttaggtatagcggttttcgagggggatttggcgcgatcgcggtttttttcgaggtaggtagaaatttcgtagtagtcgtcgtcgtcgtttgtcggtcgggagtttaggattatttttattagcggtaagaggaggaggacggcgtcgggaggaggttgcgttcggtttcggtcgtttagtttcgtaatttatttaaaggcgcggcgttcggcggttttttcgtaaatatgtatttttcgtcggcgatagttttttagttcgggaagaggcgtgcgcggcgtcgttcggttttagggtaaggttttgattttgtttaattgtagtatttttcgtttttgttgtttgagcgcggtcgcgggataagggatgttggcgggcggtaggggcgagcgtcgcgggcgagaggcggttttcgacgcgagtgcgtagcgttcggttcggcggttttttcgagttcggcgagcgtagcgttttttgtttggtttcgcgggttttacgggtttttgcgggtttttcggggtttcgggcgtcgtcgttagtcggtcgggttgagagagtagtcgtcgcgttcgtagtttcgtttagtcggttgtcgtcgcgggcgcgagtttggggtcgtcgcggcgttcggcgtcgagcgttttcgagttgcgtttcgcgcgcggttcgcgttatttgtgtcgtcgtcgttttagtcgtcgagggcgaggtttttttcgcggcgcgcggtagttttagtttttatttaaatttcggcggtcggttcgggcgttcggttagtgagggagcgttcgtttcgtcgtcgaaatcggtttcgggtgcggagtatgtttagtgtcgtcgcgagagcggcgtttcgtcgcgcgcgttttattttttttggttttcgcggtagtagcggtagtcgcgggagagaggggaggaggtcgcgggttgggagagggtcgagtatttttgggaacgtacg

SEQ ID NO: 6420 - DNA, 1154 bp, Artificial Sequence; identical to SEQ ID NO: 6419
  Description of Artificial Sequence: Synthetic polynucleotide

SEQ ID NO: 6421 - DNA, 396 bp, Artificial Sequence
  Description of Artificial Sequence: Synthetic polynucleotide
tcgttgggaagggaaaaacggtttatatcgaattggatgtcggatggaaatttttttgcgttattagattgcgtttagtatagtagatggtacgagtacgtgcggcgtttagtttaggttttcggaggtagttgagttggaaatttcgacggaaagtatttataagtttttattttgcgttggtttattcgcgtgtacgtttattttttacgcgcgtttttggtttagaagcgtatagatgtttattgtttagagtcggtatcgttggggagatcgagcgatttgcgcggcgtatagtgcggcgttggtagggttttgggttttcggtcgggggttcgagcggttaagggatgggggtgggggcggggagagtggggggagggcgaaagatcgtcg

SEQ ID NO: 6422 - DNA, 438 bp, Artificial Sequence
  Description of Artificial Sequence: Synthetic polynucleotide
tcgcgtggagagaaatgagttggagagttatatcgagttaacgcgggatacggttttcggttcgggtcgggttaggggtgggaggcggttttttatcgtaggcggcgggatttttatgcgtcgagggatttaagtttttattttatttatacgtttattcggcgtcggggcgttgcggtttcgttttacgagtttagagtaggtcgtagtttgggttggggattcggtatttgggtagggtgagtttggtcggatatttttttttaggattattcgtattttatagtcgcgttaaaagcgttttatttttttgtttttcgtcgcgtaggttttttatcgacgttcgttcggaaggcgagagtttttacgtggttcggcgcggcgcggttttcggggatcgcgagtaataaaagttcggttcgtagtttttgtttttcg

SEQ ID NO: 6423 - DNA, 438 bp, Artificial Sequence; identical to SEQ ID NO: 6422
  Description of Artificial Sequence: Synthetic polynucleotide

SEQ ID NO: 6424 - DNA, 411 bp, Artificial Sequence
  Description of Artificial Sequence: Synthetic polynucleotide
gcggtggtgtcgatttatttgagtagttgtttcgcgtttagttcgtcgcgcgtagtggcgtgcgtcggttggatggtttggtttatgattatttcgtcgggcgtcggtcgttttatggttagggcgagagcgttacgtttgcggttttcgatattttattatgttcgtttcgttcgtttcgtttttttcgtttagttttagagggtattggcgtcgttcgttcgggtcgcgaatttttggtcgttaggtggtgggagttgcgagtgagggggttcgtattgttattttaggattatcgcgagtgggggaaaattagcgttttcgggttttaggagaagtttgggaagtgcgcggggagggggttttcgggtagataggtttggaaggcggtttttcgagagtcggagcgcg

SEQ ID NO: 6425 - DNA, 1137 bp, Artificial Sequence
  Description of Artificial Sequence: Synthetic polynucleotide
tcgcggttaaaacgtttagcgtcgggtttgggtttgcgaacggtttagtttaggttttgcgttagagtatcgtattcgggggcggacggttttgtagttttttagttttttttcgtattaattagttgacgttcgggcgtattggtttttttcgttttcgttcgtacgaaagttttgttcgacgtttgtagttagtatcgttcgtattgtttagggagggtttgcgtcgagatttagtggtcgagtgagttatagagtcgttggttttggggacgttgttttttatcgttttttatcgttttttttttttttgtattttatttcggtatttcgtattttttttttcgttcggtttcgcgtattttgtttagattttataagtattttttcggggtatttaggattcgacgtttttttcgcgtcgttagcggcgttcgttatttttggtacgtcggagggatcgttttcggttttttgcgcggcgttttttaggggatttttagtttattttttatttagttgttcgggtttcgacgttttatttttgtcgaattgggggatatcgaggttgagttcgattaagagttagacggttatcgagcgttttatgatttcgtttttcggacgtgatttcggttggttaggggtcgtcgcggagggtagtgtagtcgaggtggtagcgtagggtagtagtagatttcgtttttattaaagaatttaagaagacgttttttttttttagcgttttgttaaataaatttttggagagggcgagagtggtgattaaagagaggagttttttttttttttttgtttgcgtttcggcgcgcggaggtgggtgagtttcggggagtcgtcggcgggtttagtttttcgttgcgggtgggtttcggtagaggcgcggcgggcggggcgcgggttttcgcggtcgtttcgggtttgttgcgcgggtaggtagatttatcggtagataggcggatcgggcgttcggttgtcgttgtttttcgcgcggcggttgcggggtttttgatttggagaataatgaagcgtgagttggaggggagcgagcgggtcgtcgggagcgtattgtgtataaatagaggcggcgtgcgtgtgagtttgagtttggtaggcgcg

SEQ ID NO: 6426 - DNA, 2383 bp, Artificial Sequence
  Description of Artificial Sequence: Synthetic polynucleotide
tcgacgtgttaaggaaagcgcgtcgtaaggtggagcgttcgggttgacgatgagaaggtgagttgtgaattttgtatacgtttttaaataaaaggtttacgagcggcggtttcgacgtggggagtaagtaggtttttttggtttttgtagtaggcggatttaggttcgtttgtcgtcggatatttagaatttgttttcgtagcgcgagttttgtatacgttttgcgatcggtatttttggattttttaattattcgtcgtttaattttcggagagagggtttttcgttcgttgagttgcggggttgggaaggaaaagggggacgcgtttttgggggtttttggatattttggtaaagggggttgtagttttaggttttagttaaagggtttgggacggagtgggttagaaagtcgttaaattgaggattttttttttttttaagtcggagttttaggtgcggagtcgtttgtttatttattttcggagtacgttttgttgttttcgtcggcggacgcggttggttattgcggtatttttttcgcgatattcgggcgttagaaattcgtttttagagtttgttgtagcggatcgaatttgttgcggcggcggttggggtcggggcggtttgggcggaggaggttgaggttggtcggtcgtgttttgcgtttagagtattatatagtttagttataggaagtagagttggagatatagttttcgttttttttttatcgtcggcgtcgaaagcgcgcggtcgtagattcgcggagagggagtgattaaagataaaatttgcgcgttttagaaaagagttagggtttaataagtttttcgtcggtttcggggattttttcgggttcgggttttttgttttagttggagatttcgatagagcgtcggttttttgattgtttgcgaagcgagacgcggggcgtcgggtttagcgtagtgagcggcgaggcgcggcggaggtgtagtcggtagtttcgagcggtatacgttgtataatcggtttaaagtttcgagcgattttaggatcgttagcgggcgggggaggaaattataaaagttttggcgtaaaattttaaaaaatgtgaattttaaaagaaaaaagggtttgtacgtagagttcggcggattttcgtgcgtttcgaagacggatattggaaagttgtaaaagttattagaaagaaataggtaagtaaataaaagtcgtttttagaagaagaggagggtttttttcgggttcgttcggagttttatagggtaacgaagcgcgggtagcggttgcggagtcgggcggaggtgcgcggggtcggggcgtgcggttagtaagagagagggcgggaggttgggcgttggagaagatgcggcggtggagggcgcggcgcgggggttttagaggttcggcggggcgcggggcgggtcggcgggcggcggttgttagtgggggcgcggtcgtttatacgtggggtttaattcggattgagaggtcggcgtagagtgggcggggatagagtaagggagagatcgggattgaggaacgaggggaattagggttgggtgaggggaagaggaaggaagggggggagggcgaagggagggaagaggacggagattggggagaaggggggcgaattcgagaggaaggtcgggttggaagagggatttggaaagagggattggcgagttcgggtgcgagaggaaatgagcgggggatgggggcgaagttagggtaaagagagaagtgggaaaggagagggagggttaaggttcgggcgtcgagaggaggggttcggggggtcggttggagggggcgaggcgttaggcggttttgtttttcgttttcgttaattggtcgttagttttgttttgattgtttgtataaagcgagtagacggcgggggatggggcgattagggatcggatttgggaaaggaggtagtagttttttttttttttttttcgttttcgttcggtcgcggattagggattagggtgtttaagcgcgttaggtttggtcggattcgtagttgaattgattcgtagttgaattttttcgtcggatagaggtcgtaaggttgaggatgagaacgggtttttttgtagggtttcggtttttgatttgggatggggggattcgtagttagttaggaatagaggtttacggggttgttggttgtagttttaatttaagaaggaggagattttttttttgtttttttatttttatcgttttatcgggagcggcgttagtttgcgggattaaattaggggttgggagtttttagattgaaatgcgttttttattattaagagggagtttacgcggtcgcggggggtcgaggtagttagtcggcgtcgcggttttggggagttcg

SEQ ID NO: 6427 - DNA, 2367 bp, Artificial Sequence
  Description of Artificial Sequence: Synthetic polynucleotide
gcgatttcggttttggggttttgtttttgtcgcgggagaataggttttaatttacgaagttggttaattttagaaattcgagattcggtttttgagaagcgattgcgtgtttcgggattttgcgttaataattaaatttgggagaagtcgcgggaatgtttttattggacgttacgaagggaattggggttttttttttgggaagaaaaagttcgatttgtgtcggcgagagtaggttgttttgggttgggggtattttcgagcgttgcggcgggacgtcggggttcggggcgaagagagttagggcgcggatcgacgtttgttgtttttttgcggtattgttgttcgaacgaacgaacgaacgaacgaacgaagcggtttcgtttaggaaaaatatttttttgacgcgaagttacggttgaagtttcgggttacgtagaggggttagtaattttatgggtggtggggttttttatttttggacgtagcggggagtagcgggcggtttttttttttgtttattttttttgggggtgggggagttttgtgttattcgacgttgcgaggggttgttacgggttttttaggttgtgtttttcgcggggtcgtggttcgtgttttcgaggttgttatttttttgaggtgttcggagttaaagtagagggttgatttcgtcggttgggtgaggtagtattcggtgacggcggttatgattgtgttttgggcgtaggaacgagtttttcgcgttgtttcgaaggtttttgatttttcgcgttttgcgttgtttcgcgtcgtcgggtggatttatatacgttaggagtaaattgcgtaggattcggtcgttatttttttgcgtttttttatcgcggagattttgcgtttttagtttagcgttttttattttatttgggtagcgttgcgtttgcggttcgtgggtttcgggttcgttcgtcgcggattttggtttaggtttcggtttcggttggggtttcggatttagttttggttttggtattgtacggtttttcggtttttgttggttcgttatattttagcgcgcgaggtcggggttttttcggttcggttcgtttttttcgtcgtcgtcgttcgtcgttcgcggggaaggcggggatattggtcgggaggcgggaagggtggggggaggggaagttaggtgttcgtcgggatttgcggggagaggggcggcgcgtagtttcgtcggttaggggttttggtttttttcggggcgtaggttggggttcgcgcggttggcggtcgggtttcgaggtcggggagcgcgttttgggattttcgtggaggggttttgtcgtatgcggacgaagttagagcgggttttagtttggttttggggtattttttttttttgggtttagttttttatttgattcgtgaggggttggttttattttcgtttagacgggggttggtggtcgagtttggggttttgagattggattttttttttttttgtttagtttgcgggagggagttggttttgcgtgttggtagggagagttcgttgtttagagcgtggtagttagggaggtttgaggatagattttaggttttttgtgtttgggggtagggggtgttagggtggggtaatcgttcgatttgttttggttgggggaattgtttttttttttttttttaggggttgggttggtgaggaaagggtatattaattttttaggatagatatttttggggttttttgtttaatttttatgtttgtatattttttagcgattattttgttgcgggtttgcgaacggtgacgtttttatttttgtggtttcgtaggtcgtttttggttggttgtcgttgggagacgggttggacgtaagggaattgggagtttgttttttgtttatttttaggttatagggttttttagcgttgtttcgtggttagataattttgtgcgcgaagttttatggtggaaattagttggtcgaatttatttttggtatttcgaagtgtttagtttgagtttgtttgttgttgggattatgggatgggattatagggtaggtcgggttgtggtttgttttttttagggattggagcggttaagtttgttcgtcgacggttacgggttttagagcgatcgttttcggcgtaaggtgtcgggagatggtagcgcggtagtcgggtttgaattttttatgagatgtagttagtagcggcgtttttttgtttggttttcgtcgatagttgttgcgggagaggtcgcgattcgcgttatttcggcgttttgttagttcgtgtttttagggtcgtttggtttgggaacgtagagatttacgattttttttttaattttcgaagcgggaagtcggttcg

SEQ ID NO: 6428 - DNA, 1235 bp, Artificial Sequence
  Description of Artificial Sequence: Synthetic polynucleotide
gcgttagcgcgtgttttgtttagagagttcggcgttagtttatttttcgtgtagttattggttgggattttgtgtgtcgttgtcggttaatgaagacgttggagatcgggtttttgttcgttttttttttgcgtttcgggatgaggtagagattgaatagtcggcgagtaaattaacggtatttagaaagttatgtcggattcggcgtttagcgtttaagcgttaattcgttgaaagttttttagcgaaattttagggacgatttggatttcgttgagaggaattgtttttgagtgagatggttttagaggtttggaggagcggattggtaagtatcgggagggtagtgggagttttgtttttgtttggtgttttgaataaggtttttacggttatttattatgagatttcggaggaaagagagaagggtttcgttgtgggtaacgtggtcgcgaattttggtttggatttcggtagttttttagttcgtaggtttcgggtggtgtttggagttagtcgaagattttttgaggtgaatcgggagatcggagagatgtttgtgaacgatcgtttggatcgagaggagttgtgtgggatattgtttttttgtattgtaattttggagttggtagtggagaattcgttggagttgtttagcgtggaagtggtgatttaggatattaacgataataattttgttttttttatttaggaaatgaaattggagattagcgaggtcgtggtttcggggacgcgtttttcgttcgagagcgcgtacgatttcgatgtgggaagtaattttttataaatttatgagttgagtcgaaatgaatattttgcgtttcgcgtgtagacgcgggaggatagtattaagtacgcggagttggtgttggagcgcgttttggatcgagaacgggagtttagtttttagttagtgttgacggcgttggacggagggattttagtttttttcgttagtttgtttatttatattaaggtgttggacgcgaatgataatgcgtttgtttttaattagtttttgtatcgggcgcgcgttttggaggatgtatttttcggtacgcgcgtggtataagtttttgtaacggatttggatgaaggttttaacggtgaaattatttattttttcggtagttataatcgcgtcggcgtgcggtaattattcgttttagattttgtaatcgggatgttgataattaagggtcggttggatttcg

SEQ ID NO: 6429 - DNA, 3043 bp, Artificial Sequence
  Description of Artificial Sequence: Synthetic polynucleotide
gcgagggtttcggggtggtgggggtgtcggttttagtatgtggaggcgataggattcgtaagattttacgcgtcgtcggggtaggatcgtatagggtcgttatttatttatttggggcgtttttaatgggtattcgtgtattttagttcgtgcggtgagcgtacgtacgtcgtcgttgtcgcgtttatacggttttttaaagtcgggggaggggtcgtggagcgaaggagttgtaggtagatttttttttttttttcgagttgggaaaagggttagtttcgtgttttgtacgtttggttttgttttgtagtttgtcggtgagttaagagtcggtagagtagaggaggcgtacggttcgggtcgtgttattattttttggtttgttgatttggttaggagttggggatggcggtagtatcgcggaggtacgttttgcgttgtttttacgttttttttcgaaagtagtgtttttagggggaaagttcgtaatgttatttgtttcgtcggtaaagttttgggatgtcgggtattttttgaggagggggaagacgcggtatttttattgaggtcggtaggttaggaagagaagtttttcgggcgtagggcgtagtttagtttcggggattttttgggtttttcgcgtgtcggtcgggatgaagcgcgttttgtatcggattcgggattcgggggcgggggttggcgttggtagcgttagacgttgttttattttttttcgattttggggaggatagtaataagttttgttttagttattttattattttgttagtacgtgtagatttcgggttttcggagttcggcgcggatttcgttttgtttcgcgtttttttttgtacgtttcgtgttattttaagagtttgcgtggttttgggtgggcgtttggttttcggcgaaacgtttggggcgcgtcgcgtgggtgtacggtgtttttttttagtagttttcggttgcgggggtatatgtatttatttgtattttgtagggataggcggtttttttgttgggagtttttgttttggggattttcgggtgggttggtggcgtcggtttttcgcgtcgggttaaaggtggttaatattaaagttagggttatgaattggtttagtcgttcggtatatatggtttttggtattaatttttcgtcgggagatttggattttttgtgttttttttttttttttttttttttttttttttcgtcgtttttttttttttttttattttttttttttgttcgttttttttttttttttcgcggtcgcggttcggatagaggttatttagcgttttttcgtagtttttcggagagtatgtgattaggtcgttagtagcgtcgcgagtgttcggtaatggtagggatggtgttttaaatatttttggaagttttggtgttatttgaatgaaggagtcgagtaggtgttgtttcggcggttggattaattcgagatttcggtttttttgataatacggtcgggaggcggggtttgcgtttaattattataggaggaagtcgagcgtcgttgggagcgtcggataaagttgtcgatttggcggcggttacgcgtttgcgtgcgtgtgtatgagtgtgtgtgagcgcggtcggagatgcgtgcgcgtgtgcgggtgttttagggtaatggtcgaaaggattgtataatataagagcgaatttaagttttagttgttgttaaagggggacggtgtgttttgggatagtgtttttggggtttttggttcgcgttatatttatatcgggttgggaaagtttttttttttcgtcgtttggaatttagtgagatttttagtttagaggatttgataaattgaagtagttttttaggtataatgatgttgtgggttaattgagtatatatgggaatttttggttttgtgatattttgtattaaaaagaattttacgattgaagataggagtagaagtattagatatagtatttggtttgagtaattgttttattttttcgttttggtgggtcgtgtaatatttggagtgtcgtttttcgttttttttttaatttagacgtattttaggttgggttgtagggatttaggtgatagttaggatttgtattatttttaggagggtggtagggaggtttaaggtagttttgagttagttcgtcgcggagtatcgcgtgttcggaggttagagtttgaaaggtaattttacgcgtttttaaatatatttttgtatttttttaaagcgttgttcgttatttcgtttcgggtttttttttattttttagttattcgatggaagtggtgagaataaaaataaagataaaaaagttaaattcggggaagttatttttattttttttttttttttgttcggttttttttttaagaatcgtcgggtcgggatagttttcggttatttttttattcggttcgtggagggaaggagaaagttgggcgtcgtttggagcgtttttttttttgttgtgtgtgtacgtgtgtacgtttacgtttttttcgcgtcggggtcggggataggaattgttttcggtttcgttattttacggcgtagttcggggggttcgtagggttgggggagggcggggatacgagcgtcgcgtttaagcgttttagggtacgtattcggcgttggcgcgtattcgttttttttttcgtttttattttttttttggagaataggtgagtttcggtattagttttcgattttttattttcgtttcgcgtttcgttcgcgttttttgcggtaatgcgtttgggaagttttattatttattgtttaggcgacgcggttttgggttttcgcggcggggcgtattgttcgtttggttggggtcgttatgtgatacggttgggggagggggcgaggagatacgcgggtaggttattttttggtcggcgtttgatttttaaagtttttttttttcgtgtttcggttgtacgcgggagtggggaaggcggaggcggggggttaggatggttacggttggtcgtagttattcggcgtgtcgagtttttttgagtcg

SEQ ID NO: 6430 - DNA, 864 bp, Artificial Sequence
  Description of Artificial Sequence: Synthetic polynucleotide
tcgtaggcgcggagttgcggttgtagttattagtttagacgtggcgcgttcgtagtaagtggttggatatcgtagattaggttcgcgtttttagtagcgcggatttcggggttagtcgtttaggtagtaaagttaggcggtcggtttcgttagtagtcgatgagttttattttgtggattgtttagcgttagggattaggattcggagaggtgtttaggaggagtagatttttagattaggtaggttgtgtattcggtgattttgacgttatttaagggaagtttcgttatttcgcgttagtgtttgagttgtaattgtaaattgcgcgttttggtacgagtagcggtgggggcgggtgggggaaggagcgagtgattttttaggcgtttttcgttatttgatattagttaggtagtttttagggttagagcgttagcgtcgaagttaggtttattcgggaagttatttcggtggtcgcggggtgtttatgttagtattagattttttttcggaaggaggagcggggcgggttatacggttaggcgggttttttttttaaggcggggtgggtcgcgcgtttgcgatttttcgttcgtggttttggggtagttcgggttagttaggagaattcgcgagtttagcggcgtttgtatttgcggttttcgggagtcgggcggttttgcgaggtttattaggtttgagaggtcggaggtcgttagtgtcgttgttgaagggtggattaggcgggatcgcggattttgggttagatcgtagatttggtatcgcggattgggatttggatcggggattttgagttggattacggattgggggttggatcgcggattgggggttggatcgcg

SEQ ID NO: 6431 - DNA, 2071 bp, Artificial Sequence
  Description of Artificial Sequence: Synthetic polynucleotide
gcgagagtagcggagagaaaggagttagagaagtgcgtatttattagtttatcgtagttgttgagcgttatagaggaggtttcggttaggtcggttacgttttcgacgtagagatagttttcgagtaggggttttacgcgggtggtgtttttttcgttttgttattttatagtggtttcgggcgttacgaggcgggcgttgggtcgtagtcgtaggtgtaggtttcggttaaagatcgtgatattgtagaagaggtgattgttaggttttttttcgttgttttcggggaagttcggggttcggatcggggcggttttgcgggttcgtatttttgttttggacgtagttgtcgatattacgtgggatattaagcggttttgggcgttagtgcgtacgggtatcgttaggatgcgtttcgtttcgtgttttaggggttcgtttgtaacgggaaggggcgttagatcggcggagattacggagttttagtgttttagagattcgtcggtaagttacgtttttttagatttcgttttattgcgaagggaaggggtatttcgttaggcgattttagaagttagtttgtattttttcggtttttttgtaatcgggaaggggcgttaatagggttattatttcggggtttcgttattttttagtcgttttttttttcggagattttgtttgttaagagttttgttttttgtttcgtttagggttggggttcggtgggaattttttcgtgttcgaagggacgatttcgttagagagtttttcgatttttgtatttatcgtttttggtaggacgtggagttgttcggaagttatttcgggttggtttttttattcgtgtgttacgatttttcggcgggtttttgtcgttcgagtgtttttatcgttagttttcggagcggcggagtttcggttttttcgagtacgagcggtttgttttgtttgtttagttttcgtttagttcgttgtcggtttcgttttttcgagcgttcgaggattgggaggggtggaatagggttttttcgattttcggggattttttgcggggcgttttaattaatttttagggtttaaggttacgcgttcggtagtcggttttttcggagcgttttcggacgcgagtttcggcgtcgtttcgttttggtttttttttcggattcgttggggttgattttgcgtttttggtcgcggggtttttttcggtttttcgtttttatttttcgcgatttaggagtcgttagtgtttcgaggttttttcggtttaaggcgttcgggggcggtgcggggcgttttttgcgcgattaattcggtttcgaagttggttaatttggtttcgggcggggcgcgcggagtttgtttaagttaggttggacgacgtttggggagggggcggcggggtacgcgggatagggttaggtcggcgggggtttcggggagtaggggtcgggtcgtatttatttggggggtcggcggcggcggcgagtttggcgttcgcgggcggcggcggcggcggtaggagcggcggcggtagtagtagtagtagtagtagtagtgcggggtagagtaggcggcgagcggttttcgtcggcggatttatggtagtcggattgtagtcggggtttcgtattcgtagtcggcgcgaaagtttttcgcgagtcgtttagtttatatttgggggtagttggagtcgttcgtagttgtagtatcgtagggcgcggggcggaggaggcgaggcgcggaggggcgggcgggggagcgtggagggaaggcggggagagggaaggagcgagcgagcgagggaggtaggcgggagggagggaggcgagcgagggggagggcggggacggcgggcgttttagtttgcggtgattcggcgtattttggcgcggtcgtcgtcgtcgttcgttttttttttcgcgtcgtcgtcgtcgcggtgtcgggttcgtagcgaagtagagatatttcgaggcggcggtagagaagcgtcgcgggtcgggtcgggggagtttcgtcgttagttattttaggggtataattttcgaggagcggcgtcggtcgaacg

SEQ ID NO: 6432 - DNA, 1170 bp, Artificial Sequence
  Description of Artificial Sequence: Synthetic polynucleotide
tcgggttggcgggtattgagttggggttattacgtttttttagagcgtttgcggaggtggcgaaggtttggagagtatacgaggcggaattcggatcgagtgagttttttgagtcgtttgcgtgggacgtagggagagggcgaataacgtttttaggcgttgaatgtaggggtaaggagttagcgagggtggttggagtaggttttgttagttgttattaagtttttttataggtttgggggtttggggttttttggaaagattttttcgtcgcgttgattagtacggggttcgttttcgtattttgaaggttgtcgcggtttttcgttatttataattaagtttaagattaaggttgtaagttgaggtcggggtattgataacgggaatgaagttataggggaagaggataattgggacgggttggatttatatttgatattcgggaaatttttagagcgtgtggtgtttttgttagcggtagttattggtggagttgaggttatcgttattgtcgtcgttggcgttttgtttttggaattttttagtaagatggtatttattgtttgttttttttcgattagtatttttagtcgcgttttttttttttcgggatacgtattagttatatattgtggggagaagatgggttatgtaaatgtaagttaacgcgtttttttagttatttttgtataatgtaataggaatagcgattcgcgcgtacgaatcgggtagtgtgcgcgtgtgtgtgttcgcgtgtgtgagcgcgtgtgttagcgtgcgttttcgcgcgggcgtgcgtttgggtggatttttgcgtggtttgggaggtaaatcgggcgtttttttaagtcgttttaatatgatttaggtttttaaatacgtgaaagcggtagatataatagggatgcgaaggaaataaaaaataattggggaagtggtgttaagttatttaggttttgaattgaggacgagtagtgcggtcgcgtttggggcgcgttcggaaattatttttagtttgtggcggttattgttttatttaaatttttttgcggggagagttgagcggatttttggggggttggttttgggttagttttaaatttttcggttgtatttcgcgtggttttatcgacggcgcgtttcggcgtagtttttggcgcgggttcg

SEQ ID NO: 6433 - DNA, 2168 bp, Artificial Sequence
  Description of Artificial Sequence: Synthetic polynucleotide
tcgcgttgtagttaggtagagtttcggggtagttcgtttatcgcggaggagttattttggagttttacgttttttttatattttatttatggattggaaaggatgtttagttattcgcgagtttgtttgatattgggatggaaagttatagttcgtaggttggagtgaggcgcgggaagatgtttggtttttgtttcgcggatttggtagtcgcgttttgcgggtttgtttattgaattgttgaggattcgttcgtgtgcggggattcgagtgttatttttcggagcgttattttgcgttttagtttttaggttagataatatttggaaggtagggtagggttgttttcgtttttattttttgcggaaggatggtaggattcggcgtagcgacgtagtagcgggagggtatagcgatttgtatttttagtttttttttaggatataaggttgattttatttttcggatagttgtaaagtttttgttagaattaaatcgaattcgcgtttcggagaggggtttttggggtcgtttcgttgtagggcgtggggagtggagagagggaaggggaagtttggggttgggtgtgcgcgcgtgggagcgcgtttcggagcgtttcgtatttttttattttattttcgggggtagtttgggaaggagggagtggtagtcgcgggaatgagggagtaagagaaatttttttaaagtgacgttttaaataggttcggatttagaattcgaagttaaaggttgttagaaattgggatttttcggttttttttgtagttttttttttttcgtttcgaagttcgggcggtttgttggttgtttgttttttcgttttcggtttagaggtttttggttggcgggcgtttcgtcggtcgtcggttttttttttgaaattcgtcggcgtatatgaggtcgttgttttcgtcgtaggcgttggcggttttttcgcggtgttcgtggtgatgttatgtttcgttattacgcgggaggagaggagggcggcgtcgtcgggttttgggtgaagagcggcgtagcggcggcggcggcgggcggggggcgtttgggtagcggtatgaaggatgtggagttcggtcggggtagggtgttgttgaattcggtagtcgttaggggcgacggtttgttattgttgggtattcgcgcggttacgttcggtggcggcggcggtggtttgagggagagtcgtcggggtaagtagggggttcggatgagtttgttggggaagtcgtttttttatacgagtagttagagttgtcggcgtaacgttaagtatcggcgggtgtagaattatttgtataacgtgttggagagatttcgcggttgggcgtttatttattacgttttcgtgtgagtattcgcgttttttgttatgttcgttgtaggggattattgtttttggttttttggggcgtgtttcgcgttcgcgtttttgggttttcgcgcgcgtgtatacgtggtggtttttattttttcgtacgtgttcgtggttttttttttggagtttttttttttttttagttttattttttttatttttatagtttgaatttttttttcgaggatatttaatgaattgttcggtagttttaggttttcggggcgagagttaggtagacgcgggatttaggttgcgcggataattgggagtaattaggttttaagatacgtaaattttaatcgaacggggcgttcgggagttagggaatgtaaagggaggataggcgttcgtgtgaggtttgagagtatattggagaggttaggaggtgatggcggggtaggacggggagaagtgagggggtatcgagggttaggtttttagttttaggggcggagtaggggaagttgttatttggagagagttgttaggttttaagcgcgttcggaaatacgtttcgttattatttagttattattaacggaaaatttgttagtgtatgtagttttttttgttacggagaaggtggttaaggtttagaggaggttagtaggttaggcgaagtaacgttttcgcgttgtagggggcggggaggtagcggggaatttggggcgtaggaacgcgggcggaggtgcgatagtagaagcgtaaatgggtcgtttttgatagagatcgggtagtgggttaagttttcgtttgtggcgcg

SEQ ID NO: 6434 - DNA, 2053 bp, Artificial Sequence
  Description of Artificial Sequence: Synthetic polynucleotide
tcgacgtacgattcgtttatacggaataagaattttacgaaggatatttggggattatattggtcgtattcgagggggcgggaggcggaaaaagtatttttaaacgtaattttgttaggttttatttttcgtattttttggttttcgggatagaagtttttttggtatttttcgtttagtttaggggttggttgttcgttagaacgaaatattttttattgattacggagagttttgtagggagtcgaggttttcgttcgggttaagggaaggcgttggcgtcgcgggagataagaagaggcggaggcggaaaagaagtggagaaggaaggggtggtagagggagtagcgtgcgggaggcggcgtcggcgtcgggttgttggcgaggcggggtggggtggagtggggtgtgttttcggcgggcggttagtaagttagttcgttcgagcgtcggcgtttcggtttttagcgttcgttcgcgatagcgatcgggattggcgtttcgttgtttcgatcgtcggcgagtttcgtttttttttaggttttttattgggttttttcgcgagtttcgtttggttcggcgtggggtcgttcgttttcgttagttcgggcgttcgtcgtttcgtttcgttcgcgtagtttttgtcgtttttttcgttcgcgttgtttttggttttttttcgttttagttttatttatgaagcgcggttttattacgtgttaatgagtttttgttttgttttggtagcggcggcggtatagatttcgtcgagggaattgcgcggggagggatttgagcgtagcgttcgtagttttaaattttgtttggggcgggggattcgtcgcggcgttagttttggggttagaggggataagttttttcggttcgcgttatttatttttttttttttttttttttttttgtcgtcgcgttttcggaggttttcgttgttatgatttcgttgtgttttcggatatttttatattttgattaggttaagaaggggttggtgtatgcgtcgtttacgatttcggggttattaattatacgttttcgggtagcgcgtatcgttaatatttttcgcgggggttacgtttggggtagcgggttgagtcggaaggggaaggggagcgggagtttagaggtcgaggcgcgtcgggttcgggggtgcggtttcgcgtttttttttttcgcgtaaggtcgttttcgtggtaggcggtagcgagttgggttcggggtcgggttgagttttgggatcgcgttgcgtagttttcgagtcgttcgttatttggttgcggtcgcgcggttatttgtttttcgttttcggggcgtcgtttagtttcgcgttaggcgttttttttagcgttcgtcgttttttttcggcgagattattcgggcgcgtttcgttcgtcggttttcgatgtaaatagttgggtttcgtaggcggttggtttcgcgtttttcggttcggcgcgtttttttttcggttattcggggtttcgtttttcgtattttttcgttggaggaggacgttttattttagggtcggattgggggttttgggattcgggggcggtagcggcgggcgtttggggagtcgcggtgtgtttagtagtcgcggtaggaattaggggatatgttcgttaattgtttttattattagtcgtcgtttgttttttgtgtgtacggattaaattttaattggtttttatatttattatggtgaattgcgaatttttaaataagtttgggtcgtcgtttttgtcgaggaggcgtttttttttttttcgttttcggggttttgtagggtgtgcggcggcggtcgtggttatttagatatttttatttttcgtgagttggatcgggagaggatcgtacggtttttatttgacggagttacgttacgtcggttataagggtttcgtgttgggcgttgggttcggttttcggtcgtttttttgtggtcgttttggcgtttattttatgatattttgtcggtgtttttagatattatttcgtatcgtttcgttttatcgatttttaggttttttcg

SEQ ID NO: 6435 - DNA, 1679 bp, Artificial Sequence
  Description of Artificial Sequence: Synthetic polynucleotide
gcgtttttattgcgtgtttagcggcggtggaggcggcgtttttttgtattacgaatacgcggttcgttaaggcgtcgttttagcggttgatggtttcggtttttttttaaaattttcggcgttcgatttcgtcgcgtttttttaggtaggaattttgcgattttattttttgggttcgttattagtttaggtttgcggtgcgcgggagggtattaagcgcgaggtttttttcgcgttttcggttatttcgtcgattttaggtaagtgggggtagtttaagaagggtaaggagtagttggatcgtgttttggatatgagcggagtcgttcgaggataagggtattttttcggtatcgtgggcggtttttcggcgggggtcggtagtttggttttttatttcggcgtgcgtttagtttttaagttcgtcggtttagcgagggcggcggcggtcgtttacggcgatttttatcgggaggagagtagtagtaagtaaggagtcggtttcgttttgggtaggttgttgggcgggggtcgggcgtgcgggcgtttcgggagcggggagaattcggcggcgggcggcgcgggttattattattattattacgcgtattattattattattttaagtgtttgttcgttggggattcgtcgtcgtcgtcgtcgtttggtttgttttgttttggggttttgcgcggtttttttttgtttttcgttttttcggaagaggcgttcgtttttaagtacgtggagcgcgtttcgttcgtagtcgtcgcgttgttaggagcgcgttatgcgtagttgttttttgcgtcggggttgtttttcgagcgttgcgcgttgtcgtttttcgattcgggcggttttaaagtttattcgggtggtgagtgtagttatttgttcgtcgttatgtcggtttttatagtttataacggggagttgttttacggtttatcggttattatcgtttattattcgtttaaattgtatttcggcgggttgttgaagtattcggagtttattttttattttagcgggtttgtagcggtcgttttaagtttcgtcgagttggggtcgttggttagtatcgatcgagagatcgttatgtataattagtagttgttcgagatggttgtcgggaagggtcgcggacgtttggattcggggacgttgttatcggtcgtcgcggcggcgggaggtatcgggggcggcggtagcggaggtagcggcgtaggtaagtttaagatcggttatttgtgtttttattgtggtaagttgtattcgcgtaagtatgggtttaagatttatatgcggacgtatacgggttataagttatttaagtgtaaagtttgtttgcggtttttcggcgattttagtaattttaataagtatattcggttgtacgtcgagggtaatacgttttatcgttgcgagttttgcggtaaggtatttgtgcgtcgtcgggatttggagcgatatgttaagtttcgttattttggttagagtttgttcgttaaagcgggcgacggttcgggtgtcgagttcggttatttttcggagtttggggattttaagagcgacgatagtgacgtggacgtttgttttatagacgattagagcgatttcgaggttgggggcggcggggagcgcgatttgtaacgagttttttcgggaaggggcg

SEQ ID NO: 6436 - DNA, 1474 bp, Artificial Sequence
  Description of Artificial Sequence: Synthetic polynucleotide
tcgtttttaaaggttcggggaaggaggttgcgggtgggtggcgcggatttcgggtttttagttatcggcgttttttcggggttttttgatttcgttttttaaaggaggagggttcgtggtaacggtttttttcggttaggcgttttcgggacgcgggggtgaggagtgagcgtcgtggtttattttatttttcgagcggggacggagtgggcgatatcgcgcgttcggttgtacgtaggttttgcgcggttcgaggcggttttatagggggcgaggaggaatttcggagattcggcggagagagtagagacggagtttattaaggggtttgtcgtcgtagagcgcgggagtcggtattcggtggggtcgagggttcggggacgttggggttgtttgatttgagcggcggtcgttgatcgttgagggtttttgtggtcgtagcgtttagattcggggagaagggcggtttttaagggtcgggagtttttcgagggcgcggttagcgaggagggatagagggcggcgttttcggttgttcgggcgcgtagaataagtagttgtcgttagggtcgataaagttgtttttcgaggggttgagatttaattttcgtttttcgatttagttaggggagcgcgaggtcgtatataattcggcgcggggggaaagtcggttgtagttgcgttttttatttttattcggttggtttttggcggggagtttgggtagcgtcgattaaagttcggagcggtagtttcggggcgcgggacgcggggtatacgggtttagttgttcgacgggagttcgacgcgcgtttttcggcgggtcggcgggttcggaagtttcgttgttcgggtcgggtttttaagttcgtagtcgttttgattaaaataggtatcgcgacggcggcggtaggcggcggtagttagggttggggtcgtatcgcgtacgcgtatgcgttcgtcgtttcgcgtttttcggcgggcggagttcggcgtcgcggttaggattttttatttcgttttcgcgatttcgttgcgggtttgtatattcgaggattcggtttgaaacgttcgtttatttatttttttgtcgtttcgttataagattttatttttgtttgggtatgagtggggggcggtagtttcgtgggatcggcggtattcgtcgtttttttttacggggataattcgagaagtgcggttcgggtagggagagaaattaggagagaaaatgagaaagagaattttcgtttttttttaaagttggacgatttattcgtatattttttttttgggagattcgtttataatttagtataaatagggaatagttcggaaagcgcgcgagttttcgttcgattgtggcgggggaggttgaacgtttggtttatacgggtgtaggacgcgggggttaggttttttgttgcggaggaagagggggaagaggtcgcgcgggagggatttttgatacgcg

SEQ ID NO: 6437 - DNA, 675 bp, Artificial Sequence
  Description of Artificial Sequence: Synthetic polynucleotide
tcgcggtgcgaagtttcggattcgttgggaatcgtatagttttcggtatttttggtcgtatgtttgttagaggtgggtttcgggaaatatattcgttgtttttttaataagcgtttttcgttttttattggtttttcggttttcgttttttatcgttttttttcgtttcgtagttttcgagtggcgttagtacgttcgtcgggtatgggttttaaatgtttattagcgggagtttaggcgtttttgttttggagcgcggtcgggagtaaaatcgtaggagtgggagggtagcgagttagttggatttcgagtcgcggagcgcgttggttttgtttcgtttgatgattttagagcgcgggtttaagcgtcgtttatgtagtatttttgagtttcggggaaggagagttaatgaaaaaatatttaatcgttttcgttgcggagagttatgagttgtttggatgttatgtattaagtttatggtttttcgtagttttatttcgtagtcgtttatattttttattattaggtacgtgttttttttggggattttgggaaggagtgcgcgtttttcgtttgcggcggtatggtttgtacgttaaggtttgttgtgttttcgcgcgtttcgggcgttcgattacgatcggcgtagtcgggatgcggggattgtcggagtcg

SEQ ID NO: 6438 - DNA, 1133 bp, Artificial Sequence
  Description of Artificial Sequence: Synthetic polynucleotide
tcggtttcgtagtttttcgcgtttcgattttttagattttcgggagtttaggggagttaggtgttgggcggtgcgttcggtgtcgtcgcgttttttttcgttatttttggttttttcgttattcgggtttttcggtcgttttggatgtttcggttgtatttttgttttatgattttagtttttttttttaattttttttttggttttttttttttcgagcgcgcgcgtatatatatattcggttcgttttcgcggagtggttttgggagtacgatcgattttagtttagtaaatcgcggttatgtcgtttagatttttcgtttcgaggtttcggttttcgtcgtcgtcgttttcgcgtcgttttttttcgtttagatatcgtcgtttgcggtcgtttgggcggtagtttttgcggtttttaaagttggttttttgggagggggcggtagggagtaggatgaaggatttgttgtaggaggaggatttatatatttgggcgaagggaggggtagcgtcgttgttgggacgcggcgcggattcgtattattgcgcgtagtagtcgttgtagtagtcgtcggggatcgcggagtcgggacgttttcgttcggttcgcgtttcgtttttcgttttattttcgttcgtcgggtttagtaacgtagggtgtttaggagtcgcgggttgcgtagggaggcgggtagcggttttcgcgcgtttttgtcgttttcggagtcggcgcgcggcgagcgtagggcgagcgcgcgtcgggcggcggtcgcgttggggggcgtgaggcgagcggcgcggagagcggtaggggcgaaatttcgcgggttagatgttcgagggcgcggcggcgttgttaggttgtcgttgttgtttttgcgggtttcgagcgcgttttcgtaggcggtattgttcgcggcgcggcgtgtgtatcgagcgagtgaaggtatgtgtggcgggcgcggttggagttgtcgtcgtcgtcgtcgtcgtgttagtaggttttaatgtttgttattttttaggacgttggtagtagtagtagttcggagttttcgagttttcggtaggtttgcgtgttttttttcgcgatttgattggataaagtgggggttcgacggtggtcgacg

SEQ ID NO: 6439 - DNA, 1808 bp, Artificial Sequence
  Description of Artificial Sequence: Synthetic polynucleotide
gcgcgtcggcgttggggatggggtgggggcgttggggtataagggcgtaggggcgtacggttatcgatagtcgggtgcgtttagtttgaggtcgcggagaggagtcgaattgggatgggtggggggttttcggttttaatattgtttgttagttttagtgcgtttaagttttttcgttagagttgtttttttggaggggtttttcgtacgtattgttttttttatttttttggttggaatttttcggtcgttattgtagtgtttagagatgttgcgttgtagattcgggattttttaggcgttttttttcgtttttttgttaaagcgtaacgtttgtatttttttagtttttttttttttttttgaaattgaaagttattgaggtcgtttagggttgttgttttagtagttttttttttcgttttcgagttttttttcgttttttatagttatttttttttttttttttttttttgttttttttttttttttttttttttgtttttttttttttttttttttatgtggtgttttcgggagtttagtttaatattggagcgttttttgttcgcgtacgttagaagtagttcggggttttttcgtcgttttttggttatggtcgttgtgtcgacggcgttcgtttttttgcgttttaggggttttcgtcgttgtagtcgtagtcgtcgtagtttttgagtttaaggggtcgtcgttgtagtcgtcgtcgtcgtcgttcgttcgttcggatttcgtttgcggtagttgtcgtataatatgttatttgcggtcgtttcggcggtttttggaatttcggttcgcggcgatgttagttattttagcgaagtcgtcgtagtttagtgtttggataatttgaaagtataatagttggtttttttgtttattcgttttatttcgtttgttattatagtacgtttatcggatgtgagaggagaagtttcgttgttcgggtattgtttatatacgtttaatatttatatatattttaaaaatattaaatataattaataattaaaagaaagaggagaaaggaagggaagtattattgggttattatgtatttgcgattgattttttggttttttattattttgaattttatggaatatatcggtagttaaaacgtttttcggggaaggcgttagcgaagaagtaagtgtagggttttttacgcgtttgttttttttcgtcgcgtttatttgtcgggtcgttttgtttgttcggagtcggtttttaattgtagcggttttttcgttttgcgtttcgtagaggagatgtaggttcgggttttgggggtatggacggcgttttttatttttgtttttcggcgtttttgtttttcgtagtattttagtcggtgcgaggggcgggcggacgcggcgttaaggtggttttcgttttatggtaattttaggttcgcgggaaagttcggttttgggttagattcgtattcgggatttgtgttttttttttgaggatcggataggggtatttagtcgaaggtatttgggatttttagacgtaggatgtttttgatcgttgagtaaatgataagggaggcgcggtcgcggtattcgtttatttagcgtaatcgtttcgcgcggggagatttcggttgggtttttaggttggatttcggtagtcgaacgttcgttattcggttaggaagttagggagcgagcgtttgcgcggtcgtattttcgatacgtattagcggagttaaagggcgcgcgaggcgatggggttcgcgtgtttgcgcgtttgtagagttgtcggacgtttttcgttcg

SEQ ID NO: 6440 - DNA, 1323 bp, Artificial Sequence
  Description of Artificial Sequence: Synthetic polynucleotide
tcgaatattcgtattgtttatcgaagattttcgtgttttagttttttttgttttttatttttttcgtttatggttttcgtttttttaagtcgtttttcggaattttttgtcgggtcggcgggaagcgtggatcgagcgggttttggtcgcgtttttttcggttaggtttggtttagttcgcgtagcgttcgcgtagttcgttagggggatttcggttcgtcgggcggtatttgaggagaaagcgttcgaggggcgtggagttagggttttgcggtgtttgtttcgggaatattgcgagtcggttggagttttttagtcgtttcggagaattgggggagtcgggtttttggttcggtaatcggtggtttcgcggtagttagaggcgggttttacgggtgggtgtgttcgttttcgtacgttagttttttagttcgggaagagcgtttgtaagcgggtattttgtttttaaagatgggttttgtttgcgggtgatttgggttttcgaagtgtaattttgtggtcgggacgcggatcggtcggtttgggtttttgtagagtagattttgtttgcgttttttaggaggagtgggtggtaggattggggttttttataggttttggggcggcggcgagattggtacggttcggggtcgtaggcgcgtagttacgtttttggaagttcgtttcggttttcgtttttaattcgttttttcggggttttatggcgtgaggtttggggttgggatttatttggagtcgagtagaaaattttttttttttcgttttcggttttttttgttttttttggacgcggtggcggcgtcgtttgagcggcgatttttttttttttgttcggtttgttgcgttcggtgtttttcgagggtaggcgcgtttggattttgcgttcggatggcggcggttttttgtgagtatcggtagcggcgtattttttgtttcgaggttttcggtgttttttcggcgcgggtataggggcgtttttatttttcgttcgtttgtattttttgttattcgttttttcgtttgatttattcgttcgcggtggtcgttcgagttttgggatggggagggagatcgcggttgttcgcggcggtcgagattttcgttgacgttttcgattttgtcgtttttttcgttcgtttttagaggcgttcgacgtttcgatagtttttggagtgagattaggattgagaatagggagaggcgattcgatttttagggttcggtgtttaggataggtgaggggaaggaaagggtgttgacgggagtggggaggtgggtgggcggttatcgtagtcgaaatcg

SEQ ID NO: 6441 - DNA, 1501 bp, Artificial Sequence
  Description of Artificial Sequence: Synthetic polynucleotide
tcgatagtggtttttcggtttagggaggagagcgcggtcgcgggtttttttttttagtttggaggttgtagtcgttcgagtcggttcgggtgggggcggggtgggggcggcgcggagggtacggagattacggcggcgttattcgggatatttagggtttcgaggttttgggcggtttttacgcgagatcgtaaattatgataataggtagttattcgaggttaaataaaaacggagtgggtttttcgcgcgtcgtcgtttttcgcgtttttggcggtttttttcgaggttttcggcggttttacgagttcgtagtagtcggtggcgacgtcgttttcgttttatttttttgcgtaagtgcgaggttgtcggtagcgcggcgtacgtttcggtcgttttcggttttcgcgtaaaatttttattttgtttacgtgaagttgtcgttgttttagagagggggaaagagttgcgggaaaagtcggggagtgacgattgcggcggttgggcgcgtttttttattttttttttttttttttttttttttgtcgtagttcggagttttggttttttttttttttttttttttttcggagtcggttttttttttcgtttcgtttttttttcgtttgtgtacgttatttgttgtggggtggtcgaaggggatgttttgtttttattagaggtatagcgcgaaggggaaatttcgatattggaaggaacgagaataaatatttaattacggacgtattgaatcgcggttgggatagatatttcgggaattcgaggcggatcgggcgacgaggtgagtgatttttttttttaattttcgttttagggttttcgggggagtttgagttgagagaatttttaaatttttcgggaaagtgcgcgaggtttcgtcggggacgtcgagcgttgggtattgaggacgcgtagttggacggtgcgtgggcgtttgcgttttcggggggcgtttggaggtcgggtgttttacgtttgagggttcgggtcgttcggatcgtagcggtgttttttgttttagaagacgtttttaagttttaagggtttttttcgagtttgtttgtttttttcggggtcggcgcggagtttgcgcgtaacggagtttatttagtagtttagcgcgcggtttttatttgtatttcgtttttatttggtagaggcgcgagtatcggggttttttttatattttttttatgacgtgtattattttttgatgattttttagatggtttaggcgcgaggatgttgatttagagtttttcggagggttataggcgtttgggttttttcggtgtcgggtgcgtgtgtattttaaaggttcgcgttttaatttttaggtattgatcgggttttttaattgcggcgattttattttaatagtttttatgtggcgtggattgaatgttttttgtagtttgttagggtcggtgaaattagaggcgttttgttagagtagtcgcgtttattggttcgagtagcg

SEQ ID NO: 6442 - DNA, 1744 bp, Artificial Sequence
  Description of Artificial Sequence: Synthetic polynucleotide
tcggtgggtcgggggcgtggcgagattttgttttagtggagggagggtttatgtattgtcgagacgtcgattattagattttgattttgtcgtttttagaaaaattattggtagaagattcggattatggttaatttgtcggttataagtttttttaagaagcgttacgtttgggtgtagttggtagggtatattggtgagtagtggggcgggtgggcgggtgttcgcgacgggaaggggttgggcggcgttgacggatgtcggtttttagggagttttaaggcggcgggtattagcgggttgattttgaagcgttgttcggagtcggagcgttattgtttggcgcggttgatggttgacgcgttgcgcggttgcgtgtttgttttttacggcgtggtggagcgcgacggcgaaagttatttgtagttgtaggatttgttcgatggtttcgacggattttgtgtgttcgattgtaaaatgggcgttaggtatgcgtgttttgttaggtcggttggggggattaagtaggggttcggggtcgggatagttgtttgagggggattcggggcgagtgttcgaaggggttttcgtgtgcgtttttttatgttttggtcgttgtttgcgtttttataggatttatttagaggaggagttgattaaggttcgtgagcggtttaagttgcggaaggatatgtataagaaaatgttggcggtggattttgaagtttttacggaggaggagtacgcgtagcgcgtcgttattaagtcgcgttatatgtagtggcgggaaggtattagttttagtattattttcggttttcgtatcgagggtattaaggtgaggtaggcgcgtttcgttggtatcgtcgtagttttattgcgcgttgtttttttcgatttttcgttttcgtttcgtttgttttttcgtttttttttatcgtttcgtcgttttttgtaattgggaggtatcgttgttttacgttgtttttttttttattggcgggttcggggtttttgatatttttgttttatatttagaaagcggacggtttttgtagtatcgattttaagattacgcgaagtcgagagtaggtgtttcgcgtttttgaagagtttgtgtaaggagatgaggaagtgttggtgagagcgggattttaaattttgaggtgttggggagtttgaagtcgaggattgtttttgttatttggtttagtgttttcggttgtgtttttattatggtttttatcgcgttggttcgtaattgttttacgtttttttttttttgggttacgttgggcggggttttgggttttttttttggcggtatttgttaagtatagcgtgggtttcggttttttatcgttagtaggggtttatttggcgtttagttaatttgttttttttttttattttattttttgtagaggcggtatttgaatcgtttgtagtagattcgggatattttggaggtattcgagttttttaggaggtacgaggtaagcggcggttgttcgggtgttcgggtcgcgagggttagggcgggaattcggtaagggcgtttttgggtagggtcgcggtttgacggtgcggggttcgtaggtgatcggtagttcgtttttttttgtgtacgattattgttatcgcgtcggcgtgtggtttatcgatttcggtaagattacgttttttttcgatggttagattttggattatcggcggttttgggaggagggtaatcgcgaggacg

SEQ ID NO: 6443 - DNA, 1801 bp, Artificial Sequence
  Description of Artificial Sequence: Synthetic polynucleotide
tcgttttcgggcgataggggtttttttacgtgaatcgacgtttcgggtttcgggcgaggcgtagggtttagggcgtagggcgggtttcgtacgtagggcgggcgcgcgggtatttttgtggttaggcgatttcggttcgttttttcggagtttagggattttcgaggttggcgcgggttgttcgcgataaggtgttagtagtttcgggttcgcgaggagtagtttttattcgcggttttcgagtttagttttgttttttcgttattttttagtttttcggtatttatttagggagatagggaggtagagagaagaggagaaagcggtcgtgtttgtatttagtttttgtcgtagtattcgatgagggatagtagggaggttggcggggaggtagagattaaattatgattttatcgattacggaaagattattattatttatagtaaaggaggtttcgatgcgtttattcgggtagcgattcgcggttggtgggcgtttttcgttttcgttttttcggtggttgtggaatttatttcgcgtcgtatacgttaggatttttttttttttgattaaggggaggggaaggaataaaagagattttttattttttatatatatatatatatatatatatatatatatatatatatattttttcggtattttattgttggttaaaggatttattttcgtaatttttttttcgaatattttttttatttgagtagtgtatttttttaaaggtaaagagagataagggaggaaatatagtatttaaggtgattagtcgattggatattgttgatggtatatttttttcgtttttaattaatcgtataaaattcgtaatatttcgcgttttcgcggggtttttcgcgtttttggttcggttttttcggtcgtttttagtaggcgtttcgtttttcgcgggaattttgggatttggtcgagcgtttttcggcgggtaggatattcgttcggttttttgtagtagttgagggcggcgagcggatcgcgtttaggtagcgacgcgggatttaatttttcggattcgcggcgcggttttcgttttcgtttagggcgtcgcggttatagttgagattttagcgtcgcgtagtcgttttcgtcggggtatgggcggtcgcgtttttcgtttttttttttttttattttttttttattttgaaaaaaatttatttattggtgtaaagtagatattttgatgttatttatttagtatcgtttgttttggaggtagcgttttattcggtcgtttggaggtgtgggtagcgcgtcgatgggttcgggggagcggggttgggcggttcggttttttagcggagtcggtttgttgttattcgtttaattttagtatttagtgggcgaggagagagggagagcggcgaggatgtagaggagggggagggggaggagggagcggtgggcggggagggagcgagagtcgttcggtagcgcgtatgcgtttcgcgggtcggcgtagtttttcgttcggcgcggtcggaggggtagttttttagtttttgcgcgcggtcgcgagagtttcggtttcgtttttttttcgggcggttttcggtttcgttcgatttcgcgcgttcgtttgggcgcggcgtttatcgtgcggaggggttcggtcgggattttcggtttcggtgacgttcgttcggagtttcgcgggaggttcggagtttcgagagtttttttgggtgatagcggtttttcgttcgggtttttgtaattttattcgttcgtagttcgcgcgttgttgttttgggttgcgcg

SEQ ID NO: 6444 - DNA, 1801 bp, Artificial Sequence; identical to SEQ ID NO: 6443
  Description of Artificial Sequence: Synthetic polynucleotide

SEQ ID NO: 6445 - DNA, 1684 bp, Artificial Sequence
  Description of Artificial Sequence: Synthetic polynucleotide
gcgttgggcggtgagtttagttaggttatttttgcgaggatatcggtcggcggcggatagtagtacgcggcgtttaggattcggtttttttagagtttaggttattgtagtttttaggggcgtttcgagtttatttggagggtcgcgaggtttttaggttggaaggaggaatagggagaaggaggaatagggagatttggggtagtgttataattatagaaaagggagaggcgaggttcgttgagtttttggtttgggtaataaggtatattgaaaattgggttttttttcgattcgtatcgtgcgcgttttagaaatgatagttagacggagtagggtttaaggacgttgaaaatttttgacgtgggcgcgtcgggtgcgggtagggacgtggaaggattgggttagttataggaattatagcgttgcggatcgggtgaggggtttcggttcgagtttttatttggggcgtagaggtgtttttgtaaggggataaagggtatttttcggcgcgatgggcgatttttttagttagaaaatgagagggttagacgaggggaggaatttttttagttatttggttcggtatagcgatcgttttaagtttagaatcgttaagttagttcggggcgtttcggttttttcgtttcgcgtttcgttcgtttttagttcgggtttcgtcgttttcgtcgtttttgtcgttcgggtcgttttcgtcggttttggtttcggtttcgtatatcggtagggggcgttcgagcgtagttaaaaggttcggcgggaggtcggcggttttagtggcggagcgcggttgtcggtgtgcggtcgggagcgatcgtcgcggggtaggggcgcggcgggtatcgcgtagagcgcgtagaatagacggacggcggcggggattcgacggcggcgtttcggtattttttagatttcggttagcgtttttttgttagtcgtaagtatttagtttcggtttatttcgggttttcgatggttttcgaggtcggggcgattttgcgcgcgtcgcgtcggttgttttgggcggcgttgttgtttttggtcgcgttgtttttcgtcgttttttcggcggcggttttaggtacgcgtcgcgttcgggttttcggcgttttttagtttttcgcgtatttttttgcgttcgggtttcgtcgtttcgtttagtgttggttacgggtcgtgttattagtttgtgcgttttcgttattcgcgggtcggggtatttggcgttttgtgtgggtggcgggagcggggacgtttcggtgttcggggatcgtagcgcgttggcgtttaattttgtcgtcgttcgttttggagtcgggaggttttagtcgtttaagtgtttcgggagatttaggtatagcggggaaaaaaggaaaagaaaggcgatttttagcgtgcggattggggtaatgtttttttttgtttagaatttttcgggagcgtaggtggttattttatttttttcgcgtttatttttcgcgaggtaggatgacgggcgtattcgggagatcggagggaggtagagtagggttgttttagaaggtcgtgggggaaaggttgcgagttgtcgtagggcgtcgggtgtttttgcgttttagaggagaagcgttttagtgttagttcggttttaggcggtaggaggttcgcgcgttcggggggaacg

SEQ ID NO: 6446 - DNA, 6657 bp, Artificial Sequence
  Description of Artificial Sequence: Synthetic polynucleotide
tcgggttcggttcgttttgtttttttgttttttggaggtttgggcgttttcgcgtagggattaagggttggatagtcgtaggtaggggtttcgtttttggtttttatttttcgtgtttagtaatttcgggagtaggcggcggtattttttttatgtttcggttttaattacggttttagtttttttaatttcgttttgtaggaataagtgtggtagaggttcggggtcggagggcgggcggtcgtttcgcgggttggacggagtttttgggttgcggagaggtcgttggatttacgttcggataggagtttcgcgcgtttattttcggttcggttattttcggggcgcgttgtttgcggtttttcgcgttatttttatttttgtttcgggatttttttcgggaaagatattcggggagtagtttttttttttttagtagttttttttttttttttttttttgtttttttgacggtgtggggtttttcggtcggaggggcgcggcgttggtagcggggtttagagtgtcgcgtttagcgcgcgttgggggtttcgggtttcgtagtttcgtacgcggtcggtttgtgaagcggcgcgcgggggtttagtcgggcgagggcgtttttgagtttggtttggaatttttagtttatacgaaagtcgtaggttggggaaggggcgggtgggagcgggagacgttttgggaagtcgtgagatcgttcggcgagggttcgggattattagggagcgacgggggatttttcggtttagagttcgagggcgcgatttcggattcgttgggatttcggaggtatatgaagggagagggaaattcgttaaatcgaatttttcgggaatcggaaggcgtcgggtcgtttttacgttttttttttttttcggtcgaaaggcggggggcgacgcgtaacggggagggaagggagggaggggtcggcgattttaggggagggcgagtttttggggacgcggggtcgttaggggttcgacgattttttcgttttattttttcgtttttaagtgtttcgtttttttttcgtttcgtaaacgcgcgttttgcgggttgtgttttggttttcgcggacgcgcgcgtttatagagggtttgatttggggttaatttttacgaggttgtcgggcgtttgtgagtatagtcgtgtttttatttaggggtttattttttagcgttattagggtttcgatttttagattttcggacgttttttttttaaatcgaagtttgggagtttttgggtggtttggggcgggggtagggggcgagcggggcgggttaggaggagggggcgaggtcgttattcggttttttacgtcgttttcgcggttggttttaatttttttttcggagttttttttcggttattttttagtttatcgacgtgcgggtagcgatttcgtttttcgttttttcggtcgttttcgtcgcggttttcgttttttttttattttttttcgcgcgtttttttatatgaaattttttattacgtttagaaagaatgtgttataatttcggcgttgtcgcggtcgttattattgcgttcgcgttcgagttcgagtcggagtcggagtcgtcgttttttcgtttgttcggttagtttcgggtttcgagcgcgcggttttcgtcgtcgtcgtttcgcgttcgtttcgcgtttgacgtagtgagcgtcgtagtttggttttcgtcggtttcgttgggtttcgggtcgtaggtcgagtttagtcgggcgggtttcgggaggggtcggtagggcgggagggggaggagggttgtttggagttagcgagttcggaggaggaagaggaggaggaaggaggggaagtcgtcgtcgtcgtcgtcgtgttcggggaatcggggtgcgcgcgttttgttcgttcgcgatagtgtttttagttcggggttcgtatttcggtttaggtaagaaggggtttgaggggtagggggttgttcggggtcgggggatttttttgtcgtcgttgcgggatcggagggttttcgtttttaggggaggtagggaagaggatgttttttggggggggcggcggggggtagcgtagggtttttagcggttttcgtagttcgggttattttatttttggtgttttgatttcggcgttcgcgttagggtcgagttttttcgttcgcggggttttggatgcggcgttcggggttcgcggttttcgggcgtttttatttatttatttaggttcggaggcgggcgtattcgaagttagcggtcgtcgagtttgggtcggataaattttttttttcgacgtcgcggttggaagggttaggatttcggatttttagggttagggaggcgtcgcggggatttcgaaatttttcggagcgcgttgagagtaaaaagtcggttgggtagaaagagggggagggggttgggcgcgttttcgagtgcgttggggtagtcgcggcgttttaagttgaattatagacgaatttttttttatttgaaatttggtttcggagtcggaggtggggagggagtgggttgtgggtgtttcgatttcgtaaagtcggcgtgggggggcgtagcgtttcgtttcgcgtcgtttgaattttcggagggggtgttacgggattttcgtttttattttagtcggtggttgggttttgtcgatcgttgcggagttttcgggaaggattcgttcgcggttattaataggcgtcggtgattttagtttttttcggttcgggaagttggcgtggcggggttgggttgggttgggttgtcgagtggggcgggatttcggggtttagagcggatttttagtttttttggtttttttttcgtcgtttttttttttttgtcgtttgttttttttttatttttttttttcgatttcggggtgtcggttttttttcgaattttttttttttttaaattgtacggtggttattcggttacggttttgggtcgtattcgcgtaattttagtattattttcgatcgagtttttcgtcgcgggttgagcgcgagttttcggggttaggttgtttagggaggagtagggattttttataattcgcgtttttttttttaatttacggcgagcgtaatatattcgttcgtttttgcggttttatttgagggcggggagaggtcgttgggggtagtttcgggggttgtggagggtaggggggattcgcgaagtttttggagcgtttagggatgtagttcgggcggcgtgtgtagggaggaagtagcgtttcggcgttttttttttagcgtcgttttcgcgcgtttcgagggtttaggagggttcggttttttttattttatttggatatttaggtttgagtttgagtggatttgaggatttgggggacggggaatacggagtttttttttttgtttcggtgtttgtagagtttagtttttaggtagcgtggggatttttgtttttagggttagcgtcggtttcgtttttcgtttcgttaatttcgggatttcgtcgttttttaggttttaattttttagttttatcgtcgcgtttttttttcggttttgggtttgggggaggggtagggggcgtggagcgcggcgttgggtttcggatagatgttttcgcggcggcggcgtcggcgttcgggtaatagtaggtcgttaatcggcgcggttacgggggaggggcgattcggtcgggatttcggggattcggtcgtagtcggacggcgtagttttcgttcggggtggggggggggggcggtcgcgaggattcgatttttgtcgtgtagttcggtttttagttttttgtcgtttttttttttagttttaggtttcgttttttgttggggttttggttttttaggttgcgggatttcgttttttacggtttcgcgcgcgtatttttattcgttttttaagttgatttttgaggtttttcgtggattttagatttcgagtgatcgtagaattgatttttggggttaggtagtatcggttaagggcgttttgaagaggttttcggttttagtttgtatttcgaggaaatggatttattatgtttgtttttgggaagtagtaggacgttttggcgcggttttttcgggtaggcgtttagtatagcgtagggtatacgggggatatttgcgaaggtaaaggaggtttattttagagtttcggttgtatttggttagtataggtttgggggaatttgttggaaatggggatttagtattttttttggggtttatgtttggtaggcggagtggataggttggggttcggagttcggtggttattttttgtataaggttggttaggttagaagttggagggtagtttattgggattttttaagcgtgattaaggaagttttgggggtcgattagtttttttttagtggagttgtagttggggagattttatagataggtagggaggagagggtgtttcgtttatcgtcggtttcgttttataggtttaggtttggtatattttaggtttgtagtatttatttggtgggtaaataaggatttgtttttggtttgcggtttggttttgatcgtggtttaggtcggggtagagggagaaaggttatagtttaggtgttttaaattatcggtgttttttttgtcggtttttggggttgtgttgggtttttagggtttttgttttttagtatttgtatgaaatcgtgggggcgtattggttttcgttttagtatttttttttaaggttttgtatttttattacgggagttttatttagttagtcgaaggaggttataagttttaaattattaaattcgggttagtgttgggggtttgggagttaaggtagtttagagtttatttttcgattttggtttttggagaattttaggattcgggcgtgttaggttttgtagtcgggttaggtcggtttatataggattgaacggcgtcgtgggcgtttatttatatttttttttcggtttttatatattataggatttattttgatttgttgtttttgaattgagttaatttttttgtatgttcgttgaattgtttagttgttggcggcgagcggagagcgtgtcgggggtattgaggtcgggaattagaggcgggcgggggataggaagcggggagggggcgtcggcggggacgcgcgggttgcgcggggattggagagggtttttaggcgtcggtcgttttgcgaacgcgggtttgtttaggtatcgtcggggtttgttcggtttgagcgtggagtttcgaggtttttgtcgggggtttaggttgtttttggggttttgttttcgacgcgttgtgtagggttagattttgggttttttttgatttagtttttttttttgtaatatgcggacgggggttttcgtataggtaggttgttagggtgaaattgagtcgaagagtgttttagaattttttgaagtttttatagaggttggggtgaatgaaggaaggaagcggggttagggttgggtagaggaggttcggtttgcgttttgcgtttttcgtttttaggtttttgttttttcggataaggggcggatcgacgggaggatttgagaacgttttggttttgtttgaggtggtgggagtcgcgggtagtttgtttagttaatagttgtcgtttttattttttttatttatttatttattttttttattttttagatgtgggcggggagggtcggggacggatcgcgaggacgttttttgcgttttttaggattttttttttttttttagtttttgcgcgtcgtcgggagagggaaggagcgggttgtcgcggggagtcgaggagagtagggggttcgggaggttagggagagaaggggagggttagaggtttcgagtcggattcgcggcggaggaagagggggtggaagggagcgcgtaggcgggtgagggagcgagggagggagagaaggagggagggagggagggaaggggggcgggagggggtagggcgagtttgaattttttttcggtcgcgcggcgaggggcggggtcgcgcgcgtagatcgatgggcgaagttggggaggaattttaatttcgggagcgaagttagagtttgaaggacggcggcggttgcgggcgtagtttcggaatcgaggtcgggcgggtaggtaagcggcgagcgcggtcgggcgttgaatttgggggatttgggattcggattattttcggggagcggcgcggttaagtttttcgttatttcgaatttcgggcgttttcgagtgcgtagcgtgcgtttttagtttttgttgcgtttttaggtttggcgcgcgattcgagcgtagcgggtaaagttggaggaatttggcggcggcggagcgggcgtaggtttagttcgataaagttcgggggttcgggtcggggtcgttgtcgtagttcgtacgttgtttcgtgttttcgagaggttttttttttagcgtttttttttttttcgttttttttcgtcgttcgtattttgttcggcgttttttagacgcggttttttgttttttttttttcggaaattagggggttgtttttattttttggtcgagtcgttgatttttttttaggttcgtatcgttttttttgttgggtcgtttttttttcgacgttgcgagttttttcgtttcgcgcggggatcgtttagttacgtacg

SEQ ID NO: 6447 - DNA, 546 bp, Artificial Sequence
  Description of Artificial Sequence: Synthetic polynucleotide
gcgggcgtttcggttattttattttagcgagaagacgaggttgtttgggttttggttttttcgggcgggggttaggggttcgtcgattttttttagcgtttcgggcggcggggttcgagaattaaggtggttttcgcggttttcgtcgtcgcgcgttttttttttttttttcgcggattttcgcggtcgtcgtttatttcgcgtatttcgttttttggaaatttagtagtcggggggcgaatatcgcggcgtttttatgggaatttggtttcgggtttagagcgcgggtagttggtagagtttggggggcgcggcggcggtagtagtaggttggagggcgcgcggcgggggttaaggggatttggtcggcgttcggagtcggagtcggagttcgagtcggagttggaggcgttcggagtcgtcgacgttaaatttcgagtagatggtggcgggggcggggcgggcgggggtacgggggggttttcgggttcgcgttgttaatcgtttaagttcggttttttttttttcgcgatttcgtcgttttcg

SEQ ID NO: 6448 - DNA, 288 bp, Artificial Sequence
  Description of Artificial Sequence: Synthetic polynucleotide
tcgcgagaggaagagagttgagtcgttgtaattttgggtttgggattgcggggacgggacgggtgggaagcggttaaaggcgtagcggtttttggttagagtcgtagaggtttgagacgtgggtcgcgtttcggtttaggagatttcgcggtcgcgttttaatttttagtttttcgattgcgattgcgattcgggaaaacgtttacgtttttggaaaggaagttttattatagggagttgattcggtgttagcgcgtagtacgttttcggttcgtagtgcgtcgcgcg

SEQ ID NO: 6449 - DNA, 947 bp, Artificial Sequence
  Description of Artificial Sequence: Synthetic polynucleotide
tcgtatttgtttcgcggttcgtttttttgtatatacgttttcgagtcgggagagttttcgtagtatttagagaagagatcggaatataaaggatgaacgaatggggagggggggtttggggggttgggagaacgaaaatattagttgcgtttttaatatttaaggaaggaagtggtagcggggacggggagaggatgggaaggggatgttgattgcgagttggggcgggacgcggtgatgggaggggatcgggtcgggaatgcgggaggcgaggggagcgacgggatttgtcgtttcggcggtcgggtagttaatcgattcgttttttttaggaaggagcgaggggagggtggtttagagagaaagcgtcgcgcggtttcggttgttttcggttcgggatatttaaatagattaaagaggattcggagtggagttcggagcggatttcgtagttcgcgttcgtcgcgtatttattcgcgcgttcgttgttgggttttcggtagtcgcgttttttgcgttggcggagtcggaggagtttgcgttgggtcggcggggggcgggcgtttggggagggcggagagagggttcgttcgtcgggatttttgttcggttcgggcgttttagagtcgcgggattggtcgtcggaggttgcgggaggggttcgggttagattttttagaagttttagagagagtcgttttttttttttcgtgtgattttttgggagtcgggttgttgacggtttagcgtttagtcggagttttcgcgcgtttttcgggatttattcgggagatgtcggggtttttcgggaagagtgggttgcgtttgtttttcgcggtcgtttcgttttttcgttgcgcgggatcgtggggtttgagagcggcgttttttcgcggggtcgaattcgttatttatagtggagtgtggattgatatcgcggttttacg

SEQ ID NO: 6450 - DNA, 1313 bp, Artificial Sequence
  Description of Artificial Sequence: Synthetic polynucleotide
tcgtgttatacggcgttgggttttgtaagttgttgtttgcgtagtcgttttcgtcgttgtcgttttcgggcgggtgtattagggttcgcgtgggcggggcggggtcggggcgggatcggggcggggtttgttttttcgacgcgtcggtttcgtttttcgtttcgtttttttttagcggatcgtaatgatttagaagtttaggaattttacgtgacgttatcgggggggtgatgtaatgtattttaaatagaatgtattgtaatttttgtttagtttaacgtggtttttttattcgggtttcgtttttgttttttttatatttgtttggtaagtttttaaaaatacggttcggttatttttggggtttttgtatttagttatttttgttgtatttgtcgtaggagttatttcgggagtgtatttgtttgtaggggttggttttcggtagtagtcgcgaggttatttggtttagtgggtaggttatagggtaaggagtagggaagatgcgatgtatttttttttggagggtgatttgtgtttgtaaatattttggcggattagagggaagttcggtttcgagtgttggtagattgtggaattcggttgtgttttgaggttattttagagatttcgcgtcgcgtgagtgtcggagcgttcggtggtcgtcgcgtcgcgcgtttggagggatgttaacgtggagtcggcgtcgagttcgttcggcgtgcgtgcgtgtgtgggagcgcgcgagttttttgacgcggggattagttatgaatcgggggtgtgtgtttgtttttagagatttggtaaggtgcggagttttttagaagtgcggttaagcggtagcggagacggcgagttaggaattttttttcgcgtttttagttttttagcgtggcggcggaattttcggagaaagtttgtaaatttttagcgggcgcggcgaggacgtcgggttatttagggggcgggtgggcgcgcgcgtagggggttcgtttttttcggtgcggagttgtagttgttatttttttcgtcgggttgtcggttgtagcgggtgggcgcgcgttcggggaggggaggtcgttttcggagggcgtttggttttcgttttaggcgtttcgggttggagagcggcgaggtttcgttcgttttagtttattttttcggtcgttttttgttttcgttgtttttttgttggtatcgttattttttttcggtcgttgttttaaatgatagtttcggttcgagttttggcggcgtttaggtaatttttaagatttggcggcggagtttttttttgcggtagattttcg

SEQ ID NO: 6451 - DNA, 848 bp, Artificial Sequence
  Description of Artificial Sequence: Synthetic polynucleotide
tcgttttttcgtttagttcgcgatgtttagttaggcgcggcgcgcgtttgttcggtattttttcggcgcgtttttttttttgcgtttttagatttcgatttagagcggatttcgatcgcggtaaattatggttttaggtgcgtttcggaggtagttgcgggaattagttatggtttcgggttaatgtttagggataagtatagggatagggatagagatagggattgggattggattttagttttaagagaaagtatttcgggtttattcgtattttttttttatttttaaataaagttatagaagcgattagcgcgtagttaaagggtttggaggtgaaaaggagggttgggtggggaggagagaaagtgagaagggagagaaaagcggcggttgagtaaagcgggagtcggcgcgggcggtggggtttgattcggacgtcgcgtattcggtttcgtttcgcgtttagcgtttcgtttattttttggtcgcgtttgttttcgcgtttttttgtttttttttatttattagtagttttgttgataagcgagaaaattgataagtgagaaaagtcgtttgttagcgttcgggttggtgtttgggttgttatcgcgggcgcggagggaggggcgcgcgggtatcgtcgtttgtcgggtatacgttgggtttcgatttcggtcgggtatatttattttcgtagggtagtcgcggttattatcgatttgcggagttgcgtgggttttcggaatttttattttaataagagttcggtttcgcgcgtaagtaggagggaagggaaatttttattttttcggggttagggtacgtagaagtcgcgaggtttcgcg

SEQ ID NO: 6452 - DNA, 2406 bp, Artificial Sequence
  Description of Artificial Sequence: Synthetic polynucleotide
gcgtagcgttatagtcgcgattgcggcggcggcggcggcgtagggggcgggggaggagagaagcgtttatttcgtttcgttgttttcgtagtagttttggttttagtttcggcgtattagagcggtttttgggaatttttgggtttgttgtttcggcggtcgttagttgggagtttattatcgttcgatggtatcgaatcgattcgtgtagttttataattttagtttaatttcgaggagttagcgtagatcgtttttcgtttttagttgcggcgaggtaagggttggtagcgttcggacgttttcgttttgttttttttatgtttaagcgcggggaattatacgttttcggtgtagaatagacgatcggggttattagggttgggcggtgggagtgggggttgggagtattatttttggttggacgtgtgtttagatttatcgtttttggtttttaggattttatttttttttgtatttttaggtgtcggtttttttgtattcgttttttacggggttcgttcggcgaagggtagtcgtagtttatatttatttttcgtttttaatttttgttttttttgttcgtcgtagttattcgtttggttgggagtaagttttttttttcgttgagggtgtagagagcgtttagggcgttaagagtagaggggttaaagtttaagcgttattagttagtcgaaggttttgagtttttagggtcgcggtcgggacgtagggaggttaggacgcgacgttcgttttatttgtttttttagcggttttttggtcgatagcgtcggtttgggggagggcgcgcggtcgtagacgtagttttttagtaggtaaagtttcgagggtcgcgagttcgagtcgttttcgaagtagaagagtaggttttgtagtagcgcgaattatttggtttgttattttgtgttgttcgaatttcgtttgtttaggtagtttttgcgcgtgtcgtttttgcgcgttagtagttttagggacgcgacgtggttattatttagtcggatttttttttgtatggtgtttagaggttagcgagattttacgcgtttatatttttttcgcgtagtagtttttcgttcgtgcgcgttgcgcgttgtttttttttggcgttcgttcgttcgttttttttagtttttttttttttttaaatatttatattttaggatttggcgtcgagtcgcggttttttgaatttagatatattatttttcgttggaatttttttttcgtttcgtagagttttagtattcggaagatgtcgttcgattttttttcggtgtcgggtaaattgagggattggcgatttgcgcgttggcgaggggtaggcggagttatgtgacgtcgatttttcgaagagttcgttttagtagcgcggatagggatatacgtacgtagtttcgtcgaggcgtagagtcgcgcgtaggttgtaatttggtgttttttttttttttttagatatatatatacgtatacgtatacgtatatatttaaattttgttttttttttttttatttttttttttttttttcggatgttaaaaagtaaattagattaattttcgtttaatttaatgaaatttcgaaggttcgttatttcgggagtttgcgtttttgcgttttatcgcggcgtattgtagatttggggttaagtgttagttgttatttttttttttaaaggttcgttttttttttttattttatttttaatacgaggtggaaggaggaaggtgggtggcgaaatagagttgtaaaagcgtttagttttagtttttgtatagttagtcgggttatattgaattttagtattcggttgtattttcggcggtttttttagttatttgaggatagtatagggggtgagatggggtggtggttggtgaacgttggttattttattttatattattttattttgagagttgttataattatcggcgttatttttcgtgtattttgaggtttggttggcgagtcgttgttgggagttttttgtaaatattttttaaagtttgaaggcgggttttaaacgtaggcgtcggggattatgggagtttttaaatagttgcgttggcgtaatgatattttaatgatagatttttcgtttttatttttagtttttattcgtttatatagttatacggtatttattcgagaacgttatagcgttcgtatgttgtatcgggagggcgcgcgggtcgtcgggcgagtcgggagttggggcggggagcgcgtatcgttgtttgtcgtagagggtagcgagttcgtttcgattcggagtaagtcgcgtttggttcgggcgttttgtagcggggatgggtgttcgcgtagttttgtgaaggaaagatattattttttcgtacggaaattgcgtatatttttttttcg

SEQ ID NO: 6453 - DNA, 1218 bp, Artificial Sequence
  Description of Artificial Sequence: Synthetic polynucleotide
tcgcgtttgtagttcgtgtattttttttcggagttgcgttagggaattacggacgaattggaaggggtcgagaagggttttggttattatttttagttttaagttttttcgtttttttagatttgggatttttttcggggaggattttttggcgttttttggtagtttttcgtcgtttagggtcgatttttttatttttagttttcgggcgggggaggtttcgtacggtcgtttagacgggttggggcgggaagattgtagcggttttgggtttattttttgtttttttataatttttagtggagttgggttaattttaggtatagtttattcgagttaggcgaggtttagaaaggtttgattcgtttggtagttttaacggatttgttttcgtagtcgttgattagtcgttgacgagcggatttttcggtcgttatggcgattgtgaaatgtagggtggagcgtatgcgttcgaagttattcgcgcgggtagtttttgcgtgtttttttgcgtgtttttttacgtgttttttagcgcgcgtagtatttcgtttttgcgttttttcgagcgtgtagttttcggtgagggtagttttacgtatagtttttaatattttttttagcgtttgtagttttcggtgcgcgtagtttttaagtttatatgcgtagtttttattttgcgcgtagttttacgtatagtttttaatacgtttttagttttattggcgtagaatttattatcgtttgttttttacgcgttttattgggagtgtagtttttatttcgagcgcgtagttttacgtagtttttttatattttttttagcgtttgtagtattttttagtgcgtatagttttgttagtagtttttcggcgcgtcgtttttgtatcgtttcgggttataattttgttggcgattaagtttgaagaattttttgtggttttatttttttttttaggtttagttttagttttgatattttaattaaaaggttatacgttaattaacgaggtattaaaggggaagattttagttgaaagaaatgattgtaggaagtgtgttagggaagttaacggaatcgttggttcgtcggtggtgcgttcggtattaggaaagtttttacgatcgttgaggtatcgggtagttagtgttcgttgttaacgcggagggaacgggcggagattgcgggtaatacgtggtagagtcggcgtgagttcg

SEQ ID NO: 6454 - DNA, 1848 bp, Artificial Sequence
  Description of Artificial Sequence: Synthetic polynucleotide
acgacgaaggcgcgtttttttttattcgtttatattatattttcgtttttcgaagtatagttcgggttggagaagttttagcggcggcggttttcgcggcggaggttttcgcgcgtatttattatgtttttcgttttttttcgtttatttcgagcgtcgtgcgcgttcgaagttcgagtcgtagagcgttatcgcgtaaaggaaggagttaggcgcgtgcggggttcgcggagtttttttgaattttttggatgggggcggaggcgaggggcgtcgttattattgcggtaaatttcgtttttttttcgggaggtgaaattttttaattcgttttcggtcggttcgcgggtcggatttttcggaaaggattttttaggaggagggagcgaatgtaagttttgttcggacgttttatcggcggttttttaaatttgggcgttttttgatagttatttttattttatttcgtttttacgttggggattatttttggtttcggaggcgcgggcgcggtcgtaggagcgggttgcggggttcgcgaaataaagaatttcgagcgggacgtatttgcggcggtagcggttgttaagttttcgaattttttatagattcgcggacggggcgtaggttggcggtttttcgtttcgcgcggtcgcgggcggttacggttattgcgagcggtcgggttgggcgcggggtgcgttcgtcgcgggtatggtgcggcgcgggcggtcgcggggcgcgcggggaaggcgggagagcggcgcgggtgagtgggagcggcgggtgtgcgcgagtgcgagtgtgcgagcgcgtcggtggcgttgtttttgttcgttttttttcgttcgtgtagtttcggtattagtttcggggatcgtgtaattcgattttttttgatttataagttttgagtgatagttttgatttggtttaatcgcgggagggaggggaaagagaaagaaagaaatttttagtcgtacgttttttttggtatttaatcgattttttggaaaaaggttttatttcggtttggtgtttcgtgttgggtggagaagtttttcgtttcgatttggtatcgtttgtattatttacggggtggaaaagttgtttttcggtttcgcgtttttttttcgcgcgttttttttttttttttttttttttttttttttttttttttcgcgtttttttttttttaagttttaatagatgttgtcggatttttttcgttttttcgtatttttttttttttcgtttcggttttcgtttagtttttttttttttagttattttcgggttcggaggggacgcgttgagtagtaggacgtttgtcgtcgtagggggcgaagttgggaaaatttggagtgttgttcgttttatttttgttttttcgttttttttaggtcgcgtcgggagttttcgtttttttcgttcgtcgggtttttaagttcggagtgggttttagttgcgaggcgggcggcggcggttgggaggcggcgcgtcgcgggtcggggtcgggggttgggggggagttcgggcgtcgcgagttacgcgcgcgtttttttttcgtttttcgtcgtcgtcgtcgtcgtcgtcgtcgttttttttttttttttttttttttttttttttttttttttttttgttttttttcggtttttatatagatatatttatgtttgtttttttttttttttttatttgatttcgcgttttttcggcgcgtcgaagttttatttattcggcgaggggaagggggttcgggcgtgatgttattcgcgtttttttttttttttttttatatcgttaggatattttttaaatgcgcgttttggtattcgtgttgcg

SEQ ID NO: 6455 - DNA, 2119 bp, Artificial Sequence
  Description of Artificial Sequence: Synthetic polynucleotide
tcgtcgtttttttagtatagttttcgtagttcgtattcgtttatagggttttcgcgattttagagtttagggaagaattgtcgaggggcggggggttttttatgcgtatggaagggacgtacgttttaggtttttattttttttttgatttcggggatttttggacgtcgatttttcgtttcgtaggggcgagggttttgggttcgtagttagacgcgggttttttttaaatttagtggtttggttttattgagtgggggaaggtatatattttttaagattaattgtttcgtaatagggaatttcgtaggattttagtattttcgattttttaggtgacgttaagagggtgggttttattgtgtacggtggggaaattgaggttcggaggggataaggaaggtattcgaggttacgcggttttttcggcgggcgggaacgtaggacgcggagttggggcgcgggttgtgcgcgtttaggttcgcggttttcggggttcggttgtcgtagcgcggtcgtcgtcgaggattacggtcggggcgcgggcgggttttagtgcgtaggcgcggcgggcgggaggggacgcgtttcgggcgcgcgcgcggggtagtcggcgttttaatttcgttcgtttcgcgtttcgcgtttcggcgtttcgtcgttcgtcgttcgttcgtttcggcgtcgtcgttcgcgtttcggcgtttcgggtcggcgaggggcgcgttcgcggtcgcggtcgttgtatggcgttgagatggcgggggcgtcgcgcggcggaggcggcggcggaggcggcgcgggcgagttcgggggcgtcgagcgggcggtcgggataagtcgtcggcgcgggtttcgggcgtgcgacgaggagttcgtttgtttagagttggaggcgttgtttcgcggttatacgttgcggttggagtaggcggttacgttgaaggcgttggtcgtttttagtttgttggcgggcgcgttggcgttggtcgagttgttgggcgcgtcggggttcgcgttcggtttggttaagggtttatattcggtgtattgcgttttttttttggcgttgttcgtggtaattaacgttcggtttttgtaggtgttttagttgtagtaggtcggttagttggcgttgttttttagttttattttcgcgttgttttgttgttttttcgcgttgggcggtttcgttcggggtttcgtcggggtcgttggggggttagcgatcgtcgaataaggggtttggtagttttttttggttattttcgtgttttatgttttgttgttcgtgcgtagtttgttggttataggttttgggttcgtggtggttgcgtcgtatttgttggttatagttattttggttttcgttaagcgtttacgtttttggaggacggtaagtgtagtcgcgtattttttatttggtttcggatatatttgttgggacgatgttgggaatgttcggagtcgggcgcgtttttttttatgcggcgggtggggatattgaggtttcgagtgggggtgtgtttaaggttatttttacgagttggggacgtagtcggggttggtatttttcggttagggttttttttagagttataatttacgaagcgtttttggcgtgaagtgtggagaggggagataggtgtggagagagaaaggtttggttaaggttagggagttgatgagcggttagacggcggttagaggggttcgtcggttttttgtcgtatttatttttatagagggattgaaagtgggcgaggagagtagatttttagggtaagttttaaggtcggttttgcgcgtagcgttgggttttttttttgcgtatttagagcgcgtgttgggttcgttttttaattttgcggattcgagggtggtatatgggtggtgggaaaggatttcggtttttttagttttgttggttatttttttgtggatatgttttcggtttagaaagagtggggtttgttaaggttaaatatagtttagtttttgtcgttgttattcggcggttgttttgattttgttttttttgcgttcgaattttgttattgtttttttagtcgggcgggcgagatggttgtaaggacggggacgttgtttgtttttcgcg

SEQ ID NO: 6456 - DNA, 562 bp, Artificial Sequence
  Description of Artificial Sequence: Synthetic polynucleotide
tcgtagggcgaaggggtgcgttgttagatgtggtattttcgttttacggagatatacggtgttttatacgttagggagaggtttgagacgtaaagagtcgtcgagcgggttgcgggattgtttcgttgttattttcgtttgtagttattttttcgtacgtatttgtgtgtgtatttaggttaatatggaaggcgttattttaatttttgtcgtgagtaggtgggagggaagagagacgagaggtattttattggttgtttgggaaaatgaattgtattttttttttttttgcggaggattaattttttttattttttcgggtgggtattcgtattttggggtcggagtttgaattcgggagttaaggggttttagttttagggacgtgaagttgagcgtatagcgggcgtttttagatattggggaaagtgttttacgatgtttcgagtttttttagtttcgttagcggggcgagcgtgagggtgtttcgatcgattagcggtttcgggtgtagggtggcgggttcggcggcgcgcgttttttttttttttttggcggttcg

SEQ ID NO: 6457 - DNA, 1404 bp, Artificial Sequence
  Description of Artificial Sequence: Synthetic polynucleotide
tcgtttcgttcgaggcgaaatcgttgaaagttcggttatttaatttttgtttttataattcggaatttcggatattagcggttttagttgttggcgcgcggtttttttttagttttttggattttaaagttttttgttatagcgcggcgttttttttttttgttaatttttttttttgtattgtgacggaggtaaagtaatttagtttaggaggttgaattcgagttattagagaaggagaaatagtgtcgaaaacggttcgtgcgttattagggtagtttattaacgtattaattttaggttcgttgggtagaagtcgggaggaaatattttggggatcgtatttttggttaaatgtttagtacgagttaaattcggtttttttaaagcgagttaagtttattattataaagagatttttcgagtgttttgttttaattatattttagatagttagttttgtggttgttgtttgattttaattttttttttaaatttaaaaggatgtatatttttattagacggaacgtcgcgatttttcggcgaagaaaaaggcgtcgtttattttttttttaaaacgttataataaaaattattacgtttttttttttttttttttgtttttttttttttttttagattaataaggaaaggagcgagcgagggcgtagatgttttttggttaagtatttttcggatgttttcgattaaagcgtttttaaatgaatttgtagtttgcggaagtcggggatatatttatagacgttttttgttgtttagattaggaggggtggtgggggaattaggaagttagggagagagtaaagtttttggacgcgttttaggaggaaaattttgtgtagtgttgttaggcggaggttcgttagaaggtttcgtagttgttgaggcggggtgggattgcgttttaggggtcgcgttgaagttggcgtcgcgattattgcgtatcgatttcgtttattttttgttcgttttcgggagttttttttgttttaggacggttttttattttttaaattatgttcgttttttatttcggatttatagttatttttaaatttcggttattttcgtttagtatcgcggtttttagtatatttttttattggagtagtaggtgatttaaattagatttatttgttgtgaatttttttttttttttttttttttttggtgtttttttagggagaggggaacgggatgtaggttgaggtttagcggcgcggtaattcggggtatcggcgcgcgtttttttgagtcgtagttttggttgagtaagcggagtcgtcggtagttttggtagagtcgggaagttgcggtcgtaggggttaggtcgggaggtagggggcgttgttgtttttttcgagagtcgcgttaggataggcg

SEQ ID NO: 6458 - DNA, 819 bp, Artificial Sequence
  Description of Artificial Sequence: Synthetic polynucleotide
gcgagacgtgggaaattggcgaagttgttattagtcgtcggcgtaaggagcgcgagagttttgggtgcgcgtagggtatttattttttattttttagtaagtatcgtcgtaagttttttaggtgtagaaattgttggcgttgttttcgtagttttcgtataggaattggcggtagttttgcgtgtatttgtcgtagtagtaacggagaagtagggttcggtagggttcgtagtttaggggtaggagatagattttcgcgttattttttgaagaaggggtagaaggagagtaaaagagagggaaagtggttaggcgtagtttttaggaggaaagaatatttcggggagttttgttttttttcgagcggaggggtttttgtagagaaagtgtaaatttgggagcgagttttttttgttagcggagcgcgcggtagggatttggagaaagcgaggtttggagggcgtttatacggggttttatggttcgttgcgtttttttcgtcggttggggagagaagtttttggagcggttagatatttgttggtttttgagtagtatcgtttagtgtagttttcgttaggaaaagtagtagaatcgatagttttagggggcgagcggggtttatggtgtagggggtcgggcggttcgttgggtaaggcgttcgagaaagcgtttggcgggaggaggtgcgcggttttttgttttaggcggttcgggtgttcgttttatgcggggcgagcgttcggtcgattttcgtcggggcggagtttgaggggtggttgatttatgtacggggattgttatttcgtcgttttcgcg

SEQ ID NO: 6459 - DNA, 1128 bp, Artificial Sequence
  Description of Artificial Sequence: Synthetic polynucleotide
gcgttggcgggcgtattcggcggcggcgagcgcggaggtgttgcggtatttattatggtatttttgtttcggaacgtagtaggtggggttgttcgtaatatgtagggaaatgagtatttcgttttgttttttatttttttttagtttttcgtggtgggtgtataggaaaaagaagggcgaaaagcgggggtaatagttagtcgtcgcgcgcgtttttagcgtcgtttttagtaatagcgttaggaggaaagtttgtcgggtttagttattgcgttttatgtcgtcgtcgtcgtcgtcgtcgtcgcgcgttttacgcgtcgttcgtttatttagttttggagacgtcgggacggaggagttacgcggagagaaggcgagaagaaggcggacgggagcggaacgggttcgggagcgggtttgggagcgggttttcgtcgagaagtttcgcgggagacggcggtttttaaagttattttgggtcgcgggagcgcgggatcggggttgcgggcgtcgagagcgcgtcgtttgtcgttttcgtgcgtcgtcgtcgtttttgcgcgacgtttttcggttaggtttgggaaagcgttcgtttcgttttatatttttttaaagtttcgggcgtcgcgtttttttcgtcgtcgttatacgtgtttcggtcgttttttcgttttcgcgcgtcgtttcgttcgtttttcgttttttcgggttggttcggcggtatttcgcgcggcgaggggcgtacgcgttttcggagttttcggttagcgttcggttcgtattcgggaggatagggaggggcgttcgtcggggagcgggacggggacgttgtcgaggatcgttgagttcgcgatttttttgcgagggacgttaaagtttcgtagagggtatttttcgtttagttgtttgaaggggaaggttagtttttttggtcgttagtgtgttttgttttttttgggaggatgcgtgagggaaggagaggggcggtagggacggtcgttggcgtcggtttttttgtttgagtcggttgcgtttcgcgtttttcggggttcgtagtttgttagttcgggcggttcgtattcgttttgggaattcgttcgaggtcgcgaatcgttaggggttttcgcg

SEQ ID NO: 6460 - DNA, 1128 bp, Artificial Sequence; identical to SEQ ID NO: 6459
  Description of Artificial Sequence: Synthetic polynucleotide

SEQ ID NO: 6461 - DNA, 1128 bp, Artificial Sequence; identical to SEQ ID NO: 6459
  Description of Artificial Sequence: Synthetic polynucleotide

SEQ ID NO: 6462 - DNA, 1921 bp, Artificial Sequence
  Description of Artificial Sequence: Synthetic polynucleotide
tcgcggatttgggtttggcgtttattttatcgttaggattggatagaaaggttttggtcgaggttattaacggagaggttagagcggagtttttggtttagaatggaggtagtagcgagttttcggcggtttttaggagtattaaggtggaggcggtggaggagtcggaggcggtttttattttgggtttcggagagtttgggttttaggtttcgtcgcggacgtcgtcgtcgcgtagtttcgtttcggttagggttaaggtcgagttgtttagttttacgtcgggttttagttcggtgttcggcgagttgggtttggtcggggttttgtttttttcgtagtacgtgttcgggttcgacgcggcgtttttcgtttcggagattttggttaagatgttcgagttggtgtatagtcggttgtagtagggcgcgggcgcgggcgtcggcggcgcgtagatcgggttttttttcggggtttttaagggcgttacgtgtttcgagtgcgagattatttttagtaacgttaataattattacgtgtataagcgtttttattgtttaggtcgtcgtgcgttcgaggacgcgtttgtcgcgcgtaggtttaaggcgtttttcggttcggttcgcgcgtttttcggttagttcgtcgaattcgacgcgtcgcgttcgttttcgggtttcggagcgcgcgaggagggggttgggggcgcggttacgttcgaggacggcgcgggcggtcggggtagcgagggtagttagagttcgggtagtttcgtggacgacgcggaggacgattttagtcgtacgttgtgcgaggtttgtaatattcgttttagtcgttacgagatttatatcgtgtataagcggtattattgcgtttcgcgttacgattcgtcgtcgcgtcgatcggtcgcgttttcgggattttttgggtcggtcgcgttttcggttttttttttcgtcgcgtttgtgcgtacgcgtagacgtcgtaagttttacgagttgtacgcggtcggcgtttcgtttttttcgtcgttcggttacgttttcgcgttcgagtcgtcgcggttcggaagcggaagcggaagcggtttcggtttcgtttttgcgcgttcgttcggtttcgcggtcgacggttttatcgatttgagtaagaagtcgcggcgttcgtttttcggagtttcggtatcggcgttggtcgattattacgagtgtacggtttgtcgcgtgagtttttatagtttcgaggtttatttggcgtataagaagtattcgtgtttcgttgcgttatcgttcggcgcgttcggtttgttcgtcgtcgtttgtttttattgtttttcgaacggttcggtgcgcggggatttgttggagtattttcgtttggcgtacggtttgttgttcggcgcgtttttggtcggttcgggggtcgaggttcggacgtcggtcgatcgcggtttttcgttcgttttcgttttcgtcgttttttcgtagttcgggtttcgtggttttcgggacggtttcggttcggagttttaggagtcgtcgttcggttcgttttcgttttcggtcgtcgcgttcgaggtcgtgtcgttttcgtcggcgttttttttttattcggataagggcgtttagatttttagtaagggtacgtcggcgtcgttgtttaacggtaattatcggtattgtcgtttttgtaatattaagtttagtagtttgtttatttttatcgtttataagaagtattattgtttttcgtacgtcgtcgagtacgtgaagtgagcgtttatattatagtcgtagacgttttgtacgtttcgttgcgatgcggggagggggtcgtttttaggtcgtacggattgtcgtttttgggaatttcgttacgtataggtttcggcggagggggtcgtagggggtagcgttcg

SEQ ID NO: 6463 - DNA, 2872 bp, Artificial Sequence
  Description of Artificial Sequence: Synthetic polynucleotide
gcgtttttcggaacgttacgttttgcgattgatttgcgagtaaagtagcgggtttagtttgcggcgcgcggaaaaggcggtcggcgaagagtcgttcggttcgcgggtaggggagggatcggagggagacggcggggagggagcgttggtttttttttgggttggggtttcggaggaagtttttcgttaagatttcggtcgtgcgtttttttcggggttcgtttttttttttttcggttttttttttgttatcgttttgggttttaagtaggtcgtttagtcgggttatattcggtggatagaagtcgggatttagggttggcggttgggttcgtgtattttttacgcgggcgtttcggttttgaagtgcgcgcggagtaggttttgatcgttttttttttttttttttttcggttatttttgttttttttagttattgataggatttttttcgaaaattttagattttttaagttttagtttggcggttttttttttttaagtcgcgtttcggtgatttgggttgcgcgattacgaggaagttcgagaattttttggtttaagtgagataggaattagggtaataatgaagagaaagatattcggtttttttttattttaggtcgtagaggcgtatatcgtgaaaagaaaggttaattagcgttttaacgtacgttcgggttttttttttcgattattatgtatttttaattttttgttatcgagggttttggattttttcgaggttttttgtattttaagtggaattttttgttttatttgttagtagtttcgtttgttgagaggacgtattttggggattgttaagaagtagtagatataattcggttttgttaatatagtatacggttttgttttcgtttttttttttatttttttttttgattcgtcgtttggggcgagttggagaaggcggagtaggaggtggggagaagggtgggggtgggggaaggtttggcgtagtataaataagttttttagcgggttgtttatatagtaggtggatttgacgttagttaggaggtttcgttgtaaattcgaataatattttttttcgcgtttttttttttttaaagaagttagggaacggggggagataggtggacgggggagaaaggtattttaattagttggttttaaatttattaataataataacgataataataatgtaaagtaaaataaaataaataagtggttcggcggtattttagaattttttgcggcgttttgttttttatttcgttttttcgaggagaggtagtttcgcgagtagtgtgtgtatagttcgtattgttaataatacgcgcgcgcggtcgggtgcgcgcgtttgttagcgtatatttatatatatagatatatagatatatatatatatatatatatatatatagattcgggtggggggagcggttgcgcgagatagcgcgagttttcgagaaagcgcgagatacgtcggcgcgtgtagtttcgcggtcgtcgtttcgttttagttttagtttcgcgttattcgtagttcgttcgcgaacgttcgtttcggttatttatgcggcggtcgcgttcgttggttgcggttttttcggtttttttttttttcgggcgcgttttttattcgcggtagtagttgttcggattcgcgcgtgggtgtgttgtttgggggtttttgtttcgtcgtcgcgggtgttatttttcgggacgttgtttacggcgttttcggtcgcggtaagttttttggtttttattttggcgcgttatattttcgtattttattttgttttagttatttttacgttgggtcgagttgcgattttattttgtttcgcgtttttttcgcggtggcgataaagtttcgttttaaaggtagcgttttgtttgtcggggcgagtgtgatatgtgttaaatttgggttcggcgttggggtcgtatttcggatttagtattattatttgttgtttttttttattttgttttgtgatgggggaaaaaggggtggagaggggagatttgttgttggtttacggatgatttttagtttggataatgtaaaatgttgtttcgttcggagagatttcggttggaggagaatgtgtgtcgaaatattagatgtgtgtttgtttatttttttttttttaattgtttgttgttttttttttttttttttcgtatttttatttttaatttcgggaggagaaataatagtaaaaatatttggcggttagaagtatatattttattgatttaattgttgatttttatttatttagttgggtaagtgtacgtttttcgcgtttaagttgggtattttagcgtttattttagaagtatttttttaggaaggagagagatggaaaggggatatttttgtttttggagttaagaaatttttgggttttattgacgtttcgggataatcgtgtatagggatgattgttgttttgatcgcgtttttttttttgtttacgcgttagtacgatcggtttttttcggtgtttggtttggttttatttttatttcgttttagagaggtcgtttggttgtttgtgggtgggtttggggtgaaatcgtatttcgcggtatttggtgaggggacgtgggaggagcgtagatatttttcggtgatagggagggttttttatttggttgttatttggaagtttatagtggtttcggcgggtaggcgggcgggtagagcgcgggttcgaacgtttttcgcgtttgcggcggcgtacgtgcggcggcggcggcggcgtcggcggcgcgggcgggatttattgggtggtcgcgcgcgttattcgcgcgttttttgcgcgtttttgtttattcgcgaggtcgtaacgcgttttgatattcg

SEQ ID NO: 6464 - DNA, 2906 bp, Artificial Sequence
  Description of Artificial Sequence: Synthetic polynucleotide
tcgcgggggtgcggttttgcgtaattgggtgattcgcgtgttttttcgtattttatttgtattaagggagcgcgtgttagacgaagggaattttttttttttttttggtgattttgttatttttttattaattgtacgaagtttaagggatattcgagttttttggttgggcggatgggtttcgcgtttggtatggttgagcggtttatttttattttttcgtttttatttttattataatagcgattatttagttcgttaggagtttttgttttttagcgtaggtttttttttttttttagttttttgggttgttgaagtcgggttttgggtagatagagattggggtcgtggggagagcgttaggttgtttttgtttttttcgcgtttcggggtatttcggcgcgttggggatgtagttttcgttttcgtcgtatttggtcgttcgagcgttcgcgtttacgtttcgcgcggggtcgttcgaaattggggtcgcgttagtcgcgggagttatcgaggagttgttggggtgcgtttgtttttgttttttaaataagattttcgagattttttttttatttttttaatttttagtaggatacggaatttcggcgtttttcgaaagttataaaagaggggtacggaaattttaagttcgtcgtgttaattcggagaacgtaaattcgaggtagagcgtgcgtcgtgcggggatgtgggtgtcgaggatttcgaagcgttcggtttttttcgcgatttttattttttttagattttggttagatatttatttagtttacgtttagagggcgggggttatttcgatttatttcggaagtcgttaattttagaaattttttttgttaggttcgcgaaacgaaggtatttcgttatttcggcggggtaagttcggattttattagggtaggttcgggaggttatttagggtagacgattcgaggtagagcgttttaaaattttgtcgtcgtacgtttagttagagcgtcgagcgcgtttgtttttttttcgttattttttagttttttattcgtcgattaaatttttgggggattatatttttaagttttgggagtttcgggtaaagttttttttttttttgaatttttttattgtaatgtaattatgggtagataagaggggtggttgttttgttttttgtaacgtaaaattaatagatatttaattaagttttaatgttcggttagtttttcgttttttggtgtttattttttttttttttttattttcgttattttcgttcgttattttttttatagattacggatatgtagggttatttatttgtgtttaggaaaaataaattattagagtgatatgagaaggaatggtgtatttggttgttcgttgaaaggttttagagaagaaaacggaaaggggaataaaacggggggattttttttttttaataagtagggcgttttggggaagtttgggggttaggggttttttgtttcgtggttcggtatttgtttttttcggagtcgttttttgttgtcgggcggcgagttttattttgtttttcgtagagggcgcggtgaggaagttcgtcgggggttcgtagttttatgttagcgtcgtcgtcgtcgtcgtcgtcgtcgtgtgaggcgagtatagcggtcgtatttgtggttgatttttgggttgagggggttgagttggtttagtaggcgttaagttttttttatgtgaataataaatatttttatcggcggtcgcgattggtttgcgttcggcgtttttcgatttttcgttcgcggttatttattcggcgcggcgcggggagtcgcggttaggatcgcgttcgggatcgttaatcgtttcgcgttaattagttatttcgggaagcgggaggaggaattttcgaggggcgggagtttttggatttcggtgttatttagcggttttggcgcgggtagggagggggattttcggttcgcggattttttttcgttttttagtttgaagcgacgaggagattagaaatgttaatagttttgatttttaaaaattattttttttttttcgtttttaagaaaaaggggaggatttaattatagagtgagagggtgggaagaagcgggagcggtagaagaaggaatatggttgtggaggagtttagcggtttcggttgtttggcgagttcgggatcggcgcggggaggcgcgacgttcgttcgagtatagcgggtagtattcgcgagttcgggttttcggtgaatatagttttagaaagcgttatcgagaataatatatggtagatgataagtgtttcgttatatgtttttttttcgggaatgtttaaagtagagtcggtaagtcgcgcggtttttttgtaaagtttgtttggcgtcgcgcggcggtttcgttatttgtttcgtttcgcggttttggcgattgtttttttatttttcgttttcgagggtttgagggacgcgtgtaatagagtttttagggttcgaggtattatatagcgcggttcgttgcgggtattgcgtaggaaggggtatgggtggttatcgggacggttattttattgagatgatttaaggagtcgtagacgcggggtaggaaatttcgggggagtcgtgttcgggttttgtagggaaatttcgggatttttttcgtatgtcgtatgcggaaatttgtcgggttcgacgtgtatagtttagcgtttttttttattagttattgtttaggtttttcgattttgtattcgtcggaatgagagaaagtagtttttcgtcgtttagttttcgggtagttgtttcggtcgggttttgcgttggtgagaaagttttatttagaggcggtcgcgcgtaattgtaggcggcgttttaggttcgggcgagttagggagagcggggcgcg

SEQ ID NO: 6465 - DNA, 2906 bp, Artificial Sequence; identical to SEQ ID NO: 6464
  Description of Artificial Sequence: Synthetic polynucleotide

SEQ ID NO: 6466 - DNA, 1696 bp, Artificial Sequence
  Description of Artificial Sequence: Synthetic polynucleotide
tcggagtcggagtcggcgaagtcgcggagttgaggcgcgtttgggagagttaaggttcggcgggttatgtaggtgtatgttttttttttcgtttaaggagcggcgttattagcgtttttcggttttgtttttggattttggtatcggttcgttttagtcgcgggggaaggcgttttatcgttaaagtgcgtttcggcggtttcggttcgttttgcgggtcgtcgtcggagggagtgcgggggcgtttcgaagtcgtttaggtcgtattcgttggatgttgcgttttttttttcggcgtcggtcgtttcgggtcggcggtagttgattgcggtcgtgagttcgcggagcggcgagagttaagaggaggtgttcgcggcgttttcgttttttttagatatatatttttttttttttcgttttttttcggagggtggaagagataaaaacggggggttagttttttagttcgtcggttgtcggtacgcggggcggcgtttcgttcggttttcgaggattagcggcgtggcggttgcgttcggattcggttcgtcggtcggaggagcgcgcggcgttcgcggtcgcgttcgtatcgtaggtttttttagagagttcgggggcgggcgcgggttcggcggcggcggcggtcgtagttttcggcggcgcgtaatcgttcgtcgtcgttcgtcgttgttcggttttcggcgcgtcgtcggtttcggttttgtgcggagggagcgagttcgcggtttcggttttcggcgtttttagtggtcgcgtcgttagcggattgttgtagcggcgtgagtagcgggggtcgcggttgcgggaaacgtttcggagtttaggaatatagttttcgttggttagcggcggtagtagtagtagcggggtttttgcgcgcggcgtttatcgtttttttttcgcgtcgggttcgcggtgttgtaggcggtagttacgtagattgtttttttatttttttgttttttagttagaacgtgaatgtattgttgacgtatattgttttgggagaagattagcgtgatgtagtgtttttatgtattagcgtcgtttttttttcgtcgtttgtttcgcggggttaacgtcggcgttttttagcgtcgcgtcggtcggcgtcgcgtagtttcgcgttttcggtcgttcgtttttttttttttttttttttttttttttttttttttttttttttttttttttttttttttttcgggtcgtttttttttcgttttttttagacgagcggagcggggttagggcgagcgggcgagcgagtcggagtgagcgttaagtgaggggtcgcgcgtaagtcgtaggcgttcgtagttattttgggtcggtcggagggagtagttgggtggtcgttgataggttggagcggcgcggggttgcggcgggagagttcgcgtcggttttcgtttttcggttcgtattcggggttttttggttttgaagagcggggtttaggggttcggcggttcgcggcggggttgttgtatttggtttgtttttcgttcggttcgcgttatttttattttcgttgattgttgacggggcgcggattcgcgttcggagttcggaattgcgtggtggggattcgggggacggcggtcggggttacgaggtttttaggatcgagagttcgggtttcgttgttgtattgtcgttagtttttttttcg

SEQ ID NO: 6467 - DNA, 2054 bp, Artificial Sequence
  Description of Artificial Sequence: Synthetic polynucleotide
acgcggcgatgttttaagtcgttttttgtttgaaatttcggcgtattttcggggaagtagtgttacgttttagaaaggcgtttgtgttgttttttattggggaaacgtagtgtttgttttatatgcgtcgttttatagaattgtagttttaatcgtttatttggtttttttttcgggcgttgggttattattttttttaaatatgcgttcgaatatttgtgggtttgtttttcgttgaaattttagggtgtttaaaggttacggggtcgcgatgatattgggtaggttttcggaaattttttaggattttttttattttaaagtttagttagggacgaaaggggttgggagttgaaaaattgtttttttaattttttcgggtgggaggtagagtcgggaatatatagaattttatttcgaaagtttcgggaaagagaagtttgagtttaggagcgtgagaggagaatatattcgggaaatttttgtttcggtcgttgtattttcgcgggcgtttaggtgggacgtgggtaggtgcgcgagcgtcgtgtgtgtcggtgtggatttgtgtgtgtgtttgcgtgtgtgcgtgtgcgtgtgtcgcgggttggtttcgggatattgaggattttcgggtcggtttaggtttgttcgattttgttgttttcgtcgttcgttcggttttatttttcggcgggtcggttttttatttggacgcgtcgcgttttttttttttagcgggagcgtcgtattgatattgtagatggagtttatgtcgttgtttttcgtttttttttgaacgtgtgcgtgtgcgcgcgtgtggttgttttttttagttttagtttcgaacgtaaatattttatcgaggtatagggaagtcgggagtagtcgaggaacgcggagggcgtcgaattagagtttgcggggtttgatagttttttttgcggcgtttaaggtgggcgtaatgtttaataaaaaggtcggaaaatggggatcgatttcgaatattttttttttttatttagtttcggagttcgagtagcggcggcggttttcgggggttgcggtggcgacgtcgggttgttttttttcgtttttattttcgcgggttgaatgtttttgatgttaagcgggtatagcggcgttatttcgcgtcgtttatgttcgttcggtcgggtcgttgttcgggcgcggcgagtgcgcgggggattcgtcggggagcgttttcggcgtttttgcgcgtttttttgggtagcggcggtcgtttttcggtagttcgcggtcggtcgcgtcgcggtagtttttatttttgtcgagatattcgtcgggtagtgttttggggtcggggttggggggtcgcgggagtcgtcggttgtttttcggggaggtgcggggttgcggcggtggtggttgcggcggttggcgttgcggcggcggagagttcggtcgcgggtcgagtcgggtttttcgggcgcgttttcggtttttcgggcgggttgttcgtaaagtttgtagggggtagggagcggggtcgtcgttggttcggtcgtcgtcggagttttcgggttgtttgttgtcgtcgcggttcgttgttgttgtgtattgaagttcggttaagcgttgtaaaaattttagttgtttggcgttttttgggttttttttttttttttttcgttttttttgtttttttttttttttttttcgtttcgtttttttttttttttgtcgttcgtcgttcgtcgtcgttttttttttggttcgttttcgttggttcggagttcgcggttgatatttagagcgagggagagcggtcggtagagggggtagggggcgtttttttatatgtttttattcgtcgtcgttcggtttgtcggttttttttcgtattaacgtttgtcgatatttttttgggttttttcggttcgtacggagttattttggcggtggcgatgtggggcggagagaggggtatatatgggtgatcggagcgtacggcgcgcgtttagagggaggcgtttagtcgtttcggaatttgtagttttgggcgttggtcgtcg

SEQ ID NO: 6468 - DNA, 1258 bp, Artificial Sequence
  Description of Artificial Sequence: Synthetic polynucleotide
tcgcggaagcgttttttgttgggtagaagagtgggtttttcgtcgcggcgtatttgtttcggttgtcggtttttcgtatttatttgtacgagatttgttttcggaaagttaagttttttagttttttttttagcgtttcgtttttttttttttggtcggcggtcgcgggttcgtttagggtagcggttttcgtcgtcgcggttgattttgcgtttcgcgggttcgcgtcgttttcggcgtttaggtagtagttttcggcgtcgttttcgttgttgttgttgtcgttcgtcgttttttttttttttttcgtcgaggagttggggtttatggcgttcgtttcggcggtcgcggagggagcgtaggcggcgtcgttgtaggggtcgggcgggttggcggcggcggcggcggcggttgtaggagcgcgggtaggttcgcgcgtcgttggtaggggtagtaaatggtagttttttttcgtagtatttattcgcggttgtatcgtatcggggtattgtgggaaatttcgtttattttttcgtttcggttaattagaggtcgtcgtttttcgtttttcgcgttttttcgcgtcggttcgtattttttagtttcgttggtttttttttaaatttcgagcgaaagtttaagttgaatatgaattttgttcggaggcgacgggttgcggcggagggggagagagaggaggataggttgcgatttcgggttggggacgttagggtagggatagcgagtattaggaaggagagcgttcggggaattcgagtggtcgcgttttgggttttgtatcgtgaggttggggggattaggatcggcgggcgtttattttggttttgagtttagttgtcgacgttgggttagtattttttttatcgtcgttttttagtgagtagagttgggtttaggtagtagtttttgggcgcgggaaggtagcgggagttgtatttaggggaggggggaggtagtaggagtttcgttagtgggaattttggagtgaattcgtcggcgggtgttaagtcgaagcgtcgattttttgtttttggattggggttcggatttttgcgtttttaaattgcgttttcgttttgttcgtcgttcggtgttttttttaggcgtagtagattttcggtaaatagcggttaattcgatggaatcggattatagggttttcggtgaagtagaaaggcggaggaaatttaggaggtagaagtgaggattttggcgtttggcgtcgttgcgttgttcg

SEQ ID NO: 6469 - DNA, 628 bp, Artificial Sequence
  Description of Artificial Sequence: Synthetic polynucleotide
gcgtggaggttgcggttcggcggggtaggcgttgagcgtatcgcggcggtattcggcgtagaggttttagcgcggggagtcgggtttagtttcggtttgttagcgtcgcggttttagtttattcgaggtcggtttggggggttcgtagggcgcgcggagcgtcgagtgcgcgtcgggttgggtttcgtatttcggtgtaggagcgcgggcgcggcgcggcggagcgtttcgtatggagtcggttcgggagtttttttcgcgggttcggtcgtcgtcgtttttcgtcgcgcgtttcgcgttcgttttcgtcgtttttaggtcgcgttcgttcgtagaggttgaggttcgcggtttcgaggggttgttgcggcgattcgggtcgggttacgagggtagtattagttggaaggcggttttggagggtaagcgcggagcggttttttttttttggtttagggatttttgtttaggttcgattcgcgattcggaggcggttagagttattttggtcgttgtttcggaggggagcgttgggagcgcggcgtcgggacgcggcggagttatttattttagggcggttagacgtcggttcgtggggtggggtgggagggaatcgggggttatcgcg

SEQ ID NO: 6470 - DNA, 1075 bp, Artificial Sequence
  Description of Artificial Sequence: Synthetic polynucleotide
gcggtttttagggcgagtattttcgtttttagcgttttttggttattaaagaaaaattagacgtttgcgacgggtttttttttcgttcgggttttttcgtttttcgtttttcgtcggttatcgggcgttattatcgcgggtagtagggcggggcgttttgggagtcgttgggtgtttgggttggcgtttgtaggggtttcgcgggattaggtcggttgtaggggcgcggcggcgtagtttattttgttgttgaagagtcgcgagaggttgcgtatgggcggagggggtcgcggggtatttcggagttcgcgtacgttttagaggcgtagggcgtcgtcgtgcgaggcggtgtagagtatttggtcgtgtatttgcgggcgtaggggcgggcgttatcggtgacgcggtaggcgggggggatatcgttgttcgcgtggatggatcggggcggggtatttttttttttacgggcggcggtttcgagaagggtagagggatttatttggatgtagttgatgatgaatgtgtggtttcggaatatttttcgtagttttttagattgcgcgtcgaaggttcgggcgtaagcgttttcgttgttcgtgaatattgcggatatatagcgcgcgttgggtttttttttttgttcggtttttcgtaagtagggatggggcggcgagagcgtgatttggggcgttttcgagatttcgttttacgggggtattttgaggtttatatgggaagtggatagtgtttttttagagaaacgggtttttacggttattttgttttattttgtagatgtttgcgcgttagttggttttgtttttgttttgttgaatatcgttcgggtttagtttttatttcgcggtttggtgaagttggttttcgtgtttgtttgggaagtttttgtttggggataatcgttaggttttcgagtcgttttttttttatttttcgttgcgtcggtaattttattttttcgtttttattaacggatcggtatttaaattaaagtttagttttttggggtttatgattacgtattttcgggatttttagcgggggcgagttttcg

SEQ ID NO: 6471 - DNA, 5566 bp, Artificial Sequence
  Description of Artificial Sequence: Synthetic polynucleotide
gcgtttttttagcgatcggggtagaattaggacgtgtaatgcgattgttttttttttttcgtttttcggtagagtttttgttcgcgttaatttatttattaggttttgttcgcgttacgcgcgtttttggtaggtttggggcggggaaaggcgaagcgttgggtacgcgagggtttgtgtattttagtttttacgacgtttttggttttttttaggttcgtcgttgtcgtatttaatttttttttttcgggggttattttgaagaagttttagattttagatttagttttttagatttcgttttcgagttcgttcggtgggtttgtaggtcggttttttttcgtttagaggagagcgtagatacgtaatgttcgttcgttggtttcgttcgttttatttttgtttttcgcgttttttcgtttcggtttttgtttataggtcgggtcggaacgttagttttaggagtcgacggtggttttttgttcgtttcggggaaggtgttgtttttttatcggttttaatttttcgttcggcgtttggggtttggttgcggggttcggtttttagtcgagggcgtagggttggttaggtttgttttggttgaggtggagatttcgtttttagggattgttgggcgtttttgtttcgcgagtaacgagatcgtcgcgagcgaacggtttttattgagtttatttttttaagtgttattacgttaagttagagaagcgaggcgagtggaggggacgtagaggggtcggaaaagttatttttttttggtttcgtttttagataaaaacgggagtttggttcggtattcgggcgttcggtgttttcggggcgttttattgaggttttgtttgtaaaattagcgttcgtgttttgaagcgtacggcgtttggaagttgtttttttgttcgtttttttcgaggtttttttttgtgtagcgagtttgagaaatatggaggatcgtttttcgtaagcgggtggtcgcgggcgtttttcgatttttgggtgaagttagagggaaaacggggttttcgggttagtgttttattttttatttcgggagaaattaatgttcggagagggttcgtttgattcgtatagaaaggtcgattttgagggcggcggtcgttcgggggagaaagcggaggttttgggttcgcgggagcgcggtagtcggggttggtatcgtagaggagagatacgttattgtttcgtatttttagaaagcgcgaggcgtcgttttagttggggtaggcggtcgaggtcggtttttatgcgcgtttttcgaagttttttgaaatattttgcggagtttcgtgtgtatagaatttagtatcgtttagtttttgggtagtttaattttttgtagttttattttagttttttcggttttttgaacggtgattttttttatcgtttttttagagttgtttcgtgtttgggtttattttggggggttcggtattttttagttatttttttttttatttattttttttttttttatttttttttttattttttattttttttttttttaggagagcgatttacgaatttttttttttttagttaattttagggtttagttcgtagattttgcgagggtaggtttttgtttatcggttcgttaggcgttttggaggtgacgttttgttttttagagtttttgttgtagttacgaattggggtttgggtcgtaggaaagtatagggttgaagtttagcgttttggggttatttatattgaggtagttagaggtaaagagttttaagaatttagaaaatattttttaggaagtcgtttaattggtttttatgggataggtggagttattaatttgggatggttttgtaggaattaaagagtttagggttttttttttttttaatattatgtttaggagatttagagtcgttggatttttttttttttgattggtgattattagagtttttagagttgtagaaaattttttttttaaaaaattaagtaagcgttaataagattttttataaatttttattagttttattttttcggggggtaggtagattgtggggtttgattttttgagattcggggaggatttttggtagatgtgtgtttagttagaatatttggtaaggatttttttaatgaagaaaaagtggaggaatttagttttagcgagaagaggtttttttattttgttttagatatatcggatagagggtatattttgattagagttacgtttagtggttaggaggttagtttagtatttttttttttattattttcgttttgggtgggggggtaatttttttgggagtagttgtgggaattgtcgttttttattttagtttagttagtattttgaagtttgtaggggaaggatagtacgtgggatggatattggggaaggagtttcgtaaggttagggtgtaatttttaggttttaggtggtttggtaggttacgttgtttcggagatgtttgttagattttttaagtttatttagggtttggtagtaatttgttggttgtttttgcgggggtttgggttgttgagtacggtgtagttgtttagggttaattagttttagggtgttcgtgttaggttgcggttttttcgtttttttcgtattgagggtatttatggcgtgtaaatgttttcgtatttttagagttgttttatcggatgtttttaggaatttatatatttttataaaaatgtattttaaatgatggataggcgagtttggggtaataacgggtgtttggtgggtagataagagtaaatgggaaggagttcgagggaggagggggaagagaagaggaaatagaatttttagttggatattttgataatagttggaaggaaagtttagaaaagatgaagagagaggaggggagaaattaattggggtttttatttttgtcgttggatttttaattttcgttttaaatgggttttgtttttcggtaaaattagtttaaaggattttaaaataaagaaaacgagatgatcggtttgggagttttttaattagagtagagaagttagaggggggcgggcgatttggttttgaagttttagttgaatagttattttttttttttttggtaaaaaggatttttttagaattttcgaggtttttggattttttttttcgtaaatggagtcgtatattgtattttttcgttttttcggatcgttaagtatgttttatgagggtcgttgttttcgggtggaatgcggtcgtatgtacgcgtttttttgtatacgtatatatacgtatatttataataagtgtttgtaggaggagtgttttgcgcgttagttttgcgtttaagataggaagttgtcgggttatcgagttaaatgggagtgatattatttttttttattagtaaggaaagcggattataaaagtttttttgtatttcggtagtttatttaatattatttatgtattttgtgtaaggaattgtgggatttcgttttacggtaaataatatggaaattttaaaaatagcgatttttttgtgcgtgtttatttacgcgtttcggggtgatttggcggggttgtcgtcgggtgatttatatttttgaatcgcgaagcgatagggaaagcgcgggcgagcgtaggagacgcggtcgggggttttttcgggtttttgggttttcgtattcggagcgggggacgcggtcgttttaaggggaggaggggcggcgggttgtttttgttatttagcggcggtcggagcgttacgtgggcgcgcggcgtcgcggttattggttcgaggtacgtgtttaggagatcggtttgcgacgttattcgagggggttttgttaaaaataagaataaaaatttagagtgaaagtgttttaggttgcgtcgagtggtttggaaattttcgagttcgcgcggaggtcgaggcggcgagggcggcggacggtcggggagcgcgggcggtttagttcggttcggtcgggttttggtttcgcgttttttatttatgcgattcgggtcgcggagttttgcggggttcggcgggggcgcggtcgtacgtcggtggggcgtttcggttcgtagcggggcggcggtcgcgaggagggggtttttatgtgcgtgcgggcggtggcgggcgcgttgatcgcgggcgttcggtattttcgagggtcggttagggcgtgcgggcggggacggtcgggcggcggcggcggtcggagtcggttcgggcgggcgtgagcgtcggggaacgcgttgtttgtatgcgcgtagttttcgtttcgggcggtttaggcggcggcgtcggagttcgaggcggtcggacgcggagaggagcggggagttcgggaggcggttcgcgttttcgtcggattattgcgattgtttagatttcggttgcgcggcgaagtcgaggatttggttttgttgaattttttatcgtttgggcgagcggggcggttcgtggtgtttttaatttagttcgtggatttaaaggtggtttcgcgtcgagcgcggtcggcgatttgtaggattttagttttggtcgcggtcgtcgcgtacgttttcggaagattcggcggggtgggggcgcgggggttttcgtgtgcgtcgcgggagggtcgaaggttgatttggaagggcgttttcggagaattagtgtgggatttattgtgaatagtatggaggagaatgattttaagtttggcgaagtagcggcggcggtggagggatagcggtagtcggaatttagtttcggcggcggttcgggcggcggcggcggtagtagttcgggcgaagcggatatcgggcgtcggcgggttttgatgttgttcgcggttttgtaggcgttcggtaattattagtattcgtatcgtattattaatttttttatcgataatattttgcggttcgagttcggtcggcgaaaggacgcggggatttgttgtgcgggcgcgggaggaggaaggggcggcggagtcggcggcgaaggcggcgcgagcggtgcggagggaggcggcggcgcgggcggttcggagtagtttttgggttcgggttttcgagagtttcggtagaattcgttatgtgcgttcggcgcgggcgggtcgtttttagtcgtcggtagcgatttttcgggtgacggggaaggcggttttaagacgttttcgttgtacggtggcgttaagaaaggcggcgatttcggcggttttttggacgggtcgtttaaggttcgcggtttgggcggcggcgatttgtcggtgagttcggattcggatagttcgtaagtcggcgttaatttgggcgcgtagtttatgttttggtcggcgtgggtttattgtacgcgttattcggatcggttttttttaggtgagttcgcggggattacgcgtttcggttcgtcgcggggaggttcgcggagttggggggcggtgttggcgcgggaatttatcgggaggaaaatatttcgaatttttttcgcgtatacgtataaagatttacgcgatattgtgtgaagttgacgtcggttcgggtagcggttaggagtttagcggtaggattgattcg

SEQ ID NO: 6472 - DNA, 5566 bp, Artificial Sequence; identical to SEQ ID NO: 6471
  Description of Artificial Sequence: Synthetic polynucleotide

SEQ ID NO: 6473 - DNA, 1164 bp, Artificial Sequence
  Description of Artificial Sequence: Synthetic polynucleotide
gcgatttgtttagcgttaaatcgcggttttagttttttttagttttcggtttagtcggtttattagtcggttcgcgttttgtagtttttttagagggacgcgtttcgagatggagagtaaagttttgttcgtgttgattttggtcgtgtggttttagagtttgatcgtttttcgcggaggggtggtcgtcgtcgatcgtaagttttgcgcgtaaatttttttttatttgtagattcggcgggtggttattgttattcgaattgaggatgagaagaaggaagttggaaggggcggtggatgcgtttagggatttttttagtttgggttttagtttcgaaacggttttcggagtgggatttaggaggggtcgggagggaattttttttcgatcgtgaagcggcggcgtttagttttcgttttttttttttgtcgggttttcgcgttattttttttattttggttgggatcgcgttttcgggttcgtaggtttcgtcggggaggtttcggggtgtgggggtcgggacggcggaggcggggagtaagggttcggttggcggtgatttgtagttatttttttgtcggaggggttttggaatgaaaggcgcgcgggttaaggtgatttcgttttggttggtattgcggtttagttttcgttcggggattcgcgggtcgattgtggttttttttggggaagtcggggcgcggggaggcgtttcgggtattttagtcgtacggggtacgttcgttttcggcggggtttttcgtttcgttgtgggagtggtagtgggtgtcggggtggagaaagtacgcgtggcgcggagttttggggacgcggcgttttattcgttttggggagtttcggattttttttagtttttaggttcgtatgtttttttttttttagtgttttgagaatttagcgaggggttgattttttcgaaatcgtggcgtagttattagtaatttgtggtcgtcgattcggggggttgttaggtttgcgtttggttattttttttgttttgggggttgaggttagtttcgggcgttcggtttcgtcgcgcggttgcgagtacgtggggttgacgggcgtcgcgtggaggtagcgagtataacggtggttatcgtcgttagggaatcgttcgttcgttggggtttaggcgttcg

SEQ ID NO: 6474 - DNA, 1495 bp, Artificial Sequence
  Description of Artificial Sequence: Synthetic polynucleotide
tcgtaaatttttttttgcgtcgttttttttcgcgtggaatgggacggagtagtttttttaggcgttgtttggttgcggaggggagcgggtagcgagagtttcgggttttcgtttgggttttcgggttttcggggcgttggtttcggttttcgcgtagcgtttagcgatttttgtcgggggttttcggtagtcgcgtcgttatttttcgttcggttagcgcgggaggaaaaggggttgcgttcgggagcgtcgagtttaggtttttttcggtggcgtgttcgcgttttggggtgggggtgtggtggggaagagggagggggcgaggttaggggagggtgcgaaggaggcgtttgtttttaatttgcgggcgggaggtgggtggttgcggggtaattgaaaaagagtcggcgaggagtttttcgaaatttgttggaatttcgggttcgcgcggaggttaggagttgagcggcggcggttgtcggacgatgggagcgtgagtaggacggtgataattttttttcgatcgggttgcgagggcgtcgggtagaggttaggacgcgagtcgttagcggtgggatttatcgacgatttttcggggcgataggagtagtttcgagagttagggcgagcgttcgttttaggtggtcggatcgttcgtcgcgttcgcgtcgcgttttttgtaggtaacgggagacgttttcgcgtagcgcgagcgttttagcgcggtcgttcgttttttttttcgagggataaattttttttaaattcgattcgagtttttggattaaattcgtttgcgtcgagagtcgttcgcgtagagcgtttcgttttcggcgagatgttcgagcgtaaagaaggtagaggtaaagggaagggtaagaagaaggagcgaggtttcggtaagaagtcggagttcgcggcgggtagttagagtttaggtgggtgcgtagcgcggttcgggttttacgattttttttttgttttttttatttttttttttttttggatgtcgtggtttttttttttttttttttttcgtttgtttttttcgttttgcgttttgagcgttcgttgagtcgcgcggtgtttttttttttgggggtcgtcgtttatttgggcgtcgagttttatcgggcgtttacgtttagagtttagggtaagggatagtagtttcggtcgtatttttttagagtttcgggagcgtttcgttttttggtacggtttttttttagcgttttagcggttgagtttagttcgggagtgggatttgggttataggagtcgaggttgcgtgcgcgcgtgtttcgcgttataagcgttttgtacgggggtcgtgtgttttttagcgggaaacgttggaatgggtcgtttggagggagagtcggttttttcggtgtgtttggtagcgtagaagtgggtggtcgagtaagaggtcgcgtgggaagttagtttcggcgttttggggtatagggtaagcgatgtagagtgcgcgtcg

SEQ ID NO: 6475 - DNA, 352 bp, Artificial Sequence
  Description of Artificial Sequence: Synthetic polynucleotide
gcgtttttggtagtagtcgtttacgttttcggttttgcgtatcgggtttgtttcgggaggggcgcgtgacgttatcgcggggtagtcgagaggggatcgcgggtttcgggtagggtaggcgttttcgtagttttagttataatataagggagagaaagtaacgttttggttttagaaatttttatcgttaaggttagttttggttagacgtatagttaaagagtttttttagtttagcggatgaatcgttcgcgagtggtattttttaaaattttggttttattttttaagatgtttttttattgcgtaatttagaaagtattcggatcgtcgttatttattagcggcggcg

SEQ ID NO: 6476 - DNA, 1141 bp, Artificial Sequence
  Description of Artificial Sequence: Synthetic polynucleotide
tcgtttagtttttagcgttgcgttgttttcgcgtttatcggatgattacgaatatgattagcgagttgtttattaagtttacgacgaatattacggagtagatcgtcgtgatgatgatcgggatggtcggggagatgtgcgcgggttttagttgcgcgtttttcgagtcggcgttgtcgttgttgtcgggttcggtttagtcgggaaattaggcgttgttgttggggggtaggtaggcgttcggggcgtaggtagggttcggtttttcgcggaagatttggatcggggagtttatggtggggcgattgtagtaggaaggcgaggataggcggtatttgcggcgttgcgggagcgaaagaatcggttggacgcggagaggtaaattttgttcgcgttttggttagcggcgttggggattcggagtttgcggatttttattcgggtcgtaagtcgtcgggggtaggatagggagaacggatttttcgttgttttttcggttagtaggcgcgtcgttgggtgttagagaggggcgaagagcgttcgtttttttttttttagtttttgaggtgttttttttattaattttaggtatcggtttttggtggaattgtttttagattgtttgagtttttagggttaagttttttttttattttttagtacggagttttatttagaattgtatttcgaaagtttaaagtttatttatggtttttagagataggcgaaggcgaggttttttacgggacgttttggtaggtgttgaatcgcgcgtttacgagtttcgtttagtttttggtattatttgttttcggatttcggtttcgtttttcgttcgagggttgttgtttcgtcgagcgtagttttcgttttttagcgtacgttttttattattggcggcggttttgcggggcggggcggggcgggatcggcgggacgtagtcgggacgcggttgggcgttgggggtttgcgggcggagagttcgtttggtgcgttcgttttaggtcggtaggtttttgtttcgtttcgttcgttcggagttagtttttagttttttagttttttagtttcgcgttttttttagtttcgtaggttcgttcggtttattaattgttcgagcggtatatcgtttggttttcg

SEQ ID NO: 6477 - DNA, 3297 bp, Artificial Sequence
  Description of Artificial Sequence: Synthetic polynucleotide
tcgttcgtcgtttcgaagttgttcggttttttttttagttcgttttttagtttcgtaaggttttttttttatttttttcggcgattttttttcgaggtttttcggaggcgtttggattttttttttttgtttttcgttttgtcggtcgttcggttttcgagggggtacgaggagttgtcgggtcgtttttcgtttttgttcggggcggcgttggtattgttcggtcgattttcggggggtcgttcgttgaggtttttttattcggtagttaagtttagggaagaagacgttatcgttgggtagagttcgtttatgtcggtgagtatcgtggtttttattacgttttatatttagtttttttaggatattagtttttttcgattttttttaattttaattgattcgtttcgttggggttagtagtagggagggtggtaaggtcgggaaggtcgggacgtggttgggtaagttttaggacgggatattggcggttttcgggatatcgttttttttcgcgggaagatattttaagttatttttttttgggttattttttttttatggtttaagaaaacgggagggagttttcgttttttttcgaggttgttttttaaatttttagcgtgtcgttttttttcgtttatttcgagttttttttaaacgcgttttcgtttgtttttagcgttcgtttttttatttttttgttttttcggtaggtaagggaggaaatgacgtgatgttatttttgtgttaggttagtttttagttttagtttagtttttcgggttttagggaattaatttcgcggttttatcgggttttattttcgaagggacgttgcgggttacggggatacgcggtgttgcgagttcggagagttgggcggttgggttttttttttcgttgttttttggtttattttttttttcggatttcggagtttttggagaaggggacgcggagggcgattgtcgagggttttagcgggatttggagttaggggttagtttttttttttatttttcgttcggttgttgggtggggttttcgcgttttggttagttgggagggggcgagggtcgttttttagggcgggaagatcggaggtttaggttgcgtcggggtggggcggggatagagtttagagaggcgtttcgggtcggggagaaggtagggggttgttttttagagacgcgtagtttatagacgcgaagttttggggattaagcgttttttttatgtttgtcgtttattttcgtttttttttttcgttttttttatttacgaggttcgagtacgtagtttagtatattttagtttcgttcggtttcgcgcgtcgaggggaggcgatgatatagagggtttcgcggacgttttttacgcgcgtttggtttcgtatttatatttttgggatttgttaatgcggggttggagtagtggggttgcggtcggggtggaggtcgcgtttcgcgtggggtttcgggggtatttttagtattcgcggcggtggagtgcgtcgtcgttggagggaggcgagacgtgggattgttcggtcgggtaaaaggagtgagggggcggggaggaggtagagtaaggggaggaagaggtcgggagaagagggttagagtaaagatcgagagtcggagaaaggcgaaaggcgcggtgagtaatcgtcgacgtagagagggtagtttttcgcgttgtaatattgagaaggtattcgcgggacgtatgcgtacggcggacggaggcgagtcggtcggggtttttttttcggtcggtagggtggacggtgggttcgtgagtattttagtttttcgaatttttttttttcgtttcgggttcgttttgaggtttcgtgttggaaagtggtcgaggttgggaggggcgcgtcgttcgttcggattttagggtgtcgtcgttgttgcggggcgggagtcggtgcgagtcgggggttttttttcgtagtgcgagtttgggggagtggggttgcgagtgcgttcgcgtgcgaagaggggtatcgcgttattaggattaatatgtttcgggtttgttagggcgttcgcgattttatttttgcggtttcgcgtcggtgttttggtggggaacgcgggagtttagtttttagattttagaaatcgtattgattattcgaagcgtatttcggaaagattaggcgggtggaagcgtcggtttttttacgggatagggagaggataaggaaggggttgggcgttcggggttggtggtttgagcgtcgttgggaagggtaaggagatagagttttttggaatcgtagcgtttttttttaggagaagtgtaattagggtaggggtatcgaggggtagggtgaggaagtggacgttttacgcgtggattttagaagatcgattaggtatgggcgtttattcggagtttttgtttacgtttttgaaaatcgaatgaatagagaagtgttttttatttttcgtttgcgttagggtagttaacgtgtaggcgtcgtcgggatttttttggaataaattcgggtatttgatttttcgtattttcggagttgttttgggaagtcgaaataagtttgggcgttcggattgcggagattggaaagtagggggcggagggcgggagattgggggcgggaagtggaggtgtaggttgtagttggggatcgcggtgggcgttggaggggagggtttgtgtgcgcggttgttttttagcgttgggggagcggacgggttaggggtttttagggaagcggcgtttcgggatcggggtggttttttcgtttttgtgtgcgcggcgatttttatatttagttcgggcggaggagttttgagagaagcggttagttgagagtggggtgggcgttttggggaaaggtttgcgtgcgttgcggttttatcgttgttagagaagtggaagagagagagtgggcgtcgggagggggtttataggcgtcgcgatttattttatttttttttacgtttgtgggggagtgagtggggaaggggttttgggagaggcggcgcgcgggtattgaggtgtatcgtgagtttttcggatttgatagtattaaaggaaaattttggcgagtagttagggttagcgagcgattttagtagtagggacgcggtcgtgcgagagttcgcggataggcgagggggattttaggggagtagttgttgtttacgggttacgggcgatgtacggagtggagaagtgaacgtggtttataggatttttgttcggaaggtggagagcgttataggggaattttttcgatttttgttcgtttcg

SEQ ID NO: 6478 - DNA, 2213 bp, Artificial Sequence
  Description of Artificial Sequence: Synthetic polynucleotide
tcggttttaaacgtttttttagttatttgtgaatcgcgaaggagtcggttttcgcggcggggattttgttattagtattttcgcgggtcgaggtcgttttttcggtcggtttttcgttttattcgaaaaggaattagagtatttatttaagacggtgattggtagggtagattaaggtgttttggtttcggttttagtttcgcggtgcgtttcgttcgtttattttgatcgggtgtaggtagttatcgtcgcgtagggcgtttaattcggcgttcgtcggcgtttcggcgtcgttttgtaggttgcgggtgagatgcgcgatgtaggtggtggttagtagtagtacgtttagtttggatagtttggtgtcgggcggtacggacggtagcgtgcgttgtagttttaggaaagcgtgtcgtagggtttgtattcggttgcgttttcgcgtcgtattcgtcgtcgtcggtcgttcgttttcggaacgcgagtcgtttttagggttcgtcggtttcggttcggttcgttcgggacgcgagtcgcggatggcggcggttaggggcgcgggttcggcgttggcgttgagggggttgttcgttgggcggtcgcggtttatggtagtttttcgcgtcgcgcgcgttgtaaaggatcgaaggtgcggtgaggtcggggggcggtcgggtttaattcgagaggcgtagttttttggtttttttcgtgcgtttattagtagtttaacggggttaagggcgtttttaagcgagttcgttttgtttgggacgcgatttgttttcggacgtttggggagagttgcggaatttcggagtttttgggttttttagaaggataagaagaggcgtagtgtcggttttgttttttaggggtaaattaagtaaaaggtttattttattcgggaagaaagatttcggaagtatagtttaggattagtattcgttcgcgtttgggtgattttatttaattcggtacgtacgagaggtggcgcggttttttttcgtcgacgtcgcggaaaattacggtttattagtcgttttcggttttttacgttaggggggatttttgttcgaggagcgggggatttttagttttatttcggggtacggtattcgttatcgtttcgagttcgagagttgcgtagtacgcgtttgacgggttttttattttttttggagcggttgagtggagtttcgtttcgtcgtgagggcgggcgaggggcgtggagtagggtttgtgtggttagggtcgcgttggttattttattttcgttcggtcgatgtttaagtcgacggttgtttttaattttcgttggttgtgatttttatgcgggcgtttcgcggttaggcgtgtgtgtttcgatcggttaaggtaggtcgggcggaggatttggtttatcggagaggttacgtcgggggttgaggcggtttagagggttattaattaaatttttcggcggggcgggttcgggggcggggcgtttttttggtttcgtttttcggtttattgttttacgttgtttttttcgaggcgtttcgttgagggcggcgtgtggagagtttggggtgtttgtcgtcggttgcggtggggtcgggttggaggtcgcgggtgaggtttgtggttaatttcgcgttgtcgaggttttattttttcgagtttagtttgattttaggtcgtttttaggtcggtgtttagttgaggcgggaacgttgtagtttggttgagcgtgatttttaggttttgtgaggaaaagtcgagcgcgttatatcgaggcgttagtcgtttattttattataaggtaaaagatttatgttgttttagttattttaaagttgggagatatattgtattttttattagatttcgaatgtttttagtgtttgtaattttttaagaagtttttagagtagatagtttttggatcgtgggtattttttttcggggacggggattttgttgatcgttttcgttgttttcgcgggggttatcgttttttaattatttgggcgaaatatttttttttggttttgtatttgtggatttacgggaagcgtgatttgtagcgaggtaggattcgattttaggtttttttagaaagcggacgttgcgttttaaggtttgtttagagtcgttttaggaagtcgtgggttttcgatcgttttaaatcgtagcggtttttgtaggttttggattcgtcgttttcg

SEQ ID NO: 6479 - DNA, 363 bp, Artificial Sequence
  Description of Artificial Sequence: Synthetic polynucleotide
gcgtttagtacggcgggtagcgtcgcgttgcgtatcgtcgtcgattatgagcgaggatagtcgcggagatagtcgcgtcgagagcgttaaggatttggagaagtagtttcgtttgcgcgtgtgcgtgtttagcgagttttagaagatcgagcgggattatgtgggtacgttggagtttttggtgtcggtgagtgttttcggtagacgtagggggacgttcgggcggcgcggggcgcgggtttcggagtggttgcgggaaggacgcgcggtattgtttgtgcggggattcgggacgggtcggggtattataggcgcgggaatttacgtgtggattttgcgttcgcgggcgcggtgattttcgcg

SEQ ID NO: 6480 - DNA, 960 bp, Artificial Sequence
  Description of Artificial Sequence: Synthetic polynucleotide
tcgtttttcgacgttttaattagttattattttttcgaaggaaaataaatcggtttttgatatatttttttacgtgtagcgttcgacgttacgggttttgggcggttgtattttttttttgtcggttacggtttaaggttttattattgcgcgtatttagtttttttttaggtgattttcgcgtatttggcggcggcgttttaggtttcggaggttgttcgggcgggttggggttcgggcggcgttcgttgagagtcgcggcgttttttagtcgtttttcgggcgtcgatcgtcgtttttttgtttcggggtggggtttaggggtattagtagtcgcgggttttcggtcgtcgtttgggaatttagggttagatttagttttataataacgttttttcgttacggtaatttaattggaggtagaagtcggcggggcggtcgagcggggcggggcgggagcgcggtcgtcgcgagttacggtggggagcgggcgcgggggattttggcgggtttcgggtagcgcggttgtatttatttgtgttataattgcggcgacggggggttgaggaatcggtttttttaaaagtaaatcgaaaatgggtaatagagaggtcggggtagcgttaagaggggttttgtttcggtgtttagggtaaaaaattcggtttcggtttttagaaattcgagttagcggtggtttttttttttttttttttttaaacgtttttgtgttttcgggtcgaggggcgtttttcgcgcggtttcgagtgtatagcgatattagggttggcgttggagaggggagttttttttttagtatttttcgggtttttttcgtatttttatttatagttttttttttgggttcgacgttttttcgttttgtagtcggagtttgggtttggtgtttattgtttcgcggggtgtttcggacgtttggtttttgtagcgttttttacg

SEQ ID NO: 6481 - DNA, 1404 bp, Artificial Sequence
  Description of Artificial Sequence: Synthetic polynucleotide
acgcggggttttcgggaatcgtcgtttttttttttcgttttcgcgttcgcgttttttttttcggggtttcggtttatttatttttggtgcggtttcgtcggatttaggagtttcggtcgttcgggttgcggggagggggcgtttcgggtcggttttagaagttattttgtaaagaggtagggggcgcggggtcgcgcggggcgagttcgggattcgcggggaagaagtttttcgggatcgcgtttcggtcgttcgagtttttcgcgttcgtcgttttttatttcggtcgggggtttatttgggagttcgttgttttcggttagtcgttcgcgtgtgtttagggttagtagtacgtataagtgttagcgtacggtcgtcgcgtttatgtttaatgcgggtttcgttgggcgtgcgggcgtgcggggcgcggggattcgatcgatcggtcgttttcgtaggcgttgttcgttgttcgtcgtttcgttatcgttcgggttttcgagtcgtttagttagttcggttgatgagttgatagcgcgcgtttattggttcgtggcgtcggaggggcggggcgtcgtttagggtcggttaatgggcgtcggttttcggtttttcgaggaagaggggggttcgggcgtcgtcggggggattttttttttggggcgggcggtaggtggggggtgtgggtttggtcggtcggttcgttaggcgcggggtttaggttaggttggggttgtttggaggttgcgtttttttttgttcgcggcgtttcggttttcgtcgtcgagagtggacgtttttttggggtaatttttttcggtttagaggtagtttcgggggcggggattttgcgaatcggggatttcgtgaggtcgttcgttattcgtgggtagtgaaacgcgttagcgcgtagagtagattcgtttgcgttgtcgtttgttggacgttttttgagtatttattggggatcgagtgcgggcgaggtagtagcgaaggaatcgggaggggaaatttcgtgaagattatttgaaaattgacgtttaaaataaacgaattttttagtattcgttaaaggatagtggttcgttagtgtgtttgttacggggcggtcgtaggatttgcgtttggaatcgggcgggcgttcgggacggataatgtcgtttggcggtcggtttcgcgggaggttttcgtacggggttaatttcggtcggcgaagttcgttgttcggaatgcgaggtcgaggtttttttttgtgatagatcgggcggggttaggaggaggggtagggcgggtatttcggttcgaagatttaggaattgttttggtttggtttggggtttatatttgacgtttggcgagggttggtttcgggtttggttttatcgggtttgggagggacgggcg

SEQ ID NO: 6482 - DNA, 1247 bp, Artificial Sequence
  Description of Artificial Sequence: Synthetic polynucleotide
tcgtggggtattacgcgcggatttttgtttggcggtttttgcgttcggggttgttgagttcggggttcgttttgaggtcgcggttgtggtttttggttttttcggttcgcgttattgtcgcgcggcgttcgttgtattttgttttttttgcggtttcgtatgtttttggtggaatttagttcggcggacgacgaggaggatgagatggaagtttgttggaaatcgggtaaattttatagaaaattgatgaggaagacggtcgagagtaggattttgggagtatttatggcgggtaagtggttgcgtttttttaggaggcggtggcggcggcgtaggacgcgcggggtacggagcggttggatagcggtcggggttcggtttttcgggcggattcggagtgcgaggagtcgggttttagttatataaatttcggtttcgttacgttttttttcgtttttcgttgggaggggaggaatggggagggagggtagaggaggggtggggagggtgggaggagagtcgggtggtgcgggtcggaggtgtgggggagaggggtcgcggtgcgtcggtgtggtaggaagacgtagcgttttcgcgggacgcgcgcggggttgtcgggcggtgcgcgcggcgcgggtcgtaagcgttgatcgggggaaggcgggcgttgtcggttcgtggtcggggagtaaaggttggttcgtcgcgttagggtttttttcgaattttcggaggtgtggttttttcgtagcgcggtttcggttttcggttttcgttagtcgtttttatttttttgggagcgagcggtttcggaggagggaagcggcggcggcgtttttaagagatagtttggagtaggcgtttttgttgtaggttgcgtgttgtttcggggcggtggtatttttttttttcggttttaatcgttaggtttgtcgtttgcgttttttaggggttagttcggagttagagaagtttcgttttgggttaggcgtagggtttagttcggaatagttttattttttcggttgggtatcgttttttataaagataggcgtttattttcgattttcgaggttaggtaaaggttacgagtttttagagtttggatcgatgttaaaagttgttgcgtttttttgtaggttttagttttttttttcgtagtttttaattttttttgacgtagattttagttgttttattttttcgtttgttttcgggattttttttttttcgcggtttgtttttcg

SEQ ID NO: 6483 - DNA, 1861 bp, Artificial Sequence
  Description of Artificial Sequence: Synthetic polynucleotide
tcggtgagtagagtcggcgtagttatagcgcggagtcgcggcgtttattggttttcggagttgttaatcggcgtgtaattttgtaggaatttttttcgggtttatttgggagttatattgtcgttttttttttttagtcgtttaggggagtttggagaagtaggtttaggagggagggagttagaggaaaagaagaggaggagaaggaggaggattcggggagggaggcgcggcgcgggaggaggaggggcgtagtcgcggagttagtggtttcgtttggacgcgttgttttttagatattttcggagttttagtcgcgcggatcgcgcgttttcgtcgttttgtttttaaatttttgtcgtagtttttttttaagttagcgaatttattttttaaaattagaaattgaatttcggtacgggaaaggagttcgcggaggagtaaaattatagtagagtaagaagagttttagagagtagttttttcggagtattaatttcgtgtcgggagtgtagaaattaataagtgagagggcgtcgcgttttcggggcgtagttgcgggcggcgggagtaggcgtaggaggaggaagcgagcgttttcgagtttcgagttcgagttttcgagtttgagtcgtaatcgttgcggtattttgtttcggattcgtgtgcgcgggttgcgtcgagcgttgggtaggaggtttcgttttgttttggttgtaagtagcggttgggagtagtcggtttttggggaatatgcggcgcgcgtggattttgtttattttgggtttggtggtttgcgtgtcggcggagtcggtgagtgggttaggcggaggatgcgcgcgtcgtttagggtgtttgaagttacgagaggagttcgtagggaataggggagcgttatttggggaatttttagtttttaagtatatatcggagattcgttgggataaatgcgttcgttcggttattttttttttttttttttttttttagaaaagcgttgttcgttggcgttatttcgcggttcgcgggaatgggggtatcgagaattgcggtttggtttagtcgtagaggtttttgaagttatttttaattttttcgttttcggcgggttttgttgcgtggtttgggaaggacggaggggaaagggtggtaggaggggggagtttgggtcgggttcgcgagggaacggttttatttcgcgcgtttttcgagattagggatgatttggaaatttcggggttttttttttcgtatattatttttttcgcgttagtttttttgtttgattgtatgtaagttttggggagatgggggttagatttaagagattcgcgagtgtttagagagaaaagtttgtaaaagtttttttgtttgatgttttttgcggttagggcgaggtaatcgatattacgtggaatcgtagtaggcgattttttaaggggatattgggggaggtacggaacgcgttcgaaaatgttgggacgtcggttattggatttttagttttgcggcgatttttttttcgttgaggggtggaggttgtatcgcggggcgttagggacgggaggatatttttataggagttatacgggagtgtcgtaagtagggcgaggcggggtacgtgtgatacggcgttcggtttcgggtcgtttggtcgttgggggatagaggtttttttttcgttacgttcgttttttttggttttggcggggcgtttttggggtcgggaggagtttcgttttcggcggagcgtttgtcggtatttagtttttttttttcgttttggcggtgggaatttgatttttttttttggtcgcgtttcgggggttggagtttgtttttttacgtcgtttaatgagcg

SEQ ID NO: 6484 - DNA, 3044 bp, Artificial Sequence
  Description of Artificial Sequence: Synthetic polynucleotide
gcgcgcgtgtggaaggttgggtggggtgcgtatatacgtttatttgtgtacgtatatatatatatatatatatatatatataggtatatatattcgagtttagttatttatattgtttgtttagggcgtttggaagagttggcgagttcgtttagttttgtttattcggtttcgtttcgtttttttcgggagggtttttcgggcggcgtttagtttcgagtagagtaaaggacggcggcggttattttcgtttttcggtcgttggtttttcgttttttttcgtttttttattgaatttattttcgtgtttcgaaaatttgattttaattcgattttttcgcgttttcgttttttttttttagagtgagcgttaaaaagggtttgatagatagaagtttttggttttagtatcggtttagttcgtttttagacgatttttgttttttttatttttatagtttttagtggtcgttttattttcgtattttttcggttaattttaatttttttcgttttttttcgcgttgtttcgcgttttttttttaggattttttcgtatatttttagcgtttagcgcggttttttataatttttttacgtttcgtttttttcgttttgttttcgttttcgatattatttgcgttttttattcgttttaatttttttttttcgttatttttatttgtgggtttttagttttttgttttttttttggtttttatttttgatattttagggattttttttttttttttacgttttttttttttttaggatttcgtttcgatatttcggggttttttcgttacgcgtattttttttttttaggttttgatatttgggcgttttttttttgttatttatttttagttttagttttgattttcgggcgttttgttatttttacgtttttcgtttcgtttcggtttttcgggcgtttttattcgtcgtttttatttttttatttgttatatttggtatttttgtttttatttttgtttatatttttttttcgttttcgatatttcgggcgtttttttatacgtttttattttttatattttcgttttcgaaaattcgggcgttttttttttttacgtttagtttttttttttttttcgttcggtttcggatttagtttggagatcgcgttcgggaggggcggttgtcgttcgcggggcgttcgcggtgttcgggtttgggtagcgaggaggtgacgtcgttttcgcgggatgagttcgggaggcggaggggcggaggaggtgttggcggcggtattgagcggcggcggcgtagggcgcgcgggtttttcgcgtcgattttatcgatttaaggggcggcggcggtggcggcggttgagcgattttgggtcgggcgcgtgatgaggaggggtcggcgttagatttcgttgtacgtcggagttcgtttggattcgggcgttggtagtcgaagggttttggtttcgggatttttcgtcgttagttttcgttatatttttttcgttttcgtttttttattttagtcgggggtggggtgggtggggttggggttttcgcgggggttttcggtttcgcggttcgttttcgggtgtgtttggaggagttttttttttgtggcgcgcgggagttttgtgatgcgttagtcggcgggacggatgagttgttttttcgggaaatcgttttcgtttttttacgattttttcggttttcgtttgggtgtttttcgggtcggtagtatttcgttttcgggcgttcgaagcgagtttttcgggggtttgttcgtaggtattttttttttttcgaggcggcgcgcgcgttttcggttttgatcgcggtcggatatattcgcgtttcggttcgtttgtcgttttttcgtttgttttttttagttattttatttttagttgttttcgttattttattttattattttttttcgttttttcgcgtatttcgcgtttcggtttttagttttttttttttttgaatcgtttattttatagtttttcgttttcgggaagaagaaatatttttcgaagcgtattttttagttttttttttttacgcgttcgtttttttttttttttgttttttttgggggaggggggttgtcgttttggattgaaggttattgatttgtatgtatttgttttagcgttggaggttgttttagtcgtcgcgtcggtgtcgtcgttgttagtggagttgttttttcgtttttttagggtggttcggttttattaaatatgtcggtttttgtcgggtttcggggtcgtttggtttttatttcggcggttttttagtcgtttttgtagttcgagatgtttgattttagttattttacggaggaggagaggaaaattattttggtcgttatggataggtagaagaaagaagaggagaaggagtagttcgtgtttaagtaaggatttggttttatattttcgtttttttttttgtttttcgttttttcgtttattgttttgcggtcgtttgcgcgttttagttcgtcgttttttttttcgttggcggcgtttaggttacgagggttgcggttagcgtcggtcgttcgggttgttttaggggtgtttgagagtaggggtgtgtgtcggggagggagggcgttaaggtcggttgaggtgagggtggcgagttttaggcggtgtgattttttttggcgttttttcggattttttcgttggttattttggtttcggggttttagcgggattggggttgaatttaggttttgtgcgtatttttttttttttcgtcgcgttgaggtagtgattggggtatagaatttaatatggtcgtgtataggtgttttttggacggattcgggcgaaggcgcgttggtaggggatgcggacgttattttggttttacgttttcgcggggcggttttattagtaacgcgggatagagtagggttgtttatagtggttgcgagtagcgggcggcggcgcgggttaggggtttaagttttgtcgcggtcgggtgggtgtgcgttcgtcgttattttttagtttttttttttcggcg

SEQ ID NO: 6485 - DNA, 1603 bp, Artificial Sequence
  Description of Artificial Sequence: Synthetic polynucleotide
tcgtatttcgttcgattaaggtcggggtcgtagtttgtattcggattggatttggatgtagttaatttttttttggttgatggaatagttttttttttttatagtttcggcgcgtttttttttcgcgcgtttcgtcgtttttcgtcgtagaataggagttgcgcggttcggagcggcggcggcggcgtcggagtattcgtttcgtacgtcggggcgaggggcgagcgagcgcgttttttttttcgcgttttgcgttttcgcgtttttttttttttcgttgttcgttttttcgtttttttttttttttttttttttttttcgtgttattttttttttttttttttttttttttttttttttgatcgttcgtttgtatatttttatttttttttcgtcgttttttttttttttttttttttttattgttatattttttgtgttttcgtttttttttttttatttgtttgtttattttcgaacgtgaattcgcggttttcggaggagtttagcgttcggagtatttggagttcggtcggcggcgggtcgagtttggttagcggcggcggcggcggcggcggcggcgggagtcgagggagcggtagtcgcgatcgcgggtatcgcgggagttttagcggtagtagtcgtcgtcgagatgtttcggcgaaagtaaagtaaatttcggtagattaaacgtaagtttgcgcgcggggtcgggagttggtgggattattgtttaggagcggggtgcgcgggacgggaaagcggtgggtgggtggcggggttaggggagattcgttttcggttttttagatgttttaaattttgtttgagtagtcgaagggataattagatagttatagatagatagacggttagttcgagtttcgggtaggagagaggttgcgaggagtagtttatgtttgtttcgtttagttttcgcgttttcgggttgtttttttaatttcgattcgcgtacgttgcgagttttcggcgttgtcgtttagtcggaggggtagtttcgtttttttagacgtttattattgttgttgttattgttttgtgcgattgacgtgggattatttttgggaattatttttagtaattagggtagaaattttttagaaaagttgggcggtcgagatttcggggcgagggaggtaatttttttacgcggtggaaaattagagcgttagggtttcgattttgggcggtgttagagttatattaaattcgaagcgaaataaaaagtaggtgtaaaagttcgcgtttttgcggcgggcggtcgtgcgtttttgttttgcgggcgcgggttggtggttggtaggtcgtgttttgggatttcgggcgggttcggtttacgtcgttaggacgtttagtcgagcggggattcgggtggtgtttggttttggtggcgcgcggagttttttttgggaggggtcgttagttattttttagcgcggaagttgtgagtttaaggcggtgggcgcgtaggggagtgtatggttttgagttttcgggtgttcgggggtttcgatggtgtttagaggatacggcgggttaagagatatttttcgaaataggtacgttcgtagagattaagtcg

SEQ ID NO: 6486 - DNA, 1365 bp, Artificial Sequence
  Description of Artificial Sequence: Synthetic polynucleotide
gcggcgaatatgagtgcggatcgtacgatttagttttgagcgttcgattggcgttcggttcgtcgagtttttagcgcgtttcgtttcggtttttcgcgtttttagggtatagaaaatagagtgttttgtagagttttagggttttaaaggtggggattggggattcgtaaaagttggggtggagagtatagttttgattatttgagttttcggagttagggcgtgagtgagcgtttttatacgttatttttgaagtttattacgtatttttggtagagagggatttatttcgtttattgcgtttttatcggttgttttggtagtggttgtaatttatgtagtttagaatgatgagggtaaaggagaaaaggcgaaattgtatttgggcggtcgggcgggggagagacgttttttaaagtttaggaattggagggttcgtttaaagagtcggcgtcggtcgcgttgttggggaggatttagagggagattcgttatttattttcgggtcgtatcggttagtttagcgcgattagtattttttcgttacgaatttgagagataagaagcgaaaatagggtgtgtgggggatggagagagtttcggggaggtagttgcgttttcgtacgttttaatttaaagaagagagggaaggaggaagcgaatttattgtttagtacgagtcgcggagcggtttaatttagagcgggtagttgcggacgagttggagaggaaggtgattataattagtgaattagtaatttttgtcgagttttaagtttcgatttagcggtataatgcgttgtgtcggcgtttcggggaaaggaaagaattttaaaggtattgagagcgtagggttaaaagaacgtttttaggttatttggagtttacggcggtgtatttaagcgtcgtagttgcggttgttttggtgtgggttgtttatcgtgcgtacgtttcgggcggcgcggtttttttaggcgcggtgttttatttcgggttcgggaagcgagtcgtttggttagtacgtgggttggggaaaagtttgtcgagatcggttgggagcgtttggtagttttggaattttagcggtcgtcgcggggttggcgacgttaggtaggagcgcggagcggcgggtgtagttattgggatgtttcgttttcgttcgcgagcgcggtttttaggtaaggggtgcgttcgtttatattttttgtttttttaattaattgtgtcgttttttgcgttttttttacggttattttatagttaagattttttttttttcgagttgtagaaggtagaacgttttcgggaggacgaagtgattcgaagggatgtggtaagcgtatttttcgatggagatgtagatcg

SEQ ID NO: 6487 - DNA, 419 bp, Artificial Sequence
  Description of Artificial Sequence: Synthetic polynucleotide
tcggggaggcgatttttggatgcgttttgtgcgagtaaagtcgggagagcgagttttaagtatttggtagcggtgtttttagtaggcgtcgaggaattcggttatttatttttggtgaattttgcgtttattgaggtattcgaggtacggatgtgttcgtttagtattcggagacgaaggagagagagcggggatatgcgttttagttttgttaggttttagggtttttatttttgtatttaaagtttttattttattttatttttcgttatttattttttgtttcggttattcggtgcggttttagtatcgcgcgttttttcggtacggttttcggagaaagttttttaattattagttacggtatttgtagtttttgtacgtcgttcggtttcgtcgggtgggtagcgttcgttacg

SEQ ID NO: 6488 - DNA, 3675 bp, Artificial Sequence
  Description of Artificial Sequence: Synthetic polynucleotide
tcgcgtagtttagttcgcgtcggggcggtgggtgggtgggtgtttgttatgggattatttttagcgttttatttttttcgtaaaagtggcgttttcgttttttcggtttaggtatattcgttcggggttcgtacgttcggtttagatattagcgcggtggagagtatcgggtggggttttcgaagggtgaggttcggaggcgtcgcggagggggggttttttagagaggagggggcgttgcgggaaggtttttaagggaggttgcgtttaattttcgacgttttgtatttagttcggcgcggcgcgtttagtcgttttttcggatttttttcggggcgcgggagtttagcggcgcgtttagtttttatttatggtggtgatgatcgtgatcgtaaagtagaaggagtcggcgaatttttattggacgtcggcgcggtgcggtttcgattgtaggattattagttttagttgtcggtagttttcgttgttgatgttgtatttttttttgattcggattttttcggttttgagtttttttttttcgcgtatttcgtggttcgattcgagggcgtcgaatacggcggcgtttattagtaggtaggtgaaggtgtagacgatgagggatagagttcgtacgttttgtttttttatggtcgttagtaaggagtcggcgcggggggtatgtttcgtaggtttatagtcgcgcgcgttttattgtagcgttcggcggtcgtcgtcgttttttttttcgtcgtcgtcgtcgtcgtttttaagttgtaagcggcggcggtagtagtagtagtagtagtggggaggcggggggcggggaggttggggggggtttttttcgttggggtcgttatagttatcgttatcgcgaggcggttggcggggtaggggcggcgcgggttcgggtttagtcgagaaggcggataggtataggaggttgttcgagcgtcggggttaggcgttcgggaatttcgatattttgcgttagattcggtcgaagtagttcgttttattgcgtagggttatgtagggcggtttcgttgggtatcgcgcgggttttgttgtttttcgtatttcgtttttcgttttcgcgggaaacgtagggacgggaatcggagttagaaagcggtcggagggcggtcgcggggttcggtatttttgtgggtttagttcgcgggtggcggtgtttagtaaggagtttgtaggttcgcgcgtttagcggaatttgtttttttttttattttttttcgttttttttcggtggtggggaggaaaagtttgcgaagtggcggtgtttttggagttttttgtaagcggggagggggtcgagtaggtgtagcgggaggggtagttcgttttttaaaggttcgcgcgtttagcgtttattcgggcgcgcgggtgcgtagcggggttttcgtcgggcgtcggtcggtgcgcgaagtttgttcggtttaatttttaaggcgcgggagcggggcgcggttttaggacggtagggatcgcgatggagcggtttcgggggcggtcgggggacggcgcggtggcggtcggttagttcgttttttcgggggcggcgggcgcggcggcggcggcgggaggggtttcgcgggtttcgcggagtagcggggcggacgcgggcgtatgagtcgcgcgggggtcggggtttttcggcgttcgggcgtttcgggaggcggtcgtcgcgttggtttgtttcgggcgttacgtgcgtgcgcgtcgttgggagttcgaatgtgtgtgtgcgcgtgtgtatgtgcgtgtgtgtgtgtgtgtgtgtgtgcgtttggtagtttcgtttcggcgggagggtttcggggagcgggggtcgggttacgtcgaggtcgggttttttttttttttttttttttgtagtttttagggcgcgttatttttcgtttggtttttagttagttggcgaggttgttgtggtagttttcgttgtagatttagcgcggcgtagggcgtacgcggagggagttcgggaggggcggtttgagtcgttagggagggggcgggggcggagtcgtcggcgggttttggcgggggatgggaggataaacgcggttttttgggtttttttagtttcgttttttaagagcgtaagtagttttggcgggtggagagtttgagggattcggggttggaggaggaaaacgggatttagttagagatggtaggttgatagttttaggtagattgggtagagagtggggagtagaaggggagggggttatgggtatataggagagcggtagtagcggtttacgaagttttttttattttttattttttatttagttattcggcgcgggagcgtgttattggttagggatatggtttcgtggagtggtggggtttcgagggttgtttcggttttttcgttttttagcggtatagttcgtttgggttagtatttgtagattcgagtcgtttttttggagagcgttaaggatagtatgggtcgttatttttggagttaggatagcggggaaagatatcgtaatttttcgatttagtaatttttttgttgttttattgaaggaaaaaaaaaaaatatatatatatatatatatatatatatatatatatatatatatatatatatatatatatatatatatatataattattttttgatatatataattattttttggttttttatagttgggcgtaaggtgcgtcgtggatgtagttttgagttacgcgatagttttttcgagattatttggggtaggaatacgaggttcgggttggggcgtatttattttttgtttttagatgagttttttttaggttttattttttttttattttggttttttttatttttttttttttttcgttttttttttttaggttatcgaggggtttttttttgattttcggttttttgaatttcgtttggagttttggagttttaaaaggatagatttaagttttagagatttttgggttttttttttttttttgattttagttaaggaagggatggagatgggaaagagttgtttggcggtaggttagtagttggttaaggggtggttggggaattagatttaattttcgggtagttcgcgggttttaggagattagttttttttgtgggtcgttttttggagcggtgttcgggttttttggttttagggatttcgggtttagagggtttgggattttagtgatttatcgaggttttttagttgggacgttttgtattttatttttagggattacgggtgtttattagggaaggggagttcgcgttgtgggttacgtttgagtcgttaggttttcgttgggtttgcgggcgttttggggcgagggagcggggagttttatttcgagtaggtattttttttagatttattttggaaattaaggttttcgcgttcggtaagtgagtttggttgtcgggtgagttatcgcgagcgggcgataaggatttttagtagttggtaattaattgcgtcgtggtttagtttacgacggaattttagttaggtttttcgtcgttttggtagcggcgttatttttgagttatagtcgtcgggttttcgcgcggttcggaagtcgtttgttcgtttcggcgttattagggggtattggatttcgatttacgcggcggtcgcgtagtcggtttcgttgcg

SEQ ID NO: 6489 - DNA, 3675 bp, Artificial Sequence; identical to SEQ ID NO: 6488
  Description of Artificial Sequence: Synthetic polynucleotide

SEQ ID NO: 6490 - DNA, 3378 bp, Artificial Sequence
  Description of Artificial Sequence: Synthetic polynucleotide
gcgagcgcggagtcggagagtcgggagtataggcggtcgcgtcgcgttttggttcggttcgggttcgcgcgttagtatcgttcgtagcgcgggtattcggatttttcgggcgttcggggggttttagtaggcgcgggggaacgggagggggtttgcgtgcgtcggcgggtgttttttagggggcgtttcggcgaggtttagagcgggtcgggggcggcggcggttggaggagttttttttattttcggtcgggcgttcggtttagtcgtcggcgacgcgaggcgttcgcggggatttgtaattcgtcggatcgagttttcgtcggcggggtcgttgttgttggggaaggtaaggaaggttttggcggggggttgggggcgcggcgggtgggggcgtagcgagggtgggagggggtcgggggaggggcgggcgtttagattttttaatttcgtcgtttggggtttcgtagtttcgaggttttgcgtttagagtttaggagtttggatttttattttttatttttttagttttttgttttttttagcggtggcgatggaatgtggtaggttttcgcgagttcgtattgggtaggttgaggagggggcgattttggacgtaggagaggtttttcggcgtcgtcgttttttttttatttatatattatagtttggtatttttttttattatatgtatagggtaggttggggagggcgttttcgttgtatttttagtatatatagacgttggcgggggtttaagggagttttttatggtttttaatagttatatatagacgtagtaggtttcggagagttttcgagcgtgttttttttttgttaattacgtttagggttttttatagatattgtaagggttcgagacgttttttttttacgtatagagttcggggtaggtaggagaaaattttagattttttttcgaagttttcgttcgtagaagttttcgtttgtagatttggtattggtagtggagattttttggaggtatttttttttatttcgggcggagggttatttttgcgttttttatttttacgcgaacgtttggtttttttttttttgtttatttttttattgggtcggataggtcgcgcggataagtcgtttttaattttgggtcggttttatgtcgttttcgttttaagcgtcgagtattttcgggcgtcgagtattttcgggttcgcgtcgtcggtgagtagaggtcgtcggttttttatcgtcgtcgcgttagtttggagtcgcgcggagttgtttcgaggaacgagtacggttttcgtttttttttggggaggttgggagttttggattcggttaggagttttttttttaggttttcgcggttttttgggcgaggtagagagttttttcggtttcgggagggggcggcggagttgagaattatcgcgaagcgatgcgatcgggagggtttgacggaggttgcggtttcgagttcgcgtttttttttttggtcgcggcggtttttgtttggttatttttcggtagtttgaagagaacgtttaatttggtattttagttttaggtcgttgggtattttatttttttttatttttattttgggtttttaagttttttggagcgtaggcgtttaggttgggattcgaagagttttaagttagtttttttttagtattcgttttcgtcgcgattttttcgtttttttttcgggtttggggcgtagatttttgggttgtaatttcggagtagttgaaaggtaggaaggcgtgtgggcgggtagggggtttgtattttcgttttagaggagtcgtttgtcgtttgtgttggggagggagttgggaggtttgttttttcgttttattttgggaatttacggagattttcggtattttttttatagatataaatatacgttttttcggagcgagagtcgtcgcgggggaatagtagaggtcgcgcgggcggaggcgggggaaaggggagttgggttttttttttatttgggagggaggtggtatacggtgtgtggggtttggggaggcgattgttacgttttttagaatttttatgttttttattcgtttgcgatttcggttgtcgaggaggtaacgagggaggtcgagtcgttttttttcgtgggcggtagcgaaattttgcgttcgtacgtcggggtgtcgtcgagttcggttttgagtatttagtaaggttaagtaggcgaaggagggggcgggggtttttgggcgcgttttcgttcgcgtatagtcggggttttggaagggggtgtgcgtagttcgtcgagttagtttcgttcgtttgtcgttcgcgttcggttttcggaggcggacgttgcgcgcgttcggggatttcggagcgttcggcgttttacgtttttttttcggttcgttagttgttttttggcgttgtttttagatttgttgcgtttcgatttggggggtagaaggttggttcgggagattcggcggttgagggtcgagtcgcgaagtttagggatgcgttagagaggcgcgcggtttcgcgggtgggcgttgcgttggggggttcgagtttggggtttgtcgttttcgattttagggacgggcgtttgtttttgtcggggtttcgcgtaggggcggatagagggcgattcgtcgtttcggttttaggtagtatttattcggatttcgggttagggagggggcgtagttaagttgtggagttttcggaggtttttttttttttcgtaggtttcggtttttttcggatttcggtggtcgcgttcgtgaaatggggacgcgggttttgttttcggattttttttagttttcgatttttcgtatttgtttcgagatttaacgtgttcggttcgtagcgtgttgggtttgcggcgttagggtggttcgagtttcgagattatttgcgtttgcggatatagtcgcggggtttggtatgaagggttttagggagggtttagtaagcgttcggggttcgagtagttttttgcggcgtttttcgttttcggtcggttcgatttcgttttcgggagtgggtcgtggggcgcggagttcgtttttcggggacgtcgcggggttttaggtttaggcggtcggcgcggggtcgtagtggcggaaggcggagggtcggcgcgttgtcgttgattgtcgggagagggcgttcgtatcgcgttcgcgcggttttgttcgtttttttcgtttttttcgcgtttggttcgcggtttcggttttattttgggtagtttcggtcgttatttttttttcgttcgttcgttcgttcgttcgttcgttcgttcgttgttcgttttcgtcgtcgggtttcgtgacgcgtttcgcgtttcggtcggagtttttttcgtcggttcggttcg

SEQ ID NO: 6491 - DNA, 1108 bp, Artificial Sequence
  Description of Artificial Sequence: Synthetic polynucleotide
gcgtgtttagatgaaaagcggggtagtcgcggttcgtagatagcgggcggttgggttagatcgtagagggaagtttttagcggtaagttttttcgcggggaaggttgtgtttgttttaggagatgagtcgtaggtattaggggtgatgaggttcgggggaggtggatgtgggggatggagcggttttaaggtcgttagttttagtcggcgttttgggtcgcggggtcggagagtttcggagcggattttcgtcgcgtttcgaattcgtttcgcgtttttaggttatattcggttcgtatttttttcgttttacgtgcgtttacgcgttttttcgggtttttttttttttttcgcgcgggtcgggggcgcgggtttcggaggagttgggggcggcgggggcgcggggcgggcgattgtcgggtttcgggttagttttcgtttttcgtttcgttttcgatcgttcggttttttcgttcggcgttttttcgggttgcgtttcgcggtttttggcggcggcggcggcgggcgtagagcgcggtatgggcgttcgggtcgcggggtttggcggcggcgggcggacgggcgcgcggttgcgggcgtaggtgcggggcggcgggtcggggtcggggtcggggcgcggagtcgtcgttcgggggtcggggcgttcgcgttttcgtcgtcgttgacgtttcgtttgtttttttttcgtgtttcgttcgtttttagatttttttttttcgttttttcgtagttcgggttttggtcgtggcgcggttgtcgtacggtgtttttcgacgtttttcggacgcgttgtttttgtgatcggttttttattttcgttattttagtttagtttagcgtcgacgcggtgagatttcggtcgggtcggcgggaggggcgtcgggtaggggcgcgggcgggggttgtcggcgggtttgcgggtggggagggttcgtattcgttttgtttcggaggggtcgttgtggttcgtagtcgtcgtggtttggttcggtcggcggggtttatgcgtttttggagagggtgggtgggcgtcgagcgggtggtagtgtggagttggagacgggtttgggaggagtcgggattttcg

SEQ ID NO: 6492 - DNA, 1700 bp, Artificial Sequence
  Description of Artificial Sequence: Synthetic polynucleotide
gcgcggggtgggcgttttcggttttttagtttttaattttttcgcgtattcgggacgggtgaaggcgtttagttgtcgagtatattcgcgacgcgggtttaaatttcgtcggtttttaggtatttttatttcgttatagcgcgggttgttttttttttttttttcggaggaattttttaattttttagtatttatattataataaaggaggttcggtttattaatgcgcgatcgtagtttatagggatttttaacgaatttcggtttagagaatgtatttggtcgtgttacgcgcgattttcgaggggtaggcggacgggtttaggcgcggataaaggggtttttcggggcgtttaagttcggggcgggacgtcgggagcggagttggtcgggaatttattttcgtagcggttcggttgtgtttttcgtggagtagaagggcggcgggtagtagtagtagttagacgttgagtcggggttttatggtggcgcgttcgaggcggcgagggacggttgttcggcgtgcgggggtcgcggcggatagttagttttcggaaggtcggatttttagcgttacgtatcgtttcgggtgcggcggttttaagcggagatttgagcgcggcgggtcgagttttttaatttgttggcgttgttttttttttttcggcggtgcgcgggcggcgttttaaaggggaggattttgcggcgcgggtaagaggcggcgggagcgcgcggttcgggagtgtggttgtagtgcgtcgggatattagggtttcgcgtttcgtatttaagaggttttcgcgttttaatttttcgcgttcgcgcgttcgcggatttaggtcgaggatcgaaaggggtcgttcgagttttcggggtcggcgtttagagagtttagtaaggtcggtcgttttgtcggtgtgtcgtcggcgggtgtttttggaagggttaatgcgttcgggtagtagtttttgaagtcgagttcgaggtgagagcgattttcgagcggcgtttagattttggttcgagagtatcgatttggagcgttttgtgtaggttagggttgtacgtttttttgtttgggagtagaaagggggagggtgggagagcgaagatcgagtttttcggttaaggagtatttataggggtttaacgggaggtttttttttttttcgggtcgtgggggggacggtttttcggttatttttgtatgcgggtcgcgtatcgcgttgttttcgcgtttcgcggatcgagatcggcggtgaggatgggttgttttttttattttgcgttaaattcgttttgtttgtcgtttttaggttaagtgggattgatcggggtttagagtggacgaatcgttagtatggggagagattagcgcgcggtggtcggttttgttttacggcggtaagcgattttttgtttggttttcgtgggttacgcgcgtatggatttttcggtgtaattttcggggattgataagtcgggttcgtacgtttacgttttttttttttttttttttatgtaggtggttgttgttggggatagtgatcgtggggtttttcgtttagagcgttttggcggtaagttttggttttcgcgtttggatttgcgcgttcgagagtggttgggacgtttgagtggttttggagaaggtagttcgttcgtgcgttttcgagtgtgtgtgtgcgtgtggatgttcg

SEQ ID NO: 6493 - DNA, 692 bp, Artificial Sequence
  Description of Artificial Sequence: Synthetic polynucleotide
tcggcgattcggttatttttcgagggttttaggcgttttatttaacggtcgtttttcgttttttgttcgttattttttcgtttttttacgaaggcgcgaacgttttagattttcgtcggttttcgatagtatttatttagttttttttttggagattttaggttgtattttgggatagaaaagaaggcgggtacgatcgcggtgtcgggttttattttagtcgtttttttttttgagggagttaggcgggagagaggggaattatcgaggtttcggttttttcgcgttttagagcggtcgggcgagttttattttcggtttgtgattcgttgatttgtttttgttttattagtcgggcggtgaattggattgattggtgatttttggtattaggtttttttatgggtatcggagtaggcggataggggtggggtttcgcgagcgatacggaagggttagtgtggcggagcggattttgtggaggcggggttattgtgtttttgagaagggttttcgggggtggagtttattaaggttgcgggggcgtggttacggagcggagttaataaaagcggggcgtgtacggtcgcgggttagtgtttatgaagggcgaggggtgtggttatagggcgggatttacgaaggatgtaggggcgaggtcgggtttttgtaggatgtgcggtcgcgggtcg

SEQ ID NO: 6494 - DNA, 1924 bp, Artificial Sequence
  Description of Artificial Sequence: Synthetic polynucleotide
tcgtcgtttgtttaatgttttcgttagttttgtcggtttttatcgtcgtttgattttattgtttttttcgtggtttttgttgtttttttaaattgtttaacgatcgttatttagtaaaaatgaatgaaacggggtcgtgtgatttaggtagtttggagatgagattttggaattataagttatattttaacgtataaatcgattttattcgttttggatattcgatgtacgcggaatgggcgttgtaaaatgcggttgtttcgtcggaggtatttgtttgggatttgttggtagtcgtcggttttttttgtttgcgattttcggtttagtcgtcgggattttggtgtatttgtttttgggcgttttttttattttttagtggtcgttagttttatttttagtttgtggtttcggattcgtcggtttgagcgttcgtagagggtcggtcgtcgttatagtttcgcgtttcggttttcgcgttttttggattttcgttttaggtcggcgtagtttagtttttcgggtaggttttacgttatcggggtttagtgcgcggcgacgaagcggagagttgtgtttagatttcggagagaaatttcggtttcgcggggcggcgcggggcggcgcggggttcggagttgtttaatttcgtcgtttcgggaaggcggtttcgggttcgtagggagtttcggggagggttttcggtttcgtcggtagcggcgtcgaggggtgtttgggtttttggggatcgcgagaggaaaaagaacggaaatcgtatcggggaggaaggacgcgtagaacgttttcgtgaagcggggtgtttcggttaggcgtgcgcgggagcgcggttcgggggagttcggcggcgtcgtcgcgcgtattcggtagaggtttcgcgggagaacgcgtagttcggggcgtggggcggggaattgttcgcgcgaggttttcggcgcgtttgggtttcggcgagagtaaagcgcgttttggtatcgggggcggcggcgtagaggtcgggaggaagaaattcgggttttggtttaggtcgggtttttatttttgcgattcgcgagaggtttaggcgggaaaggcggcgagtggcgttagcggtttcgaaagtaaatttggttcggtgttattgttcgagggtcgtcgggcgcgttttttaattttttcgagtttggaaaacggagattttcgtagcgttttttttagtgcgtgttgcgagtgttgaaggaggattcggtgtttggacgattcggagtaggggaagtattcggtcgacgttgtcgttgttatcggcgttattggcgggtaggatagtggggcgggtaaggggttttttcgcgtttttcggtttttcgcgttcggcgttagttttttggtttttttttttgcgtagttttaggtttagtttttagttattttttaagaagacgatttcgagggtcgaaggtcgtttttgatttttgattacggatttttcgtgtaattcggaagagtcgtgattttaaaattcggtttcggggttatagaagttcgagatttgggaggcgttcgggattttttttttagaatcgtagggattcggtttgggatttagggtgtggtttttcgttttgcgcggtcgggaaggcggtcgggttcggttatcgcgttaagtattgcgtatttttgggacgcgtcgttgcggggggttggggggttggggcgtttttacgacgtttggtttgttcggttagtgtttggtgtcgttggtgggttcgtggttgcgacgggtaaacgttcgtttcgcgagtcgggtaaggtaatttttgcgggtcgcgttcgaaggtcggatttttttaagtcgtttgggagtttttaaataggtggattcgaagtttttgtttgatcggagaataacgtttaatttatttcgtcg

SEQ ID NO: 6495 - DNA, 1991 bp, Artificial Sequence
  Description of Artificial Sequence: Synthetic polynucleotide
tcggtgtatcgtgttttggtaatcgggttttggcgttttcgagagcggggcgaggggtgttacgcgatttttaggtcgttttgtatttttcggtgcgtttgtagggattttgtagtaaagttttggatgtttgtagtcggtgtaagtttgtaagtagttggagagcggtggttggagtcggggggcggtgggcgtggttacgtttttttttaggtagtttcgggaatgttttgaaaagtattcgaaagttttgagtcgcgcgcgcgttaaaagaaaaggtataattttttattatttcgggcgtggcgtgtttagatttcgttattttagttgcgttttcggttgtagcgtatacgttttttgcgttttttttttcggagcgtcgttgttcgtcgggtttatttttcgtagtagtttttaggcgagagagggggttagagtgttcgtattttttttaggggtattatgtttaacgacgaggtatttagtaagttttttatatcgtcggaagttttttacgttttcggggtatcgtcgtagggtagagtcgggggttttggtaaagcgtttggggcgttagtgggggcggttagcggttcgagcgtcgggggtagtagtagaggaggcggtttcggtttcggggcgtcggatttgggtgtcgggagtaagaagttttcgcggttgtttaagtgcgtacgttgtaggaattacggttacgtttcgtcgtttaagggttataagcgtttttgtatgtggcgcgattgttagtgtaagaagtgtaatttgatcgtcgagaggtagcgcgtgatggtcgcgtaggtgggtgcgggcgtgcgggagttcgggtttagttttagtttttttttttttttttttttttagatggagtttcgttcggttgtttaggttgtagtgtagtggcgcgattttggtttattgtaattttcgtttttcgggtttaagtaatttttttgttttagttttttaagtagttgggattataggcgtatattattatgttcggttaatttttgtatttttagtagagacgggggttttattatattggttaggtcggtttcgagtttttgattttaggtgatttattcgtttcggttttttaaagtgttgggattataggcgtgggttatcgttttcggtggggttcgagttttttgaatgaagtttttttagtatggtcgttgttatgcgggttttgggttgtggagagatgcggcggtatttgtcgatagcggcggcgtttggggttttgggttttcggttacgttatatcgtcggtttgggagcgtcggagacgcgtttgatttcgttcgtcgggtagagttgcgggtttcgttcggttcggggttttttacgattttttattttgtgtttcggcggagttgcgggggttttttttgttttcgggtttttgagatttttgatttcgtttttagggtagggaatttcggggttcgtttttttgggttttttcgcgattttagagttcgcgttttaatagaattgggagggtttattgcgttagaggagtttttaggattttcgttttcgtttttcgaggtgaggttagaggggagggttcgattttaagggaattttagggatttttagtttcgtttttttagtagagaattaaggaatttttttcgttttggggttttaaaaattttcgatcgcgttttgggagtagagggtttcggggttcgattttttcgagcgtttttagaatttttgattttttttttttgttgagttgtatttaaattagaaaggattttggagggcggtagcgttggttgttaggttagcgggaaagggaggttcggtcggttgttgtttacgcgggtaatttgtcggaaagttttgtttgtttttttggaaaagtcgttgtaatggatatagcgttgcgcggtttttttgcgcgtttggggcgttttttgttttcgtttttcgtggatggaggttgagcg

SEQ ID NO: 6496 - DNA, 1667 bp, Artificial Sequence
  Description of Artificial Sequence: Synthetic polynucleotide
tcggggtgtaatcgtaatattttcgtaggttcgagttttttcggagttgagtttttgcggttaaatgtcgggataaaagcggttttgggttcggaaaaacgcggttagatttggattggagggaggagaagagagagaagcggagcggttattttattcgtttataggtatttttatttttattttcgttggtttttttttttttcgtttcgcgagtatcgtcgcgttttggagcgtcgtagtttttagtcgcgggttggggtagcggagagggtttggaggagggggtcgcgagcgttttcgcgagagtggtttggttgtaggtggtaaggaaggtgaagtgtaggtattcgaggggcgtaaaggaggaggaaggcgtggggcggggagtgtaaggagatagggattttaggggcgggggtggcggtgggaaggaggaggggttgggggagggcggcggaggtgttgggttcggtcggtttacgagggagttgtagaagagttggtttagattttaattagagttgtcgtcggttttttgtagtcgtcgtagcgttttcgcgaaggaggacgtgtcgattcggttgcgcgtttaaggtagaggttcgcgtcggcgttggttgggcgtgagttgggaggtcgagttgtgagcgcgaagggagttggagagacgattgcggtattttcggtcgtttcggagtatatacgattatcggggttgcgggattaagggtcgcgtcgttcggaggtcgtttttgagcgggtttcgtagtttcgtcgtttagcgttttttggttttttttcgtagttaggttgttaatttattcgggagttcggggtatgaacggttacggttttttttatttgtatatgggcggttcggtgtcgtagtcgttacgggcgtttttgtagcgtacgtttaagtgcgcgcgttgtcgtaattatggcgttttgttttggtttaagggttataagcgttattgtcgttttaaggattgtatttgcgagaagtgtatttttattatcgagcggtagcgggttatggttgcgtaggtggcgttgcgtcggtagtaggttaacgagagtttggagagttttattttcgattcgttgcgcgttttgttagggttttcgtcgtcgggggacgtcgtcgtcgtttcgtagtcgtcgttagttttttagtcgtcgtagtcgtagtcgtcgcgttttgttgtcgagttggtcgcggtcgtcgtgttgcgttggattgtcgagtcgtagttcggggttttgtaggcgtagttcgttaagttaggtaagagcgtttgaggtgcgggagtttggtcgggcgcgggggtaatttcggagtgttagttgtagttttatttgggaggattggaggtaaagttttgggacgtgggtttgtcggggtttttttttttatttttcgttaggtcggggttttttttttcgggagaagtcggttgagtttggatttagcgcgagtggtattcgcgttcgtagggaaggcgttttcgggtagttaaacgacgggattgtgcgttagtatcgttaggtgtttttttaggttgaagggttcggaacgtgttagattgagtagggagataacggagttgagataggataaaattaaaatttacgtgcgtatatttattacggtggggtcg

SEQ ID NO: 6497 - DNA, 433 bp, Artificial Sequence
  Description of Artificial Sequence: Synthetic polynucleotide
tcgcgagataaatggtgattttttttttgtaggtatcgttatatttcgggtttagattttggataggcgagtcggttgtatcgaaggttcggtaggcggattttggcggagcgttttagagagaagagtgtagatcgcgggaggcggagggttttttgttagcgtgtttcggttaattagtatttatatcgtttgataatcggttaattagaggacgtaaagtttcggggtttgagcggatagtattaggaaggggagcgtagtttgtagattgaagttagtggcgttgcgttgaatgtaattgcgcgcgttcgtcgggtgagttagcgatttgagttaggcgggggcggttcgatttttttcgtttagtttgggttagaggaagtcgaaagcggttttagtaaggtgaggcgttcgaggttgtagaagatcg

SEQ ID NO: 6498 - DNA, 896 bp, Artificial Sequence
  Description of Artificial Sequence: Synthetic polynucleotide
acgaggattaaaggtacgaatttgtttttacgttacggttcgggatttagggtgcggggattacgcggagcgtagtagagtttagggtaggagtcgggaggtcgcgtaggtagagttcgggtagggcggaggggaggtcgcggagggtcgggtggaggtttttatcgttagttttaaggtttgtagtatttttttttggtttttgtttttagggtcgatgtgttttcgagcgaagtcgtcgtgtttgggtagaaggcgttttaggaggcgcgaggttttagtcgcggcgttgttttcgtcgttattgttgttgtttcggtttcgcggcgtttagtacggtttcgattttttagttaggcggcggtcgttttcgatttcgcggtttaggcgtagtttttacgttttggtataggattgtatggtcgcggttatcgttttttgtttcggttcgtaagggttagtcgcgtttttggttttttttttggtttcggtttttcgggtggcggttgcgttcggtttggagtttttttcgttggatagtcggtcggatagatggatggacgttcgcgggtaatgaatgggcgttgcgtttaattaagatattcgcgtaaagttgtggttttatttaaggtatttgtttcgtatattttaagcggcgttttggaggcgggaggtgggttggggttaggaagtttttggttaatgaaagtagatagagggggagggggcggaatagttttcgttttcgttttttttttttattttttttttagttttttcgtggagtttcgttttttttggatcggaggttgttatttttagttttatttatttcgacgttggttggtgtcgggggtcgggacgtttcgtacgtcgttcgttagggtgtggagtcg

SEQ ID NO: 6499 - DNA, 1494 bp, Artificial Sequence
  Description of Artificial Sequence: Synthetic polynucleotide
tcggggtttttttaagcggagtattttaaaagtcgtatcgcgtagtagaggtttttaggggtttttattcgtttttagtgattacggagcggtttttatttttcgtcggcgtttggttattttttttttttcgtagttttcgtttgatttttatgtgattgtaggtaagaatagtttagtttttgtgtttttgtaaagaacgtaaataaaaatgtatattattattatttaataaacgcgtaatttcgtaagatataaagcgttttttaaatatcgtttttttggtaatattcggtattttggggttgttaaatcgtagataaagacgtttattagcgcggggggtgaggagattaagggagagataagattaacgtgtttttattaacgggagcggcggttaaaagggcgtcggtgttaggggtgagggacggggtatcggtattaattagcggttcgtttcggggttttcgcggttaaggcgagaacgtaggattaggagtattgttgtttattttttatcgtaattcgtatatttcgggattacgtaacggcggatggggcgttcgggagcggtttttgtaggggagagtaataggttttcgcgttttggaggtttggtttgcgtttcgggtttttaggttaatattttatttttagtttttcgatattaagattgtgtttttttgggttaaggaaaaggaaaaatttttaaattttttagttagcgagagtaaaagaaaggggtggcgggggtgttgaaaggtttaggattatttatcgcggggttggggggagtggagatttgcgagtagtaaaggaaatttttagattttatttttttaaaaaagttatagtagcggttttcgcgaagcgtcgggtcgcgcggggtggggtaagcgtatcgttttatcgttttacggttcgtcgttatttttatttttatttttatttttatttttattttcgtttttatttttatttttaagcgtcgagtttagggcgttcgcgtatttttttcgtcggcgcgcgcgtagggcgcgggggcgcgtttcggtttttgggtcggggtttaagcgtcgtttattcggttcgcggcgttcgtttagggtcgcgacgcgagggggcggaggattggggagtaggggtcgtcggggtttttggatgtttcgtttcgtttacgtttattgtttttttttttgaagtaacgattcggcgaggagtttcggattaaaacgtatagatatttacgcgtgattgagaaatttaatttcgcggtggttcgacgttagtttagcgtttcgtcgcgtttttttttttagcgcgcgtcgtatttgcgtcgatcggggttgtcgcggaggcggtggcggggtttaggttgttggggttgtcgtgacgtttgcgatcggcggggcggcgggcgcgttttggttaattaggggacgcggtcgagtaggtttgtgcggggttttaaattcgtttttgggtcgttcg

SEQ ID NO: 6500 - DNA, 828 bp, Artificial Sequence
  Description of Artificial Sequence: Synthetic polynucleotide
tcgcgattttatcggggaaatatcgcggatagtcgggttagtagcgttcggagtttattttaggtttttaaatttgtagtattttttagagcgcgcgcgttcggagcgggatttgtttgttttagtgtacgtcgcggagcgaattatcgggttggcgggggtggaggggtgtaggcgtgggggttgcgggtcgttcgggttttgggttttttttgtcgtcgtcgtcgtttttcgttttcggttaggagtcgcgcgtgacgcggttcgtcgtaggagtttcgaaggcgcggcgtcggcgagttttttttcggtaggcgcgtgggtggtagcggttaatttgatagtttttcgggtcgggcggttagcgcggaggcgttacgttcgggtcgggggcgggttgacgtcgtcgtcgtcgcgggaggagggataaaggggtgggttttcgcgggtcggtatttcggcggttgggttgcgggttagagtattgttcggtggtgtttaggaggagtaggagtaggagtagaagtagaagcggggttcggagttgcgcgtttacgcgggatttgtgttcgaaatgtcggtgcgaggagatcgcgggtttttatttcggcgggagttgttaggttggtttcgcgtaagtgtttttttgtgtcgcgcggttgggaggagggtcgtgagcgtgagcgtgggagcgttgggggttttgttcgcgtgttgttttgaagttgtttttcgatgcgtcgtaggaagttgggatttttttattcggacgtgggacgtaggggaggggtaggttttatcgttcgggttgatgattcgtggttttcg

SEQ ID NO: 6501 - DNA, 2705 bp, Artificial Sequence
  Description of Artificial Sequence: Synthetic polynucleotide
tcgtgtttggtggttcgggtggggcgtagttgcgggaaatgtattcggagttgtgttttttttcggcgaatagtttgcgttattcgtcgtatcgggaggtggttgggggttgtcgagcgagtggtgaacgcgatgggtggagagcgttcgaaacgaggtggaaaagggggcgggggcgaggtacggcgtttttttgttttttttttagttatagacgcggcggcggcggttgagttttttagtttcggttatgtgatagtttcgaagcgttagttgcgggggtttcggcgtttcggggattattataaaacgtagttaggagagcgcgtcgttgttattgtcgtcgttttttttttttaagataagttcgggagaaaggcggtagttgcggcgcggacggttgagttttttcggttagtatttatttagtattcgtagacgttttttttagttcgtcgttcgtttttagagttttgcgttttatattttttagtagaatttgcgggcgttgtcgttttagaaattattaaagttttttttttttagcgatagtttagggttgcgcgttttttttaatttcggcgacgttgcgagtttcggagaaaagagaggcgttttagaagttaattttttttttttttattttgattttttattttaggaaaaggagaattttagcgcggtttggttaagtgtttggttaggggtttgcgtttagggtattggaagttttgttgttattggtttttaggatagtaggcgtaaatttagatttaaagggttagagtttttattgtttagattttttttttagttattttggtttgggtttttttcggatttagaaaaagtaaagaggtcgggaggaaatacggttttttgttatttttttttgtagttagttttagtatttagtttttggttattcgggggaagacgtagagaaggcggcggtaaatttggtgtatttcgttcgcgattgtgcgcgttagtcggtaatcgtcggggttagaagttgttagttttcgagagttgagtaggttcgaaaggttaaggtcggagatattaggtaattcggagaaggtaggagagagaagtagagagggtttggagggcgagagggtaaagtggcgggattggaggggtcgagtgggaattagtgggggtagttaggttttaggaacggagtgcggagagattttgtggtttagtgcgggtcggagggcggtggaggagtcgggggcgatgtcgcggtcggggaagagttcgtatagcgattaaaaatcgttttatttttatatttcgttgatcgttatggtaatttagtattcggtcgagaagatgttgtcgttgagcgatatttataagtttattatggagcgttttttttattatcgcgagtatatatagcgttggtagaatagtttgcgttataattttttttttaacgattgttttattaagatttcgcggaggttcgattagtttggtaagggtagtttttgggcgttgtatttcgattgcggggatatgttcgagaacggtagttttttgcggcgtcgtaagcgttttaaggtgttgcgcgtcgattatatttatttgtacgcgggaagtattaagagcgcgtcgggcgtcggttcgggagggtatttttatttttattattattattatttttattattattattattattacgttgtcgtatattattattattattattatttattttagtcgtcgtcgtcgtcgttttcgtcgtcgtcgtatatggtatattatttttattagtaatcgtttattgtttcgtagtcgttttcgtatttttcgttatagttttcgtagtaatcgttttagtagtcgtagttttagtagtcgttttatttcggtaagatgtaggaggcggcggtcgtggcggcggcggcggcggcggtcgcggtagtcgcggtgggtagcgtgggacgtttgttttagtttttattttacgggttgggttcggtcgtcgtcgttgtcgtcgcggtcgtggcgtttacgttaggttttaagtatttttttgttattgagaatattattggtcgggattataagggcgtgttgtaggttggagggttgtttttggcgttcgttatgtattatttgggttatttcgtgttcggttagtttggtaacgtcgttagtttcgtgtggtcgtacgttggcgttatggattcggtggtcgtcgtcgcggtcgtcgtagtcgtagtcggagtttttgtaggttcggagtatggggttttcggggtttcggttaagtttttgtgttattcggtaagttagagtttgtttgttatgtcggtgtttattaagtttacgtttgcgttgtcgttcgtgttcgcgttgtagtcggggtttattgttttcgcggtttcgtagtagttttcggcgttatttatcgtgtgtttcgcggtcgcggtttcgttcgttgtttttttgttggagtttatagtttttatttcggtcgaaagtaagggcggttttttgtattcggtgttagtgtatttttaggggattcggcgggcgtggggagattagcggggtgagagacgtcgggttcggaatcgtttaaattattcgacggggagagggcgttttggttaggtcgggtagagttggcgagttttagtttttgttggaacggaaggtatttaaatagacgaataatttcg

SEQ ID NO: 6502 - DNA, 704 bp, Artificial Sequence
  Description of Artificial Sequence: Synthetic polynucleotide
gcggaatgtgggcggggcgtagttggggagtttgcggggaatgtgggcggggcgtagtggtgggagggcgtaggagtgtgggcggggcgtagttgggggagggtgtagagatttgagggtttgaggttgtttggttggtttcgtttttagaggcgggtgtcgcgttgtcgtttaggtatttggggtttttggtgtttgagtgttttattgtcggcgcgaatataattgttttagttataggcgaggtttggttaaggtgtgggcgtatttggggtaggttttgagaggtttagcgttcggtggtgcggatagaggcggggtatcgcggcgttcgtcgtcgttttttcgtaggtgattatttttttgtaggtgttttcgggttttaggtggttgcgtgtttgcgttatggttgatattttgggcgagcggtatttggtgatttgtaagggcgcgacggtggaggtcgaggcggcgttgtagaataaggtggtggtattgtatttcgcggcggttcggtgcgcgtcgagtcgcgattttacgtcgttgttttgcgatttttatacggcgttggtggtcgaggcgcggcggttcgcgtttttcgaagtggttttcgtgttagtcgacggtagtttttaggagatgttggattttatgcgcgagttgtatggcgtttggttggcgttgtttttttacgatttttatcg

SEQ ID NO: 6503 - DNA, 950 bp, Artificial Sequence
  Description of Artificial Sequence: Synthetic polynucleotide
tcgggacggagcgggttattcgagtggtaaatttttttttaatggatgcgggaaaagcgtatttgtagttttttttttatcgttgttaagcgagttgattgttaaggagtgcgtatttgtttgtttttaacgtgatagtcgcgggagcgtttcgtatttcgggttttagggaatgaaggagtttgtttcgaattggttttagaatttttagtttttagggcggttcgcgttcgtatttattttgattacgtaggtgatttcgggttttagtatttggtcgttggcgtgcggcgtttttcgagggggtttgggtagcggttcgtcgtcgggtcggttttttttggcggcgtttatggtcggggcgcggggcgtcgagggcgtattgtcgttcggggcggttaggttgggcgcgttgtagttgttcgagagtcgcgcgttcgttcgttttcgggcggtcgacgataggtcgcggaggttcgagttggagagttttaggtgggatattttgtggagtaggtggtttaggttgtcgggtttatcgtcgggcgttttgcgtagcgtttcgtcggatattaagtagggagtcgtcgtcggggtcgcgcgcgtcgtcgaaattttgttttcgtcgtcgtttatcgataggttgtggagaaggttatcgatcgatgttatcgagttatttttgaagcggttatatttggtgcgtggaagtatgttttttcgtgggttcgttgtattcgttcgggcgttgttggtgtcggtttcggcgcgggttgtcgcgtatagtaggcgagttattgttttcggagcgggacggagagtgggggtttcgggatagttttttggagaacgagagtagagtaagaggatggtgtttttttatcgttaaaagttagtatagcggcggtcgcgtagtttcggttcgggagatcgttgtttggggttgtacg

SEQ ID NO: 6504 - DNA, 4861 bp, Artificial Sequence
  Description of Artificial Sequence: Synthetic polynucleotide
gcgtcgtcgttttgagtattttgcggaaaatgtgagaattttggggagttattgttgttgtaaggattcgcgggcgggttatcgcgttggtgggggggttttgtttaaattttgcgttttcgattttttattcgttttataaagggttggtgaagattattttaaggatcgtacgaattggttttttaagttttaggaaatcgaaataataatcgaggcggttttttgttcgggttattttcggagcgagttttgcggcggatttttggttttcgtttttttgggtattcgcggtgcggttagatcgtttttgttagcgattttttggttggtaagggagaggaggtggagtttagattggttttttacgtttagagtggaagcgatttttaggattttgtagttatcgagtcgttcgtcgtgtttagttcgggtttgatggtgaagagtatagttgttttcgatagagtcggaggaaaggaagtttaagaagtaattgttcgcgtttcgtttattttgtcgagtttatttttatttttatttttattttttgcggatttagaagttgttttatcgagttcgattgtgttataaaatattttattggaaaaaaagttatcgttttcgtaagagggggtaggggttttagcgatatcggggattcggtttttaggtcgagtcgacgggttgtttcggggtaattttaggtcgttgtggtttgagtttaatcgttgggttttcgacgtttagaagcgggtgtgtgtttggaggtttttcggtcgggagggtaggttttagacggggtgggggtgtaggcgaggagcggggcgtgaatacgcgtggagcgttttgcgttacggagtttagggtagagattgtagttttcgtcgggttggatgcgagttttttaggttagagtttagaagcgcgttgggatttgggtttggtttttgggtttgtgttttttttcgtttggttttaattgttcgtatttaagattataataaaaaggtttaggaagtaaattttttggacgcggaagggtcggttcgcgggttttcgtcgagtgagggggttgcgggtggcgcgggtattttaggtttcgtatcgtatatcgtttttagttttcgcggtttttgtcgttgggttcgttcggtattttcgtcggtttttttgtatttttggcgcgtttttgtttagtaagttgttcgttcgttggaattgagttttttttgggtcgttttttgggtttggtgggagattttaggtcgtcgttttgtagtatttgtacgggggatcgttagtatttgggtgagttagtacgtggattggggattttcgaggagatttgaatttaggtaggattaaggagtgtagggtttatatgaggaaatggtggggaaatgtttcgggaaatggcggttatttgtttaaatgtcgtttggggagcggttcggtttggggagtataagattgttaggaggtttgaaggtgtcgcgggaaaggacgaaatgttggtttatttaaggggtagaaaaaattgagaggatttcggtgcgtattaggtatcgagggaatcggggggttgggtagagttttagtggggagaaagaggagagtagttttgtatgtatcggggtatggtttaggaagttgaggggtgggaagttattaggtatatttattatttttttttattttatttttcgattttggtattacgtttttatttgtaattggtttaggtttagggatttagtaagatttattttggaaagagtagggcgtatttttagtaaggtaagtgattatatttttatagttcgttggttttagttttgtatcgttttatttgttcggcgtggaaaggtatttttgtttttcgaagcgtttttttaggtttattagttgtagttcggtgaatatagtgcggtttcgacgtttttttttggttttggtgtttggttttttagggtttgtcgtttttagtttttcgcggagttgtaattcgagcggtaggtgtggcgtattcgcggcgtcgggtagttcgggttttgtcgttagtaacgtagagtttagttttgaatagtttagcggcgttagtgggaatttgaatatcgtcgtttgttcggtttttagtacggttgcgaagaaagagaatgaggattcgggtgagttacggtcgcgtttttttgttttagggattgtcgtattacgtgtcgcgggggtgttcgcgtttggttagtgttttttagcgtaaaatttttacgttttgtcggtcggcgtcggtggcgtagatggagattttttttaacgttgtcgttttttagatttgggagggagtattttttcgattttgttcgtgttttgttttggagttttttaggttttagttgtttttgagatttcggggtttttgatgaatatgtttgtagttgcgagaaattcggagtgtgttttgtttttcggggaaagtagaaattaaaaagaaaacggtagttggttttaagaagatggcgtttgttttaattaaattagttttgttgcgttagaaaaagaatatgtacggagcgtgtatatttgttttttcgtgcgtggtataatagttatgcggtggttaggagttatttgggtcggagttgggtgtttttcggaaattttaaagtattttgagaatttggaaattattgtttacgttttttatttttagacgtttttttatgtagatgtttttattttttttagttttaaaatgattgtgtgttcgttttaaacgaattagtagtaatagagtagatggagacgaaaggtagtcgaatggtcgagttttagttggatttagaaggagcgcgttggttttgtcgtttttaggttagggagtatcgattaggaggtgggggggtgtagggaaggcgatttgaagggttggggtttcggttatagcgtaggagtttttttttttcgataggtttgttattgaggtgcgagttttagtttggttggagtcggaaagggtagggtaaggcgtaggtaaatgtggggtagaggattcgtagggaaaaggtgggagatgggaggtaggtcgattttaatgagagaagcgagggaggtcgatcggtagacggttggaaagcgagatagggaaagataagacgagggtggagtgcgatggagatagtattattagggtagagtaggtttcgttaaattagaagaaagggtagaagttgaaaaggtttgcgtaggtcgtttaagttttgtagaggtttagtcgatttgaaattagaagggatagttaggtagttgtttatagttaggtttttggttttaaggtaaggtcgaagtaggttcgtattgcggttaaggtcgcgtttttcgttcgttggagttttcggggatttcgggtcggtttgggttcgcgttagtatttagttttcgggagcgtaggttttttttttagaggttcgatttttttgggttgggtagtcgcggttattttcggttatttttttgcggcgaagtttaggcgttcgtggtttgaggtcgtttttatttacgagagttcgtagtttggtagtgcgtttgtattggggatgtttattcggggttttcgggttggaggtcgaagggaagtagtgaaggaaagagcgaatatttttttcgggcggttcgcgggtacgaggtttggtttttgtgaggtttggagtttgtatttttcgtttttcgtttggagggtttcgagagacggttttagaatttgcgtttttagagtagtttttcggggttgtttcgatgtcggaggaggttcggggcgttttcgcggtttagttcgttgtttttcgttaagttcggttcgcgatttcgcggtcgttatacgtatttaggtggttgtggaagggtcgcgtcgttagtagcgtttgtacgtcgaattttagtagttcgttcgtcgcggtagcggcggttgcgggcgcggcgtttttgggttcgggtggtttcgtgaggatttttttaattatgaagttgcgatagcggtgcggtcggtggttcgcgtagttttcgggcgggtcgaagcgcgcggcgttcggttttttcggtcgttgtatcgcggcgtttattgttgcgttcgcggtttggcggcggcggcggcgacggtttggtttcggcgcggggttcgcgcggggttttaggtcggttcgtagttcggggcggcgcgcgggcgtcggtttatgttttttttttcgtcggtcggtcgggcggaggcgtagggcgcgggcggggcgcgcggggttcggtcggtcgaattcgggattgcgttttttttttacgtcgtcgcgttttttgttcggttagtttcgcgttatcgtttcgtttcgtttcgtttcgcgtcgttgtttttaatttttaggttgagtcggagggagggatttagaagggagggaggcggaagggaggttaaaaaggagggggttacgtgaaagaggtcggtcgatcgagatcgagggagattgagcggagcgtacgttttggaaggagagagtcggagagttcgggaggtaagatttttagagacgagagtcggagggattaaacgatataggtgagagaaggggtagaggtagacggcgtgggttaaataagattttagatagtgatgtgagggtattagagacgttatcgagatgtgcgtagagagattaaaagaggcgtgagagttagcgggttgtgacgtgacggagggtatagaggtaggcggggtagaggaagggggcggtaaagaaatgggaatagttagaaaatcggcggtttgatcggtttttaggtagtttcggaaaggtcgggaggaggaggggtaaaggtcgcg

SEQ ID NO: 6505 - DNA, 999 bp, Artificial Sequence
  Description of Artificial Sequence: Synthetic polynucleotide
gcgtaacggtttgtttgcgttttttgcggttatagtcgatatacgttcgtagacgtacgtacggatatttcgttttttattagcgtacgaagacgggacgcgcgtttatagttttagggttcggttttgtattacgagttaacgcgcggtttttagggaggtggcgtagaaggtatggcgtttttgtttacggcgtttcggttttggtagtttttatagagattttcgttgatggtttaggtttaaaaggttttttttttcgagtttgcgtttttttagttttttcgttgggttagggtttattattttttttcgtcggcgagcgtgggtttttttggaggcgggggtggttttgtagaggtagttttaggtgcgcgttggagaggtcggttcgtcgcgcgggagatattttttttaaagtggaagcgttgcgtgggtagtagcgcgggtcgggttttcggattttagtttttgttgttttcgagattttcgtttcgcgtcgtatttttcgagtttagcgttttcgggttgcgttgggcgtagtggttttcggttagggcgtagtcggtttgggcgttagagttttttttagttttcggtttagggcggggaagcgttagttttcgtagtttttgtgaaaggttttttgtgttttttgtttaggtgcgcgttgtggtatttttggttagaagtatttttggcggtttgttgggtttttcgtagtttttggttgagattttgtcgtcggcgttaacgggttgcgttcgcgttttcgttttgttttcgttcgggtttcgggtttcgcgtgtatattattttttggttttttttattaaaattttttgatttttagttcgatgttgtcgtcgcggttttcggaattgttgtttttagacggcgagtcggggttgggagcggtttttacggggacggatttttttcggaggcggaggtggtttttttgacgcgaaaggtaggggcgcgtttcggtttttagcg

SEQ ID NO: 6506 - DNA, 1750 bp, Artificial Sequence
  Description of Artificial Sequence: Synthetic polynucleotide
tcgcggttttagggttcggcgatttttaaggttttcgttttaggcgttgcgggtaaatagggtttgggggtttttttttatcgcgggttgagttttcgttatttgttttttttgtcgcgggtatttaagtttcggaatttgcgagttaggtagcgttttattttcgcggcgtcgtttttgatggttattttgtggatttttcgtagtttttagttttcgatgtggtattttcgattcgcgtatttttggtttatggagtttaggagcgtttggtttaggcgtttttcgaaattgaagagtttttttatggtggcgattttttagacgttaattattcgttattgagtcgtcgcggtttttcgtggtttttttatttcgattaagttttaaattcgcgatttttttttttatttcgttatttatttttaaatttaagatttattattaaattagtaatttatttttaaatttaagatttatttttaatttcgcgatgtagtttagaattcgcgatttagttcggtttattatagtttttagtagcgatattcgtagttttcgattttttagatcgagtgagtttaattaagtcgttattcgcgtgttagtagttgggcgtttcgattttttagatcgcgtgagtttagtaaagcggttaggcgcgcgtttgtagttcggcgttagttcggatttcgggagtcgttttcgagttcgcgtggacggtagagggcggttgtagttcgggcgtaggcgtcgttggtttgcgggtttttttgggttcgcgtaggatatttcggaatcgtaggcgcgtattttttttcgtttgagggttcgtttggtcgtgattttcgttttttttttttttcgaagagagatggggtcgttggtaggggtttttcgtagttatcggggatggggttgagggtcggtttttgtttcggtgtagtcgtcgcgggtagatcgtttggtttggtcgtagttatagcgatatttagtttcggttttgcgaggttgggcgcgttagttagtttgggagttgtttggcgtttgtagttgggcgtttaggtggtggagtatggtttgggcggtttttggatcgcgagtgtttttggtttgagagttcgttagattttgtttttattcggttttttttttgttagagttcgagatttttagttaggggttttttgtaattatcggggatggggttgagggtcggttttcgtttttgtgtagttgttgtaggatagatcgtttggtttggtcgtagttatagggatatttggttttggttttgagatgtggggagtgcgggcgggttcgagagttgtttggaggttgttgtttgtatatagaaggcggttgtagtttgggtgtttaggcgggttggaggtgtatggtttggtcggtttcgggatcgttagcgcgtttagtttgagggtttttaggtcgtgtttttcgtttatttttttatttgagggggattggggtcgttggtatgggtattcggtagttatttcgtgtggggttgagcggcgggttttcggttttgtttttgtgtagtcgtcgttgggtagaatgtttggtttggttgtagttattgggatatttggttttggttttgcgatgttgggagcgcgagcgggttcggaggttgttaggtagttgttgtttgtatatagagggcgattgtagtttgggcgtttaggcggcggagtatggtttgggtggtttttggaatgcgtgcgcg

SEQ ID NO: 6507 - DNA, 391 bp, Artificial Sequence
  Description of Artificial Sequence: Synthetic polynucleotide
gcgtaggtcgtagaattttttcgcgaaggtgtcgtaggaggagtcgtggcgcggtatcgtttcgtcggcgttcgtgttttttcgcgcgcgttttcggggttttcggtttttcgggttcgtatcgtcgttcgcggggttggttgcgtaggcggcgggtttcgttagtagtagtaggagtagcgacgtttagattttcgggtgttgtcggggcggtcgcgttattcgtgcgtatagatttcgtagttaggtcgttcgggtcgtagcgggggcgtcgcgggcgcgggtcgggattgagttttcgtcgaggttattagtacgcgttcgcgtagtcgcggagtttttcgtattttcgtttttttgtttcggtttgcgtattttcgttttagtatcg

SEQ ID NO: 6508 - DNA, 817 bp, Artificial Sequence
  Description of Artificial Sequence: Synthetic polynucleotide
tcgggatagagacgggtaggtagcggtgggtcgaagggttcggggattagggttcgggtcgggaggggcgggcgttttatcgcggtttgttggaaggcgtttttggtgtaggtgtcgttatttcggtaggagatggtagggattttttggaggagtagcgcgtatttgtgttggcgcgcgcggcgggtggagatgtaatcgacgcgcggtattacgtagtttttggacgagaaggttacgatggttacgcgcgtggtcgtgggtattacggggaagtcggatagtagtttgcggacgaatatgagttcgttgcggaagttgatttcgtttacgttggacgaattatttattaggaagataagttttaggcgttcgttgagttttcgtagtagtcgtacgcgtcgtcggaacgtttggtttagtcgttttattttgtttttcgtcgtttcgtcgttaggagcgggcggcgcggggatattttcgggggtttcgggcgcggtttcggggaagaggcggaagttgaaattgcgcgacggggatatttgttgaaaggtcgtttagttcgaaacgagcgttagattttagtaataaaaggttaggcgaggttatatcgcgttggagatagagcggttgtttcggagcgtaggcggcggttcgggcgggaagaggcgttgggcggtcggattcgtagaggggcgtgcgcggagttgggcgcggggtagcggttaagagttttagcgtttttttatttgatattggggatagatataatttagattttttagtagttcgggaatttcggagggaacggcgcgcg

SEQ ID NO: 6509 - DNA, 814 bp, Artificial Sequence
  Description of Artificial Sequence: Synthetic polynucleotide
gcgaagaaagtcgaggcgtcgaggtttttaaagttggtagtttcgggtggcggtgtaggggcgaagggggggcggggggaatcgtcggatatgcggttttggagttgggtgttgtatttggggttgttgagcgtcgcgttgggttgcgggttggtcgagcgttttcgtcgggttcggagagattcgcgggtcggtcgattttcgcgtttcgtcgtcggttcggttatttgcgttattcgggcggttcgcggtcgtcgcgtttcgtcgtcgtcgtcgtcgtcgtcgggcggtgtttgggaagtcgtgcgcgtttttcggcggcggtagtagcgggaggcgaggggcgttatcgaggagtcgagttcgtcgagtcgggcgttttattttagcgggcgaggcgagtagttgcgttttcgggtcgatttcgagttgtttcgggacgcgtttacgttgtaagtgtggttgcgagcggaggggggttagaggttttcggtagtgattataggtaggtgagggcgtttcggcgggcgttgtatcgtttttgcggttttagaggttcgcgggtgtttgggcgcgggtggcgggcgggtcgggggtttgcgggcgtgtttgtgcgagagttgtttcgcgagcggcgtagagatattcgggcgagttgagagttttattttgttttatcggtggaatgggtatattcggaaggcgtagttgttttatttttgggaggaatttggggagtttttttggcggtttcgcggattttcggttagtgagggttggttttcggagtttagggtacgtaattcgtgtttcg

SEQ ID NO: 6510 - DNA, 1429 bp, Artificial Sequence
  Description of Artificial Sequence: Synthetic polynucleotide
gcgcgtataatgaagtagttgtttgtagcgttaattagttggcgattttgaggttattgcgtggttttgttttggtcgtttttaataacgggatagagcgtcgggtatcgcgtattgattaattatttttttttcgcggtcgttcggtttttttttttttttttcgtcgggtttggttttatttttttcgggcggtttgcgtttttttttttcgcggtttcggtttcgtggcgtcggtagtttcgggagtttcgggaagtttgcgcgcggtagtttcgtagtcggtagtcgggagtttcgtagttttcggggagcgtcggggttggtggtttttttgttggaggaggcgtggagggagcgtttttgttttgagttagttacggtggtcggttggaggttgttattttattatgcgtcgggtttgtttgtttgcgaggaagtagatggtggggaggtaggtagcggcgagagtggttagatttgaatttcgtttatttgttattttttataaaaggtaggttcgggggatttaggtattcgttgttattttttgggggagggggaggtcgaggggtcgtcgttttcggcgtttgcgaaggtttcgtatttgtcggtgttcgttttttttattttttgttttttttttggttgtagtttttcgtatcgcgtaaatgttatttacgtgttaggatgtgtgtttatagtttgtttttttgtttgtttagtttcggcggatagggtttagcggttgcgcgacgtttttcgtcgttgggggagattagtaaagttattcgtttttggatttcggggtttgggtttttagatttcgtttcgcggcgggagatgcgtttgagttttttatagacggagcgcgttttagtttgacgtagagggatgaatagataagcgtatcgggcgggaatttcgattgtttgtgtatttggggtcggtttagcgttggacgtgggttgttggttcgagaggtggcgacggaatcgcgtgtttatatgtatgggggagtggaaagtcgtagggtgtgtttttacgttttttgagtagttcgcggtaagagttgttgagtattttatttttcgtttttagattttaaggtagtttttcgagttttttaaacgtattgtatttagttttttcgagagtggagttgtattaaggataaatattttagcgttattataaattttttttgttttttgggcgatttttagatgaattttggtgatttttagattggatttttattttttattttttttgaaagaaagtgttttagatgcgttaataaaatatgtttatgtattcgtgtaggcgttcgtatgtttgcgcgtcggtcgtgtgtaggcgtcgaagtatacgtttgtgtgaatatacgggtacgcgcgtttttgggtttagtggtttttttttcgcg

SEQ ID NO: 6511 - DNA, 7708 bp, Artificial Sequence
  Description of Artificial Sequence: Synthetic polynucleotide
tcgggaagagcgagaagttatacgttgggttgtagattgggttttagcgggtttggagcgtggatatgttggttggttttttttttcgggagttatagttttcgtcggtttcgttatttaggttttgtcgggtatttaggaggtttgtacggtcgtttgtagttcgttgtgtagagttcgggtcgaaggcggagttcgatgggaaacggtcggtcgaaggtttttgtaattttgttataggtttgttttttcgggttttttaggcgggtgtttgaggtcgcggttttaggtcgaggggagatcgtagtgagacgagtatttttttgttgcgtttttttaggatagagggtttaatttttttttttgaagatatcgtaggaagttgttcgtattttaaaaattttaaatttcgcgtttttttttttttttgttttttttttattttcgttttttagtttcgtttattagtttttattatttcgatttttttttgttttttttgtttttttttttttttttgggtttttcgttttttcggagtacgcgttgttagggtttggggcgtcgagcggttaatggtacggcggtaggacgtgatgttaggcgcggttgtagaaaaggcgcggaggtttgcgttggcgcggattgtagagtcggggttgggttaggcgcgcgtttggagagtattgcgcgcggttgggttcgcggtcggcggtttttttttttattttgtttttttttttttttttttttttttattttttttttcgtttttttttttttttttttttttttttttttaattttttcggtggttcgattcggttcgtaggtttcggagaaatttttattttagtcgtcgatttagcgtttaagagggtcgttttgggttgggggcgtattttagggaggggaggggtttaggtagttgggtcgtcgcggatatttagcggttttagggtgaatttcgatcgtagtcgtcgtcgtttcgggtagagtttgcgtttttgttttgcgtttcgggcgttgaagtcgggcgggcgatgttcgcggcgtgaaagcgttcgcggcgggcgtcgatttttgttttagttttttgtttttttcgtttcgtttgtttcgtgtttttgtgattttggttttggcgtcgtcgtttaggcgtttcgtaatgtagttgtttttgcgtttcggcgggaggcgttttgtttcgcgagcgttcggggttcggagttcggtttgggggtttagtcgagttcgggcggggtcggggtcgcggtggcgatgtatcgggttcgttagcgttaggagcgttaggtagttgaggcggggggtaagttttttttcggaggagtcgcgttttcggtttcgtcggtttcgtcgcgatgttgttttatagtttgtcgggtttcgaggtgtacggggttatcgacgagatggatcgtagggttaagagcgaggttttcgttattagtttcgttatcgatcgcggcgatatcgagacggtaggcgcgcggttgtggggtcggggttgagagttgggatggggtcgggttagttagcgtttttgtttttcgaagtttggggagcgtttttcgtgtcgtacgggattgggtgttggggattttcggttagaatgtaaggtcggtggttttcggttcgggggaaattcggttgttgggacgtagaagggaaataaggttgaaatcgaaatttcggttttgggggtagaggagagcgtttttttcgaattggaagcgaagttttattcgcggttcggggcggttttttttttattttgttcggtgtcggggtcgatagtttcgcgtttttttttatttttcggtttcggttgttggcggcgtcgcgagcggcgttagggaagggcgaattagttgggagtattggggttttagtcggtttgggtcgtttttagtttttcggtaatcggggattttttttaatttttagcgtagttttagaggtcgaagttttcggggttaatatttgtcgttgatcgcgtttttagatttttgattggttagatttagttaggttagggttgggagtttaggtttcggtttggttttcgtcgaaggagattttatttggatttttatatttggtttcgcgggtttagttttaaatagttagtttttcgttttaggtttttttgggggttagacgagtagatattgttcgattagcgggtttagaagtgatttttaggaggtcgcggaggtggggagtacgggagaagtttttttgtttcgggagtaggagtagcggcgttagtgttttttcggtttttgagcgttttttcggttagattttttttgttggttagtttggatagggaagtatttgggttgaatttgttttttatttacggattttgagggtgtttttgtattttatttattttattttcggatttaagagggttttagttcgtgtggtagaggagttagaagttggttgatttgttttggttttaatttttggtttaaggatttagggattattggagttggggtttaggaatttcgttgtttttttaaagaggattttgtgtggagggtgatttaatggttattttatttttcgggtggtttatttaagaagtagtttagggaaagtttttggagggtttgattggagtagttgttttggtttttaaatatagttcgagtattttgggggaaaggatagggaggattggaaggaagagaggtaagtattagagttatttaggttaggagttcggtttgggttcgtggttggcgagggttgcgtaggtaggtttgggttttgaatcgtttagaaatggaaatgggttttttggggtggggggaagcgcgtcgtatgttttggtagtttttttcgcgtttagggtagttaaggttatagagggagttgtgggtgtcggtttttcggcggcggaggggtcgttggttgacgtaggcgttgttgtttttcgttttttttttttcgtagattatgtcgtttattagtagtgatcgcgtcgcgttgtgcgtcggttgcgggggtaagatttcggatcgttattatttgttggcggtggataagtagtggtatatgcgttgttttaagtgttgcgagtgtaagtttaatttggagtcggagtttatttgttttagtaaggacggtagtatttattgtaaggaagattattataggtagtttttttatttaattgttttttaggatttttttttttaattttaggtatagttttatagtttggttttttttttttcgtttagttttaggagagggtttattatttaggattttttcgttttttttttaagttttttaagttattataagttgggtgataattttttaaagtagtaatttggggagtttttggaaaggtttacgaagtaggagaattagaaaaaaagtagaagttgtttttttgttcggagtttagattataaaaaagtttgagttgggatttttgtttttttttttttttgaagttttttgagttaattcgaggttatagaaataggtatttttaaatttaggtagtttaagttggagtgaaatatagttggaaagagagttgtgggagtgggtgtatttttaggttttttgagaaaatgggaatgaaaggtggttaagattaaagaattagaattattagtagattttaagttttttgtttttttttttttttagttttaggattagggtttatgtatattttttttgtttttgtttttacgtttgtgtttttttttttttttttgtttttgtgttttttttaaattataaaagttagtaggatttttaggcgttggtttggagggaggagtaaaggttgaggagggggtaagtggtaagtgtttttttttatttttaggtaaaggtttttttagggtttgcggagattttgggtgaagtagaagtttttgtaggtataagtgtgttaagggaaattattttaggataggattaggtttgggttaaaatttagtttttttttttttttattttttaaataaaggtcgggttgttcgttttgaggaggggattgtttttcgtagtagtagcggtatttggaggaggaaaaggggggtatttaatcgtgtgtttttatagtttttttttttatggtttttataggcgtttttttgtgtagcgttgcgttcgttgttatttgggtatttcggtttcggagatggtgatgcgcgttcgggatttggtttattattttaattgttttacgtgtattacgtgtaataagatgttgattacgggcgattatttcggtatgaaggatagtttggtttattgtcgtttgtatttcgaggcgttgttgtagggcgagtatttcgtatattttaattatgtcgacgtggtagcggcggtcgttgtagtcgcggcggttaagagcgcggggttgggcgtagtaggggttaattttttgggttttttttattataatggcgtgggtattgtgtagaaggggcggtcgaggaaacgtaagagttcgggtttcggtgcggatttggcggtttataacgttggtgagtgcgcggcgtacgaagcgtttttatagggttgggggaaagtgtgcggtttcgacggtcgggagttggattgaatttttgtgtgttgggtaaatagcgagttttaagtatcggacggtttcgtagaagggatattagttttttgggtttttagattgtgcgttttcggttggagcgggaggagagggtgtagtggttttttgttgtttcgggtgtagggttttgtttttgataaattgtttttttggagatggttttttggtttgggtttttgttttattttgttaggtaggaagtggtagggatggagaaagtaaggcggcgttgacgttaaataggttttgggttggcgcggttgagggtcgggaattggggtagcgaaggaacgaggtagggcggcgagggttttaagagaaagggttggttgtggttcggggcgtcgagttcggtttggagtgcggtttgatttcgtgaaatgttttaagggcggtaggtttggggaattcgggtttggggaatttaggaaagtaaaggttgcggttttttttgttcggttcgatttttttttaaagataggttttagttttttcggattttttttttcgagttttttggcgtttgttggggtgagggtcgtgattttcggaagcgagtttttcgggcggggacgagatcggagtaggtttggtttcgcgttggggtggggtggggtggggtgaggtggggggtttggttcggattttcggtatttttgaattttaggttattttcggagaagttttgttttttttcgcgtttttttttgtttaggatagttgtagaggttttgagtttcggtaaatgagtcgttaatatttgttcgaagtttgtaaggttcggaaaggtttatgatttttcgggttttcgaattagagtttatgtgtaattattttttttttttcgtttgtaatagaattagatttggagattttgtgttttttttttttttttttttagtttaatgtataagtagaaaaaagtaaaaataaaaataaatttaagattgtgtagagggtgttacggcgggaagaagttagttatttttattttaaagaatttgagttgaatagagagggaaatgaggggcgggtgttcgttttaacgaaatcgtttggaggattatggggcgtgtgtttttgtgtgcggaattgggaggaaaacgtagtttttagtttggtaaatggtgaagtagcggtaggtcggtcggtggcgcggatttaagatttgttgaaggtattattatagatgtagttttttggaatttttatttttttttttttattattttttaaaaaaagataaaatcgagtttagatcggtttttttaatattaagtcgtttttatttattaagtgggttaatttttattcggaagtatttcgcggggttcggttttagggtatttggtggttggggagttgtattgtttttttgggtacggaggttcggcgtcggttttaggattgtgtaaaaagagagtagaaggtatagagatttatttttgttttttgttgtttagtcgtcgtttgttttagcgaggtgggttggaggttgaattttaagttttgtttaatttttataagagatattttttatttagttattttattttttttttggtttttttttttttttttttttttttcgtttttttcgttttttttttttatttttgtttttgtgtgtgtcgtgtttgttttcgtgttttttttttcgattttggtcggggtttttagttttgagagaaacggcgttcggtgcgtcggcggtggttatgcggttggttttttcggggttttcgggattaggttggggaaagagggtattttttcggtttttcggggtttagtttagtttttttagatttggcgttcgttttttttttttttttcgtattggtaggagagaaatggtcgtagtgtgggtcgcggggtagttaggattggaaagcggggattttggagggtgcgatcgcggacggggtgtgcgggcgcgggtcgtgtgcgtgtgcgtgtagggtttcgattacggggatacgagtttgtttgtggtagtgttttatattttgtggtttagttacgacgattttttgtaaagttttttgttttggggatagttttttcgaggcgcggcggtattttattgaagggcggcgagttgggggtcgagtggggagggggcgtcgtcggggcgtcgggcgttgggtttatagtagagtcgcgggtcgcggggtcggaaagttttttcggggcggggtcgtagcggttttttttcgtagtttttcgggttcgggtttcggtggaacggaaatttttttttatttcgggaggggttgttagcgggttgggggtgcgaaaacggcggtaggagcgggcgaggggttcgggtcgcgtattttgcgtttgggtttgcgcgtcgcggtcgcgggagtttcgcgcggatcggtcggacgttcggttttttttagttttagttttttgtgtgtgtgtgtttggcggcgtaattattgatttgattttaatttattatttagataattgaatttataatttcgtttttagtaaaatgaggcgaagttagatttgattataggtttagttttagcgataagagttcgaaattcgatgggttaataatagattacgagtaaattatttatgattttacgagttttttagttttattgaatcggtttaattgagaggaaaaaaaaaaaaaaggagagagaaagttcgggtttttttttttttttcggtttttcgttttttttcggattcgattttggggaatttcgattcgttttcgggtattgggggcgggagtgagggggttcggggcgtcggttaaatttgggttttacggttgtttttttcgtcgtcgttttttgtttttgtttttggtcggtttcggtttcgttatttagggtcggtttttttttttttttttttattttttttttttttttttttttttattttttcgttaataacggtttcggaaaaggtttttttcgtagggatcgggtttttcggagtttcgggatttagttcggttatcggattttcgttataagttgcgtttgttttcgggattcgttttttttttcg

SEQ ID NO: 6512 - DNA, 3969 bp, Artificial Sequence
  Description of Artificial Sequence: Synthetic polynucleotide
tcgggagtgtgggtgtttcgggggcgtgggtgttttaggagtgtgggtgtttcgggggcgtgggtgtttcgggagtgtgggtgtttcgggggcgtgggtgtttcgggagtgtgggtgtttcggaggcgagggtgtttcgggagtgtgggtgtttcgggggagtgggtgtttcgggagtgtgggtgtttcggaggcgagggtgtttcgggagtgtgggtgtttcgggggcgtgggtgtttcgggagtgtgggtgtttcgggggagtgggtgtttcgggagtgtgggtgtttcggaggcgagggtgtttcgggagtgtgggtgtttcgggggagtgggtgtttcgggagtgtgggtgtttcggaggcgagggtgtttcgggagtgtgggtgtttcgggggcgtgggtgtttcgggagcgtgggtgtttcgggggcgtgggtgtttcgggagtgtgggtgtttcgggggcgtgggtgtttcgggagtgtgggtgtttcgggggcgtgggtgtttcgggagtgtgggtgtttcgggagtgtgggtgtttcggaggcgagggtgtttcgggagtgtgcgtgtttcgggggcgtgggtgtttcgggggcgtgggtgtttcgggggcgtgggtgtttcggaggcgagggtattttagaagtgtgagtgttttaggggcgtgggtgtttcgggggtgtgggtgtttcgggggcgtgggtgtttcgggagtgtgggtgtttcggaggtgagggtgtttcgggagtgtgggtgtttcggaggcgagggtgtttcgggagtgtgggtgtttcgggggcgtgggtgtttcgggagtgtgggtgtttcggaggtgagggtgtttcgggagtgtgggtgtttcggaggcgagggtgtttcgggagtgtgggtgttttaggggcgtgggtgtttcgggagtgtgggtgtttcggaggcgagggtgtttcgggagtgtgggtgtttcggaggcgagggtgtttcgggagtgtgggtgtttcgggggcgtgggtgtttcgggggttgtgggtgtttcgggagtgtgggtgtttcggaggcgagggtgtttcgggagtgtgggtgtttcggaggcgagggtgtttcgggagtgtgggtgtttcgggggtgtgggtgtttcgggggtgtgggtgtttcgggagtgtgggtgtttcgggggagtgggtgtttcgggagtgtgggtgtttcggaggcgagggtgttttaggagcgtgggtgtttcggaggcgagggtgtttcgggagcgtgggtgtttcgggggcgtgggtgtttcgggagtgtgggtgtttcgggggagtgggtgtttcgggagtgtgggtgtttcggaggcgagggtgttttaggagtgtgggtgtttcgggggcgtgggtgtttcgggagtgtgggtgttttagaggcgagggtattttagaagtgtgagtgtttcgggggtgtgggtgtttcgggggtcgtgggtgtttcgggagtgtgggtgttttagaggcgagggtgtttcgggagtgtgggtgttttaggggtgtgggtgtttcgggggcgtgggtgtttcgggagtgtgggtgtttcgggggagtgggtgtttcgggagtgtgggtgtttcggaggcgagggtgtttcgggagtgtgggtgtttcggaggcgagggtgtttcgggagcgtgggtgtttcgggggcgtgggtgtttcgggagcgtgggtgttttaggggtgtgggtgtttcgggggcgtgggtgtttcgggagtgtgggtgtttcgggggagtggatgtttcgggagtgtgggtgtttcggaggcgagggtgtttcgggagtgtgggtgtttcggaggcgagggtgtttcgggagtgtgggtgtttcgggggcgtgggtgtttcgggagtgtgggtgtttcgggggcgtgggtattttagaagtgtgagtgttttaggggcgtgggtgttcggggggcgtgggtgtttcgggggtgtgggtgtttcgggggtcgtgggtgtttcgggagcgtgggtgtcggggattgtagggatatgggtttttttttttatttttgtcgtttagggtattttttgtgaggattcggagttcgtgagtttttatttttttgagttcgattttttggtgttttcgtttgtatttttagtttttttttaaattagattagttttttaggggcgtcgacgtgtgaaattgattttaaagaaaataggtagtggtttttttttcggttttacgtggtttagtagcgtttatttttcgttttttttttcgcgtttagtaattaatttaggtcgtttttgtagaattcgggtttttgtttatcggtttatagcgtttatttgaggtttcgtttttttagtaaaggtcgttttttcggaacgcgttttttgcggtttttttagagtttttttcgcgcgtttttttagtttcgttcgttttttttcggggtttttttttttcgtttgtttttaggttcgttttttttcgcgggttgaggtaggttcgggtagtacggtcgtttcggggcgggggttattttttattatcgcgtggtgtttatagtttacggcgttttcgggtgacggttttttcggttgtagggcgttttgaagagcggtttgttcggagttgagcgtacggggttgtttcgttttgggcgtttttggtttttattagtttcgtttttttatgggtaaaacggcggttttgtttgtttataagtaatcgtcggggttacggaggggttaggagttgcggcggggggttgtgtttttaggatcggttttaggaggattcgcgcgaggtttggagtttttaggggtcgcgggggatagaggggttttaagcggaggcggggaaggcggtagaagtttaggatcgttaagagttggcgaggaagttcggggttcgttgtcgggggagtcgggtaggggtcgcgtttcggattaggacggaggtttggggaaggcggatttggtcgtcggagacgcggtgcgggtggagacgagggatttggattttcgcgggcggttgtacggatttttacgcgcggtttacgtgggttttagggggttgttcggtattcggggtcgcgtcgtttttttttcgtcggtatcgattcgtagttttacgtttacgcggcggcgttcgtagtttttttcggttcggttttcgcgcgtgttttcgagcgcgttttcgggattagttttcggaagtagagaggttaggtcgggaaggatgggcgacgggggtggttgattcgggagtacggtagggaggatatttagttaggttcgcgagtagcgtcgttttttttttttaggacgggcgggaatttgcgatgttttcgtcgcgtgggtcgtggggcggttttcgaggtattgggcggggtacgcggtgggcgttttacggaattcgtattttttagttttcgtaatttaggaggaagtttacggcgttttgtatcggcgtcggcgcgttaacgcgtttttggaggagttgcggtcgggttttttggagagggagtgtaaggaggagtagtgttttttcgaggaggttcgggagatttttaaggacgcggagaggacggtgagtttagtttcggggcgtttcgcgtcgcggatattgtaggcggcggtgaattaggtcgcgtggggtcgtttgcgtttttttggttgcggttgtgggcggcgaatacgtagcggcgttcgcgcggcgttttttgcgggggtcgtttttcgttcggggtgatttcgtttttttgggcgatgttttttatttttaggtacgcgtttttttcgtgcggtcgtatcgcgtatgtcggtttttatattagaaaatacgatttgtaaagtatatttagggtgttttttttaattttttaagggagtttttttagttttcgaagggtttagggtagtttgcgtatcgtagacgcgcgcggttcgtagaagggacg

SEQ ID NO: 6513 - DNA, 2490 bp, Artificial Sequence
  Description of Artificial Sequence: Synthetic polynucleotide
gcgtttttttttcgttcgaggtttatttagcgttagcgttcggtttttttgtagcgattgggttttaatgtcgtacgaggggttttcgcgaaggttaatggtattatttttttagttttttttttatttttattttttatttttttaggttgtggggggttaggggtcgaggttcgcgcggcgcgtattttttaggcgtatttttatcgttaggtatttttggaagcggtagaagggatagcgtttgcgttgcgttttgtcgattttgtagttttggttttcggtgtacgtgtagtgtttgttgttttgtatcgtgcgtttgaagaagttttgcgggagttgagagttagcgaggtttcgtagcgttcgtttgtcgtatttttgtcgcgcgttcgtcgtttattttgtagtttttatacgtgagtagttcgtagtggtagtcggatattttgttttcgtatacggggtatagttcgtttaggttttcgtcgtacgaatagtttatgttcgcggcgttcgtttgcggagggatagcgggttagggagggtcggcggagatcggtagtttggggttttcgcggtcgtcgttttagtcgttgtcgtcggttcgtcgcgtaattttttttttgtgtttaggcgttgtcgtcggtatttatcgagcgtttcgcgtagcgtttcggggtgggttcggtgtagttttcgcgttcggtttttttttgttaggttttacgttttcgtttcgttcggggggtttttttcgcgcggatttcgtcgcgttcgatttggggttttcgggttcgatgcgtttcgattgggattcgtttgtttgagaataaaatttcgattttgagaaaaagagatgggtttagtcgcggggaagacgttaggggatttaggagcgttggggcgttcggttcgggtgttttgggaattcgatagagacgaaggaggtagagatagagttcgggggagttagagatgggaagaaattttggcgagagataacgatcgacgttatcgggcgtagatacgaggttagttcgagagtgttagagatatagatattgagacgtttagttagagagaattcggcggggacgagatatagggagggatggagagagatagggagatagagagagagagagagagagagagagacgagagagagagagagagagagaaacgaggggtgggggattggattagagattcggagagatagcggaggttcgaagagaaaatttaagagagattgacgtagagttagagatataacgatagacgatagatagagacgtcgagacgagaggagtttcggagagacgaggtcggggagttatagaaatacggagagaaaatttggaggcggaagcgtttagttcgagggtcggggataggggacgcgcggaaatttgtcgggtaggagtttaagcgttaaggcgaggtttcgtagggtcggatttagacgggggttcgggtcgtaggaggcggaaaacgacggcgtcgggatcgagagttcgaaaacgtagagtcgtcgggatttttttttcgggggagataaagtcgtagtagcgacggtaacgggaggcgtagttcgagtcgtcgttgttatcgggacgtcgggcggggagatttcgggcgggggtcggcgggtttcgggaagtcgagttcgaggcgagggagcgatttcgggcggagaggcgaagttcggaggagggaagcgcgaagagttagggttcgggacgcgagagggggcgcgacggcggttgcggtcggttcggcgtttatttggtcgtttttgcgagtagcgtttcgcgtttcgttcgcgcggagttcgtatttttcggtcgcgtcgtcgtcgtcggcgaggagtcgtattcgggcgtagcgtcgttcgttcgcgatgacggtcgttcgggtcggggacggggaggcgggggcgcggggttggcggcgcgggggtttcggtttttttttttcgttttttcgttttttattttgtttttttgttttttttcgtatcgtcgtcggggtcgtttcgaggcgtatttgggattcgggttttttagtcgttatttcgttttgcgttaattcgtcgcgttggggtcgggggtcggtttttttatatcggcgcgtgcggtattcgggggcggaggttcggtcgtgttttttttttaagttcggttcgcgtcggtatttttttcgtagtttagttcgagttttcgtttttattttttaggttttttagtcgtagttcggtttttcggatttcgagcgcggttagagagttgcggagttcgagtgtttcgcgatttgggtaggtatagggtagtgggggttttgggttattcgtttgtagtgggaggaggtagtttttgtttgtgaatttagttgggtcgtggcgaatgttacgcgggtggttggtcgtattatagcgtggaagtgggtaagggcgagtggcgatcgtggtcgaggttcggatttacg

SEQ ID NO: 6514 - DNA, 5370 bp, Artificial Sequence
  Description of Artificial Sequence: Synthetic polynucleotide
tcgtgttcgagggaggcgggtagcgtagaggagagggtgtaaggttttaagaagaggagcggggggattagggcggggtttaatggagttggggcgttcgtagattggaaggagtcgggattttcgttttagagtttttttttttattttcgttttttttagtgatttcgagttttcgatttagttttttttttaggtagagagaattcgaggttgtttttgtcgttgaaatttgagcgggagagtatttcgaagtcgtttgcgtggagcgagtagttttcgcgttatgggttagaggcgttcgggagaatttgcgggttacggattatattcgtaggggtttggcggagtaaggtgtcgttcgtcgtttgcgggtaggagtcggttttgggtttcggtttttgttgtgtcgtttagtcggtcgttttttcgttttttcggtaagggaagcggtggagaggcgcgggagtttcgattgtgttggagagatttgggatttttgcgcgtttgcgtgcgaaggattcgagatcggttaatttagttgggagtacgggatacgaggagtgaggataaagggtaaggaacggggtttatagggagggtgtgtgtgtgtgtgtgtgtgtgtgtgtgtgtgtgtgtgtgtgtgtgtgtgtgtgtgtgtgtagggggaatgaatggatagcggggaaggtatgtagaggggtttaaggggtgtggatttagtagttttattttagattagagaaggtagttaggttttggcgtttatcgagttagcgtttttatttgggcgcgggtcgtatggcggtagattattttatattcgttttggtggcgtgggatatgattggtaggagcgcggaagaggcgttgagaatgtatgcgtattcggatagattagacgcggtacggagggggtattttttataagtttttttgttttgagattaggttttcgagtggttcggggaatgcgtttttgggtatagttagcggttttagatcggtattggacgttaattcgagttagagaagtttgggagattggatcgtaggggtttttatttagttaaggagggggaaaggagagttgtagggtaggagaggttaggtatagggaaggtggggaggggatggagttttgcgttaggagttgggggtgtagggtttgtgacgagagagtattattatgtgtattttgaaggagagggagagggtttgggtttggaacgaggattttcgtttgtaggtagtcgtttagtttcggttgtagggatggatcgcgattagtagagggtagaaagtgtttggttcgttcgtcggtttcgagtcgcgtttcgcgtttcgggattttggttttgtgcgtcgaagttttgttcgttcggtttttttttgtagtagtcgcgttttcgttttagatgttcggagaaggcggtttaggtttagtttaatttcgcgggtttaggtttggggtttttaggttaagtaaagaggggatcgagatgtgggagagaaattttatattgattgtttatttttttcgatttagttatataaaggcgtttagaaatatacgaaggtataaagttttttattatatataaatatatatatatatatatatgttaggagatacgcgagtatatagaagtatttagaatttcggagataagtatagatacgtaaagttgatagagatatttatatagaaaaggatcgtagatataatatagaggttgagatacgtataaagatttaggttttcgtatgaaatgatgcggatatatattttagatataggtacgaaggatttatatatttatatatatacgggtgtaggggatttagatatagatttatagatttatttttgggagtttggaaggttgtagggatatatatatcgtgtgtgtagagttaaggagtatacggaggtaagagtcgtagaggcgggggttcgatacgtatagatatatatagatatttatcgatatatacgtaggtagggtagggcgggagtttttaattttttataaagtcgggttttttcgcggggtttcgcggcgtagggggttatttttgattaagtttttcgtaggttttaaattcgattcgttttttcgtttttagcgaggttaggggattcgttttttatgtttttcgttttcgttcggtttcgcgtcgttgtttcgtttcgggaggggtcggggtcgtttcgtagcggatcgcggggggttagttcgtcgttatttcgggtcgtaatcgtttttttgtttttcggtgagtcgcgcgtcggtggggattacgggtcgtagatagtcggttcgacgttgtggtttttcgtatcggacgcgggtgttaggttcggttggcgcggaagtcggtagttttatttcgttagttttcgcgtttcgttgtcgaggtttattttgtttaggttggttagagtattgtttttgattcgcgcgttttagcgatttttggtcgggtattcgattcgttaaaggatttcgattttggtagttaatttaatttttttagagtcgttattttggggttattatttttttttagcgttttttattgtaaattttaggaggttcgggttttgtttattgtttttgtttttgttcggggattttttttttagttttagttgttttttaaattttcggtcgtttgaatttaggtttgattttttttgtcgttttagtgttttttattttcgatttcggggttttaattttttatcggtttagtttttcgtttaatttttgttaggttcggagtttttttagattttttatttatattttaggtttatttttcgtttttgggtttgggttttttttgtacgagtttagggttagtcgttttcgttttttgttcgttttcgtttttcgtttttgggagtcggtttttttcgcggattaagcggtttcgagtaggcgtcgtcgttcgggggatttcgatttagttttcgcgatttatttcggtcgatagtcgggggtttttaagcggttattttcggtcggcgtcgttttttggcggagtcgtcgcgttttttgtcgttcgcgtagtttggtttcgttcggggttatttttcgtagcgttggagttttataaaatattaataataaagaaggtagaggagaaaaaagaaagttttcgttttttaatttttaaattaattttttaagggggtggagtagagggatttgtttcgaagacgattaaaatttttgcgaggggttcgcggggcggtcgggtcggggagtcggggtttgagttcggggttaggcgcggcgcggggcgcgggttaggggcgcggagtttcggggcgcgcgggggggcgggacggtattatttgacgtggagtcggcggcgtatttcggcgtagggatatcggtcgcggggtttaaatgttaggaagtttcgggaggtgaggcggttcgtattttttcgtcgttagttttagttttaaattcggcggtttagcgggcgtattatggtattggagtagcgcggggagcgcgttcggagtttcgcggttcgttgcgtttcgttcgggatttcgttgcgtcgcgcgtttttttcgcggttcgcggggtcgtttttgtatttttattttttttttcgtttgtcgtcgtcgttatcgttatcgtcgtcgtcgtttttttttcgcggtttcgtttgtagtagtcgtcgtcgtcgggtttcgggattgataagtaggtgatagaggagtcggcgcgcgtggttgtaagtgttcgggagagcgcggcgcgggttgtagtcgtttcggttcgttcgtacgacgtcggggttcggggttagcgcgtcgtcgttttacgatcgtcgggggtcggcgtaatttttgttttgcgggggtcgcgttttttcggttttagggtcgcggtggcggagagcgggtggacgggtcggcgggcgagtagttcggtcggcggggttcgtagcgcgtttcgcgttttatggatatagtaataggtttcgagtcgttggagaggtgtttttttcgcgggtagacggattgcgttaagatgttggacggtattaagatggaggagtacgttttgcgtttcgggttcgttattttgggggtgttgttgggtgagtgcggggtcggaacgttcgagtggtttcgggcgtgggatggggcgtcgttcggttgtggatacgggcgttggggttaacggataaaggaaatgggtttgtaggatatggggaggaggtagagataggatttttggagtgatcgttagagggtcgtaagtacgttttcggtaggcgttttgaggggataggatagttttagtcgttatttattattttttttaggtttaggttttagagttgttatttcgatgtggtaggtggcgggtggtaggggtgatggaggatttagtaattattttggcgagtttgggagaggcgtaaggttatttggggtgggggagattttaagagaaaaacgtttttttggttatttaaattatagattttggggagatcggggatagaagattacgaacgttatcgtggggcgtgttagttagcgagcgttttagttttatttcgtttgttttggttttagtcggttattttgcgtcgtgttcgttgttatttgttttaatacggagcgcggatttttcggagaaggggagagtatagcgtcgagttaaggttcgaggttcgcggtttttttacgtcggagttcgaggattgggacggattagtcggggtcgttcggtttttggcgcggcggttcggggagcgtaggcggtaggcggtgatttcgggcggttcgagttttcggggtcgagggttgtgggttcggtgcgatcgggacgtcggggttgggtcgggcggcgttgacggtcgggttttcgttttgtgcgttataggtttcgattgttcgtatttcgtcgtttgcgagggttgttagcggtttattttcgatcgttttttgatgcgagttaacgagtcgttttggtacgaggagtgtttgtagtgcgcggcgtgttagtaagtttttattattagttgttattttcgggatcggaaattgtattgtaaataagattattaatagtaagcgtttttcgtttttttttttcgttatcgttcggtattcgagttcggttagttttttgtcgggttcggttcgcgttcgttttgtcgtcggttttgtgcgcggttgggtcgggtagttttaagggtttcgagagttgcgcgttttggggttggggcggattagtttagtttagcgggtattgatggggttttgggagttttcggacggtttttagttgttattcgttgtttcggaattttgcgttgggtcggtcg

SEQ ID NO: 6515 - DNA, 3120 bp, Artificial Sequence
  Description of Artificial Sequence: Synthetic polynucleotide
gcgggagagtttttttcgacgttcggatacgcggatggggcggtttttagcggtttttattcgcgtatttttttaggtttatttttcggcggttcgtgtagtatgttttttattgggagtgggatgatattatgtataggtttttgggtttcgtagtcgagtcgcgggtattagcggcggttgatgaatttcggtgttattaggggtttagttcggatttgggaatcgcgcgttttaatacgcgtatacggttttgttttttttaaagcgtagtttttttatttagtagttgatttatggaggaattcgattttgggacgcgttaggttgaagttcggagtttagggttttgtagtagttttcgggttttttagcgtttcggggatttttggtggttcgggggtttttttgggttggggtcggggtgtttcgttaggtggggttttacgcggtttagaaagagttagtgattttttttggagttattgtaggttttcgttggagggagtaagattggcggggagagttggtatttttattttttgttgagtatagttttcgtttttttttaagtttttttgtcgattttttcgggttggttaaaagtagtaagttcgggaggtttgtttattgagagaatagaaaattaggggttgcgggggagaatttaagatttttttttcgtttgagaaacgtgcgaagttttttagtttttggaggtaattaggcggttcgaaagtcgagttttcggcgcggatgttagggtcgattttagtttttttttttttgcgttttagttcgagggcggcgagtggtaggtttttttttattttgtttttttttttttggatttggtttgtaggggggaaatgtggttgtattaatttataaatatttatttttaatagatttgtatttgtggagatttcgaataaagatagtttagggggattataaaaattttaaatttcgtttttttttcggatttggtgttttaaatgttaattataggcgagttatatttaatagtaacggggaaaggcgagtaggtttcggggagggaggtggggggagagttcggttattaaatgtaattttttattatgaaaaggatttcgtcggttttattttttaataagattatgttacgaatataagtatttaggatggtgttgagtgatagggttttgtcgtttaattagaggttgtgtcgtttaaatcgcggggttttttgttttacggagtgaacgacggaaatttgttattttaatttttttatttatgttaagtatagaaaagaagtcgagtattttataatcgtgttttttttatttttttcgaggacggcgggaagagggggtttcggttttgtagttttttgacgtttttcgttttcgagcgcgtttgggttttaggagtcggagcgttgtcgtgggggcgggggaaggggtggttttgcgggtgttttaattggtagcgtttggaaaatggggatagtgattttacgattagaggatgaatggggggagggttagtgggatgtgtttgttttttttgatcgagagtacgggttttgttttgttttttttttttaggaaaggtggtatttcgggtgtatatttattatttttattaaagcgggattgattagaagagagaggtcgaatggagatgttaggttggggttttcggcggggtagatttcgttggatttttgggattaatgtcgtagcgttcgtatttttgtaggtttttagggttggttattttcggttgtatgttcggtttttttttttcgagggtgaatttttttgttttatttttacggaaattttttttttcgttaggttcgtggcgtttttttcgttattttcgtcgtcgtcgtcgttattttcgttttatcgtttgtagggtttttttgcggcgttttggtcgtagagatttagttttgtttgtcgattggtttttcgacgtcgtcgtcgtgtttgagtttcgttgtttgttcggataagtagaatttcggtaggcgtagcgggcgtcgaggtttgggttttagtcgtggcgttcgtttcggcgtagtggggagtcgcgggcgtcggagaagcggtcgcgttgtttcgggttattgtatcggttgaaaaaattaaaagtaaaattaatatttagaaacgaagtttgcgtgttttcgggggtttcgttttgttttttttatggatatgggggtggggagttcgtggggttttagtttaaaggttttagttagtggaatcggagggggatttcggaggaatttgtttttgatgtttcggttttttggttttttattagaattcgtagaggattcgttttggagttttcgtgcgttttggtagaggtcggggacgttagagtgtacgtagttttttgcgcgtcgagtttaggtttcgggcgtagggaggatcgggttgagagtagggtgttatttcgtaaaagcgataggtaaggattgttttatggggagggagaaggagtaggaagtgatgtttttatttttgatagtatagggatcgggagtttcgatggaggaaatttttttcgggtaggacgagtagagggataggatatggtcggggattatgggattcgttgttattaagtatgggacgggtaggcgagagcggggaaggggatcgatggagttagaagttttgagtttatttttcgttcgtttttttttggagttttttttgtaatttcggtttagtcggtaatcggtttttttttttaggttaggggtgggggagagattttttttttcgaaatatttgatattaattttgtttttttggtaagaaaaataagttttgtttggaaaggggtgggtggggggcgtcgagcgagcgagggaaggagtaaggaggcggcggcggagtaaattttgcggattaggttttagcgttttcgttttatttttagtttcgcggcggtgatttgtgtgcgggggtttgtgattttgtaagtattaaacggttcgcgggaatcggtcgagtttagagggatagtgggtcgaagggcggtttaagataacgtagatggtttttattagttcggtcgggttcgtagcgttcgtcggttcgttcg

SEQ ID NO: 6516 - DNA, 3120 bp, Artificial Sequence; identical to SEQ ID NO: 6515
  Description of Artificial Sequence: Synthetic polynucleotide

SEQ ID NO: 6517 - DNA, 7861 bp, Artificial Sequence
  Description of Artificial Sequence: Synthetic polynucleotide
tcgttttttcggaagtcgtgtttttttttttttgttttttttattttcgagtttttgtatttttgcgttttcgattcggttttttatttgttttttttatttcggtatcgttttgttttagtttttttcgatttttgtttcgttttttttgtttttagaagtttgcgtttttgttttttttatcgttcggttttttggtgttttcggcgtttttttcgtcgttttcgtcgttttgattagtttgggttgtggcgttggtatcgttggtttggggatcggggtgtgggcgatggaagggggttcgagaggcgtaggggaggggttttttttttttcgtttttgggcgtttggggagattcgcgtgttagttatttgtcggtcggggcgtcgatttcgcgtttacgtattttacgtgggcgtttcggggcgcgtttttgtttttttcgagttttgaaagttaattatattgggaggggataggggtggggtgggagagggggtcgttgtttttatttattgagtcgaggtcgttatttcgtcggtagtttcgcgtaggtttggtttcgagttacgtttgttgaaatcgtttttttcggtttcgtttttattcgttttggtagttagtcgcgtttttgtacgcgtcggcgggggcgttttggaattttgaatcgttttacggggaacgggggtggggggaggggagcggcgcgggttttacgcgaggaaggaattttttgggttattgcgaaagattgaggtttagaaagttagagagagacgtgcgaggaggaagcggagagggtgtgcgaagttggagagggagtcggagcgttagcgaaagaggggagcgttggggaaggaggaagagaaggagagggggagaagagagacgcggatgttgggcgcgcgacggtagcgggcggaggaggggagcggtcgggaatttgcgcgtaggggaagttaggacggagcgtagtatcggtaggggagggttgtcgaggggttgtgtcgaggagttcgggtgggggcggttggatcgcgggtcgcgggatttatagatagtgcgaggcggcgcgggggtttttttttttatgcggggttggggcgtaggggttgggcggggcgggtgggcgtttgagcgcggcgcgggcgtatttttcgttttttttttttcgggtttatttcggtcgatcgatatttgcgcgggatttgttttcgtcgttaatatttttttaatgagttcgttaggtttaaagcgagcgcgatttgttttttagggtggattttttttcggtagatgtttcgggaggaggaggcgcgcggagttttcgggaggggggataaattttttttttcgaggggcgagaataggagatttttttttaaagtttaaaagaaagacgggtttttattcggtttttaaaaatgtatttttcggcggataatgggtttttttttgcgtttttgagggtcggcggggcgggtagggcggggattcgtgcgttttggtttcgtttgatcgattcgtatttttttttttcgtatttaggttcgggttttagagcgagggcgtaggagtcgcgaagtcggtcgttttttcgagcgtttttttgaagcgtattgtcgggatttggttttttcggagttaagtttcggcgtatcggcgagaacgaaagcgtcgtgcggggttttgggttgttttatacgttttcgtttttataggtgttttagtcgggtcgaagggacgcgcgttggtgttttaaggggaggacgaacggattttcgggtttgggtcgcggttttttttttttcggcgtttcgttttgagcggggtaataattagaaattagttaatttcgggcggttgtcgggttttgagattgttttgttcgtttcggtttagttattttttcgggtcgtttttgttttttttttttattttttttttaatgttttttcgtggggtcgtcggtttgtcgcggcggttttttttttattttcgtgggtttaggggaagagggtattcgggcggcgaggatgattttcgaagagtcgcggtaaattgattcgtttcgttcggagtcggggtcgcgtgaatgggggttcgggcggcggcggtagcggagaagaggataaagatgttttttttgaaagggggagggggcgcggagcgggaagcggggttatttatttttggttcggtttttcgggaagtcgcgtcgaagaaagggggtcgaggtttatttaagttttacgagtcgtttataatggatcgatatattgagggtttttttattaacgtttatgaatattaaagagatcgttaagtggcggttagcgggcgaggggggcgacggagtttgagagtttcggttcggtcgaggggagggggtttttgcgcgagtatatttcgcgtttgggtttcgcggaaaatgataaaataatacgggttattcgttgggaaagttcggaatgttttttttcgaaattttttttcggggagatgtgagtatagggttttgttttttattttaatgtattttgagattgggcgttatttacgggttttttttttttcgggcgggggtttaggtgggttttgtcgttagattagaagtataaaatgtgagcgcggtggagatttgggcgtattagttgggaggacgttttgcgtttcgtttttgttcggtttttagtattgtttttcgggtttgcgggttcggaggagaggaatgggattttttggtcgtagttcgagttcgtggttattgcgttagcggaatttaagtttttaattttaagtcggggtttaggatttaaacgttgtattttagtacggaggatgtatagatttgagggtttttcgtagtgggacgtggttttggagagggtaaaattttcggggttgtcgtggggtaaagtgattttatttaaagagagattaagtaaagaaattttagtttataaagtttaatttaaattattgtatagatagggatatcgaggtttagagaggaaaggggtagtttataggatatatagtagtttttatttttttttggtgttttggaggaattgaggtcgttttcggggtttgggagttgtcgtagcgtttggtttttggtagcgtttttcgacgtcgtttttttcgtttttagtattttgttttttttatttaggtttttttagaagttaagaagtaggtttcggtgaggtttttttgtaggagttatcggattttatacgtttttttagattcgagttttggttagggagtcgatgcgatttataagttgcgtcgaaaaatgagtggagggttcggcgattttaatttatttttttttttagtagcgttgttttttgttggcgttttgtttaacggttttgttttttgttaggtgtgtttttttttgggttttagtttcgggcggattcggacgtagggtttgaaggttagttatcgtcgtttttttttttttgcgttttaacggggacgggggatgtcggagattattggtaggaattggggattaggggtttggagtttggacgttaggtgtgagatttttttagttaaggcgcgttcgggtggtggaggggcgtttatgttaataggcgtttggatagggtttcgtttatgggaggttagttcgttgtttttttatttaagtttttcgcgttgaggagaaggtttagggagtttatatagtttagcggagattaattcgtgagtttgatttacgtcgagagggtttaggtatttttgttagcggtatttgaaattgtaggttggtgatgggagttagaagtgcggtaggtggggtgagtttttttatttagtatgttagggtttggggttcgaggtttgaggttgatattggggagtcgcgaagtttgtaggaagcggggtttttcgttgggtttagtagttatttgtttcgggagaggggatcgttgggtttcgaggtgtttcgaaatcgtcgtaaagtaagtttgtttttgggatgatgggtaggaggaatagaggagaggaagggaaagaagagagaggtagaggagaaagaaagaattaggaggtaagaaggaaggggcgtcgtaacgttatcggtttttcgaggttgtagtttagtaaggagtcggaaagtcgggtcgtaagtcgaattcgtattgaggtttttcgcggagttgtttgtagtttttgagggatttcgtttttaggtacgtttgtttttatttaggaagggtttcgggattttttttaatttttttatatttcgtaggaaattttttttttagagataggttgttagggcgatttttgttcgtttatttcgattttcgatttggtttcgtaagggtcgggagtttggttttttatgaagttgttttaggtcgggattagttttagtttcgacggtcgttgcggtttcgtttcggtagtttcgtgagttcgcggaggagtttcgtattcgatcgtgtatagcgatcgagttggcgcggttcgtatgaagcgaagcgtcggttttagtagcgtagtttgagtaggggattcgcgtggtaattagggttgcgcgcgagttcggggcgattgtggcggttcggggagtgtagggtcggagagggaagaggacgcgggttttggtcggggagggagagcggtgtagggttgggtcggttagtcggggtagtaaagtaaaggtgaacgtcgggttgggttaggtcggtgaatatagattaggtttgaggggagcgcggggttcgaagttaggcgtttttttttgtttagtttggtttttggagttttagagagtttcgtcgtatttttttttttttttcgtttttttttttttttagagtcggttgagtttttttttttgttttgcgttttttacggggagagaaggaaaaataggaggggggaggaaggattaggaaggggagagaggagtggaggggtattgtttggagcggttcgcgcgttttcgtttttcgcgttttcgcgacgaaggtttttcgagtttagtcgggtataataagtttgtttttcgacgttagggggttattaataattaattaggagggttattgcggtttttataaaggcgttgagattttgttaaggggaagacggtttcggtcgagtgtgcgagaggttagcgcgcgtttgagttttttgttgtcgtttttttgtaattattcgttttttatttattttgtatttttcgtattcgttttcgtttttattcgcgtttttttatttttcgcgtcgtttttgttatttttatagattttattatttttttttttttttttttttcgttcgttttttttttagtcgtttttttatttttcgtttttttttgcgtttttttttttttcgttttttttttgttttggttttttttttatcgtagcgtttttttttcgttttttgggtttttttttcgttcgtttatttttttcgtcggttcggtcgtttttcggcgtcggggagtttcgggtcgtttatgatgggtttcgtgttttcggttgaggttttggtgtttaagatcgggttgaaggcgtcgggattggcgttggtcgaggttattattttcgatattttgtatagttttttgtacggtcgttggcgtaacgtgttcggggagtagtttttcgaggataagagttattacgttagttttaagatagtttttatcgtcgaggtgttggcgtagttttttttcggcggtgagtttagtcgtcggagttcggcgtaattttttttttcggcgatttttattttcgttttggcgatgcgcgagacgcggttgggatattcggtttcgttgttattcgcgttaatttgggttttttcggcgttcggtgtattttagtttttttatgggttaaattaggacgcgagttattaagtagtttcgtagtttattcggtttaaggatcgatttcggcgatttcgtcgttcggtttcgacgttttcgtcggttttttttttttttttttgcgtttgagttggcgggttttcggtatttatagttttattaggcgtgtaatagtagttgatttaaaaagaaggggttttaaatttatttagttaatttgggtttgatttacgaaagtttttatttaaattaagaattttaaaaggtagtcggggttggggagggggtggagggagggcgggcggggagaaaaagtcgcggggagagcgagggagagaaagagagagcgagaaaagttttttttttttaagatgttttaagtttttattttttatttattaattcgtaaataatatttttttttggttttggtatttttgcgcgtcgtttttttttttttttttacgatttttgttttttttttaatttatcgtgaagattaattttatttttatttacgttatgttaattatttaattttttttttttgtaaggggaatttttcggttttttttaaataagtttttttcgtattgagttataatttattgttatagtatttttttagggttaatgaatttagaattagtaatttttttcgaatggagtcgaatgaatgcgattattttaatagcgtgataaattgttcgtcgcgtcgtaatggatatcgtttaattttttttttttagtcggttcgttcgtcgggtatttttttaggtagtttagaggggaattttgtaagatatggaggtcgtttttgtgcgtttcgtcgtttttagttttgtcgtagatgttcgataggggaattttcggggagttgggggtcgtcgcggttttttttcgtttagagagatgatatcggggtttgtttgagttcgggcgtcgttttttttggtattttagggtttgggagtagagagggattcgggcgcgttcggggttatatagcgagcgtagagtttggttagttgttgtcggtgtttttttggtatttttaatatttgttagttcgaggtttgtttttagcgttgattacggttcggtttttttgttagtgtttagagtttggatatatagtgggttttcggaagtcgattaggcgaaagagttttcggttggtttttatttttttgtaggatttggttttagtttttttgtgtataaaatcgttcgttgtcgttggtttattaatttttaaatttattcggggtagaggatggaagaagttgcgaatgttttgagaattcgcggagagattaaaaatttatttttaaaaatgatttttaacgtattattcgttttttagggtacggagggtttttaggttgtaaatagaggagaggtcgttgagttttcgtatattcgattttttttatattcgggtggtttttttggatttggggtcgatttgggtttggttggtttgggtaggatcgaagtcggggtttcggcggggaaggaagggtcgggtttcggttgtttcgggttttgatcggtttttttggtttcgtcgtcgtagaagtgtagaagttgtttagtttggtgttgtttgcggaggtgattatcgtttagagttttatttttggcgagggtttcggtattttttttaagacgtggattaaggcgggaatcgagatgggtttttttatcggtcgcgtgatcgtttcggagtacgtggatatttgtaagaataataattttatgtgggaggtacgcgcgggttggggtagaggggcgtaagggtcggcgaggggcgttggtcgcgggtaggattcgggcgttcggtcgtcgtcgtttttattcgggttgagagcggcggatatttttggtttggacgttttttgagtcgggattttaagtcgttcgagtttggagtttatttcgtttttaggttttttttaattcgtgtcgaaaattcg

SEQ ID NO: 6518 - DNA, 1434 bp, Artificial Sequence
  Description of Artificial Sequence: Synthetic polynucleotide
tcgggtgtgcgtttttttagggtttttattgcgtatcgcgggttacggtagattattttagttttcgttttgttgtgtaggtgttaggagtgtcggttggtttttttttttttaagtaaggttttagggtatcgcggttgttttgggatcgtaggggcgtttttagttttttatcgatgtttcgacgtttttttggcgttggaggttttcgcgagtttggttgtttttcggagtttgttttgtttgttgggttttaggcgacggtttaggttggttgggattttcgaattatcgcggaaaagggttttagtaggtaggacggcgtcgtttttttgtcggtaatttttgttttaaagcggattttttgcggggatcggagagggatgtttcggcgtgaggatgggagaagtttcgggacgggagggtcgcgggtcgtgtttttagttggagttttcgcgtcgtcgtcgggtattttatgatttgggggtggtggtgtgttcgtttttttatgttattttgattttaatttttgggcggattggagtttgtagatttcgttgttagtagttagggggcggcggggagtcgagcgagaggaaaaatttatttattttttgggcggattgcgtcggtttcgttcggtcgagtttcgtttttcggtcgcggttttcgcgcgtagttcgcgtagcgtttagagtcggacggcgtttttcggtggcggcggaggagttcggagggacgtagtcgggtaaggtagggcgtagggcgggcggcgcgaggcgtagggcgcggcgggtagaggttatttggttattttttttggcgttcggggaaggtgcggcgatggtcggggcgcgcggggcggcggcggcggcgggcgggcggcggcgggtcgagggggcgcggggatatagttaggcgtttttgttcgtcgcggtgttcgtcgtttgaaggtcgtttgggcgcgggagtcggtgttagttcggagcgggcgttggaggtagttcgaggcgcgatgtcggtgtcgttgtttaagatcggggtcgtgttgagtattatggttatgattattaattggatgttttagacgttgttttcgttggtgggttttaatattattaagttttcggcggtcggcggcgggacgttggatcgtagtatcggcgtaagtgcgttcgtcggtcgttttggcgcggttttttttttttttttttttttttttttttggttcggagtttcgggttgggcgggcgtcgcgcgggattcgagtcgtttagggaggcggcggggagtagggcgggtaagggtaggcgtcgcgggtcggcgtagcggtggcgattttgtttttcgtttttttagtttgggttattttattttcgttcgcgcgtttttggggcggcgtttttttcgtttgggtttttcgtcgcggggtcg

SEQ ID NO: 6519 - DNA, 5053 bp, Artificial Sequence
  Description of Artificial Sequence: Synthetic polynucleotide
tcgcgggttttttgggatttttgcgatttcgtcgacgcgcgttcgttttttttcgagtttcgcgattttttcgtttatcggggaaggagattttagcgtcgttgttttgttttttttgaacgttgtttttgttcgatttggagtcgtcgcgggagcgttttatgttgcggaaatattgtttttagcgttgtcggtcggcgtttttttttagttttttttttttggttcggcggttttggaattaaatttgggggcggggcggggtgagcggtcgttcggttttgcgggggtttttaaggtcgcgggcgggagggaagtaggggcgagcgttgatttgtattacgcgtatgtttaggttcgtttcggacgagagttgttcgcgtacgtggcgcgtcggtttgggcgaggtgttgtaagcgttttttagcgtttttagttgtttggcggtgatggtcgtgcgcggtcgtttggtcgtggtttcggtttttgcgcggcgggcgagcggtgaggcgcggtagttttttcggtttcggtcggatttttagtttttttatttcggtcggcgcggggacgtcggggttttaggtgtttatttttatttcgttttataggtttttcggaaggcgcgggcgttgggagcgattggtaaaaacgggtagtattcgggttggggtggagggggcgtcggcggagggcgggttttgtcgcgggggcgggggcggcgttttttttaaaatcgtatttttacggcgttttcgtttttagttttggtttttttttttaagtattttgattttttcgcgggtttttttttattttaagggtgtgggtatggtttagttttcgcggttaagaatttagggcgataatttcgattaggggcgaaaagtcgtatatttcggatcgaacgaagcggttcgggacgcgggtttgttcgtgatttcgtcgttttcggtttcggttttttgttgtttatatcgttttagtttaggtttttttagtgagcgtttggggagagaattttttcggacgtttttttgggcgtggttttagttttattttttttagattaggaaaggtgggagcgtcgttttttcggttgatttcgttgtttggcggtttcgtagttcgttttgtatacgagtcggttgttttttatgaggtagaattcgtcgttcgtggttagttgtcgtttgtatacgacgtaggtaaagtagtgtaggtggtatacgaagttttgggcgcggcgtattatttgcgtgggcgggatgtttagttggtacgcggcgtatttggtttcgaagcgtttgcgggacgtatagggtcgggtttagcgcggaagcgcgaggtttatttcgtttcgagcgggttggagagaggtaagcggttgtttgggaaggcggtttcggaggaaggttttgttcggttttgtagggtggtcgttagtttggtcgtcggggtagagttgtttatttttattgagaagggaattttaattttagaaagatttcggggagtttagtcgttattgtttgtaggatttatgttggatttgggaaggtgaattcggagggagaggatttatttggggttagttttttatattttatagttggagttatgaaggttattgggttagagtcgttgggtgttagtattaggaattaaaatattattaatttcggaggaattaagtttagtagaattttataaataggggtgtattttttttaatgattgtttttgtgatttaggtaataaattgtttttttttttaaataatatttgttgatgttttagttaggtttagttatttagggagtatttatggagaggttttatttttaatttggttaggttatagggtgttttgtttgggtgataggagtgggttgggattgcgagagacgtaggtttcgagggtttggttttggtgattgtgaggggaggagtttttggggtaggcgtgtttttcgtttttatattgaggtgaggtttcggggtttatttgaaaaagtcgtttttgtagtaaacgtttttttttcggttgaagtagcgttcggttagtggcgtgtggtagtcgttgtatttgagatatttgttgtgttagtggcggtttagagttttgaggatgaagcggtttaggatgtgttggttatagttagcgtatagcgggatttttgtgggtacgaggaagttttgggttatttcgtagattaggaggtagtgaagttatttttttattttaacgcgagttagtttttttttcggtttataggatttagggttgtcgaggggtttttttttttttatatatttttttttttagttagtttaagtggtttcgtaagtttcgggagtgtgtaggtatcgtattttatgttaggagttaaggggaaattgatatcggtttaaaaatgtgtgtgagtaagaaagtagtttaggttattttacgaggttgaatatttaattataaaatgttgttagtgttaagaagggtgtatgtggagtttaaatgaaaattttattttagggggatttgttttttgaagttcggtaggaaatatagggaaacgggtttttattattatttggagttggggtattttatcgggttttttttatgttaagcgttatggttattttttttagggatttttcgtaaatgtggttgttttgtttggtggttttgtttgtaggttttcggggtaaatattaatgttttttttattattgggtagtcgtaaaattatttatgagtggattggataagtcgatttattgtttttgtgttaggcgtgggtgtttttaatatcgttagagttatttaaacgtttggtttttcgttgtttttgttttttatattttatttcggtattgtaggttttttggaggaattatattggggaggtttaagggtgttttgtgggagtttcgagtttgtgagcgggttttttaggtgttaagggttgaggattttttttttatttagaaaaagtttttggaagagaggagtgttcgttgaagggatcgggatttattgatatattgtattcgtttttttggttgtggatttcgtcggttttagtttattttttagtgggtgagagatattaggaaggggttttttcgattttcggcggaaaaaattgggttgcgtttttttacgtagtggcgggaaatcggcgatgaatgcgtttcgtattcggtaaaatcgtagtttcgggtgcggagcgtcgaggattcgttgcgcgttcggggtttttatcgtgggtagcgatcgtaggcgaggattcggttcggagcggggcggttcgataggtcgatatagcgcggatttagtatcgcggatcggatagcgtttcggtcgtagttcgtcgtcggcgttcgcgtcgggtaaaagtcgttttagtttatttcgcgtcgcgttcgcgattttagttttacgttgtatggcgattttagttttggcgggggtttttgtgttagggatggcggggtcggcggagtttggacgttagttcgttcgtttcggttagttttttcgagcgcgggcgcgtagttttttttttttttttttttttttcgttttttagttttcgcggttaattttttttaggaatcgtcgaaaaataaataaataagtagggaatcgcgagtttttatagtttggatgtaatttttttttcgtcggtcggttttttttattttttattggtttcggggtttttttttttattttgcggttttagttggttcgggagtcgaggagaattgtttaggttttttaagaattaaagtgttgggagttagagtggtgttattaggaagttggggggtttggagaagagaggtttttttttatagacgggttttgagcggggataaatcgagcgggtgtttgtgggcgtagacgttgaaatttgatttcggggagatcgacggtcggagtttagttcgattttggtttttgtatttgattttgtttcgttggaacgtggaaagagttcggttggggcggtttttttggggatttttttgtttcgtggttattgtttcgttattgttttttgcgttttttttagtttagggagttggtttcgggttgtagaggttttttaagtttattttggattttcgagagttttttggtcggagtagcgtagtgttataattttatttattttttgataatttaggttaggggttttgtaataaatataggttgaggcgtttaggcgcggacgtttcggggttttcgcgtttattttcgtttagattttttagtttttgttagttttcgcggttaggttcggaaaggtttgaggattttttggttttttcggtgtagttattcggttcgggtatttatttcggcgtaggttcgtttttcgcgttagtagtgttagtagtaggtcgtttttcgtcgattttcgggtcgggtttagtttttcgcgcgtttttatgggtttcgtcgttcggcgtcgttattttttagtttcgaattttttcgggtttagcgacgttatttcgtaatagtttcgaatcggcgtttaagcgatttcgggtgttgttgggcgttgcgttcgcgggtcgttttggggttcggagtttttggtcgagcggagggcggagcggtcggggggcggggtcgcggggcggggcggggtcgggggtcgcggagattagttcgggttattgcggattttgagcgtttttgcgtcgggatttgcggtgtttagaggtcgtttcgcgtgttcggttcgagggcgggtatcggtaagggagggtttaggttagggtttttcgttagcgttcgtttcggtttcgtagttttttgcgtcggagcggtttagaggtagaggtttgagttggagtatacgttaggagggttaaggttttcgggagaggggtcgagaaggtagtagggttttttcgtcgttgaggtttggtttcgggagtagtagatggtcggcgggagtttaattcgaaacgtagaaggggtgagtgtggcgtcgagggttgcgtatcggaatcgtaaggtgtcggatcg

SEQ ID NO: 6520 - DNA, 6343 bp, Artificial Sequence
  Description of Artificial Sequence: Synthetic polynucleotide
tcgttttttattgtgcgcgatcggaggggtcgttttgtagtgggcgttgtgacgggggcgtagttattgacgttttttggggtaatatttataaataaggtttaaatgcggttcgtttttttaattgcggatattagagggcgtagttttaggattacgtttttatttttttattttattcggaaaggggtttattcgagtcgatttcgtcgttattagtcgggggaggggaggttttggagttttacgcgggagttttcgtcgcgggaattataattacggttaagtttttttggttcgttcgttttatcgtagggagaggacggggggacgggtaggacgggcgtttggatagttgggtttttttcgtaggtgtttttgatttcggtatggaggaagcgttcgcgttttcggtttaggttcgtagttagggttgtttcgttcgttgcgttttaggtaagtcgggttagcgtgggggagtagcggggtttgggttgcggagggggtcgttttgattcgcgtttttttttagggtaaaagtttcgtaaggtagtgtgagttggagtcgttagtttggggattttttttaagatgattcgtacggatttttcggatttgttggtgtcgatcgtgtattaggatattaaggtggcgatttcgggattcgcgtttaagtgttcgttatgtgagcgattcgtggttcggtttgttgagttcgcgttttttaataagcgttattgtcgtagtttcgattttttggaggcgttggacgggtcggttatggagattttgtcggagttatcgtcgtcggagttcgttgtgtcgcgcgttcggattcgcgaagtcgagttacgtcgtcgcgttcgttttaagagtgcgtttcgcgcgttttcgggtttgacgttcgcgttcgtttcgtcgtcggtgttgtttcgtcgagggcgggaggtttagcgtgcggcgcgggtcgaggtatcgtcgcgtcgggagttcgcgtattcggcgtttcgcgtttttgttaacgagttgtattttattaagttgtagtcgtagcggggcggtttcggtcgcgtcgcgtttttgtgcgtcgtcgcgggtcgttgcgtatcgttcgagttattcgcgggtttcgttttttacgtgcgttgtcgtttggatattaagttagacgacgtagtgttttagtacgttattcggggttcgcggttttgcgggtttatcgaggtcgcgtattgggttcgtttcgtttcgtagttttacggttttacggtgttcgggtttcgttatatggcgttgtcgcgtatttcgacgtttagcgatttatattgtgcggattttcgggcgttttattgcgacgggtttttgtttgggtttcgggattacgtcgagcgtcgtagtttgttttttattatttcgtcgggttttatttagtttttttatatagaggagttttaaggttttcggggtagttttgtagttagtttcggtttaattttcgacgtttattattttaggttttattcgttcgaggagttttcggggtttagtttaaggcgtatgggcggttattacgtaggagaggtgcgtatttttttaatttaggaatcgttttttcgtttttattatggggaggttttacgagtttacggtttgttttacgggtttcgttatgttttcgaggagtttcgggtttattttatcgttcgttttttttatacggaggatttcggaaggtatcgcgagcgtgacgttttggttcggacgtattcgtattcgcgtagtagttcggtttgggcggattggggttcgcgatcgtatcgtattttgtaagtggtgtcgttttttgatttcgattcgttgttcgttttttggtacggcggtatcggtattagttcgtttcggttggttatcgatagtcgttattattcgcgtttttgggataatattttggtttcggggtcgcgtcgagaagattcgttgggtcgcggtcgtagttacgagaatttgttggggcgcgaggtgcgggagtcgcgaggcgtgtttttcgaaggtcggcgttcgttcgtcgtcgtgaatttgtttattttttttagacgttacgtcgtattgtttttgttcgagacgtcgttgacggagaagggtcgcgcgggcgagggtttgggtcgtaattggtacgtgacgttcgagattattattattgataatgatttgcgcgttatcgagcgttcgagcgttagggtttgggagttgttcgggggtcgtacgcggttatttttttacgcggttttcgacggttttatttttggtcgttagcggagtttagagtagttggacgagtttattacggatttggttatcgattcgcgatttatcgtcggttaggttttagagttcgcggtcgattgtttgggtttttaattgcgtcgattgttggattcgcggttcgcgggtttcggggttttcgcgttggcgtcgttacgttcgtttttcgtttcggtcggtagcgtcgaggagttcgcggtttcgggagaggcggtcgacgcgtttttcgaatttagcgtcgacgaggacgatttgatgatttgttttaatgcgcgttgtcggcgtatcgagattatgtttaacgtttgtttttattttaagttttgttatagttgttatatttattattgttcgcgtttgtgtcgtcgcgaggattgggacgtttataaggcgcgttgcgtgtacggtcgcgtgggtagcgtgtgtcgttacgtattgtagttttgtcgcgatagcggttcggtgtatcgcgttttttcgcgtatcgcgcgtgtcggttttttgtcgcgcggtcgcggcgtgttttttttgggttttttaagtttaggttcggtcgataattttttgcgttttggtttggaggggttgttgttattttttatttatttatcgttgcgtgagttggttatatacgcggcgtttttgggtagttacgcgcgcgagttggcggtcgttgggcgtttttacgaatcggtagagtgttttttgtttagcgtgttcgtggtcgtgggattcggtatcgcgttatcggggatatcggttttgttcgcgttcgcgttacgtagttacgggttaatagtgcgtaagttcgttaaggtagcgttggcggtcggtagtttcgcgcggtcgttttcggcgcggagtcgcgagttcgatatggagacgttgattttgacgttatcgtcgggtacggcgggtttggattaggacggcgaggcgggtcggcgcgcgcgcgaggtggtttttatttatatttagcgcgagttgcggttgcgcggcgtttttttgcgttacgagttttcgcgcgtttacgagtagttttgcgagttcgtcgaggttaataggcgttttacgtttattattatttattttacggatcggcgtatcggtcgtttttttatgtgtatgattatggtcgttttcgagtcgcgcgcgttcgattgggtggttagcgttaatttgttggacgatattatgtgaggcgtcgggtttattaggtttagtttaggcgttggttcgaattttgttttgtttatttaggtttcgttcggtttatttagggtcgttttcgagtttcgttagggttttatttcgattttttttaggtttcgtttttaattttttagttttttaagtttcgtttagttcggtttttagtttcgtttaggtttttatttttcggtttttcgttttcgtagtgttttttataggtttttcgtttttttatttttagtaatttttttttttttttcgggtttttttttttttttagttcgttttcgaggatttttagaagaagtcggttttcgttttcggtgtttttcgttgggaggcggggtgggtttgaggatcgtcgagttttgtttttattcggaggggttattattgtatagattttattcgtagagattcggttttcgtcggttcgcggggttttcgttggagttttttcgatttcggttttttttcgtttagaagttcgacgtaattaaagtttagtttgttattttaaatacgtttcgtttcgtttttcgcggttgtgttgttttttcgttggagaatattttggtcgatttttgtgcgttcgtgtgcgcgagcgcgtttcgtcgaggcggtgggtagggcggacggtgcgtagtgcgttttcgttggtcggagttagtatattaattacgttacgcgttttgtcgttttttcgtttttagtcgttgtagtttgggttttgtaggagttgggaaaaatcgtagggaggtttttaggtcgatatgtaagttttttagtcgaaggggtaggggatttgaataggggaagtagagtatttgggtttggttagagttgatatttggttaggagaggaaggattaagggacggggcgtttttaggtgggagtttggagggtaaagcgtggtgcgagtaggtgagggagagagttagttggtaagcgtggaagtttattcgagggggtttgatttgtttcgagaggttttcgtatattcgttttggtcgtacgtcgtattgcgggcgtggaggcgtaagttcggcggttcggtttttatttgttttttaagtgtattttggttcgcgtttagagttttttggagggtggggtatgcgggagaggggtggaggttaaacgtaagggtttttttggagtttttagttttatttcggagttaggggagggggtattaagtgagagaaattgggtattttcgttttcgtttttgttttcgtattcggtacgtttatttcgttttcgcgcgtttgtatcggttaggcgtttcgtttgtttattcgtcgtcgcgtttcgcgttttttattttagggtttttgtattcggttttatttttgagggtcggtcgggaacgtttttggatcggaataatttttagggggtaagagttttcgaattaagtaaaatagaatttgaatgtagcggttgtcgttgtttttttgtatcggtagcggggttggggacggaagttttcggtcggtggagaggagaaagggagaggttttcgggcggtggacggggaagagagggagtttttcgggcggtggagggggtggagagcgaggttttcgggcggtggagagcggggaggggggaggttttcgggcggtgggagggggagagagggaggtttttgggcggtgggggttacggggagggtggttttcggattacgtgcgggataggaggttagggttggtaagttttttaggtttttttcgttgttttagtttcgcgggtcgtttaattgtttcgttttaagggtgttatcggatttcgttggagaggaattttttcgttggttggattttattattatttattttcgattttacgttttttttaagcggggttggcggagtcgtaaggcggtaaggaattggattgcgattggttagtacgtgtttcggtcggcggtataattggttgaggcgttgggttttgggaagtatttttcgacgggattggtcgtcgttttcgtagagttcgtttttcgtagtataagcggttttcgggtcgggtgggaggaggggatttcgggaggaggaatatggcggtggcggatttcgtttttatttttgatgtggatatcgatttcgacggcgtttttaagtatgtgttgattcgagtttattcggtttttcgtttcggggtttcggttgtagagagtaaggagatcgtgcgcggttataagtgggttgagtattatggtgagggcgggatttgcgggtatgttaggggtacgtttggcgaggcgggggcggggttggcgggacggagacggggttgacgaggtaggggcggggttggcggggcgggggcggggttgcgggtcgtagcggattgcgttttgtttcgagttttgtttttgttaggtttgatttaggttgaggttttgggcgggaagggcgtgatacggtttgatattttttttagtagttttttagttttcgcgtttttttcggttttattttttttcgtttatttatttttgttttagttttaaggggtttcgttttttttggggaaggggttgtttagagttgggattttagattttttcggttgggagtttttttcgcggtttttaagggcggttagggtacgttttgaggtcgtttttttattttagcggatatttacgataaagtgtcgggcgatatgtagaagtaaggttgcgattgtgagtgtttgggcggcgggcgtattttttattagagttaggataagaagatttacgtgtacggttattttatggtgagtcgtagtttcgtttcgttttgtcg

SEQ ID NO: 6521 - DNA, 1089 bp, Artificial Sequence
  Description of Artificial Sequence: Synthetic polynucleotide
gcgggaaacgtcgttttttttggcgtttgagatttggggttttttttttatttggttttttcgttttcgttttagtttcgtgcgttttaggagggtatcgtcgagcgtcgggttttcgtagggttcgggagatttcgcggatcggaggagggataggattttcgagttttgggggcgggaagggagggtggaaggaggaggggagcggggttggggaaagttggagtttcggtatttttttttcgggttaggtcgttttcggggttttgcgttgcgtttttaagtgttgggaagatttcgcggggaaaggtttgaggacgcggtcggttggtataggtgtggcggttttagagggtcggggagaatttatggtttcgaggttgtggattagaaatgtttttgattagaagttgagaatttttggttagggaggtggggcggcggggaggggtcgttaagtcggtttagagcgcgtttatttgcgttataagggagaagaggtgtttttcgttttttttcgtttatcgtcgttacgatgcgtcgcggatttcggcgatttagttcgggtagaagcgcgcgttttttttttttagtttcgtgcgtcggtttttgtttcgttagtttcgttatggttttttatttattttcgcgggagcgtttttgtttttttattttgtattttttttagagtcgcgcgttagtttttcgtttcgtggaagcgtttttttttcgatttcggttgattttcgttcgtcgtttttttcgcgggtgcgcgttcggtttttttttcgttcggggcgggtttgcgtgggcggtgtttcgggtcggcgggcggagtttcggttttttagttttgcgtttcggtggagttcgagtcggagtcggtagaggggcgcgggcgcggacgcggcgtttggcggggttttgggaggttcggacggggttttggcgttgagttcggtcggttcggagcgcggatttagtcgtaggggcggcgatgggtatcgagggattttcgttttcggtcgtttttcgcggacgttagggttgtttgttggtatttgcgcgggtgagtgcggttttttagcg

SEQ ID NO: 6522 - DNA, 1020 bp, Artificial Sequence
  Description of Artificial Sequence: Synthetic polynucleotide
gcgggcgtgaggtttcgttttcgtcgttttttgttcgtttttagattcgcggttcgtttggtcgttttatttggtcgatggcgttggtggtgagtataggaaggttattatagttttaatttttgaggtaatggttgaagttcggcggggcgaagtcgttgtacgaggggtcggtattggtggcgatacggttggcggcgttggttgttagggtagcgttggcgacgttgacgtcgttggtattgggaggttgtttttagttagaggtattaggggggaaggtttcgtagtggtaatgtagcgggggcgttagcgtgaagatggggttcgaggttatgtttagagttacgaagagtatcggtaggtagtagaggtcgagttgtagttgttggtcgtcgtttagcgtttttatttgggcgagtagcgttttaaagttgagggggtttgggggtacggttagcgataggttgttgtttagttcgtcgtcgttcgcgtttttttttttttttcgttcgcgttttcgtttattttgtagttgtttcgtgggtatcgtattttcgagggtttcgatttgttgttggggggtagggggtggtaggagaagggtgaagcggaggaaatcgtagagtaagggtagggggtaggtgggagggagggttaggaaggtagttaggggcgagggatgcgtaggaggaaaatgttagacgtttcgcgggggcgggggtgttgggagaggatggcgtcgttatttggggttcgggtatttatttcgttggaggtgggggtgatttttatagtgttgtcgattttgtcgtcgttttcgttattgggttcgggggtttcggtggttattcggggagttagtttgtcgatcgtaggggttttgtcggttcgcgtcgaaaggatgcgttgttttttggtttagttgcgcgtcggttgttcggatatagatagttcgaagagatttcgttttgtagttttgtagtcgcgggcgtttttttggtttttgcgatttttgcg

SEQ ID NO: 6523 - DNA, 6343 bp, Artificial Sequence; identical to SEQ ID NO: 6520
  Description of Artificial Sequence: Synthetic polynucleotide

SEQ ID NO: 6524 - DNA, 1109 bp, Artificial Sequence
  Description of Artificial Sequence: Synthetic polynucleotide
gcgaagttatagtcgtatagttaggggttttcgtttagacgtagggagcgtagcgcgggtagcgcggttagggcggttacgttgaggttgcgtaggttgttgtcgttgagttttagtatttgtagcgattttagggtttcgaaggcgttttcgtgtacgtttattaggttgttgttagttaggttaagttttattagtttttcggtcgagcggaaggcgtcggcgtttagttgggttaagttgttgtagttgaggtcgaggaatacgagtttggtcgagtcgttgaacgtgtttttttttagcgagcgtagcgagttgtttttgaagtttaggtagattaggtcgtcgtagaagatgaagaagttttcggggattcgttggatgcggttgtcggttattagtagtttgcgtacgtttagggggaaagggtttggtacgttgggtagttcgcggtcgcggtagtttacggtgtgcgggtcggtgtaggcgtagttcgcggggtacgcgtgttcgggcgcgagtagtagtagaaggttgtagagttcgagcgtcgcggcggcgtaggttggggttcgggggcgtatggtcggggggttcgcgtcggtcgcggcgagaaggaagcggttttcggagcgagttttggcgcgggacggcgcggtgaggtattggttgtcgggcgcggggagttagagggcggttcgggcggggagggcgtgcgttcgggcgtgcgggggcgatggagcgcggcgcggacggattggggagtcgggatagtagggatggagaggggaggggcggggagggaggggcgagggatttattaaagggtttattcggataggaaattaattcgttagaaaaattttttgggagaggcgggagcggtaggggtggtcgagtggtcgtcgttaaaacgcggttttattttggtagttgattttcgagatttggtagtaagacgtcgcgcgtatcgggcgggttgtattcgacgtttaagtttagttattaagtttaggagcggtttttttaaggcgtgtttcgggcgtgcgttttgttttttcgcgttcgtttggtgttaaagtacgttttttgtacgttattttatgtcg

SEQ ID NO: 6525 - DNA, 1109 bp, Artificial Sequence; identical to SEQ ID NO: 6524
  Description of Artificial Sequence: Synthetic polynucleotide

SEQ ID NO: 6526 - DNA, 1384 bp, Artificial Sequence
  Description of Artificial Sequence: Synthetic polynucleotide
gcgggagtattagcggtttacgtcgaggaagataggcgtttttttttggggtgggtagcgtaggtttggtttgcgggtggggggtggagagtgagaggtacgcggggtattagtttagtttttttttggggatttcgtattcgtagtttaaggaatcggtggagtacgaattttatttttgagttggcgtaagcgttttttttttatggagatttatttcggtttttttttgaggttttttttttaagtattttttttttcgagtatttagtatttttttaattttagtacggttcggggtattagttttttagggcgggggttgttttatcgtttaagggaggggatagagggtcggtttcggtttaggcgatttttgtttttcgttaggggcgttattttggttttttttcgattgtcgttcgtcgttttcgttttttcggggggtgtgttttcgaagtacgggggcgcgggaggttaagggtgtttttagttttcgatcgagattttttttcgagtcggcggcgaatggtaggttttatttaaagagtgtttggtggcgcgcggtgttttttttggagtagttttcggcgttcgttcgtcggggtttcggcgatcgttgttttttttttttttttttttttttttttttttttttcgtttttttttttcgtcgtttcgttatcgtcgcggttagggttggaggcgtcgttgttatttttgtgtcggaggaatcggcgttgtcggtgtttgggggtcggggcgcgggcgaagtcgggtcgcggaggatataataggtagagtcgggggtgttcggtcgcgcgtttttcgcgtattatgtagttttttgttatttttttcgtttttaggttaaaattttgagtatgatggaagataataagtagttcgcgtttcgtatcgatggggcggtttagtcggttagttaggaggtgattaatttgcgagtcgaatttacggttattaatcggagattggcggaattgagcggcggcggcggtttcggttcgggttcgggagtcgcggttagcgtttcggcggcgggggattcggcggcgacgaatatggagaatttttagtttggagcgtaaggtaggatcgtttcggcgtttagggcggaggaaggcgagtagagtacgttcggtttcggaggtggtcggggattcggggttttttatattcggggcgaaatcgttttgtattttggtttgtaatttttttcgttcggcggtggttatcgttgtttttcggttgggagttgtaggttgttgttatttacgaaaattcgagcgtagtgtgtacggggttatacggttatatcggtttcggttagtttgagcgaggcgtagtcggcgggtttttttcg

SEQ ID NO: 6527 - DNA, 1384 bp, Artificial Sequence; identical to SEQ ID NO: 6526
  Description of Artificial Sequence: Synthetic polynucleotide

SEQ ID NO: 6528 - DNA, 835 bp, Artificial Sequence
  Description of Artificial Sequence: Synthetic polynucleotide
tcgtgaggtcgtgtgtgagtttttgcgtgggtcgtgagtgcggtagggagcgcggtgttcgggggtcgtttgtcggtgtgtttgtgcgtgtttgtgcgttagtttttgtttttgcgagtgcgtatttttaggatcgagtttgtttatatgagtttgtgtttgtgtgtgtgcgttttcggttttgcgtgtgtttgtgagcgtttgtcggggcgcgtgtgtgttcggaatttcgcggtggtgtgcgggtgtgttcgtgtgtttgtgtacgtgtaggcgagcgtttttatttgtgtgtgtgtatttgagtttgggttatgtgtgatttagggattagtttatgagtttgtttgtgtttttgagtcgatatttgtgtgtgatttagggacgagtttatgagtcgatatttgtgtgtgtttgggtgtttgtgtcgtggtgtgtttttgtaagcgtttgtgtttgtaggtgttggagtgtgtagttgtgggaatgagtgcgtgtgagtgtgcggaaggggtatcgcgcgagggagcgtcggtgcggaaggttaagcgagttcgcgttttttacggacggtgtcgttatttttttttttcgtttcgcgttatgtgtttttgtgtgttcgcgtcgtcggggtcgtttttgggtttcgggagggggttgagcgagcggttttttttttttagggatttcgggttcgtcgttagttttgggtatattcgtttttttttttagcggtttcgttcgttgatttacgggtattcgatgggtattcgggaggtaatggtcggagaggatgggtagttagcgggagggattgagtggcgtcggttttacg

SEQ ID NO: 6529 - DNA, 2248 bp, Artificial Sequence
  Description of Artificial Sequence: Synthetic polynucleotide
tcggttttcgggcggtcgtttaggaggagatttattcgttgggtttttgatcgttttttaggaaaattttaagtacggaaattaagttcgatatcggtttcggtattttttttacgtcgttggtagtttaaggttcgttttgaagaagagttgtagaggaggaaggtggttttggttcggcggagttcggttcgtttggtgttaggcgttggtgttggcgtcgagtgaatttaggcggtttaggtgttcggtttggtggcgggcgtagggtttgcggtgatggaggtttcgttttagttcggttaggtttagttttgtcggtcgtcggttcgggatatgcgcggcgtttaggtttgtagggtgttttgggcggttataataaagttaaagatcggagtaagagttttcggcgagaagagacgcggagaagtcggagtttcggaaagtcgcgcgtagtttcgttagtcgtcgttagttgcggaggaattcgggttaattttaaaaatcgttggcgtttttgggtcgtttgttcgggtcgtattgggcggtttttatcgttttttttttttatttgtattgttttaggcgggagagaggttttggtttcgagggattagttgtagcgggtagcggggttttgtttttttaattttcgttttatggtacggggttgaatcggtattatcgaggttaagggcgattattaggagagaagatcggttgttttcgttatgcgaatttgtgttttgcgatttcgttgcggttgttcgagttatgttagaggtggggacgaagggttcgcggggagtgaggtgggtagaggagagaagttggcgttttttttagggtttttattttgcggagaagttcgatcgtagaattcggtcggttgcggtttatgttggtagttatcgcgaaatgcgttttcgattcgggatcgtattggaaattttcgttatattgtgttaggtttgattttttaggagcgcgttaagggtttttcgtttattgcggttcggcggttttttttttaataagtaaggttcgtgatttcgattttggaattttgtttttatagggaggagtttttggtggttatcgatcggtttagtagttcggagagaggttaggaaaattttttcggaacgcgttgggaggtttttttattttcgttttttttcgggcgtacggagattttcggttttagggagcgtttatcgattcggatgacgtggggtatttcgcgcgagttcgggatttagaaggcgtatacgaggagttcggtttagtatttttaaattagatttcggaggcgtcgttagggagcggttatcgttgggcgtcgtcgagcgtgttcggggcgcggtcgtggcgggttttttggggcggtagttttaggcgcgggcgcgtagtagtttcgaaggcgtcgtttggtttagtcgttcggttttcgagcgtcgttgtaagtggggggcgtttcgcggcgtcgcgtatattttattggggggtcgtttcgtcggcgttcgtttcgtttggttgtcgtttacgggttgttcgcgagcgaggtttttgggtttcgttcggatttcgttcggattcggtttcggtttcgattcgcgtcggttcggttttcgcgcgggtttttatttgtttcggttgtcgggttttggcgggcgggttgtacgcgttttcggtcgttttttttttagtcgtcgtcgatgttatcgttcgggttcgtataaagtttcggagtggagttgtacgcgcgtatatttttttttttagtttttttttttgcgttttgtttttcgtttttcgcgtcgttcgtcgttcgcgtttttttcgcgtattttttcgtgtatatatattttatatttatatttgtcgaggcgtatattcgcgcgtttatatttgcgcggggggcggggaaggggattttggttttattgtagggggacgttcggagaacgaggatttttttcgttttttagacgtttttattcgtttcgtcggttttagttttttttattgcgagggtacggagttcgggagttaggcgtggagcgcgagagttggtatcgcgagttgggagacggcggtagtttagcggtcggattagttggaggagacgcgttcgtcgggagtagcgagatcgggagttcgtcgtttgcggagtttggtttcgcggtttttacgcggcgggcgttggttggacggcggtggtagcgggagattgattcgggaatcg

SEQ ID NO: 6530 - DNA, 3541 bp, Artificial Sequence
  Description of Artificial Sequence: Synthetic polynucleotide
tcgcggggagtaggggtcgcgttatgcggcggtcggtttgtagtagggtagaagttttttttcgtttgggtgtgtgggagcgtagattttttcggcgtggtcgggaattaagtcggggttcggatgaaacgaaacgaaaaatgaatattcgaattttttttgttagttttttttttttttttttgtttttttttggggggagggtagggtagggaaatataaggggaaaaataaattaggttagattaaagttttggttattttttgtttttatatatagacgcggttttcgcgatttttttttcggggtttcgataaatatagtatattgcgatttaaattaagggcgcgggcggagttagaaggattttaggagtcgagaggttttacgaataaataaaaatcgtaaaaaattaagttcggagaaaggggaaagcggggtggggcgtatttttataggagagaagaggcgtgtagcgaataaagtgatagttttttattttggattcgtaggtttaggagtttacgcggggagaggggatggagaatttttttcgtttcgttttttttttcggggaatttttaatttcgtattgcgttatttgtcgttttggggaggtcgttgtcgggattcggtttcgaatagttcgggggggtaggggcgggggtcgtcgaggggatgggggtagagagtaggcggcgggtaggatgttcggggtgagttggcgagtttcggattttcgtttttttttttcggggttcgggcgacgtagtttatcgggttgttttcgtcgtttatcggagagggtcgttcgggtgtttggttttgttcgaaagtttttgggtttttttttttttttgtaaaatttaaagtaatcgaataaaaagagtttaggtcgcgcgggcgggttgcgcgttcgcgttttgtagcgcgtcggcgggggttcggttcgcggggttattgtattgagtcgggtagtgtgtggtggtggtggtggtgtagcgtcgtcggcgggggcggtgggggcgcggagggtggcgatgcgtcgttttcgttaggttttagttttttaggcgcgtatatatcgtttatgggcgggtggttcgcgtcggtcgtaggggttatgcgtttttttttttgtcgtcggttgtagaattagacgcgtattatttttttttttagttgtaggttgtttgttaagtcggtgatttcgtgcgtcgagggtttggggtatttgagaaagtggttttcgagcgcgtttttgatttttatttcgatggacgtgcgttttttgcgtttgcggttttgcgtcgcgattttgtttaggttggtggggttgtcgttggacgagtcggttttttttagttatttgttgagtagcggtttgagtttgtatatgtttttgaagtttagttgtagggtttcgaagcggtagatggtggtttgcgagaatacgttatcgtagagcgtgtttagcgttagttttacgtcggtttgcgtaaagtttagtttgatgcgtcgttgtttgaattgtttggcgaattgttttaggtcgttcgagttgggcgtattttcgttcgagtgttcgtttatcgatgagtcgtcgtcgttcgcgttcgggtgtaggtgcgtcgtcgtcgcgtgtaggtcgttcgcgtgtgtatgttcgtgtgcgtgttcgtgggcgtttagatgcggcggcggcgacggttttagttgcgtttcgtggttattttcgtgtagcgcgtggtgtaggttcggtttcgcgtcgttatcgttcgtcgttagtatttcggttaggtcgtcgtcgtcgtttttcgggtaggtcgtttgcgcgtatagttcgagcggttggggttggtggttttcgttggtttcgggcgagggcgatatggtcgggtttaagtggtgcgttgtgttgttttgcgtttatgtcgcgttcgcgtgggtcgttttttggtgtattaggcgcgcgtggaaattttcgtcgtcgtcgtcgtcgtcggttcggtcggtgtcgtcgtcgtttgttttgtcgtgttttaggtgcgggtcgtcggtttaatcgtcgtcgtcgttttttttcgtgggtagttattgggggtgcgttaggtttacggggtggttcgcgttcgcgtttagttattcgtggtgtattagtttttgtatttcgcggtacgcggtttttgtatgtaatcgtttcgcggtcgtcgtcgtcgtcgtcgtcgtcgtggcgttcgggtgtataagcggttcggtgttttcggtttcgttatcggggtttcgcggtaggtattgcgcggtggtggttatgtcgtttcgcgttttgcgtcgcgtcgtcgtcgtcgtttcgtttcgtttgcgggtttcgtcgtttcgtttcgtcggtttaaagtttcgattcgttcggcgtttcggagttttatttcgttcgtcgtttattggttgttcgcggagttgtttttcgttttttttgttcggttttcgtttcgcgcgttcgttcgttattttgttcggttgtttagagttttttattgggcgtcgttttcggggtttcgcgcgtcggtcgtgttgattggtcgttggggttttatttacggtttttttatcgttcgcgtatatatttacgtttcgggggcgcggtcgttacgtggggagtggcgcgggggtggttttgggatcgtattttttttcgttttggttgtgtgggtttcgtttttttttagcgttggagatttcgagttcggtcggttttatattttacgcgagttgaattttcgttcgtatttcgttcgggtagtagggattgtcggtttcgggaggcgttcgggtttcgagaagcggtttagtttcgcgtttttttttttttagtatcgttgtcggcggattaggattttcgcgggttttggcggttgcgagcgcgaggcggcgcggattcgcggttcggtttcggcgcgattgtttatcgcgttcgtttcgtttttcgcggttgttagcgtgtattgggcgtttttcggcgcgtttgttcggttcgtttcggtttttttttttttttttttagttttagcgttataatttcgtcgattttttttgttttgagagcgcgttcggtgcgggcggagtcggacggattttggttttacgtttcgcgcgggtatattttttttcgggtattgaggtttaggtgagtatcgcgcgggtagttggggttgggacggcgggcggtagcggttttatagttttacgcgagtttttggtattcggtcgcgtttcggggttttagaaggagaagatttcgaggtggagattgtggtttcggggaaaacgttgttggtaagggcgttagttgggggtggacgttgggtttaggggtatttgatttgcgtcgttgtagttttttcgtttttttttttagtttgaacggtttatcggttgtggtcgtggtgggattacgtttcgggagaggagaaggatgggtttagggaaggggttcgggttttttagaaattcggcgtgtaggtcgggagttgtttagtttcg

SEQ ID NO: 6531 - DNA, 1513 bp, Artificial Sequence
  Description of Artificial Sequence: Synthetic polynucleotide
gcggggcgggtcggggcgtcgttgcgggacggtatttaagggcgcgcgttgcgtgttgttttcgcggtttttcgggcgttatcggttcggttaggtttcgggagttgttcgttttaggtcgcgggggcgtttcgggttcgtaggattcgaaaatttttttttcgggtcggggcgggtgagtaggcgggcgttgggttgcgttcgacgtttttttaggtcgtttaggagagtttcgagggttgggagaagtcgtcggggcggttgggttggacgagcgagtttaggggttaatcgtttttattcgtcggtcgcgttgtagagcggtgtttttagggttggggtttgcggcgatttcgttgggaggaagggagagcgagaattgagacgtttgttttaagttgtttggagttaaaggttttcgagagcgtggtcgtggggttgggtcgttggagtggtcgtttcggtttagatattcgtattttcggcggtgcggcggtttttacgcgcgtatttatttagcgcgttcgggggtttgaggtcgtcgttacggcgtttcgtttcgggtagtagtaattagtacgtaggtatttttggaataggcgggattgttttttcgacgcgcggtttgcgtttaggcggcggaggggtttagtttttttttagttttcggttttagggcgtagggttacgagttttcgtttttattttcggtttttggtattcggcgtcggtttcgtcgtttttttttatacgtatttttggtagggtttcgcggggcgttttaaagtttgggggtagtttttaggtgtttttgggaagggaaagaaaggttataaagtaaaagaaggagtaaagagaaggcgagggaggagtaggggttcgggttttgtggattcgtttgggttgggagtggggatattgagagggttgcgaaggtttcgggggtcgcgcgtggttcgtaggtttatttttggttcgcggttgttttttttttttttttttgggtttttggttttttttagtgttgttttttttttttttttttaggtttttttttttttcgcgtagggtttcgttttggggattaagagaaaggagggaggggaaaggggaggggaagggaaggggcggaggagaaagagggacgatttttttaaaggcgggtgttgagttttagtttaggattttcgggtttaattgtttgtggtattttttatattttttattttcgtttcgttttggttttgttttagttttcggcgtttttttttttcggatttcgttgtatgtttcgtttgcggtggttcgatcggtttttttcgggagttttttttttttcgttacgttttcgttttttcggtcgttttcgcgtttttcggttttttttttattagttttatatttgttttttttatgggagggagcgcgcgtttttcgtttagcggggtttttagtagagtttttttaattttcggcgttttttttatatagggttcgttgggtcgtttttgcg

SEQ ID NO: 6532 - DNA, 3541 bp, Artificial Sequence; identical to SEQ ID NO: 6530
  Description of Artificial Sequence: Synthetic polynucleotide

SEQ ID NO: 6533 - DNA, 558 bp, Artificial Sequence
  Description of Artificial Sequence: Synthetic polynucleotide
tcgagagcgtaggattattaagagaggtcgggttatttttttcgtcgttcgttgatttttaggggttgggtcggcgtatagtaagggggttggaggtggggtcgtttttttttacgcggttgggtttttaggcggtgttttgggtcgagtcgtttggagattttagattagtatgtgggtgggaaagggcgtttcgttttgggttttttcgtttttgcgcgtagagtagagacgcgtagattcgtttttatttcgtttggtttttttggagtagtttcggcggcggtagcgatgggttgggaggggtcggtacgttggtttgcgcgggtttttagtcgtttttcgttattcggaattttttttttttaagcgttgatcgtcgatttatagtttttttttaattcggggcgagcggggtttttattatatatttttttttttcgttcggttttatttttttttcgtttttttttaggttttacggtttgtaagtatttttgtaaataatttttagtttatttatatcgtttcgttcgtatttttcgagagttaggtacg

SEQ ID NO: 6534 - DNA, 7244 bp, Artificial Sequence
  Description of Artificial Sequence: Synthetic polynucleotide
acgtttagttagggcgtagagagagcgttgggcgaagaggggtcgatggttcgcgggaatagggttggggtttttgtttggggatcggtcggttgttaggtttttcgttttattgttttttcggagcgtcgttgattataggttcgtataggtcgtcgtcgtaggtcggttttttgtgtatcgtcgtagtagcggcggtcgagcggttacgtatgagatcgttaaaggcgtagtttatgggtgggcggaagtcgagcgtgggtattaagtcggtagtggagtagggcgttatgaaggttagatcgcggttgtgcgtcgtcgtcgcggagtaggttaggcgtagggggttgaggtcgagcggcgcgtttagcgggtaggcgttcgcgtcggtatcgaagtgattggcgttgggttgtagcggcgagaaggtcgagcggttgtttagcgagtttagcgttttaggcgttatggcgtcggttagtaagggtttgtggtgcggaggtgcggcgggtttcgtttgtagcggcgtaggtagtttaggtttttcggcggcggcggcggcggcggcggcggcgtcgacgcggttgggttacgcgtcgtttgtagttgttgtagtatttacggcggttttatttgggggcgtcgtagggtttaggtcggtcgttaggtttttacggtggtggtttagtatttgttcgatggtttgtattacgtcgtcgtcgtagttttgtaatattagttttaggacgtttcgtcggtggtttgggaatacgcgtgttaagatatttagcggcgttcgttgtcgtggattcgagttttcgtttagttttggcgtcggcgcggttttatttttttttttgttagtttttgaatcggatttagagtttagagggttagcggagttcgggttgtttttttcgtcgtcgtcgttagggttagcgttgtttgggtagttgttatttgtttttttggaggttcgagttaggggcgaattagaaaaggattcgttatcgtcgtttttcgagtttgagtcgggtcgtatttttggggacgacgtttcgggtttcgagtttgcgtcgtcgggtgataagggttttatcggcggcggtagcgggttgttcgggcggtttgtttgtagtagcgttttaggaaataggttaaatttttgtaatttggtttttgggaggggagaaaacgtgtcgtgaggagcggttagttagaagatagtagttatagtatttcggttttttggattttagtttttttttttttagttttatagtttttatttattaggttttagtgtttttttttttttttgttttagtatttttttcgttttgagtttttatagttttgattttagggttttttttttttttgtattttttagaattttaattatttgtgttttgtaaattcgatgtttagtgttgttttttttacgtttgtgttttaatatttttatttttaattgtttttttagttttgttttgtcgtggagaagtggttaggtttagggtttaaataagagataatataatttttgtttaattacgttgtatagaagagtttattgtatagaaaatgtttgttttggtagtgtagtttgtaaggaaaggcgttttggttatttaggaggttttaagtttttttataggtagaagtatagtttttgtttttaatttattttttttaaaattgagatttgagaagttttttttttttaagtttagagcggatttttttttttttttaacggttttggtttaattttttttttttttataaaaagttacgggggtttagaaaaagagggtggtgttaggtaggtagtaggaagcgaagaggaaaagatataggaaagtagatttgagaaattagggagggtgcggaagaaattagaaggagggagggcgtagtaagcggttgtttagagggcgttaggaacgcgagaaggggaaaagaaattagggcgttttagaatttagggcgttttaaaatttagggtgttagttaaagggggggggattttttaagggagttgggaaggagtagagggaaagggtttgtggagaagcgtagagcgaacgaagatgcgtaggtttttatttggggagaagacgaagtaaagaagtagggatttgtttgcgtttgggtagaggcgagtaaaaaaattaaagcgtgtatatttcggttcgatgtaggagaaaggggtaaagtgtaaatgttttagaagcgggagaaaggagagtttttgtatttacgttttatattcgaggttgggcgagcggtgaattttagtagtcgcggcgattggatacgggggttttattttttttgaatcgagataagtttttgggtttcgtgttttagagttacgattttgttgtttttatttgcggtttggtcgcgtttttatttgagttttttgcgttagttgtttcgttttcggttttcgcgggcgttttcgttttaggtttttcgtcgtcggcggcgtatattgaatcgaagatttcgtaggcgggtttcggggggatgatgtcgttggcggcggttagcgttagtttttcggtagtgtcgtagagtagttgtagttcgcgcgtttcgttttttttttgcgtttgttgtttgcgtagcgttatttgcgtcgttatgatacgttggcgtttcgcgatgagcgtgtatttggcgtataggtagtttttttagcgatagtagcgtttgtggtttttgagggtcgatattacgttatggttgcgatagcgcgcgtatttgggggttcgcgggtatttttcggttgttcgtagtaatagtggcggttttcgtagtaagtcgtttgttacgtttatcggtagcgatgtagcggtcgtcgcggttgtcgttatcgacgttatcgacgttataggcggtttcgtcgttgttgtcgtcgtcgtcgtcgtcgtgtcgggtacgttgggtagtttcgagcgtagttttatgataggatttgacgggaaagaaggtgggagaggggagagatttggtgaggagtatatcgcgcgttaggttaaagcgtcgttttgaggaatttaagttggagagggaaatttgggtcgcggaggttgggttagaggggttagaattgttgggaggaggtgtagtcggaatttttttgtgagttttagtatttttattttagtttggttatggttgtttttagatttgatatatacgttaggggtaagattttgtttgaattagtgatttcgttggaaaaaataaagagatatgtaaagtgtgaaagttattgatttagatggttgtaatgagaatttggaaaagttaagatgatattttaaagtttagtttaattggggtgagacgggtgagagaaatgttcgtttgacgggattgggattagagcgatagttttggtttagaagttaggttgatgttaagggtaaaataggaaaattcggagtaaaacggttagtttggtggaagggtgaagaggagagagatgtgaaggcgtagatgtgaaggtcggttgggtcggagttttgtttttttttgtttgtttatttttaatgtagtttggggtagaagttttggagagaaaaattaataatagaaagaatagttttaggaagtagagtgaggacgaggaaataatttgggtaaagttaggtttagtggttttgggattcgtaaaaatgtgagcgttaaaagttttacggtgagggtttttagagagtgagagataaaatgtatgtggaatttagtttaggattgggaagtattaaagagaaaaattcggttaaagaaattttttgtataggtaaatttagtttaaagatgagttttatgggtaaggaaaatagtgaaaagtagttgatttgggtgttcgggatttaggggtcgcgtttgggagaggggaatgtgtaagaaaaaattttataggtaaatgttgggggaggggattgggtaaaatttgtggtgtagttttttagtttcgtagtttggagtagtagtcggggcggaagacgtattttgcgaaaagttaggtatttcgggagggggatttttttcgaagattattttatattgtttttttttttttttcgggtttagggatagagtcgttagatacgtttttttcgttttggggttttaggggatttttttcgagcgtaggtttttgcgttttgattttagagttggggttttaggatacggatggtttagtaggtcgtattaagttaggggagtcgttttcgtaattggttataaacggatattagagttttttttacgtcgtagttttataaggtttaagtaggtttagtttttcgtttttgtcgcggttttttttgtttttcgcgtttttcgtttttgttagagttcgcgatagagtttttgtgttttcgttcgagagttttagattttttttttatgagcgttgtttttttttttagatttttcgggcgtttttaaggtttacggggtttaggtttttttaataggggtcgtagattaggtttttatttattgttttttttgcggtttttaattatttgttttgggtttcgggatttttttttttcgttggcgttgtacgcgtttttcggttttattggcgacgttggagtttttggtcgtttttttttgttttcggttttttatttgattacgttatttttttttagttattatgttcgaattttcggattttttagaacgtagcgtagtttaattttttttttagaaattcgggtcggaggttcgtttgcgggtcgcgtggttggaattcgcgatttgattttcgtcgtgtcgggttttttcgcggtgcgcgtcggacgttgcgcgtagtcggggtttagttgttcggcgttgttagatttttaatgagtcgttcgttcgttttattgttggtttttagggttttattagatagaattggataataatgtggcgtttgttattggttaggggaggtagacggcgttttgattggtcgggttcgcgttcggggagtttcgtattttgtagtgttcgaaagattcgaaattttaaaagttttattgcgtgtttttgggaggggagggggcgcgttaggaaaggagtggaaaaaagtgggcgaggaggagcgttgaaaattttttgataagtagttttcgtgcgttcgagagcgtgtgaattgtttttaattatcgtgttcggtgcgtttttttgcgtagatttgtgtaatttttcggtttttggggcgtcggttcggttgtatcgtttttattggtttggggcgtttggtaaagtcgagttttttaagtggttttggagttttgaggcgggatggggggtaggtgataatttaattattgcggtcggggtaggggcgggataagggtgcgggggtggggaagggagggtgtttaaggtataaatgttaggacgattttttttgttttttttttgttatgtttcggcgcgtttttaaattcgacgagtttggggtagttgggggttgttttggttttttttttttgtttttttaaagtttagttattttattttaaaagttttgatacgatagttattttggagggtaagtgtggtttatgaagattttcgtgtttaaagagaagtttagcgaagagaaatgagattgtattttttgtcggtgttcgttacgtttttcgcgttttgagtttttttttttttcgttttttttttcgcgttttttagttttttttgagtttttttttttttattttttagtatttcgatttttttttcgtggtggtgggattttttttgtcgttattgtaaatgaataaatagttttttttttttttttttttttttttaaacgaaagtaaaaagtggtttttgtgttttcgtagatttttttaaatttaggacgcgtatcggtttgttcgattttttcggtaagagataaagttattgttgggaggttttttcggatagtttttagttttaattttcgttttattttcgttttgttttgatgttacggttttgaggaatagttcgttttgtagaagaggtaataggttttagattttgttttttttttgaaaggttgttgttttttaaatatttggaattaatgtcgcggttttcgggcgagtcgttttcggtttttgtagttttgattttatttttgtgtttttttttttttaatttttaaagttttgtttttttttttaattttgtttttttttttaatttttaatgttttgttattttcgtttttgttttttattttttttttttttttttagaataaagaaaattcgtttaaataatgaggaaaatgagcgtttttgtcgttttttttttatttttgatcgtgcgtttttgcgttgttttttcgaatttttaggtcggcgggaatttgggcgcgtagattcggttcgggtcgtcgcggttttaggacgtagtttatttcgtttggtacgattattgggtcgcgttttgttagtttattagtttttgagtttaggaatgggggtgggggaaggacggtgcgattaacgggtttttattcgaagatcgtagaatttggcgtttcggaagagttttggaagatgtttatcgggaggttgaggttggagggaggagtgggtgggggtgattcgttggaggatcgggcggagagtttttagaaagtttattaggtttcggcgcgagggcgtttcgatacggataaggtttatgatagcgataaaaagttggttattcgtttttagaaaatgttatttgttggagtttgtgaatgggtttaggagagagaagggtgttagttttcgcgagggtttttcgcgtgaagtgaggataagggagtgttttagggataatatgttttttaggagcgtaggatttagattttattttttaatatttggaggtttcgaggttaagtatgtttagtttcggttgtatttgggtaggtgagttatggggtcgggggaagagcgtcgataatcgtcggatttcgcgtaggggtcgttaggcgtttgtttttagagtttttttggataaagttttcgggaaattttattaaatcgaaaacgaaataaattatataaatttgtttagtttttgagggggcggtggtttaggtatttttttcgtttgaggttaggttatcgtgagatttttttatttcggatcggggatttcgtagaagttaagggtgtagttacgaggattcgggaattcgaggcggtttagtagatgcg

SEQ ID NO: 6535 - DNA, 824 bp, Artificial Sequence
  Description of Artificial Sequence: Synthetic polynucleotide
acgcggattgagcgaggaaatgtttaagattataggattgaatttttcggaagtttcgacgttgtttagttagttagagtttagtcgtcgacgcggatgaagttgttttttcgggataggaagggttaaatggttgcgcgttaattcggtttcgattggggtgttagggagtaagagtcgtttgtttcgggggatttcgtttggggggtttttaggggtcgttttggcgtttcggttataatttgggcggttttgtgcggcggttttcgtttgcgtttttgcgcgttatttaaaattttgcgtatattgtagtcgtcgttttttcgtttttcgcggtgagacgcgcgtcgttaagtgtcgtaggtagttttttatagtcgtcgcggtagtcgttgtttggtttttggttttagattttttttttattgtttttagtttttatttaggaggttttttcgcggtcgcgagagttcggcgttcgatttatagtaggtagtgcgggtatagtgttgtagattattatttcgttaggttcgggtagcgtttattagacggataggcgttcgcggtcgtttttatttcggcgcgtttatttcgagttttttacgtcgcggcgggcgggcgtaatatatttttttatttttagtcgtcgaggattatatttttcgtttagttttttcgatttatttttcggttgtagtagagggcgagcgggtttcgtttttgttttttggggttggtaggttcgtgtggggttagggcgcgcgggagacgtcgcggagttgggtatttcggagaggggatgtttatttttagcggtttcg

SEQ ID NO: 6536 - DNA, 824 bp, Artificial Sequence; identical to SEQ ID NO: 6535
  Description of Artificial Sequence: Synthetic polynucleotide

SEQ ID NO: 6537 - DNA, 1415 bp, Artificial Sequence
  Description of Artificial Sequence: Synthetic polynucleotide
tcgcgttgttagaagtcgacgttagcgagggaggtgtgaagagttggttagaatgattaattttttttttatatttattttttttattatcggtggttcgttgttgttgttttgcgaggaagaggagtcgtgggcgggtcggcgtatttcggtgttatttttgtattcgggtttggttatcgggggtacgttggttaacggtatggttatttatttcgtgtcgttttttcgaaagttgtagattattagtaacgtttttatcgtgaacggttgcgtcgtcgattttagcgtttgcgttttttggatgtcgtaggaggcggtgttcgggtttttgtttatcggttttgcggagtttttcgtagattgggacggcgttgggggtagttatcgtttgttacggggtgggttgttgggtttcggatttacggtgtttttttttttttattgtttcgtggttttgaatcgttatttgtttattattcgggcgttcgttatttattaggcgttgtattagaggcgttatacggcgggtatgttggcgttgttttgggcgttcgttttgggtttcgtgttgttgttttcgttttgggtatcgcggttcggcgtcgcgttatcgcgagtttattattcggcgttgttggtcgtcgcggcgttgttggcgtagatagttttgttgttgtattgttatttgggtatcgtgcgtcgcgtgcgtgttagcgttaagcgggttagcgtgtttaatttttatttgttgtattagttgttcggttgcgtcgtcgtcgtcgtcgttttttcgggcgtttagtacgcgtcgggtttcggtggcgtcgcgtattcggcgtaggtttagtttttgtcgttcgcgttgtattcgcggcgggtatagcggcgttttagcggtttgtcggtgttgttgttttgttgcgtttttttgttggttacgtagttattggtgtgggtgagtttggttagcggtttttcgttgtcggtgttttggggagtgtaggcggttagttggtttttgtgttgcgttttgttcgcgtttaattcgttgttttatacgtggaggaacgaggagtttcgtcgtttcgtgcgtttagttttgtcgggcgtcggcgacgcggcggtcgttgtcgttgtcgttatagtcgtgttcgtagtgttttaggcgtaattgggtattcgcgtcgcgggttagtattggtaatttagtcggggttcgagggaagcggagattttcggttttcgacgtttttgggtatcgtcgttttttttttttttagggtattttttgtttgaacgaagattttcgtcgcgaagttcgatagatcgggggaaaatggggttttcgattttagcgggttatttgaattaaggcgtttttttaagtggggcgttcgaagttattttggacg

SEQ ID NO: 6538 - DNA, 1415 bp, Artificial Sequence; identical to SEQ ID NO: 6537
  Description of Artificial Sequence: Synthetic polynucleotide

SEQ ID NO: 6539 - DNA, 3039 bp, Artificial Sequence
  Description of Artificial Sequence: Synthetic polynucleotide
tcgcgggattagttttggtttttatatttcgttgtagttttgtttcgcgtcgtattgtttttttcggttattgtggggttattaagcgatttgtagaattcgttgaggtttaggtttttgtagttttcgtcgaagatttaaagttagagtggatataaacgtcgtgggtaggatttcggtgaggtttcggtgttttttttgggggtttttagcgttggtttagaagttttagttcgggtttaagaatttgggatttttttcgattttggcgatcggtcgggttattcggtttagggttttagcggtagcgggtaaaattttagtaggagttttttgtcgagggcgtgtttcgacgttagagttaaattcgggatagattagttaagcgcggacggcgcgagagtggttggtagcgttagtacgtagtttgggtttagagtaaggttgggcgtttttagtaaagggcggtttggggttgcgcgggcggcggattgtaggcgggagaagagcgaggtgcgttaggttttggggcgcgtaattgtttagtttcgtgaaagatcgcgtcgtagatggggcgtagttgcgcgtttattcgtgtggattggaaacgtttcgagtcggttattttaaaaatcgggaaataaggcgggtttttttttcgttcgttattttttattaagtaggttgtgcggttttgggggttgattgtttttaagtagttaggttttatcgcgcgtcgcgttgcgtcgaggttcgttttgtcgtagggacgttggtagttcgttgaatatcggtaagagcgttagaggttagcggtcgttaggatttttattaggttttgttcgtattcgtttgtttttttttcgtttggtttgtttttcgtttaattgaaatcgttaatttttttatttttttgtttttattttgatatattttacgttttaaatatgtttcgtttttttttgtttagtttgttttttttttttttgtttttttttttttttttagttattcgtttcgttcgattttgtttttgttttttttattcgttcgttttttatttatttattttagtttattttagttcgtcgattgttatttattttttcgttttcgtcgcgtttttcgttgttttgtttaatttttttttttttttttttggttgtcgttcgttttttttggttttttttttcggtatttcgttgttaaggttatttttgtcgtcggatttcggggtgttgggtttttttcggtcgttcgtttcgtattagcgttttttgtagttcgcgcggtatcggtgtggttcgggggttcgagttgtcggtgtcggatgcggcgcgtttagtagggacgcgggtttgggggggtggtttttgttcgacgcggagcgttgagttaggtcgggtatttgtttttggcggtgtttatcgtattgcgcggtttttgtcgtttggttgggattagaggagttaggttaattgttttttattaagttttaattgtggtttttattaggaaagttttttttaaagggtatagatacgaagtttcgcggattcgtttatttttttcgttgatttatatatattttttcgtttttttttatatatttttatcgtttcggttgggcgaaagtcggagatgttcggttatttcgtggaggttcgcgaggcgttagtcgggcggcggtagggggttgaggcggattttggaggatttagttttgggtttaggttgcgggatatggtagcgtagataaggtgggtgtagtgcggaagtcgagacgttttataggttatagggtgcggcggacggtcgtagagttgtcgattagtttgttaggtttttgtttttaggcgtattttcggatgtcggcgcggtttagtcggttttagtatagggtatcggttcgtgagttcgcggcgttagggggttaggttgtttagggttgtttttgattgtttagcggtgatgatttagcgcggggaagttaagattgttagaagggcggttattatagtgtataacggtagggaggttagtttagtatgagaaataagaatatagttatttcgttttgaggatagttttggtattgtacgattagtcgcggttagattgtgttagtttgtcgtataggtagtattttttttgtgaaggttaggttcggggaggagagacgggttaagattaggtcgtagtttttagtcgatttcgatttgattattttaggttgaggtttagttttagggtttttaaagggcgttagatataaaagtcgcgttttttcgttaggttttagtgtggttttatagttttcggtcgggtttgggttttagggtaggtggtagttttagtttaatttcggtagagtatgtttttttttttttaggtttaattgttttcgggtttcgattggatttcgggtcgtcgttattgtattttttttcgatttttcgttttttattttcgtcgtcgaggaacggtggtttattttttcgttttatattggtttttgtttggttcgggttagcgttaattcggttttcgtggaagtcgtggcgaaaggcgagaggggtaaaaagttgagaaataggcgagcgggagagataagtaggaaggttcgggtgggttcgggtaaggaagaagaagagagggtcgggttgcgcgttacgtttcgcgtcgcgcgttatttttcgcggggttttcgtagaagtggtcgtcgttgagggtcgggtcgggttcgaggttttgtaggtatttggcgggcggtttggtcggttttgggaggtagggttttaggggttcgtaggtcggaaagcgggttagtcgcgggtcgcggggcggcgcggggtgtaggtgaggcgtagcggcgggggttttttgcgggttcggaggttcgtttttcgaggttatataggggtcgggtgtaggttttacgcggaaaggcgcgtagtgttcggggtttatgtcggtttagggcgtataggttttcggggtttcggggttcgcgttgttcgcgtcgtttgtgagcgttcg

SEQ ID NO: 6540 - DNA, 1277 bp, Artificial Sequence
  Description of Artificial Sequence: Synthetic polynucleotide
tcgttttacgtttatttttttcgtttacgtcggttattagagtttcgttcgttgttcgagagtttcgtattgacgtcggttcgcgcgtgagttaagtttgcgttacggcgtttcgtcgttagggtggtttttcggaaagcgagggaatagtgcgcgtagcgtttcgtttagtttcgttttgtttcgtagagtcggcgttgttagggcgtagggagggcggtattcggttttagttttcgtaatttcgcgcgtttttttcgtcgtgggatttgggttttcgcgtcgtttttttgagtttcgagcgcgcggcgggcgggagttaggttgggattggtggtgaggtagggagtgaggagcgagcggagtcgcgtgcgtcggcgcgtagtttcgggtcgttttagttttagtcgggggtttgtggttcgggggaggagttgtgcgttcgcgattcgtcggggatcgtagttgttcggtcggagtgtacgggtcgagtttgcgcgattatttacgcgtgataggtgagtcgttggtcgcgtttcgtttggttttatcgggtcggttattgtaattttttttgttttggtttcgttttagttagggagggttgaggattaaggtgtgaggcggcgttgttttcgtattcgttcgattttgcgttcgtttcgggtttttttcgtcgttttagtcgtcgttgtttggcgacggagtttcggggttcgttttttttcgcgtatcggggtttttagcggcgtacgtacgggttggatatcgggttttagtttttggtgtttagaagggtttaagaatttcggaggaaattgggtttagttgcggaggtaagcgttcgcggagaatcggagggggtttgttcggtttattcgcggtttgaaattgcgcgtttagggcgtagttttattgggagttttttacgtagttggagattttagttttagtcgttcggttttaggtttgtgattttgatagtaatattggtaagcgaagtagaattgttacgttcgagatgaatatttaatttttagttttggggttggttttcgttggattcggagttagtagagagttttttttttttcgtgggaagcgtatttggggaacggaatggttgagataggggacgtgcgtgtggtgtttatttggagggggcgtcgttttggcgggtcgagaggtttttgttgtatttatgtttgtgtgcgtcgtgttttgaagcgatgttggatgttcgtagtattatgggtgggtcgttttttaggggcgcg

SEQ ID NO: 6541 - DNA, 2394 bp, Artificial Sequence
  Description of Artificial Sequence: Synthetic polynucleotide
gcggttcggtttgggttgtttcggtgtagcgcgtttcgtatttggtttcgtcggtttattttcggagaaattttttttgttttgtcgtggtttatagggttgatttttcggtattcgaaacgttagtagttttgggagtttagcggagagtcggagttattttggggttagtgacgtttttcgttgataagaattttaaagttgttttagttttttttttttttttttttttcgcgtttaattttgatattattatttttttattttttaggtatttttttaaagtcgtgtcgggattgtaattcgtttttcgatttagttggggtcgggttttatttagttagttaaggggcgagttagcgatgcgaatatcggtttggggggtacgattttcgtttacgtttttcgtaggcgcgtaggggatttaattttatatattttattttcgaattacgaggaaaaatattttattttttaaaaaaataatttgttttttatataaatcgttatttaaaaatatataaataaggtttaagtataaaatttaattttggggttggcggtggagggaaggtgagggagggggttttggtatacgtttttcgtgtgtgtttgcgcgacggttgatgagggcgcgttagggattttggcgtttaaggagatggggttgtagggaggcggacggagagcgttttaggcgttcggtttcggttttgttttaatcgtagagcgcgttttaaagtcgagggtagttttaggtgtcgttttgcggttttattagttttaggagattagggcgggggatgttaagtgttggtaggcggggaagaggttaagcgtcgagtcgggatcgaaggtagggtagttcggtagagggtaggcggcggttggaggggcgtcgtattttttttgggtcgcggcggtttttatttcgttatcgtcgtcgtcgtcgtacggttgttcgtcgcgaataagtatcggtattattacgcgacgtagtaggtcgggcgcggcgtgtagttcggcggatgttgttaggttaggcgatttcgtcgtttttggagcgcgagcgcgttttagtttgtagcgatgattttggaattagattttgatttgcgtgggcgtgaggcgaagtaggttcgttagttgttcgcgttcgggcgtagataggtatcgttgttgtcggaagcgtcgttttaattttagcgtttgcgttttggagaatagtattcgtcgttttttttttttttcggcgttcgagttcggagacgcgggtttagcggacggtcgttgcgacgagtttggcgggttggtttttaggttgttttcgttcgaggttagggatagtaaaggagatacgggtgggtgagacgtcggattttacgagggtttgttgtttttttggcgcgggcgtggaggtattggttagagggtacgtttattagttcgagattttcgggatgaggttattttttgagtttatatttggatatttattttttcgaatgcggtgattttatttatattatagcggttattagcgggtttgagatcgtgtttcgaaaaaatttatttcggggtttttttaatatgttcgtatcggtagttgcgttggtcgattagtttattataagttgggttattagcgtcggttttttttaggtcgattgtattgtagtgtgtcgaggtttgcggagttttgagtgggaacggggtgggggtaaattcgttaatattggttattttagacggaggtttggagatcgtggtcgtgtttttaggtatggagagggggcggggggtggggtgggggcggtaggtggcggcgcgttttaaattttaattatttcgatttttagaaatcgttagatatagaaattttaaatttcggagtattagtgttaggtagggatttgtttttaggatgtgtcgatcgggatgaatgcgttaggggttcgaggatagggttttcgtttttaagattgaggaaatttagattttgggttgggatttcggtttttcggtttttcgtgggttgggtttttgattttgttgttttacgttttttattttttatttcgtatcgtaatttattacgtatttataagggtagtggtcgcgtttcgaatttagttaggcggcgtaggggtcgggttggggggcgcgtggttttggttttcgtttcggtaggtgttgcgcgttttgttcgggtaaatttagaaggttgcgtacggtgaagtttaggcgtttagaggtggttatggtcgaggaggggaaggaggcgggggtagggtaggttgggaacggaggggcggtcgggacgtcgtttttacggatgggcgtgggaggcgttcgttatgcgttggtagtcgggatattagcgtatttatagcg

SEQ ID NO: 6542 - DNA, 1627 bp, Artificial Sequence
  Description of Artificial Sequence: Synthetic polynucleotide
tcgtggggttacggttacgttgttttgcgttttgggtattacgttttttagttataaggtgcgttggagtaaggtggagtttggggagtttcgggaaacgttgatttttattattaacggattgtacgttcgggggtatgggtttttgggagggcgcgttaggatgcggagggggtatcgattagacgtttttttggttatcgcgggcgtgcgtttggaggacgagggtcggtatcgttgcgagtttattaacggtatcgaggacgagagcgtggcgttgattttgagtttggagggtgaggttttttcgttttcgttttatttttgtgtagtagcgggttcgtttcgtttgggttttttagggtttttttttagtatttttttcgtatttttggggattttagtttttttttttaggtcgcgtcgtttttttttttttttcgtttttattcgttggttttttttaggattttcgttattttttaggtgtggtgttttcgtattaatttagtcggggtcggtattagtttaattattacgaggcgaagtaggcgtgcgaggagtaggacggacgtttggttatttatttttagttttattagggtgagcggtcgaatttagtattttttaagtttcgcggagttgttttaggggttcgagagagggcgttaggcgagtttagtttggtttttgtttatgacgttttttattttcgattttcgtcgtttttcgttagtttggatcgagggtttggattggtgtaacgcgggttggttgttcgagggtttcgtgcgttattttgtgtttatcgtacgcgtttcgtgcggcggtcgaggtcggttcgggattcgtagttacggatttcgcgatcggatgcgcgatcgttacgacgttttttgttttattttcgcgttggcgggtgaggcgcgggacgaaggtagggttttggggaggggtttgaaaaatgtgggggacgaggagtggattttagtttgagattagggtagggttttcgggtttttttaaggtatcgtttttttattagttcgttcgttcgtttaggttttagtttatttttttaaattttttttgtatttttgtttcgattttttaattttttttatttaagttcgatttagtatttttgcggtttcgtattttaatttcgttttttgggtgttagtcgttttttttcgtttattttgttttcggtcggtgattcgttgtggtttttaggttaagtgtttttcgtgttcgggcggttgacgttgtttgaagtttacgcggcgtgtcggcgacgcggcgtcgtggtggttaaggttgggtatttttacgtcgtttggaagttttcggggttagattagtgcgacggcggttggttggttgacggtagtgtgcgttttttaattattacgtcgaggtcgcgttgcggggggttttcggatttcggagtgcgtagtttcggtttttttaggttttaataggtagtttatgggatttattgttacgtcgagaattaggcgtttatcgtgttttttttagcgcgcgcgaagaagtttgggagtcgtggcgggggtttttcgttattttttttcggagagttttttttttttttagattcggagcg

SEQ ID NO: 6543 - DNA, 271 bp, Artificial Sequence
  Description of Artificial Sequence: Synthetic polynucleotide
tcgttcggtggttgtcgcggtttttttcgcgttgttttttacgtttggtttattatgtacgaggtaggtaatttgttttttttttcggggatttatttcggagataagaaggtagtttgttttttgtaatggtttttgttggagtgcggcggggtttaggcgcgagcgggggtacgggcggggagttggtagcgaaggatgcgttcggcgtttttcggcggtcgttcggagttcgaggtcggcgcgggaggagcgttgatttcgcgggtcg

SEQ ID NO: 6544 - DNA, 884 bp, Artificial Sequence
  Description of Artificial Sequence: Synthetic polynucleotide
acgtcggttgtgaaatttattgaagtgagcggcggcgttaggatttttgggatttcgatttttttgtagttcgtatagttaagggcgagggcgtttttcggtagaagtagtaaatcgtcggtaagtttagcgaggagggttgtcggggtttgggtttgggaattggttggtatttagcggaaagggacgtgagttgagcggcgggggagaagagtgcgtaggttagagggcggcgcgtagcggcgtttcgcgaggtttttacgtcgggcgatatggggtgtttgttgtttttgttgttttgggcgtttttttaggtttggggaagcgttgaaggtgggtggaacgagggcgtttgagtgtattcgcgggagggcggagagagggagttgggtagggacggggagggtaacgtttgatggggattggtgagattcgggacgtattggcgcgatttaggtagaaaattcgttgttttttggtttcggggagaggtagcgcggtatagagttcgttggtattagtcgttttttgaagtttatttttttttgttttttttttttttttttttatgttggttgttttttcggttatttgttatacgtttttaatttttatttttttttagtttcgtaaaggttttttttttttcgttgtttttagatttcgtttttcgttaatagtagttggacgcgtatcgacggtttggcgtggttgggggagttgtagacgtatagttggagtaacgattcggatatcgttcgttttttgaagttttggttttagggtacgtttagcgattagtagtgggagacgttgtagtatatatttcgggtttatcgaagtagttttattagggacgtgaaggaattcgttaaaatgttacg

SEQ ID NO: 6545 - DNA, 1007 bp, Artificial Sequence
  Description of Artificial Sequence: Synthetic polynucleotide
gcgacggtgttcgtgcgtttttttattagtgtatgtgcgaggagggttggaggtatgagcgaaagagggaaggtaatttcggtttttaaaaaatttaggggatttttttttttagtataagcgtttatacgtgcgttcgcgcggatatatatatatatatttatatttatatataaataaatttttagtatttgtttcggaaagttttttttcgtaggttggttcgaaggcgcggtttcgttagcggagagtttttggatttatcgtggtattatttttaattaattttgcggcgcggcgcggggagcgtagggtgggttttaatttcgggttcgtttgacgttatttgggaacgcgcggcggcgcggggcggcgcggattcgggacgatttcgtcgcgatttggtttcgttttcgttcgcgcggggttttgtttcgcgggaattaaaggaaggagaaatgttagtatatttttaattggaaatcgagttttttttttagagcggtttgtttatttaggattgggtattagaatttaggggaggttttaattgaagtgacggttttggagattatggggaatatatggttttatcgtcgggttttttatttgtatttttttataaaattgtcgttcgtgtgtgtttttgcgtttggttttttgtatttttaaggggtttttgaagatagggtcgaatgcgcgcgggggttttaggtattttgcgttttacggcgggtttcgtagttcggttcgagtcggttttggaagtttcgttttggattagattggtatcgacgtcgtttttagtttgagcgttgagagggaaaacgagagttagaaaggaaagaaatcggattggtgattgtttggtaggggtgtaatttaaattgttgtgagtagacggtaggagggagttgttaaggtaacgggtgatttttattcgtcgttttttcgttaaggttggggagagggaagttttcgcgtgttgggttagggttaagttcgcg

SEQ ID NO: 6546 - DNA, 2191 bp, Artificial Sequence
  Description of Artificial Sequence: Synthetic polynucleotide
tcggacgcgatcgttcgtagtttgcggtttttggcggttgaggagtcgcggcgatttttggtttttatcgtagtagttaagttcggcgcgtattaatcggcgttgttgaaagttggagagtttttagttcgtcgatagaattcggcggtgggcgttaggggaattttttttagtgtcgtaattaggaaagttttaaaaagtaaggattttagatagataagagatttatttttttttttagtataagaaatatttcgcgtcgcgttagtcgaacgttgttcgtataaggttattcgttttttttggtcgggacgtattcggtgttttttagttttttattagaattggtttagggggcgcggaaatagagaggtaattgtgttcggtttgtggttttagacggaaacgttttcgggttttttggttcgggggataagggttcgaaattttaatagtcgcgagggtaaggatagaattattaattttcgttcggatgttcgggatttgtttttttaagttcgtttcggtttttttaaaggacgcgcggtatagtttatgcgttttcggtattttattttatttttttatggttttttttaaatttttttcggggagttttataaagtatagacggcgttttgaaattcgttaggtattcgttagttatttttattttcgtttttcgaattttttttgtcgcgtttttttcgtttcgtattttttttttcgcgtttttgggaagttagaagtaaattacgagaaaatgttttcgtaaggagtttttttatattcgttttgttattgaaataaaagcgtagggaggagggaggtgggagaggaggcgggaggaaggtttagaaagacgatggggatagtagtaggaaggagttggggaggggggttaaggtggtaagtagagttgggggtttagagttcgttttcgtgtcgcgcggcgagtcgtttatatgtttaggtcgttgtaggtgttgaagaattttatttgattgtacgtttgaatttagtttattatttaggtttcgtggcgggggatggggggtatgattacgcgggcggaggttttgaagtagggggttttgtagcgtaggacgatgggcgaggttttttcgatgcgcgtggggtattggtcgatggtggcgtatatatcgtatattacgatgttttcgcgtcggattcgcgttttgtaggtgatgttttggatatagtttattttgtagttcggtgtcggtacggcgcggcgtggggtagcgcgggggttcgcgcgggtagtcgggggcgttcgttacgtcggtatggcgacgcgtcgttcgttttcggttagatttagttcgtatttaggagcggggagtcgtcgggtatttttggggaagttttttttttttgtagtcgcgcggggttttcgttgtttcgacgttcgtttacgttcgttttttcgtttcggtagggcgcgcggagggtgtatttttaggaggcggcgggtgttttcgtcggttttagcgttcgggcggagggtagggaggggagcggcgttgcgaggaatggtgtttatttcgggtcggagtttttcgtttttcgtcggagaggaggaggcggtagcggcggcggtatggagtcgggggagggcggcggtggtagcgttcggtttgtttgttttcgcggcggtagtagtagtagtcgtcgtcgtcgtcgtcgttgtatgaatttttgtattacggttgtttttcgcgtgtagcgtatttagcggcgggcgagcgggcggtttaagaggtaggcggaggtagtagcggcggcggcggcgatcggagttttcgtcggtttcgtttcgtagtcggattatatcgatatttttcggttcggttgtttcggttcggggggcgttaggaggttgtggttcggggtggagagttttaacggttggagtagtataggacgtgtttcgcggaggaaattggttgtacgttatgagttttgtttttattcggttgtcgttcgggtggggggggggtaatgtgtaagggtgggggtgtttaaagggtcgttagcgtcggggtggggtttcgtacgtggggttgaggcggggcggggttttggtaggtggtgttttggggtgggggtgggggattagggcgggtttaagcgttatcgggtgggtgaggtcgagtagggcgcggcg

SEQ ID NO: 6547 - DNA, 859 bp, Artificial Sequence
  Description of Artificial Sequence: Synthetic polynucleotide
acgtagaggtcgtggtatttggtcgtagttgggttgtagtgcgtgcgcgtttggtttggtggttcgatgggaagttcggggcggggtagtcgcggggcgggggcggggcgtcgcggagataggttacgtttttgttcgttcgcgtaggcgcgttgcgggtcgttagttgttagagttaagcggcgggttggcggcgggtttcgacgtttgcgttaggatttggttggttgagttcggcgtagtagtagtagttagggtagcgcggtttttattttttgttaggtcgtagaggcgagtagggattagttggtcgtcggtttttcgggtaagatggggaatcgggagatggaggagttgatttcgttggtgaatcgtttgtaggacgcgttttcggcgttgggatagagttgtttgttggagttgtcgtagatcgtcgtggtgggcggttagagcgtcggtaagagttcggtgttcgagaatttcgtgggtaggtaagcgcgtagggcgcggagtaaggatgcggtagtggggcgatttcgttgcgggtcgttggaacgtggacgggtagcgggagttagagggtggatggattaggcgttgcggtggaatggggggtagagtggaatggggggtagagtggcggtgttcgtggggcgggcggggttttttagttttgggtatttttcgttttttgttatttttcgtttggtggtttttttgtttgttttttatcgtgcgatataaagttattttttttttgttttttagtcggggagtcgggggaggggttcgtttcgggttcgatttttattttttcggtgcgcgttagtttcgggtagtttttttgcgtagcgcgtcg

SEQ ID NO: 6548 - DNA, 791 bp, Artificial Sequence
  Description of Artificial Sequence: Synthetic polynucleotide
tcggggtattcgtgtgcgcgcgaggattttttttgtagagaatgaaattatcgttttttttcgttcgtggtttatttcggggtttttattttacgtaagtgttgtggaatttcggggtgatgagtttcgggggaagttagtattttttgttttttagtgtcggcgttcggtagagtttcgggatttttagtttttgtcgtcgttgaggacgcggcgcgggttgttggtcgcgtcgtcgagggagggttcggatagttttgtagcgcgttttagcggagttttgggggtcgcgtcgtttttttaaatatgatttagaatcgttcgttagttttggttttagcgtttggcgcgagcgaatcgggtttggttgtttcggtttcgtttgaattttgcgggtcgcgggttagggcgcgtcgggattcgttgcgttaggattttgtagattcggtcgcggtcgggtcgagtgtttttcgtcggggttttacgtttacggtttacgtttgtaatattagggttgtacggcgggttcgtagttgggtttgcgtttgggattcggggttttttgcgtttttcgtgtcgtattttttgttttaattttaagcggacgggttttggggttttatcggttaggtcggagttttagttttataatttttttttttttatcgtattgttttttttgcgttgtggcgggagttggggattggggtcggagaaaggagacgcgtcggtttttaagttttttgagttatttcggtttcgggcgcgttttttagggttgtagtcgcgcg

SEQ ID NO: 6549 - DNA, 586 bp, Artificial Sequence
  Description of Artificial Sequence: Synthetic polynucleotide
gcgaagaggagggagtttcgaaaggagggaaacgagtcggtaaggggcgataggagcgagtcgggaagggagagtagcggagggttgtagagttgcgggcgttcggatcgtgttatatatttttcgcggggtacggagggtattgcggggggagatatataaagatatgcgaagaggggttgaacgaggttcgcgtataaagacgtcggggcgtacggtagttggggttgtatttatcgttttcgcgtcgcgtcgtgtcggggtcgggttagcgagtagttcggggttgagcgcgtggcggcggcggcggcggcggcggcggcgggtaggcgcgggattcgggtcgttcgcgtttttcgggtgattcgggttcggtagtaggcgcgcgcgggggcggcggcgtttaagtttaatttggttttcgtttcgttttttgtttagttcgtcggtgttttttttttttcgcgatttcgtttttttttacgttttttttttcgttttttttcgcgtttagtttcgttttttttattttgtaaaataaagtcggggaaaatgtttgttcgtgtagttcggagcgcgtagttcg

SEQ ID NO: 6550 - DNA, 1678 bp, Artificial Sequence
  Description of Artificial Sequence: Synthetic polynucleotide
tcgataggcgaaattgtaagaatcgggaggggcggttgcggcgtttaggcgcgaggtatatattatattttttcgtagttttttattttttttagacgtacgtgtttaaagagtttttgttttaatcggtttcgttttattttcgttcggtttttagttttgtttgtattgttggttttaagtttttttcgagaggcgggcgtgtatagttgtagtggcggcggtagcggttattaagcgttcggcggcgtttcgttatttatttttttttagttttcggcgttgtagttttcgttcgtcggggagggcgcgtttagcggaataggagtcgagggtggggcgtcgagaggagggaatttcgggtcgtatcgttatagttttcgtagtggtaaaggcggcggcggcggcggcggtagcggtagtagtaggtggagcgagttatagcgtttggtttgaaatttattgttgtagttattcgggttggagttggttcgttgggtggagttagtgttcgtttcggttcgattttcggttttcgggatatttgggttgcggaggtcggttggtcggagttacggttggggacgggcgcgtttcggagcgtacggttgcgttggaagtcgcgtttggggcgtaggattaacgggatttattttttttcggttatttaaagattttttttttcgggaaagagcgttgttcggttttgggatttgggaggagttcggaggtcgttcgggtatttcgttggatattattcgtttgcgtttcggtggcgcgggagggttcggagcggagcgttcgtttttttttagcggtttagtggagaaaagtagagagttttttttggggcgaatgggattttttttttcggtttttcgtggagtcgtcgtatcgtttgtcgtgttggtttcgaggggtttatagtttggtattaatttgtaggtgttcgttgttgatttggtttttttttcgatttgcggacggttttttttagcgattttcgatatacgtttttttgttttcgtcggagggtcgggtttggggtcgtcggagtttgcgggaatttagcgtttattcgttgattttcgagtcgtttcgttagttgtgcgtttttttgggtattagtttggagaggagcgtgtagacgcggttttttggagggagtgcggttttttagggaggtatcgggtttttaggggttttttggcgtgtgtggtgggattggggttcgtcggttatggtttttattttcgttgcgttttgttatatgttgtttttggtgttgtgcgttgcgtttatttttttcgttatttggtacgtgagtaatacgttttggttttttttttttcgttttaatttcgttaaattttttcgattttattttattttttttattttgcgggcgtgggcgaatcggaaggttggattttttgtcgttttattgtttcggggtaggaggtagttcgttgtatttcgtcgggcgcgttttcggtgttttggttggaggcgaggggtcgttggtgtttaggtaggatattttttgtagggttcgattgggcgtttcgggtttcgggcgtcggggagtggcggttataattataattaatttttttttttttcgtttcgtttttttttgtcggcgggaggcgaaggagaagcgtcgtcgtcggtttcg

SEQ ID NO: 6551 - DNA, 1600 bp, Artificial Sequence
  Description of Artificial Sequence: Synthetic polynucleotide
tcgacgatattgttattggaaaagtgttggttacggttttcgttttattttttttatttacgggttcggagtttttaggagtagttagatcgattatcgtttttgtagttttatttgttttcggagagatatttataagttagtttacggagagtttggattcgttcgttttagtatttacgtttttttcgcgttcggttttagcgtcgttttcgatatttattcgcgggtagttttttatcgtcggtattttcgaagcgcgggggcgggcggtttcgtagcgttgcgttttagttcgcgtcggtttcgttttttttcggtttttgtgcgttcggggcgcggggcggtggcggggcggtttttgggggtttcgggggttcgcgttcgtcgttcgaggaggcggtcgaggaggagcgcgaggcggtcgaggtgttgtagaaggggttttcgtcgttgttcgggtcggattcgtcgaatacgtcgttcgagatgtgtaggttttcgtagcgcgcgcgggtagtttcgagtagcgtcggcgttttttttcgcgcgttttcgtcgttttcggttatggtttcggtcgtcgttcgcgcgttcgtttttatagtgttttttagtcgtatacgtcgggttttgggttcgcgtcgcggttcgtcgttttttattagcgtagttcgtagtatagcgttcgtcgtttcgtgttcggtcggttcgtcgttttggtcgtttcgggtttagcgttcggggaagcgttttcggagttcgggcgtcgtaggttgcgggtcgcggcgggaggcgagtcgcgcgcggggttggtaggggcgatttagagcgggcgggacgtagaggttgcggtcgagattaggcgtcgtcgtcgttatcgtcgttattatcgttattatcgtcgtcgttgtgttttttcggcgttcgtcgtttttttgttcgttttttttacggttttcggcgttcggttgtcgattttttcgggcgcgagtcgttagaggcgggttttgtcgttttttatttttcgttcgtcggttaatggggagttcggttcggatagtcgcgggggagttgggcgggttcggcgcggggaacgtttttattttttttcgcggggcggggcggggcgcgcggtcggggttggcggttagggggagggtcgtcggcggtagtgtcggtttttttttatagggacgcgtagttcgggatcgttacgcgtagcgcgggagggggagggcgggatcggggaataggaggggagggggattcgggtgtttttagcggttcgggttcgcggacggagtgcgggtcgatttcgtttattgttttttttcgtagttcgcgtgtagttttagggagttgttcgtttcggtggttttgaattaggcgtcgtcgaaacgttttaggtaggcggcgggttcgaggttattatattcgcggcggcggttgttgtcgaggttttttgggggttattgttagttgcgtcgtatgtttttataaatataggggttgtttagtttttgggaatttcgttttaattaggagttcgtttcgtcggtttattgttggtcgttggttagatgttaatttcgtttcg

SEQ ID NO: 6552 - DNA, 2394 bp, Artificial Sequence; identical to SEQ ID NO: 6541
  Description of Artificial Sequence: Synthetic polynucleotide

SEQ ID NO: 6553 - DNA, 1160 bp, Artificial Sequence
  Description of Artificial Sequence: Synthetic polynucleotide
gcgcgttcggtgttttaaggtttttaggcggagcgcgggcgcgaggtgcgggtttcggggcggagcgtacgttcgggaggcgggaagtgggtagtagcgttttcgtttggtttttgtgcgtttcgattcgacgttttttcgttcgattaggtgtttcgagagcgtatagttgggagggttttttcggtcgcggcgagatttacgtttgcggtgtgttagggcggcggcgacggtgacgggcgtggggcgcggcgttgtttcggttgtcgggtcgttgcggcgagcgcgcgggtcggtttggagttatcgggttgaatcgtcgcgtttgtatcgtgtcgtacgtcgcggaggcgttcgggtatagatcgcgcgggcgcgtataaagcggttcggggcggtcggcgcggcgtagattttcggtgggtagcgtattttagtttttttaggttagcggttgtagggagtttcggttcgcggttttttcgttttaagtttgggagttgtcggttttattttgtttttgtttatggggattcgagagttttttagcggcgtatttaggggtaagagtattgtcgtgtgagtagcgtttcgggcgtgggtgagcgagtcggcgggcgggaggtcggagcgtcggggtagttttttgtagttgggatattgggtagtttgaggttcggggaagggcggcgcgcgcggtggagttgttcgggaagttttagttattttttttttcgttattcgttttaattcgtattgtttcgagacgtttaggatagggtattggggatagttgttcggggaagtgggtgagtggcggcgggaagggaggagcgcgggttttgtcgcggcgttcgttttcggagggtttcggtcgcgtttttgttttcgttttgggatttgttttttacgaatttttttttttttgtttatgttttttttgtttatttatttgttcgtggcgtttgcgatcgtagtggtatgaggaggttatcggacgttagttttcggagattgttcgatattagtttttagtttcggtagtttaagtatttggtggtggacgaggcgattaaggaggatttgaaatggtcgcgtttcgtggaggattttattagcgggtcggtggggtttacgtttatcgaggagcggattttgcg

SEQ ID NO: 6554 - DNA, 588 bp, Artificial Sequence
  Description of Artificial Sequence: Synthetic polynucleotide
gcggggttgggcgtttcggggaggagggcggagtaggtgagttgcggggtgggagtagggagtgtatttgtacgtgacgttggagtttgtagtaatttttaagtaggaggttgtgcgcgcgtgtgtgtggagtggttgcgcggtcggggaggatgtgcgttgtagggcggtcgtcgtagtgagtaacgcggtaatcggagttcggcgggtagtcggggaggtcgggattgagaggggcgagtcgttggtgtttttcggcggtagagggtcgcgtcggttacgggttcgggagagacgcgttttagtcggttttaggatgtaggcgatcggcggtagcgtttttgtaggcggtcggtttattatgaagaagtattcggttcgggtggtttcgtttagcgtttgtaatagttcggttttgatttttattaaagtggaaggtaatgcgcggtcgtttcgtttcgggggtttttgtattttagtcggggaatgttgttattttgaggggggttgtttggttgcggggcgtcggggttgggggtattgtttttttaggacgcggtttcgtagtgtagagcgtcgtcgtttgcg

SEQ ID NO: 6555 - DNA, 878 bp, Artificial Sequence
  Description of Artificial Sequence: Synthetic polynucleotide
gcgattcgcgattgtagtcgttttttaaggttagtttttcgttcgtagtttgtttcgggcggtagtcgtgttagtttttcgttaggattcgtttagggggacgtgggtatcgggtaggacgcgcgttttgggcgttggggacgttcgggatattcggggtttcgttttgcgttttagtttcgggtcgcggtatttcggttttcgtttcgcgtttttggagggaggtatcgagggacgcgtagcgaaggggttttgttaattgttaaagtaggaagtgagttcgtggaagaagcgaaggaggagaagaagaagggaggggaaggcggaggagggtaggggcgcgtagagttacggtttgttttaggcgcgtcggaatcgtaggattttttattttcgtggttttacggttttttcgcgtttcggaggtttgttagtttcgttcggacgttcgtttgtttttaattcgtcgttatggttttatcggacgattttttgcgcgtaggtaaagggatatagcgtcgcgttcgtttttggagcgagtatcgcggggcgggagttcgggaggcgttcgtagtagtcgtagggttatcgaggtcgggtttcggcgattttcgagggaggttcgggaattattttcgatttaggcgttagattcggagtcgtacggggtttttagtttagtttcgcgagcggttgttgatcgtttttttcgcgttcgttagggtttttgtttcgcgttagttatcgcgcgttttttttttgtttatgtcgtagttttcgtggtttttgttttggattcgggatgttaggttgagatacgttttgtaaatttttggtagaaatgggcgtaagggggtggatttcgttttcgtttttcg

SEQ ID NO: 6556 - DNA, 561 bp, Artificial Sequence
  Description of Artificial Sequence: Synthetic polynucleotide
gcgcgggtttacgttggtcgttagcggcgttaattttatttattcgttaatttgttagtttttggattgagtaaaatagtttttaaagacgcgggtaaacgtcgttttaaagtttattattatgtaacgttaggttgttcggagttacgttggtggtatttttttttcgtgtttattttgtataggtatttttagaatttcgtgtaaatgaattttatcgggagacgtaggtgggtaggtcgggtcggtagggattaagagtttgaaagggaatttgttttttttttttcgtagttcggttattaaggtaagaaattgtaggtagagaagttttcgaattcgatttaggacgtcggcgtttgttaggattttttcgtttgtttttcgcgtttcgcgcgcgtttatgttattattacggggagggtgtatgcggtaggtgtttggtcgaggttttcgggagcgagtcgtttttacgtgttttagtttgtttttttttcgaagttagacgttggcgttgtagttttgttgtttgacgttgttgtagaagttcgcgtttattcg

SEQ ID NO: 6557 - DNA, 1235 bp, Artificial Sequence
  Description of Artificial Sequence: Synthetic polynucleotide
gcgatcgtagggtttcgtttattttttttttcgggatagtttggatgggagtagttggcgcgagggttcgttttttcgtttttgggtaatttttttggtattgggagacgagatggttttcggagggtggaaggtagtgttagttcggtcggttattggggattgcggggttcggagacgcgcggggttttcggggagtttttcgtcgttttcgttttatttcgttcgggttttttaaatatgtcgtagcgtggttgtttattgttttttttgggtaagaggaggttttagatatttttacgggatttgaattttcgagcgttttgtacggagtagttatttcgttagtattttaaagtgaagttgtttataacggataagttcggagattttatgagaggtcggggtggagaagtcgggggtgaaggggggtaggggtcggcgcgttacgcggtttttattttttcgtttggattttcgtttttttttttttttggatttgtatttgagttgattgtttagttttttagattttttgtcgttttttaggatcgaggttatggtcgagatttaggcgcggagtttagagtcgttttttttttgtatttgtatttgtttttttttcggtagtcgtcgtcgtcgttgttgcgaagtttgaggttgtaaattcgggagcggtttattttttaggattgagtaggaaagcgcgtttcgtttttttgtttttcgaattgttttttatgatttgtttttattgggttgggggtttcggttgggcgtttggagcgagttgttttttggttagggagggcggggaagggcgcgcggcgttttgagtgtttcgagtttttcgcgggttttgttttttgttttgggtttttagcgtagggaggttatttttgcgtttttgttagttgtttggtattagttattttgaagttaattacgtagggagtttgtttatttgttgtagtagcgtttaattagatttaattataattgttttttggttttgatattagtagtagtattagtcgtatcgtcgtttggtcgtttgtaaatttagttttcgtttggacggtgaagtttttaggatcggcggttggagggaggttgttttcggggaataaggacgcggcgcgggtgcgtttgggagagatcgggggagtttttaggagggattttgttcgggaggacgaggttttttgtcgtagtttcgcggatagtttagttcg

SEQ ID NO: 6558 - DNA, 5964 bp, Artificial Sequence
  Description of Artificial Sequence: Synthetic polynucleotide
gcggtaatcgagttagatttaagaggggtcggtttcgtttaaattggttttttattaatggtttcggattagtcgcggttgtgttgcgggagtttttaggacgcggttggggttggtgcgcggggtttcggaattttaaattcggttcggttcggtaaggtttagggagataaggtagagaaggttggggtgagcgagaagtcgggcggtcgatcgttagggttacgagtttcgttttgtttttttggaattttatttaattttaaaggtttaaagattttgaaaatttcgaaagcgaaattgcgagttggtttttagaagtttgagaacggttttttaggttttttagcgtcgtttcgggattttcggatattataaacgttattaattacgagtatcggtgttcgtggttattgtttcgaatggtttttattcgcgttttcgggaattttttcggtttttcgcgtatttaggtttttagttttagttattggtgcgtttcgagtttttaggtgttagagcggtggtcggtcgggtttttgtttagtttcggttttttttttttttttattagaaggaaaaatttgggtttttcgagaattttgtggaatgttttttgtaattaattgtatattcgtttttacggtacggtttcgtgtaaaatcgcgggtttcggggttttggagtaaattgcgtttgttagcggcgacgttaggaggataaggggaggggttcgcggttgaaattgtagtttcgtagtatagagttattttaggttgttttttatttcgcggggtttatgggaaagtcggtttcgggagggcgcgtttaaacgtaggttggaggagttacggacgcgttttggtcggcgtgtcgttatcgtttagtttcgttgtttaggtgggaggggttatttgtcgcggggtttttaagttagtgtcgtttgttttcggtttttatttattgatagtacggcgttcgagtgattttgtttagtttcgttttgcgtttttgtaaattacgttgttgcgttaattataaatttggttaatatgtttttgtaattttattatttaaaaacgtttttaggtatttggtcgttgttagattaggttcgcgggttcggaggaggtttttttatttgttttcgttagtttcggggatcgtgcgcggttttcgtgtggttttcgtttacgaggtttttcgggtaggaatcgtcgcgcgatttttgtttagcggtcgcgttttggttacgggcgatttttgtcgggaattttgttttcggttaagttgcgttttcgtatttcggtggtttttattcgagttcgcgtttgttggttttttttttggtttttttgtttgatttcgattttgttttcgaattttatttttagatttttttcgttttggaacgtcgatttttttttcgtatttcgtcgtttatttatatttttcggcgattgttcggtttttatgttcgttaagataagaagatgttttttttcgatgcgtcgagagggtttttaagtcgagtaagggataattttttttttaaacgttgtttttattttttattttttttagagcgcgaaatttaaaagtaaggaaggtaatttttcgtttcgattttacgtgtttgttttttagagtcgcgcgttttcgtttttttgttttattttattattattattattattttggttttttttaagtttcggtttcggttttttattttttattttagagcggcgtggaggaaagtaggagtttattattaagtgtagcgcgttttttgtatatacgaaattcggttggcgtttgtagttcgattgtatttaatattcgggatagttagtttttttaataagtattttttcgttttatttattcggggatttattcgcgtaggatttagtatatataaggcgagagttagttcgttttttagaaagataaaataaattattttttttgtttttatgtattttatattacgtgttcgtagtttgttacgttaaattatggtagggtttggttttaagacgtatatatatattcggggtggttttttttgatatatatatttaaaaaaattgcgtatacgtaggtttgtatattaatttataggtatatacgatagttgcgtttcggtgttttggttcgggttaggggtatttttttattttttttttttttagtaatggatttgatatatagattttaattacggaaaaaaaaaatcggatagtttattttttttttttttttttatttaattcgttaaagcgttttttggggtagttaaagagagtcgaaattaaggggtggaaattttagttgggtttttttttattttaaaatttttatttttagtttttaaaagttattttagttcgttatattgaaattggtacggtttttaaagatttttttttcgtagttgtggcgtttttaagaaaatacgagtacggattaggttttggatgagtgttcggttatcgagaattagttattttttattttttaggattttttagttttttttagtttttttttatcgtttttggttaaaattaataaatatatttcgtagtttttatagttgtattttggcggatttttgtaaaatatatatatatatatatatatttacgtacgtatattaaaaaataaattttagaattagtttaagttagtaattttgaaagggggtcgaataagaggagataatcggaaagtttttaagtgataggatattattttaaagagaaaataatgaataaaaagattattttcgttggagtacgttttaaaattattattgttaattttattttagttgtttaggtaaatgtttttaagggagcgatttcgaatgtttgtacgatttttatttttatgtcggttttcgatttttcgtttttattattttttttttttatttaaattaaaagaaaggggagattttagcgcggaggagacgcgggagcgcggggtaggtagtagcggcggttgcgtcgttaaaatgagtgtagaaacgaggaaggtgggcggcgggaggggataggttgcgttcggggaaggaggatattttgtaatttcggacggattttcgtacggttcggttttttcgagttcggagacgtaggcgaaggggattcgggaagtaaaaatgataatttggagcgtatagaggagtttgaagtttcgtttaagtgtagtcgttttttttttttgtttttttttttcgtttttttgtattttttttagtttttttttattcgttatttttaattttagtttttttaggtttttttttttttttttttttttttttttttttttaggttggaaaaagtttttgattagcgtatttaatttgcgggtcgaagggttgtttttcggttagtttgggcgtcggggatagtagtcggcgcggcgttttatttggtgaagttcgttttgttttcggcgtggatttaggtttcggtcgtcgttcgggagggtatcggtttcgttcgtttgttcgttcgttcgtttttgttcgttcgtttttcgttcgtcgtttttttcgcgcgttcgtttcggtttttcggtttttattatagtttattttaatatggtattttttttgtgcgtatgttcggcgtttttttttttttttttttttttttttttttaagattttgtgtgtgtgtgtatgtgtgtgcgtgcgcgtgtagcgaatttttttaacgattttttttagcgtttgtaaaattttttaagttaattagtttgcgggacgtgatcggttttttttttagttagtttcgcgttattttttgcgtttaagtaggcgggtatttttaggattttgggattttttacgtttacgcggttttttttttatcgcgttttttttttttttttttgtgagttttttttatatatgatttgtagaaagtttttatcgcgggcgttttcgtatattttttcgtaaggataattgggtaaattttcgtttttttggttgcggttcgtgagttgggtttttaatggtttagtcgatcgtgtgtataaatttgcgttttattcgtcggggatcgttgggagcggagataaatttaatttttagggtaattttggtttcgttcgttttattttattttgtgtttaaatagagttttttttgaagttgcgaatatttttaggttttttgggtagggttggaggggtcgaggagagttattcgagggaaaggtgtttcgaggggtaggaaattaagttggggttgttcgggcgagttgttaggtagtcgtgttcgttacggcgttttatggggtatttagttagtggcgggttttatagggcgggaaaagaatcgtcgtttatattttagtaaaacgtggttttcgacggttcgttggagagtttcggcggtcgtgagtttcgggtagggttggacgtttgcggagttttcgggtattttgtttcgggcgtttggggaggaacgcggagtttttagggttttaggtgtaacggttgcgtagagtttaaacgaaatgtttttagtgcggaaaagtcggtgacgttttggtagtaagattaagagttttcgaagaacgttgcgtttttaattagggggtttcgtagagatgtttgtgtgggtttgtattgtatatttttgcgaaatagcgaatggatacgtttgtttagggtttttatggttgttaaagggggtaaaattatttagttttttaaatttgtgttttatgaattttttttatagtatttttttttagggggttaagaggttttttaggttttcgtgggttcgtagttttattcgttttttttcgttttgtatttttaaggagaggtgttcgttttgaagggttaggggttagttatggagtgaggggatcggggttgattacgcgcggtatagatagaggtttttaggcgggtttttttttggacggtggggtcggagttgatttagaagaaatacggagggacgtgtcgagaagtcgttttttttcgtcgcgattttggagagcgtttttttatttaaaggatttgtcgagttgagagatttagggcgggcgttcgtagtcgtgaggttttttgcgtcgttagtatgggaagattttgtttttttatattttggagaacgttgggcgacgattaaagcgtttttcgtcggtttgttattttatgtgatataggagttacgtgagatttagaagagtttagcgattcgtcgcgcggcgtattttaaattttagtttgagtttgcgatttttttagttttttagtttttagttgttggggatattaagtcggagttttgggttttttgttttgtgggtcgttgaaagtagagattttttaaattaatcgaatcgggcgtattaattttttcgtttgtatttcgttgtttttcggttgagtttcgaggcggttttaggtagaatttgttggattgattgcggcgtttagaaatttggagtgtgggttttagatattttttacggtttggtttcgggttttaatatttaagtcgttttttttggtttttttattatatagcggggtttgtggaaagggaggggtcgagagattcgtcggcgtattattgttttcgaggggtttttattttgtgtattgttgaagcgtagggcgcgtcgcggtaggaatggtttcgagtgcggattttttgttttgagttttttatttttggttcgcgttgcgtttatttagtggttttggtttcgtagggcgatagcggttgtttttttttatttgcgttttagatcgcgcggtttcgtttagttttcgggagtcgataggcgtttgttttggtgttagcgtagggtttttcgggggtttggggtaggggtaggggtgcgggggggaaggggagaacgtaatttttttttgtaggagtcgtggagacgtgagttgtaattagttatcgcg

SEQ ID NO: 6559 - DNA, 5964 bp, Artificial Sequence; identical to SEQ ID NO: 6558
  Description of Artificial Sequence: Synthetic polynucleotide

SEQ ID NO: 6560 - DNA, 5964 bp, Artificial Sequence; identical to SEQ ID NO: 6558
  Description of Artificial Sequence: Synthetic polynucleotide

SEQ ID NO: 6561 - DNA, 703 bp, Artificial Sequence
  Description of Artificial Sequence: Synthetic polynucleotide
acgcgaaataaacgattttaggtttttagtaaagaagtagcggcgcgtttttttttttcggtttagcgtgaaaatacggaaggcgaagggttgtcgttagtcgtttttttgttatcgcgatcgggaaataaagatatattattttttattttttgcgtttttaagggattcgaggaatttttggttgtaagcggttggtatttcggaacgggcgttttattcgttcgggcgaaggtttttggtttattaggcggttttggcgttcgtagttggcgagttttcgtttcgttttcgtcgtcgttttcgtcgtgggttttcggcgttagtttatagttcgttcgcgtttttcgcgtcgagtttggttcggcgttagtgagtttcgtcgtcggttcgtttttcgttcgcgttcggttcgtcgtatggtgcgtttagcgcgtttcgagttagttttcggcgcgttgttaggtcgggtgttaggcggttatcgcgcgttatcgtcgtcgttatcgttcgtcgttcgattttggataataatgcgcgttttcgtttttttagaaagttagggacgtttttagtcgtcgttagagttggttcggttttttagttttttttcgtggtattcgtaggcgagataaagttcgttttcggtgaggttgcgcgcgtttaaagcgtgcgggatgtttagtacggaggtttttaagcg

SEQ ID NO: 6562 - DNA, 1315 bp, Artificial Sequence
  Description of Artificial Sequence: Synthetic polynucleotide
tcgcgttttttttaaatatacgtatatttttatatttattcgcgtcgttttagtttgtttatttttaacgagtttaagtcggtgtagtcgcgttttatgttcggttcgtagttttcgagttttagttcgttcgcgttgggcgtcgttgtatttgttagtggcgcgcggtatcgcggtcgtcgggtttcggagcgtttttagcgttgcgggggtgtcgtgggtggtttttttgtttttttttattagaattttgtatagtcggggagaaaatttaagttgttatatttcgtcgggagttgttggttgaaaggttgggagtcgcgttttttgtttggtagggagatttcgtatttttcggtttttaggttaggtttttagttttagagttggaagagttttagggcgggaaggaagagatagtaaggattagaatggggagtatgagattttgatgcggaattcgacggtaggtttcgttttatagttgtttcgtttatagcgatgcgcgttagagttttcgtagttttgatcggtttttttgttttttagtcgtcgtttatcggtcggagggtcgtttttttgcgatttttttttttattttatttttaggtcgtcgtcgttcgtgggttgtttttcgtcgcggttaaaagttttcgcgttcgaggggaagcgatgggcggtttgggggttcgggggcgttaggcggggcgcgcggcgcggggcgcggtcggcgggtgggtgggttatttggcgcggtcgggcgcgtttgtcgggtattagagtaggtgtagtagtagtagtagtagtaggttggcgagtagggcgagtagtgcgtttttcggtcgtattttgagttataggcgtcgtcgttatcgttgttgtcggggcgaagtatagttcgggcggtttcgattcgcggttttcgtcgtcgtcgttatcgtcgtcgtggtcgtagtttcgcgtatttatagcgtttataggcggtagcgaggggcgttcgtagtttattcggtagagttttcgcggcgggcggagaagaagtcgcgttcgggttcgtttcgggttttcggtttcggttcgcggagcgtcgcgatcggttggtagatgacgattcgtcgagttcgtcgtttgttttttcggaggcgttcggagttgttgcgggtttcggtcgtcgttgttattgttgttgtcgtcgtcgtcgtgcggggttatttgaaggttggggcgcggaagtttaatttcgtgttgattgggttttaagttttttgcgttttcgtttcgtttcgagtgttcgcgaatttttcggacgtttacg

SEQ ID NO: 6563 - DNA, 1316 bp, Artificial Sequence
  Description of Artificial Sequence: Synthetic polynucleotide
gcggtcgtcggtttttagttttgggattattttggtttcgatacggagtgataggggatttttacgcgttttcgtatttagggcgtttttttagttgcggcggaggtatagagaggttttggcggcgttgtggtttcggtcggtatcgggtttcgcgtagtcgggttttttattttgagtggagttgttttttaagtatttagtttttgttaattattgtgtttaatattaagttttcggggcgttttgttttgcgttatcgcgcgttcgttcgttcgttcgtttaatttatttgttgaagattaggtagtttaggtggttgattttgtggtcggagcggtggcggttgtagtttttttataggtttttgaaggtcgtgatggttaggatgaagagtatcggcgttagtgttaggtcgggttggaaggcgtttatcgtcggtacgaagttgagtagcgcgatgaagataaagtatacgttggtcgggcggtggaattgttcgaataggtttttgggtaggaaggatagtagcgtgtatttggtagttttgagtcggttgtcggttaggtgttgggtatattcgcgtcgtcgtcgtcgttcgtttttggtcgcgttagtcgtagggttttcggcgttcgggggcggtagtaggttggagcgtatcgtgcgcgttttgttttttcggcgttttcgtcgtttcggaggttcgggtttttcggttttcgtcggttttcgttttatggtcgcgtgtcgtcgcgttcggttttttcgtcgtttacgttcgttcgcgtcggttttttaggttattattattcgcggttcgggcgcggcggtgcgagtttttcgtttgcgggacgtacggagatcgcggttagcgcgtcgtttggtcggtttagcgcgtttagttcgcgtttagtttcgtttattttcgtttagtttcgtcgttcggtcgtagtttttagggcgtaagttgggcgggtgtcgtatagagtttttttgttttcgtcgttcgttttcggttcgggtcgttttcgtcgcggtggttacggtttcgttttcgtttcgcgttcggattgggttacgtcggatagcgggaaataaaaaaagttcgagttggaaattttagagaggtttagtttcgttttttagaagtattagttcggttttaaaacgttgtaaacgcgcgttgtttgtagtaggagagaggaaatcgcgaagcgcgagaaaaggcgttttcgtttttaagtagttcgcgcgtttttttaggggttagatttgttttattttggacggcgaaacgatttcgggagatttcg

SEQ ID NO: 6564 - DNA, 1110 bp, Artificial Sequence
  Description of Artificial Sequence: Synthetic polynucleotide
gcgtcgggtttggtttttgtggtttcgtaaattttttagtttgtgtgttacggcgacgcgtagcggttgagtcggagtttacgcggcgcgcgtttttcgcgaggaatttttcggtttgtaggttgtttgttattttcgtttttcgacgcgtttttttttggttcgcgttttcggagttttttttttttttggcgaggatttttttcggcgttcgcggtttcgattttcgtcgcgttgcgttcgttttttcggtttcggttgtttcgttgagggttttttttttttaggtatcgtagtcgcgttttcgcgtttcgtttttcgagcggttcgtttcgttcgatgtttcggtttcgtttcgcgtattgagcgtttggtagtagggcgtcgagtttcggggcgttgcggggcgttgcgtcgagaacggtcgggtttgagttttgggcggtttttagagtcgattagagcgcggggaggcgggggcgaggaggaggggattcgtcgtcgggggttggttgtttcgtttcgagtcgatttttcgttaatggtttaaagggatatgtttaagtcgttttttatagcggcggcggcggtggcgtaggagatttagatggaattgttagagaacgtggttttcgcgggggcgttcggagtcgtcgtataggtagcgagagcgcggcgtttttttttttttttgtgagtcgtcgggtagggtatcgatttcgggttttttcggcgtttttattgtagggatttttagtttcgtatttttttttttcgtcgtttgtttattttttgttttttttttggcgtcggggattttgtttttttgcgtttttttttggttttgtttcggtttttatttttttttgttttcgaaaagttagtggggaagggcgggggagatttgttagtttttttagatttttttcgggttgttttagttggtttttttcgttttttttcgggagaggtatatggagagatatgaattaggggagtggattggatttgttgaagatcgtgagttcgggtgggcgggagggggttcgtttttcgtagcgttttttacgatgtcgatttttttggttacgtttcgagtcggggtgggcg

SEQ ID NO: 6565 - DNA, 1655 bp, Artificial Sequence
  Description of Artificial Sequence: Synthetic polynucleotide
tcgttttcgttttcgttgatattttgtaaagtcgcggcggtagcggcggggattacgttgcggtgtattatttttcgttattttttcgcgttgggttggggtcgagggggtttcgtagagtcggtaatcgaatcggttttggtttgttttttttattttttagttattattagaattagttttcgcgaaggggcgagttgtggttaattttttcgtgtttagggagatttcgttagggtcggggcggggcgcgatcgtttttcgtagtcgggcgcgaaggcggttcgggagttaggtgggtgtggggcgtagttggcggagttgtttagggcgtgcgagtaggttgcgaggatggcgtttcggcggcgcggaggtatcgtttcgcgttttttcgatagtttttcggtttgtttttttttttcgcgttttggggtagtcggttgtttggggcgtacggggttggagtggttttttttttttttttcgttaggttttttcggtttaatttgttggtcgcgattttttagttagtttcgaggaaagtgtagttattggataggtttgtgcgggttgtcggttttagggaggaaggtgggagaagtttggaggagcgaaggggagggcggagggaggagggaggagggtgcggcggtagatttggtaaattgcgagttgttttttttttttaaagtgtggagaaggagcgcgggggagcgtggcgacggtagcgtttttttcgttattaaatttttggggtttcgcgggggtttggggttatttttttttgagttcggaggaattttttttcgataggttttagcgtgatttttttttattttattttttttttttttttttttttttttttttttttttttttaaatatattttttttttggtttcggattttagattgttgtagttttaatttttttagggtttagttttttggagttgtttattttttcggttgcgagaaaggacgcgcgttttgcgtcgggcgaagaaaagaagtaaaatttgtcgggagggtttcgttattaatttttttttcgtaaatttaaattttttgtcggggttatttttagatagaggaaagtttttgtagagtcgattagttttagtggatttggggtaggtagcggcgttggttgtggaattagatttgttttgaatttagtggagcgtatcgttggggttcggaagttatcgttcgcgggtatcgggttggcgttgttcgagtggaatcgatagtttgcgagtttcggttgtaagtggtttttttttttcgcggttgttgtttagtgtcgggtgagggttgcgagtgtggtaagttgtaaagagagttttagaggttcgaagagcgttgcgtttttattcgcgttcgttttttttttttttcggttttttattgtgaaatcgtagcgatatttataaaggttttcgggttttatcgagatcgattcgtagcgtttggttcggtcgtgtttattgtatcgggagttttcgagtatcggcgaaggattggcgggtggggtagggaggtggcggcggcggtatggcgaggttttcgaaggtcgatttggtcgttgtaggagttatgttattttgttatttttttacggattagttttagttcgtcgatgggaaattcg

SEQ ID NO: 6566 - DNA, 1655 bp, Artificial Sequence; identical to SEQ ID NO: 6565
  Description of Artificial Sequence: Synthetic polynucleotide

SEQ ID NO: 6567 - DNA, 304 bp, Artificial Sequence
  Description of Artificial Sequence: Synthetic polynucleotide
gcgggcgttggaaggggggcggggtaaatgcggtcggcgtagaggtggggagtaggtgggaaaggtggaggcgggttcgtttttggagatttatttttgtttttattgtttttcgtttgttagttttatagataggtttgaacgcgtagagagttttttggagtgttttgattttgttttcgagagggtttttaattttcgtatttttttagtggttgttttggtaggtgcgcgttttgcggggagttgcgtttcgggggttatcgtcgagcgggagttgttttttggaattttgtttatcgcg

SEQ ID NO: 6568 - DNA, 1666 bp, Artificial Sequence
  Description of Artificial Sequence: Synthetic polynucleotide
gcgtattttttttcgatcgttagtagtataagtggcgatatttttatggagcggtcgcgtcgtagtttgtcgtatttagcgcggacggtttggtcgcgcgttttttcgttcggacgatcgggcgcgtttgatattaatagttcgcggtttaggtacgagcgggcgtcgtatttgatttaatttaatttataatcggtcgcgtttgtaggtgtcgttttttgaaatcgttatttaggcggtcgttgtttatttttcgttgcgtcgcgggttttgtagaagcgtaagaatggggttgattatttcggtgtttatatgtcgtttttatacgtttttattttcgttcggcgtaagattttttttggttaaaagaggcgtttaattagttttggggtcgcggagagttagcgtggtcgataaagttcggttttttaggtaattcgggttttttgcggattcgggagggggcgcgcggggtcggagtatcggttttgggttgcgcgtttttttcggcgatattgtcgtttttttggttttcggttcggtttttcgtaggttaaaggtttatttgtcgggtttgggtggttcgggttagcgtcgtttgcggttttcgagtgcggttggttttaaggtcggcgtttttttttcggtttttagtgtttagagttaggttagcgggaaagaaggtagtatggttcgtaaaagataggtggtagtggtagttttgtatgatatttgttttttttttttgttttttattttggggaaatattggaaatatttttttttttatgcgtattcgcgttttagtatcgagtgttttaagttttgcgcgtagcgtcgggtttggaaggcggcgaatggttgtttagtcgtcgtttttattagtgatattcggtcgttagttttcgtttaggatgtgtatatttgttggtagtattggttcgggtggtagttatcgggttatttattttataggtataatcgtatttaatttaatttggaattcggagggttgtgcgcgtcgagttgggatcgcgttttagcgagtcgggtttttggttgcgttagggtttaggtcgagttatttcgtcgttcgcgtcgtcgcgaggcgggatatcgtgtgatatttttgtcgtgggttgggcgtcggtcgcggggcggagagcgggtgttttatttcgttttattatttgattttcgttagcgtttgaggacggcgtatttaattcgttttattcgttgcgttttgtgaattagcggcgggtagggcgggggaggtcgggttgggggagggtagggtggttttaatttttcgttttcgtttcgtcggtttcgcggagtataagtgttgggatttttacgggtaggcgtgttttgcggttggaggttcgagcgtttagggtttaggagacgtggcggatatagaggggtttgtaggtacggtgattttcgtgtttttgttttgaaagggtttgaaaggagcggtttatggtgtattattagttaagggtttaggtattagcgttttgtgtcgggaattcgggcggtcgttcgtgttgtaggtgtttgttatataaacgtttcgggagggggagggtaggtcgtcggattgggggtcggggaggggttttcggtttggtttgtttttgttattcgcgcggtttcg

SEQ ID NO: 6569 - DNA, 5030 bp, Artificial Sequence
  Description of Artificial Sequence: Synthetic polynucleotide
gcgttacgtggagagttatacgaattttaagcgttttcgttttttagtttttcgcgggaaaacggattagggtgttaatgggttttgattatttgtattagcgttatttgcgagtcgagggttaagagtattttttcggttttggtggggtacgggttgttacggtgtttgtaaagttattgtttgaggggtcgcgttatgttttgtagggtttgtcgtttgtgttttattttttcgttattttgtcgggcgttgggatatggggagaggaggcggttttggtgagcgacgcgtttgttcgttcggacgttttacgtttcggttaagttcgggtttcgtatttaaattgcgtatttttgttttgcgtttttgttttgcgcgcgtttagagtgtttgggagaggtaggaagtgggagttatatagtttttggatggggagattatttcgataggtttattttgaatagggggatattttgaatttaatattttaaggttagaggtttagaagacgaaggttaagtgatttgaagaatattgttattttagtcgcgtatttgggtagcggggttaattgttattttttttttattcgttggcgtcgtattttcgagtggttttggtttggtaggtttggtagggtatgcggttggttttcgaaatttttttcggggattttttgtttgtttttagaggtttttcgtcgtttgtggttaggggaaaggtcgtcgattggatatagggaataaagtaaaggagtattgtcgtttcggttttttttaagttattttttttgattttttaggaaaagggggaaattttttaaaggagttggtggtttgtggaggaaagttgtagaatttaaaaatatcgtcgggtcgtttttcgattaagggagggttaaaagtacggtaagttttgttttattatgtaaggtaaaaagattttaggaaaagtatatttaaagggggaggaggtagaggtagttaggagtttggagcgtggtttggggcgttgcgtttttttacgggttcgggaggtgtcgcgcgcggtcgttagcgagtttagtcgtttttcgaggtttgcgcgtttgcgtcggagttttttgggtttttgtttttttaaatattttgaaatgtaattttattcgaaacgattggtagtaatattttgacgaaatcgaatttttgttttattaagtagcgacgtcgtagaataagtagttgatgtaatcgtttaggtggaggcggttaggacggtcgttttttttcggcggggcgttcggggagtcgtcggatcgggttaggtagagtttgttttttatttatcggtagtttgagtagttggtttattcgtaagttatcgttttttttagtatattttttatttcgttaaatttaaattcggtttcgtaggttcggggttttttttttcgggttcgtcgcgggtttagtcgagtcgcgtttacgttcgggattttttggcgggaggcgattttttcgattttttgggttaggcgagtcgcggggttttggcgaggggttcgagtgatcgaagagaagttcgcggagtttgagtttggatttttcgattgttcggtttcgtttgtttttttgtatcgagtttagtttttttttttcgtttttagtcgcgtatcggtatttatagttcggagaggggtaaataatttttaatttcgaggtttaggtagcggagggtcgaggggtagtttttggcgtttttagtttttattaagttttttggagttgtttcgacgaattgattttttatgttttaagataggagttttttaatatgagaatgcgcgagttttggaggggtagatttgtatttttagggaatttcgggttttttttcgtttattcgttcgcgttgttacgggatttcgttatagtttattatttttattttttcgggtcgtaggcgggtagggtttttaggggagtgcgtatattcggtttttcggtgttttaggtcgaggttgtttttgaggggcgggtcgtcgggaatgtttatttcggggcgggcgtgaggattgtttaggatatcgttgtagggtcggttatttcgttttcgtttcgaggcgttttcgtttttaaatagtatcgtatcgttgagtttgttgaagacgatggtgtttatggtgtcggttggtagggacgcgcggcgcggtcgtagagtttcggggttgggtcgtcgggagtttcgtagcggggttcggtttttaggagaggaaggtgtatttcgttatttattggttgagagtgtttagatttttgtaggtttagggttttgaatttggtcgggtcgtcgggttgcggagtcgaggggaggagcggcgtcgtcgtaattggtagggattttgcggttttttttagttggttatacgttttcgtttttgtaggtttttcggataggtatttgtttttttttttgtttgggcgatcgatttttttaatttttttattttttagaattataatcgggaattatttattcgtagaggtaaaggaaacgaatttttaaacgagtttttgggttttagtttgaatttgggagaggtatatttcggattgcggagcgcgatcggcgtgaggtcgcgcgtggttttttaattatagtagaagattaaagtttttaggaattttaattcggggcgttaggaggggttggatggaagggaagatttggggtaatgtgttaatcgtatttataagattttttagtttatgagttttaggttatatcgggatttgggggattttcgtgttttttagatcgtggatggtttggttgaaattttcgtattttttgttcgttaaggtttttcggggtgaggttgggtttaaggataggaaaaagttaagtggcgttaggacgaaagtattatttttttttttttttttttagaatttttttattattttttaacgcgtttcgggaagtgtatggttttaaggtttaaggcgttaggatttaggtttttagagtttttaattagtgttattttttttcgtagcgcgggtgttagtcgcgagttcgtagtttttcgatattcgtttttttttggggttttcggggatttttttagaggttgtaaaggtgttagaagtttaaggtaggaggtagtttggtcggcgtatttttcgggttattgttgttattgtcggggagagttagtagtttatttttggggtcgcggaggttttgagtttttgtttgtcgcgtatcggcgttaggagtaagttcgcgcggtcgcggagtcgtagagttatagttttaaggcgcgcggcggatttcgttcgttttattttttcgtttcgcgtttcgggatagttttcgtttttttcgagcggttttagtttcgttgttagcgttttttttgttcgtttagtcgcggtatgggttgttattttattaatatacgcgcgcgcgtatatatatatatatatatatatatatatatatatattttttgtttcgttaagcgtttatattcgttaacgttttcgtttcgtttttcggttatcgtagtagaggttacgcgtgatatttaggattacgcgtgattatcgcgattaaacgacggttacggtttgtgttcgtagggaagtgaagttagatttttgttggatgtcgtgtgttttttaggattgcgttttttcgcgtagataggtacgtgtttggggtgtgtatatagtttcggtgataagtgttaaagagaattttcgtgtttgtagtttttgttttatagttaagattcgcgttggtgtttttttttaaaattatgtttttagggatgtgtgtttatgttgttttatttgtataagatattttttttcggttcggtttttttcgagttattttagcgcgtttttttagatgcgacgacgtgttttttttagcgaagttattacgaggttagttatttcggatattttttcggtagttttaagtttacgtagagatcgtagatatagatattcggcgcgttgtaggtttgtaggtagtaggtttagaggtaagcgatggtaaaggttcgagcgttgttttgtcgtaaggggttcgggggcgtgtgaattatatttgttgatttttttaggattttcgcgcgcggttattcgcgtttttttttaaattatttatttcgatttattttagattgtggtcggggaggttattttttgtagaagtgttttttttttttaacgtcggcgaataattttaaagtaaaggaggcgcggttaggtgggtttttaagtttcgcgtagatttttgggttagttttggtcgttattcgagcgtttttttattagattttggagggaagttgggggaagggcgggagagtatcggcgtttagggcgtaggggttagagcgagtttggcgtttcgtcgtagtcggttgagattcggcgacgcgggggttgtatttgtggttgcggggtcgacggtcggttgtagggcggttggttttttcgtttcgagattaggcgtatttttattttcgtcgtatgttttttacgcgggttttagcgcgtttattatcgttatcgtcgtcgtttcggttttatttatttagttcggcgcgcgtcgttcgggaataggaatagcgaggtttttttatgttttttgattgtcggttttagtcggcgaatattttgcgggcgcggtatttacgttttcgggcgggtggagaggaagcgttcgcgttcgttcggtcgcgggggttgttgttaatttttagtagaggagtcgttgtcggggagtttcgggttcgtcgagtttttcggagtcgggcgcggtttttagattcgtcggttttgtagtcgtggagtagacggggttttttttttcgtattttaggagagaaattggagaagttgtcgggagcgttcggtttcggttttagaagttgagaggttgcggtgtaaatttcgtgttttagttggttcgattgtcggaaattttattgcgcgtggttaggcgggagaggttattgtgacgcg

SEQ ID NO: 6570 - DNA, 2868 bp, Artificial Sequence
  Description of Artificial Sequence: Synthetic polynucleotide
acggttttacgcgaggaagagggcggggagcgcggatcgggtgtgggaggtcgaggtgatagtaggtgagggtcgggtgcggatggggaagtgagataagtatcgtgtgggtattatttatttcgttttattaaggaggttgttggtaagcggaatttttagttttttttttaatttagttgaagtttaattttattgaagttattttttatttcggttcgtttggggggaaattaggcgtttttggaagggaagggaagggagttcgggttgcgcgggttaggtagttttttttcggtcgtcgcgtgttttcgtcgtttttaaatttgtttttttttttattaagggaatttttcggggagtttagatcgcgatttttttttttggtttcggggtgcggggggcggatacgcgaggcgtgggattgatggtagttttgtttttaggaagtaggtaggcggggatttttgggcgttcggaggggtagtttcgagggtatagggtatagggagaattagttagatttttttttgtttcgggtagtcgcggcgggtgtggttagcgcggaggtaggacgtcgtcgagtttttaattttatttttttaatttcgatagttcgtcgtttttttgatcgcgtttttacggtttttcggtattcgtttttttttttttattatatttgaggaaaatttttttttcgttttttaatttaaatttagtagtgtttacggttgtcgtaaatcgttcggtttttagtaataaggtttcggtcgtagagcgagagtttttaggtgtaaggaaggtgatgtcgtaaagtcgggagtgtcgtaaattaggtgcggtggggaggggggaggggtggaggcggaggggtgggggggaagggggagggagggggaggaggtgattcgagtatttagatataagcgagaggattatggcggatggttttaggtgtaagcgtagaaagtaggcgaattcgcggcgtaataacggtgagtggcggaggggatcggggagcggcggagttagggggagttgggtagtcggggcgttttcgggggtgaggggggcgagtcgggttgggggtagtcggggtagggacggtaaagtggagtgggaaagtagaaagtagtgttttttgttttttttcgttgtcgtcgttgtcggagtcgcgtcgcggtcgttcgttttttttgaatcgttatgttttttatttggttttttttcgtttagcggttttcgtcgtttttgtcgtttttttggatcgttagtcggcgtcgacgtcgtcgtattttcggcgtagggcgggcggtcgggacgtattggttatttttttggtttcgggtggagcggttgttgttttttttcgtatttttttttatttttgtgtttttcggcgtttttttttttttttttttttggtttttttagcgcgatttttttttagcgtttaggttttcgggagtcgcggaataaatttgtgttcggcgttgatcgtgtaaagtggttttcgcgcgtcgcggtttcggtcggcgtcgtcgttgtcgttcgggtttcgcgattcgggtcgggttgtgggcgcgcggtaggcgggttgcggcggcggcgggacggggcggtcgcgggttgcgtggggtttgtgcgcgcgtgtgcgcgggcgtcggttgtgcgcgtcgcgggcggatagggttcggtcggcggcggtaaagttgggattcgcgggtcgggcgcgttcgcgtaacggggattagaggcgcgggggcgcgggtttttaagcgttttttttttttggcgtttttcgttgttcggtttagagtttcggtttggggatttcgcggcgagtttcgcgagtggggtttacgtttggcggggcgcggcggggcggcgcggggaataaggtaggaaaggtatttatttaacgtcgtcgggagtcgcgcggatgggggcgagttgggcggcgggtgtgtttgcggagttgttatttgggtttagagatcgggaagtattatagatagatttttttttcggggtagacgaggtttttgcgtcgggatgggtcggtgtgcgtgcgtttcgcgtttttttttttcggtttttggggaagttgttatttgggtcggacgtacggagcgttgaagtcggataatggggtttggatggcgttttgggtttcgggtggaaggagggtgggggagggggcggacggatcgacggacgcgcggggttgttatttgtatcgtagttgtagtgtttattgatttgtgttgttgtgttaagggaaatatatatttttttgtttggcgtgagagttaaaaaaaaagagagatagttcgagggatcgagatttgaatatgtggtggtggttgtatagtcgttttttttagtttggagagacgttgtaagttgattgtatttttggttatttcggggcgatgttatgttttttttttttttcgtgtagtagcgaaatgtttgttgattgttattgtttggatagtttttgtggcgagaggggcgagatttgttcgttcgggggcggcgggagcgtagggagagtagttttcgtttgcgtcgtttcggtatttgtttgtataataatgggcggtaacggttttgtcgtcggtcgtagtttaggttatataaggaattatacgtatatttcggatcgaggggttcgttttggtttttgcgttatttttaaaacgatttttaagagaggggtaataaatgcgtttataatgggatcgttgtagcgtcgagaaaacgaggaaatacgtgtttaggagaaaattttttcgtgtttttttagttttatttttcgcgtttgggtttttttttttttttttttttgggatgcgaaacgcg

SEQ ID NO: 6571 - DNA, 2678 bp, Artificial Sequence
  Description of Artificial Sequence: Synthetic polynucleotide
gcggttggacgcgcgtttaggttcgcgtcgttgcggatcgcggagttgtgtagaagcgcggtttggcgggtggtataagttcgatagttgcgtcgcgtagttcgttcgcgtttggttaagagtttcgcgagggtgtggggagaggatcggtttcgtagggagcggaggttgcgcggttgtatcggattttatagttttaagtcgcggtatgaggcgaattttgtaaagcgcgttttcgttatgtatcgttcgatttttagtattgtgcgtagtaggatttcggagtttattcgtttgtggaaatcgagttcgtagcgggaaggtagtgggtggagggtgggtaggtaggggtttggggttcgcggttttttattttcgcgttttttcgcgttagtttcgaacgtttttttggggcgtttttgtttagttgtttcggttgatttcgttttgtagttagtttgaggttaggcggtcgttttttgtaggttataaattttcggcgtaaaagtagggttttgaacgcgatatcgtattagagcgtttagttaagcgagttgtttttatttttattgtgtcgggcggcgtaaattgcgggcgtaggtagaggagtcgcggttttgcgtcgggcgggagtcgaagtttagagtttcgttagggttttttcgtcgagcgtatttatcgtcgttgaggtagagcgcggttagtacgaggattagtacgattacgattttggcgtttatggtgcgggcgggcgggcgggcgggcggacgagcgcgggtcgggggtcggacgtcgagcgggtaatgcggttgacggagagtgaaagtgcggcggtgggaggcgcgcgtcgggcgttttagaggggagagttaggcggggcggggcggggcgcgcggtgaggggcgggttcggagtcgagtgttggtcgtggtcggggtttttgacgcgcgattttttcggcggtattttttatttatttttttcgtttttttttcgttttttttgtgttttcgaggcgtagtgcgtttcggtttttgatttttttaggtttcgttgggtttcgtatcgttggttcggtttgtagtgaggttcgtagtttgagcgacgtcggttggagggtcgtttattgtttttgtgatagggttttattggagagattgaggattttaggcgtaaagtggggcgcgcgtggaaagttgcgggacggggtttttcgatggcgggaattgaatgagaattaatgaaaagtaaataagttagtttcgggcggagggtttgttggcggtggcggtttaaggtagtcgagggggttttgttttttgtgcgtgggggtttaagttcgttatttgttcggtttgcggcgtagtcgtcggtagagttcgatttgcgggaatgagattcgtttttgtagttagcgtggttcggattttaagtttacggcgttattagtcgagttttagttttttcgtttgtataaataaagtagaaggcgtcggcggtttttagtaaaagcgaatgtagtttttgtattttcgattttttaatggtgaaatgagttaattataggtttatttcgcggagtgggacgggagatttaatgagattcgttttacgtcgcgaaattttttgtatcgtgtttgataagtagatagtatttaataaatggtagttgtaagtaagttttttaaatttaagtatttattgttttatttaagaaaagtttcgtgcgatttaaagagttgagaatttttttatttcgattttcgatttttaggatagtattattggcgtttgttttttgggtttagaaaattttttttacggagtcgtttttcggcggtgtttagtttttcggatattttcgagatattttagatggttttagttcggtggcgaagggagggtgtaggtcggtatttaggagacgtgggggtgaggagagcgtttttttgggtttcgttttgtgatcgtaggttgttttagttatttttttgtgttttttttagtatagcgtttagcgaagtggggttagtcgtcgcgtttatttaggggtttgttttggggatacgtttttgtttttggggagttttggtcgtcggggagtgggcggttagcggttgtattaggcgggagcggttaataggaggttgcgagggtttcggaatttcgttggtgggagtaggtgttttttgtgtattttttttttaaaattattttggtcgttagatggttgtgggtcggtattttatttatttatttatttatttatttatttatttatttatttatttatttattttgggtattgggtttggagtcgggaattttattgatttggttttgtttttaaagaattgaaggtagtgaggtttagtgaagaaggtagtcgtcgggcgtttttaggtttttgttgggttgggtcggggagtttggtcgtttatcggtcgtagcgttggggtttcggcgttttttggtggcggcgttttttttttcgtttttagagttttggttagttttatttttgcgtagttgatgaaattcgggagggcgaaggggttcgcgggaaatttatattcgggtggaggggcgttttggagttcggagattcgattttgcgggagtcgcgcgtagtttcgtttgtttttaaatttggttaaagtaaacgttatcgtttttcg

SEQ ID NO: 6572 - DNA, 2756 bp, Artificial Sequence
  Description of Artificial Sequence: Synthetic polynucleotide
gcgggagggcggtagcggttaggttaatattcgcgatttcgattggggcgcggtaatttttgtttttagtttttataagttttcggtcgcgattcgcggtcgagaaattttgcggaggggtcggtgggttagagttaggttaggtagttgttgagtttttttttttttttttggcgggagtgtgtgtgtaaggggttagggggcggagtcggagaaagggttgggggtgttcgtgtttagcgttttttcggacgcggttttataatttagttgcgagaatagatggacgtagcggcggtttatttcgggggttttttgttcgttgtgcgtcgaggtttaggttgaagcggagatcgtaagtttttggttttcgttttttttaaggggtttcgaggaatcggttgtcgcgtttttttttttaagaggagaagagcgggcgttgatttcgcgagttttagaatcgcgggcggggggtaggtagggggcggggggtagagggttagttatcggcgcggaacgtttattttaggggttggtttaagatttttatatcgagagttttttttgggtttttagttttggagtatttggagagcggatttttgttcggttacgtttcgttttcggttttcgtttcgtcgacgtcgtattagtatgagcgacgtaagtggttcgggtattattcgggggttgggattcgtcgcgttatagtttcgagtggaagggaaaaaaaaagaggaggcggcggaggaggtaagagtcgacgcgaggggaggggagcgtagcggcggggttaacgggcgggtaagcgggcgggcggtaatagtatgtttttcggttagcgcgggcggttttttagcgcggcgggggttgttttgggcgcgtttcgggcgaagtgcgtttagttttcggtttcggtttttcggcgcgttcgatttttcggtcgtttttgagtttagtagtcgcgggtttcgggatcggttaagagtagttgtaacgtttcgtcggacggagtttttttttttttcgggacgttgggttatgagtttcgcggttatttgaggtataggggagtttgttcggttaggatagttttttcgaagtttcgtgttttcgtttttgtattgcgggacgttagcgttcggttttggcggaggcgttttcggaagagtatcggggtgggggtatggaattcgcggaatttgcgggttaggttcgggcggcggttattaagttgtcggaggttgtgggcgcggcgttgtaggagtttcggcggtagaggcgtttggtgtttgttatcgtgtgcgtggcgttgttattggataatatgttgtatatggttatcgtgtttatagtgttcgattatatcgtttatatgcgcgggggcggcgagggttttattcggattttcgaggtgtgggagtttattttgtcgttgtttatttcggttaatgttagcgtttatacggttaatatttcggcgttttcgatagttgcgtggttagcgggtttagtttttcggtttcgttattttacggagagcgaagacgtgaagatcggggtgttgtttgtttttaaggttattttgtagttgttagtgaattttttgagcgggttttttatcgatcgtatgagttacgacgtgtcgttgttgatcggtttgggcgttatgttcgtttttatagttttgttcgttttcgtcgaggattacgttacgttgttcgcggcgcgtagtttgtagggtttgggtttagttttcgtcgatacgtttggtatagttatgatcgtcgataagtattcggaggagtcggagcgtagtcgtgtattgggcgtggcgttggtttttattagtttcggaagtttagtggtttcgtttttcgggggtattttttatgagttcgtcggtaagcgcgtgttttttttggtgttagttgtcgtgtcgttttttgacgcgttgttgttgttggtagtggttaaatttttttcggcggttgtacgggttcgggttaatttgttagtgggtatttttatttatcgttttatgttagatttttatattgtcgtggtggtcggcgcgtttattatttgtaatatttttttcgtttttttcgaatttattattgttacgtggatgaagtatacgatggcggttttcgagtgggagatgggtatggtttggttgtcggttttcgtgttttatgtgttgggcgtttattttatcgtgcgtttggcggcgcgttatttatatttgtagtggttgtacggcgcgtttgggttggttgtgatcggcgttagttcgtgtatcgtgttcgtttgtcgttttttcgcgtcgttagtggttttattatgcggtttttgttttggtatagttttagtcgatatagtattgttgtttacgttcgtttttttggtggacgtgcgttatgttttagtttatggtagcgtttacgttatcgtcgatattttttattcggtggtttacgcgttcgggtttatagtggtaggttatattgtgtattcgttgggttttgagtagtttagttttggtatgggattggttaatttgttttatgttttcgttttgttgttgtttcgtaacgtgggttttttgacgcgttttcgtttcgagcgcgatgtgttgtttgatgagttatcgtaaggtttgtacgatgcggtgcgtttgcgtgagcgttttgtgtttggttaggacggcgagtttcgtagttcgtttggtttttttgatgcgtgcgaggacg

SEQ ID NO: 6573 - DNA, 990 bp, Artificial Sequence; identical to SEQ ID NO: 6343
  Description of Artificial Sequence: Synthetic polynucleotide

SEQ ID NO: 6574 - DNA, 829 bp, Artificial Sequence
  Description of Artificial Sequence: Synthetic polynucleotide
gcggtgcgacgaggttaggttcgcgttcgttaagttttagggtcgttgtcgtcgacggttatggaggacgagtagttcgatagtttggagggttgggcgtcgtttcgggagggttttttcgtcgatttttagaggtatcggttgcgttttttggtggtttggaacggcgcggagggtaagtttgttgtgatttgttacgatcgtatcgcgtagtagtcgtagcggcgcgagggggttcggttggggttggagtataagttcgaggtcgtcgtgttttcgtttagttgggtcggtcggttttcggtcgcggggtttcgcggcgcgcgtcggtagttagcggcgttgtggtcgtttttggaatattgttttttacggttgtcgtcggagttggacgtgggcggcggcggggtttgaggtttggggttcgggcggtgggcgttgttttggtcggcgcgcgtgggtttcggcgaggcggcgttgtaggagttttgcgggtagttggagcgttatttgggcgcggcggtttacggttgtggcggcgttatcgtgcgcgacgtttttttcgcggttaagggtcgcgcggtcgattgcgagagttcgcgcgagtttcgggagcgggttttgcgcgtttgatgggtcgaggcggacgcgcggttgcgttaggtaagcgaggtcgggtcgtcggcgtttgatcgcgtttgggtggtttgggattttgtgggaggttttttcggcgtcgagagttttggttgacggttgatggggaggagtcggcgggcggagaaggttacgggttttttagtatttttatttgcgcgggatcgttgcg

SEQ ID NO: 6575 - DNA, 4119 bp, Artificial Sequence
  Description of Artificial Sequence: Synthetic polynucleotide
tcgtgatggtgttaaatcgagaggagagttcgagaagggggtgggtgatttttcggttgttttttattttcggcgttttgtgtttttttttttttttttttttcgttgcgttttagtcgagggttgttggagcgaatgggggatgtagaggaaggagttcgtaggttttcgtgtttttttaatttttttcgtttttttcgatagtcgcgcgttttcgttttagtttaaggttagtggttcggtttcgaggaaggcgcgggggtcgcgagagacgattttttatagtatcgttaaggaaatcggcgtcgtcggtgttttcgcgggtttttttcggtagttcgggggttgtttttcgtcgttgcgcgtttttttttattatttattcgttgttttcgtcggtcggagttttcgttttattaatttttttaatttcgcgggcggcgggtaggtgggggcgcgtttttaggtcgtaagaagggagcgtttcgagattttttcggggtcggttttgtttaggagggagttatcgacgtttttttttggcgttttttcgtcgttcggttttttaggcgcgtagtttttttcgagagtttcgaattttatcgttattttgtttttgtttcgggagaggggaggtcgaagtgttgtcggttagagggtttacgtaagtttcgaaattcggggggacgttttttttatttttatttttgcgttcgttcggggttgggcgcgtcggggcgtacgtacgtcggtttgttggcgatttggcgtatttgttcgcgcgttttggttttagttgtcgtaggttttttttgtatttatttttagtttttaaagttagtgtagttagtatcgtttatttggagttttaatttttttttgcgattttcgtatatttattgtattttatttattattttcgggtcgcgtaggttcgggtttgcgaagatacgcggtttattttcggttatttcgtttatttggttaaaggggttttttagttcggtattgggaaagatggttatcgacgtggcggcgaggttttttatcgggtagatgttgttagatagttggtgtataaaattattgagagttattgggattttgtttacggttttggcggttattatttgtttttcgtataatttggagatttaattttttcgttatttggagtgttagaaaagtcgttttggagaggggttggattgagtttgggatggtatttttttttgttttttatatttaaaaataattattatatatattaagaaaaaaaaattaatagaaataaaagtagtaaataagttgttgttttttaagaaataagaaaaatgtttatttgttattgatttttttttgtttgtgtttcggttgttgggaagttaggagttgttggtgtagtgttattataatagttagtgagttttttcgtcgagttattaattaattgtttttcgtttagttagacggaaagtgttgttttaagtatttatgggtaggtttttaatattcgtgacgtcgttgtttatatatggattgaggaatagggttgggttaggcggtttttgtcgttatatggttgatttgtatatacgggttcggtcgcgcggatttcgtcgggttcgcgatttttagttcgtaggcggcggggatcgttggggtttcgggcgcgcggttttagttgtagtttgggttcggggcgtagggatcgcgggggagagggcgcgttatggatttagttatagttatagtaggagagcgagttgttttaggttgcggtttagtttttcggggcggggaggaatttcggttttttgggattttttaaaaaaggcgaagattcggtgtcggcggtttcgtttttttagtttttgtttgggagttatttcggaaaattaaatttcggaaagaaatcgagcggagtcgagatattatagttaaatttttatttatttttttggtagtttaaaatcgtaagtaaaaggaggtagcgaagaaaaaaaaagttatatgtatttacggaagttgattgtttttttttgaattatttggtggaaagaagtggttggtgataagagtgaatgcgtattgtttttttggaaagtttgttttatttatataggagcgaaaacggaataggtttgggttgtttgtttgtttaagtattttgggtattttgggattgggagggtaaattttaggaggagtagaattattgtggggagtttcgagagaaatttttagtcggagatatttttttttttttgttcgcgcgtttttcgtttttttttagttgttgcgcggagcgggcgtttttttcggcgcgtttgggcggtcggttgcgtgggggcgtttagatggaagtttggatatttattttgtttttttagatatatatatatatatatttatattcgttttattttcgttatatattttcgttttcgttgttttttttatatattcgtttatatattttatattatatatttttttgttgattgcgttcgcgcgtcgtcgttgttagtagtgtttcggcggtagagcgggtttcgggttcgttggataggaggttttatgaagatattggtttaatttttattatcggtttttgtagttatagaatttttttgatttttatagtttaggatttaggatcgcgttttgttcgtattcgagttagaatatacgtattagaataaatattttttttttttttttaaaaaatatttcggtgagtttagcgcggtttttagtgacggtcgaaagtatttttaattatttttaagacgttatttttattttttaatttattcgttttattttgcgagatttcggtagaaatttttttgtttcgtttttaaagtaatttttaaaaatttttttaaagtttaaatagtagtaggttttggtttgttgggcgtaaagtttttattttttagtgcgttttagttcgtaatggatagtcgggtttgttcggggttttataggaggttggtttcgggtgtttaagtttagcgtatcgtcgtttgtatgatttatttatggtcgtttgtgtaggttgcgaattgttttagagttttttttcgttttaaagtcgcggaggttagggataacgcgtagggttagtttcgtaggtttgttttgttttttttttatttcgggttcggagcggttttagtttagtgtgggtcggggcgggcgggagttacggcgttacgtcgtggaggaagcgcggcgttgtaggcgggtttttagtcgtttatttgtttcgatcgttgtagtcgtgcgttagttttcgtcgggtttagcgtatcgcggttagggttttgaggttgtcgggagcggtttttttttttgtttttttattgaagcgttgtttttttttttttttttaaaatagtcggtatttagcggtcggttatttttttgatttaagttatttagagtatatttgggaaagtttttcgttcgcgttgtgcgtttttttttaattggggatgaaaaggatatggaaagaaatcgtagtaaggttagtattttagtagatattttattttagtaaaaatgtgtaaagttttattttttaagaaagaaagaaagaaaagaaaagtaagaaaagatagttgcgtttttattacgtgcgttagtttatttcgtttgcgttttggcgggtttcgcggttttcgcgttgattatgggtaagacgacgtttcggaagggagttcgattcgtatttcgggttttgagttcgaaagaacgggggaaagtcgaattatgtaaatgcggatttttgcgatggggttcgggttacggttttcgtcggttttttaggtgaggtatttatcggtagtaagcgcgggcgaggcgattgttcgcgtttcgtttttttttgcgtacgtgggcggatcggtaggcgggcgagttgttcgggtcgtttcgcgattggcgttgttgttaaattcgtcggcggtcgtcgcgcgttatttcgagggggagtttttggacgttcgagtgttcggttagtagggcgcggagggtaggatcggggttgggggcggggcggggtgtttgagcgagggaaaatcgcgaggttttcggttgttatttttttcg

SEQ ID NO: 6576 - DNA, 1575 bp, Artificial Sequence
  Description of Artificial Sequence: Synthetic polynucleotide
acgcgtttatggaaggtggtgttcgttttatcgttttcgtggaaggttaaacgagttttcggtgtgaattcggagaaagagagggaagtgtagcgttagttttattttatattttttttttgtttataaataattttaagtgttattttaaagaggacggggagcgcggtagaggggttttcgggtcggcgggttggggtcgtcggatttgtttattacgttttttattttgggcgagtttgtataaataaataaatttaagtcgtcggtttcgcgggaggtggaggaggagtgacgaggaggaggaggaggagggaggggggagggagagattagtttgggaagtagtacggattgtttattcgattcgtgtcgtcgtagggagtgtgttaagttatagaggcgtcggaatcggtttttgcgtttttcgttagtcgttacgatttatttttgtttatggggtttttcgtgtgcgttttttcgttcggggattgaaattgattggttcgggagatacgaggcgtttagaaggattgatagcgcggtattaattgttttgtagatatttgaagggaaagattgggcggagagaaggagagtcggttagatttttttaatttttttggatttggaacgtttttcgaaataattttttttttatttaggtgtattttaattatcgttggttgtgttttttcggtatttttttttttattgttaattttttcgttttttttgtcgggagtagcggaaagggacgttttttagcgatataagttttttttttttgtttcgtagtttggatagagttttttggtagcggttgtcgtttttatttattttatttatttatttattggtttttaagacgcgagaggatggtagcggagcgtatttataaagcggtagttatcggtgttcgcggttttggggagttgggcgcgttcgggacggtggttttggtggcggcgcgggcggagcgcggcgtacggttgtcgagtttagggtcgtgcgggttgttgacgttggttttttgttcgttggtatttagtttgttcgtttattttcggacggtcgagttgtaggttcgggtgttgcgtttggaagcggagcgcggggagtagtaaatggagacggttattttgggacgagttaattaattgttggacgaggtttgtgttttttgttgttggtttttattttttttcgcggcgttttttcgcgtagtttttagattgtttagtcggtgttcgcgggcgttcgttttttgcgagttttaggttcgcgcgagttgtttgcgggaggggtcggggatacggatagacgttgttttattagggattcggaggatttggtgggtaagagtatgatttagcgattttcgtttcgggtaagcgttttcggtttttagcgttgggagcgttttgggtacgtcgggtaggtggaggaaggttgggcgcgcggaggttcgcggaggcgggtaagttttatttttttttttcgggattcggttagggtggtgtgatagtcgtttcgcgttcgcgtagcggtaagcgcgtttagaggtttaggtcg

SEQ ID NO: 6577 - DNA, 2401 bp, Artificial Sequence; identical to SEQ ID NO: 6353
  Description of Artificial Sequence: Synthetic polynucleotide

SEQ ID NO: 6578 - DNA, 1579 bp, Artificial Sequence
  Description of Artificial Sequence: Synthetic polynucleotide
tcgaagtcggggagcgggagcgtacgtgcgcgtgtttattttgttttgggtttttcgttcggggaatttcgggggtgttagggtatttagggttagggaagtaagatgtcgggtcgtttattttttttatttcgtagttcgtttcgaaaattttttaaatcgagatttaatttggatgtttagtttcgtttttttttttttttttttttttttttttcggtcgaggttttttttagtttagtttttttttttatttttttttcgtcgtggatttttattagtatgtttatttgggaggattcgttggggggcgggagatattcgaagttatttatcgttagcgttttttcggcggttttttcgggcgatagcgtttcgggagttttattcgtataagtgttgtttttaattaattgtttgggcgggggaaggaaaggggtttcgtcgtcgttttcgttcggaggttggagtgttgttcgtcgggtcgtgcgttcgttcggtagcggcgtgtattagtattatttttgcgtgtaagtttgaaatgtgagttgttttcgatttatattcgttcgcgttttttcgtagcgaagtggttgggttgacggtttgcgcgcgcgagtgagtgcgggcggcgggttggggggcggggtgcggacggcgaggttcgcggggcggggagggcgcgcgcgagtcggggttttttggagacgttaaggtaggtttgttcgttttttatttttttttcgcgtttttttttttttttttttttttttttttgtcgcggttggtttggtttttttcggagtttttagttttacgcgggtatacgtagggtgggtggttacgttcgtagggttcgcgagcgcggcgtagagcgcgggtcgtgggaagttttttcggcgcgtttcgtgcgttttcgtttttcgcgcgttttcggtttattttcgtttttggagagttgtcgtttgcgttcgggcgcgcggttggttgttttttcggcggcggcggcggcggttttattagcggagttttcgtttatgattggtttcgttcgggaagttggagacgggcgatgaataattgatgtgtgcggtgcggtagtcggacggcggcggcggtggcgggtagtagcgagcgggagcgcgggagtcggagcgttttcggagcgggtagcgcggagcgagcgggcgtcggattcgttcgggttttcgcgtcgtcgtcgtcgtcggggcgcggagcggggatgtaggcggcgttcgttgtttgcgcgtagtttttgttcggcgttggttgaattttattcggagtcgttcgtcgcggtcgtcgtcggtcgggttttaagttttcgagggcgttagggcgggatcgcgatcggtgtaatttttaggtaagtgcggggtcggaggggtcggcgtttgggcgtttacgggtcgggttttgggtttttttcgggcgcgggggtgagtgtgcgtgtttgtgtgtgatagaggagggtcggtgtattgtgggtagcgtcgtgtgttgtatggtgttagttttaggtttggtcgcgagagtggtatcggcgtgtatcgggtcg

SEQ ID NO: 6579 - DNA, 919 bp, Artificial Sequence
  Description of Artificial Sequence: Synthetic polynucleotide
tcggggcgtttagtgtggtttttttattcgggagtttggaagggtttttcgtagttcgtaggagacgtagcgtttttcgtttagggggagtaggaggatagttggtcgttttcgggagttttaggcgcgaagcggttttttttcgttttaggtgagttttgttcgacgtttaaggtttaacggttagaatcgtttttgttcgtcggatttagcgaagttaggggaataaattttaaaaatagttcgggttttttcggtgcgtttatttttatatacgcgtttgttcgttatttaggagcggcgtttcgttgttaggtaacgagagttcgcgttttaggagttagtgtaggcgtcgtaaagcggaaggggcgcgcggataggtgagtagagggtacgcggtgggtagcgaagggggaacgcgtagtagagaggagagggcgtgtaggagtaggagtaggcggtagagtagagggggcgcggtagagtagagggggcgcggtagagtggagggggcgtgtaggagtaggagttcgtcgtagagtagagggggcgcggtagagaggagggggcgtgtaggcgcggggcgttcggtagagagaaggggtcgtgcggaagggggcgcgcgttaggggagggggttagagaggagggggcgtttaggagtcgggtttgcggtagagatgaggcggtgtgtaggagggagagcgcgtacgagggggtaacgggtagagaggagagggaatgaaagaaggggagcgtggtagagagaagcgggcgcgttttagggggcggggtttagggaggagggggagcgtaggatcggggcgggaggtagagaggagcgggtacgcgggacgggcgtgtgttcgtgaggggtcgaggaaaggcgtatgtggaggcgcgcggggtgggtgagtcg

SEQ ID NO: 6580 - DNA, 944 bp, Artificial Sequence
  Description of Artificial Sequence: Synthetic polynucleotide
tcgtcggagcgcgcggggacggcggcggcggcgttatttggaggcgcggtggcgggtaggtgttcgaattgtacggcgatgtagaggtcgttgtttagggggaatttgtggtagtgtagtattttaggttaggggaagtcgtaggtttttatgagcggcgcgtagtcggcgcgtacggtttcgtatagcgagcggtacgggtagatgggtcggtcgagatagacgggcgtaaagagcgagtataggaagatttgcgtattcgagtggtagcgtttggttagtagcggtagttagttgttcgtttgttgttttatttcggttaggttttcgtgttttagtaggttgggtagtcgtatgcgtttgtagtttatcgtgtggtagagcggtaggtcggtagggatgttaaggtattgcggcggtttggagtaggagcggtcgtgtagcggttcggtttgttagttatagtagtcgtatttttcgtagcgcgtcggcgtttagtgtagcgtttttagtagtagcgttagcgcggtcgttcgtacgttttttttcgtcgtcgtcgttcgtatggttgcgttttttttaggtgcgcgtcgcgtagtttttcgacgttcggtgttcggcggtttaggtgtttcggcgtgcgttttcggttttgattttatttagtcgtcgtcgtcgtcgtcgtggaggtcgtttaggtgggtggtagtttgcgttgcgggcgtttcgattgattttggcgttttttatttcggggttttagttcgggtttcgtcgtgcgttttagttaattttcggtcgtttggttttagttttaaggcggggaggtagtgggggcggtttttagtttttttcgtattttgttcgagcgtttcgtttagcgttaggttttgcgtttttttttcggttcggtttttttgtcgtagttttggtttcgtttagcg

SEQ ID NO: 6581 - DNA, 1096 bp, Artificial Sequence
  Description of Artificial Sequence: Synthetic polynucleotide
tcggttacgcgttgggttcggggaagaggcgcggtcgcggtcgaggcggggatagggaggcggtagttttttttgcgtagcgacggcgcgggcgggcggaggtcggggcgttttagtttttcgttttcgtttttttcggtcgtgacgttagagtcggacggggtaaattgagcggcggcggcggggcgttggggcggagattgcgattcggagtcgttcggattgacggagtttattgcggtgcgggcgttggcgcgggtacggaggattcgggtaggtatcgtaagcgatttcgaggtaatacggtttcggttttttgttcgtagggcgcggtgtcggaggggagcgggttcgggggaggtagggaggtagggaggtttttagagttacgcgggcggggttgcggggatttcggggtagtcggggcgtagggcgtagggcgtaaggtgtacggggtcgagcgtgtagtttgggaggtggtatagttgggggcggcggggattagggtagcgttttgggggttttaggttgggtttttagattgggttttcgacggcgttcgcgggcgttttttttagggagcgcgggttttcgtggggacgcgttcgaggtaggtgagtcgaggttggggcgttcgggggtgttttcggatgtcggtgcgcgcggttttttgattcgttttttcgcggtttgggggacgggagaatggggggtttacggtcgttttgggtttttatcgcgtatcgcgttcgtagcggagtttcggagttatggttttgagcgagttggcgttggttcgttggttgtaggagagtcgtcgttcgcggaagtttattttgtttatcgtgtttttggcgttgttgttggataatatgttgtttattgtcgtgggtacgtgcggatagggtatttttgtttcggtattttagttttagcgtttttttttcggtattttatttatttttgcgcggtttcggagtttcgttaaggttcgggaaagttggagaattcgttttgtaaaaaagatattttttttaggttgtcgcgtcggggttaggaggagtcgcgttgtgtggtttcgtttttttgatgttcg

SEQ ID NO: 6582 - DNA, 4048 bp, Artificial Sequence
  Description of Artificial Sequence: Synthetic polynucleotide
acgttagagatcgtggggcgagagagggagagagttggaagtttattgtttcggcggggtcggtagttttcggttttaattcgtaaacgaacgagtcgggttaagaatcgcgaacgtatcgattttgggatttcgaggttaagcgtggttgatggggtgggaggatttcgtattttttattttaggattttttttggtttaggaaatcgttgggagttttgttaagtgtggggattggtataatcgaacggcgtttttagttcgggaattagtttttgttcgtttattttcgcggtgtttttggggcgattttagttttttcgacgcggggtcgcgtaaggtagtagcggcggagcgttaggttagaggaatttgtttgtttttttgttttattagtttgggcgaggtaggttcgggatttagggggtcgtagcggaggcggcgtcggttagggattttgtagggatcggggtgtttcggagggagtggtgttggtggaggaggaggcggtggttgagggggagtaggtggggaaagaggaggaggaagaagaggaggaggaggaagaagaggaggaggaggagaagaagaaattggaggaagaggaggaggcgaaggaggaggagaagtcgtagcgggcgtcgtaggagcgagtgagttgggagcgaggggcgaaggcgcggagaagttcggtcgttcggtgggcggtagaaggtttagtcgaggcggcggcgtcgatttcgttttattttcggttcggatttaggttttcgggtttttaggcgtttatttttttttgacgtattttaaagagtttttttttttttattttagggcgagtaatagcgattaattattaagttatttattaggtttcggaggaagttgtttatgtgattttcgtattaattaggtttatgaattaataaatcgtttgtataatttgtgaagaagcgaatatttttatggattgtttttggatttagggcgttttgttcgttttttgtagaggagaaaaaatttttttttttttttgtttttttcgagaatttttttttttttttttttttgtttttaatttcgatttttttacgttatttcgttaaaaaaaaaaaaaaaaaaaaaaaagaaaaaaaaagaaaaaaaaagaaaaaaaattattttaatttacgtttgtaaatttttttggaaggatttttttttttttttttaggttgggcgcgtttggtgtaagattttcgggattttcggttttgtttttttttttttttttttttttttttttttttttttttttttttttttttttttttttttttttttttttatttttatttttattttaaataaacgagtttttaattttcgttcgttttcgtcgcgggtagcgggcggcggaggtagcgtgcggcggtcgttaggagttgggagtttagggcgttcgtttttcggcgtagtatgttttagtcggcgtttaagcgttgttttattatcgagtcgttggtggttaaggatagttttttgttcgtttcgcgtttcgaggattttattcgtttcgcggtatttagttacgttaattttagttttataaattcgttttttaacggtttttattcggtcgtcgtcgtcgtcgtcggtaggggcgtttattttaattcggatttggtgttcgtcgaggcggtttcgtattcgtttaatttcgtcgtgttagtgtattcggtgtcgtcgtcgtacgttttggtcgtttattttttatttttttcgtattcgttatattttttattcgtttcgtagtagcgggattcgtttattttttatttttggtttatttatcgttatcgatatttgggttatcgtttttaaggtacgtgttacgtcgcggaattgtagcgcgtcgttttcgtcgtattttttattgttttcggtttgtttcgggtgggcgtttggtaaggtttgggcggaggttttttcggttcgcgggttagcgcgttttgttgggaaattaggcggcgcggggtcgggcgtggtgtcgatttttagttttcgaagttacgattggtttggagtgatggtttgcgggtcgtttgattttttgggaaggggtgcgaacggagaagttgttttttagtgcgttcgaattagagtaggttgggttgtgcgtgttcggcgtcgcggagtttagagttcgcgggatttttaggtttttggtattttcggtaatgtttttaatcgttttggtttcgaggggcgcggataggattcggtcgttaggtttgttttcgattgcgttcgattttgtttattatttattttgcgtttttttagtttagattcgcggttttttagttttttatttttttttggaggcgagaggattttcgcgtttcgggagaaaagtatgggatttgtttttttttttttgtttttcggaggtttggggaggggcgggaattcgtgcgggaggaaagttttagggtttggcgttttcgtcgcgatttgtttaattggggcgtcgagtagttatagcgggaaggtaggttcggtttggtttttgtttttttttttttttttaaaaaaaaaaaaaaagaatttggttaggaaattgttttagagggaaatatttgttcgtgtgtttttattttttgcgatattttttatttgtttgtttttttttgggtacggggtgggaggaggagagttaaaattttagaaaaaggagtaattagtttacggattggagttagtaaaagatttattttcggcggtagtcgattaatatttcgcggtttgtttatttattaatttattgcgtttttgtcggagtttagaatcgggtagatgttatttttttttttatattttaaaaaattaaattaaaggaaaaaaaatttaaaaagttttttatttttaatttcgaattggatttgtttgtattttgtttggattgtcggtttgtttttttttgtttgggttttcggtgaatcgattttttatgttaatgagtgaatttaaaattttgaggttttgtttgaaaagtttagggttgtttttttttattcgttattagttatgtttatggtttttttattagattcggagtcgttgggatttttttgcgttatagattgttttggcggtgtttgtaagtcggtaatttttcgggtttcgattttttcgttcgcgttttttttttagttttcgggagtcgggagtttcggagtttagttcgcgagaggtagtagcggttgtagttaagtatattcgtcggttagatttttgtttcgatcgggttttaacgattcgtttcgtttttatattttttcggaggggtaataaaataaataatttaaaaataaatttttatgaaaattttggagagtagttcgtcgtttttttatcgtgggttaaagtttttcgagaggttagaaagaagagaaagtagttttttcgggttgtgggcgttaattttttggttaggttttgcggtttttttttttgtttttagcgttcggcgaggaggtggcgaggttcgcggcgttagggcggttgcggagtcggtcgaggttaggagtttggggattggtttttttgcgatagcggttggttgggtgtcgtatcggtggagattcggcgtttcgggtcgggtagttgagtaggcgtttttttcgtgagtttttgggaggattatcggttttcgtaggtcgagcggcgcggttatgcgaaggttttgagtacggtgtcgggttagttcggttcgggagaagtgcgcggtttcggttagagtagttttttttaatgggatttttgttgtgtttttcgtagggaacgatattagtttcgagagtttttttttgtataacgcgttggttcgaaagtttaagcggattcgaatcgtttttttttcgttttagtttttaaggttggaatacgtttttgagaagaattattacgtggtgggcgtcgaaaggaagtagttggtatatagttttagttttacggaaatttaggtgattgcggttcgggcgcgaggaatttatttaggcgtgcg

SEQ ID NO: 6583 - DNA, 3292 bp, Artificial Sequence
  Description of Artificial Sequence: Synthetic polynucleotide
tcgttgtcgtcgagacgcgtagcggatgtcgttgtttgtcgcggcggaggaagttacgtcgttgcgttttcggtttattttgtttttattaaagcgttagttagatagttttaaacgttagttggtcggagagattttttgggagaaagtgttgtcgtcggggttatagattcggagttgattcgcgagttttgggtatcggcggttagagtagaggggtgttttttcgagagtagtcgtcggtgtcgagaagttgttgttttagtagttttatcgagtgacgcgcgggttttggtcgggttagcgcgtatacgtatataggtatatttatttttggtttcgggggaaggtttatttttcggttttttagggttaaaggttaaggttacgcggatttttgagttcgaagacgtagtgcgaggatttatatttggatttttttattatcggttggatggtgggtggggaatttaaatttttttttttttggtttcgttttttttagtaggttttaggaaaaatatcgaggtcgtcggattttaaagggtaggaaaatgatgagtttttcgagggtcgaggttacgttttgttttttgggtcggcgttgcgtggttttttagttgcgtgggggcggcgggtttttgtttagttttagggggcgggggagcggtagttgcgagcgtagataatttcgaggtgattcgggagggtttggttcgttttttttttttttcgtaggtttggcggcgggaagcgggtttttgcgtcgtaggggggagaggtaggcgcggttttcgggttcgcggtcgttagtgcgtttcggttaagggcgtcgtttgtttcgcgtttttcgttcgttttttgcgttcgtaggagcgtttcgagtgtttttttagcgggagttaatatttttttgtgttaataggtttgtttttatttgttgtttaattggattatataaagttaataacgggcgggtttttatagttcgaagttaaagcgttaaaattcgagggaaggcgaggagggggcggtggcggaggcggttgcggggtcggggttcggttgagttttcgtttgtttaattttatttgttattgtacgcgtttaatcgtcgtatatttttcgtatttaatttggatgatattttgattttattattagtattcggcgtcggattgacgtagtttcgagtcggggattgtttttgttgtttttttcgcgggagtcgtagtcgtagtcgagtcgtttcgatttttcggtgtcgcggtagggtcgtttttcgttttttcgtattttttttttatgcgagttcgttcgtttgggtttttatttcgttttttcgtcgttggatttgcgttcggggcggttttcgattttgcgtttcgtagttgagtttcgtttatggtttgattttcggtttttcgtttgttcgtttcgtcgttcgtttgtttcgttttttttttttcggggattcggaggagaggggattatgtcggaattcgggtcggacgttgtcggtatcgttagcgtatagttttaatcgtcgtcgttttttttattcgtttttaaggagttttcgttttttattaagaatttgtttaacggagattattatcggtcgttttttaagttttagtcgtttttacggacgtttttcgcgttagtttcggttgtcgtcgtcgtcgtcgttgtcgttgtcgtggcggttaagggggttttggagggcgtcgcgggtttcgcgttttcgtaggtgggcgatttggttttttttcgttttgagatttcggcgtagaggtttgttttgttcgcgtattatttggagcgttttttagtttggtggtatttttatattttgattttcgtcggcggttatttttcgcgatttgaaggtatcgatttttttttgaattttcgttgtttttttgcgcgttcgtttcgttttcgtttcgcgttgttttttttcgtagttttgggattttagtattcgtaaattttttgttcggttagtttttttcggtttttagtttgttttcgcgttgggttgcgttgttcgttaatttaattttatttggtgagaaaagaagtggaattggagtttcgggtacggtgtttttcgggaaaagtggtttcgggcgtgaatagggaggtttcggacggtcggggtttgggatacggtttggaaggagggggtgattttaatgcgtttaagtcgaaagggaatcgttttgtcggtttttggcgaggaagttgagggaatggaaggaggtggtcgcgttattattatttgtttgtttgttttcgggaggagggggattttaggattcggcgttttttttttggtttagtcgagaaggaggtagttcgcgggaatggtgaggttttatggtttgggatttggaggtcggcgcgggttgagtttgtcgtttttaggcgtcgggtttcgtttaaggttgtgtcggtgtgtatgtgtgtgcgttcgtttgtttgtttttttagtttcggagaaggttttgttgagagatttttttttcgttttcggtatagatcgcgatttttcggagttattgtttaaggtcgatttcgattataaggagttggattttaagagttcggacgagattattttggaggagagcgatttcgaggaaagtaaaaaggaaggcgaagcggcgttaggcgcggtcggggcgagcgtaggggcggcggcggttatttcgggcgtagaagattggaagaagggcgttgaaagtttagagaagaagtcggcgtgtcgtaagaagaagacgcgtatagttttttcgcgtagttaggttttttagttcgagtttattttcgatatgaagcgttatttgagtagttcggagcgagtcggtttggtcgcgtttttgtattttatcgagacgtaggttaagatttggttttagaatcgtcgtaataagtggaagcggtagttggcggcggagttggaggcggttaatttgagttatgtcgcggcgtagcgtatcgtgcgggtgtttattttttattacgagaattcggcggtcgagggcgcggcggttgtagtcgcgggggtttcggtgttagttagttagtcgttgtttattttttcgtatttcgtttattattcgtattcggtggtttttttcgtgtcgttgttacggtcggtttgaggttttagaggggtgggggagggagcgttcggtttttttgttcggatttcggaggagattgggtcgggtcgagggcgtcgagaagtttagcggtttttaggaattggggtttgggcgcg

SEQ ID NO: 6584 - DNA, 3753 bp, Artificial Sequence
  Description of Artificial Sequence: Synthetic polynucleotide
gcgcggagattcgtcgtttgcggaggcgtcgagttattttagtttcgagtttcgtatcgtttttgtttttggagagaagggtttaaggggtttaaggagtcggagttgtcgtagtcgttaggaattcgggttagaatttgtagttgtttttagttttggttgtttttggttagacgtcgttgatgttcgttaggttttcggcgcgttttgggggcgtatcggtgttgtgtgtttggtcggagcgttttgaaatttttcggggtcgttcggcggcgttgcgattggtcgcgttcgggtaatttttatgtaaatgaggtcgcgtcgttttcgcgtcgtcggagattcggcgagttggcgggcgaggaaggggtatttgtatcggggttgggcgggcgtatttagagttaggcgggtaggaatttttgcgtagttattcggtgtttgtatgtttttggcgcggaagggacgttttattagtttcggcgttttttttttttagatttttttttcgtttttttttattgtttgtttgttgtattattttttatttagattatttagatcgtttttaaagggagtttttggtttttttcgattttttatgaatttaggatgggtagtaaagaagatgcgggtaaggggtgttcggcggtcggtggcgtttttagttttattatttagtttattttgggcgggggtttttcggaggtatcgcgggagttcgtcggttggttagttaggaagcgtagtttgttcgtgttttcggaggaggaggagtcggacgacggttggaaggcgttcgtttgtttttgtttagattagtacggttttaaggagtagggttttaagtattatttttttattttttttttttgtttgggtaaggatcgtacgtcgttagtgtggtagcgagcgagcgcgaggggagggaggttgagcgtttcgttaagattttcgcgtcgggttttttttggttagagttgcggtagtcgggggttcgggatcgcggggagaggggcgcgtattgtggtgtttttttcgttcggtgggtttttgggagtaggcgaatatagattcgtgtcggtttgggttttttggggaaggttgagttgttgagagagtggattatagcgagagggatacgcggtcggttttatattcggttgtttttaattattgtatatttggtatttttttttcggatacgaggtggagatttgtaagtcgggtttgggtagtttgtttttatcgtaatttttttttgagtttttttttttattcgtttcgtatttttgttttttttttttttttttttttggaatgattagtattttaagatgattgataatggtgtattttagagacggtttttttttataatatttgacgaaggggagttttgcgttagtttttagcgtgatttttaaataaacggtttgtgaaatgatgttattttataaagttcgaggaatttttttagtttaattattattaagtaaattcgttttttaaaattatgttaatgtttttttttttagattttttttttttgttgtttttggtttatttataaaggtgggagtatagagattttatattttaagtagttgggttttttttttgtcgtttttaaaggacggggtgttgggtttggggggttagtgagagggataagaggaggggattggtaaggtgggattaaggttgtaggcgtttgttaatcgtttggttttagggagagttggcggttttcgaggttttttaattaattttatggtttttttgtttgttttcgttttttaggtatttttaagggtagcggaggttcgggttcgggcggtttggagcgtacgttttttttttttttttcgtattcggattttaaagaagagaaagagaggtttttgttcgcgggttcgttttcgtcggggttcgagcggtcgcgggacggcggcgttgagcggtaggtcggcgcggttaagaagaagacgcgtatcgttttttcgcgtagttaggtgtattagttcgagtttattttcgatatgaagcgttatttgagtagttcggagcgcgtttgtttcgtttttagtttgtagtttacggagatttaggtaaagatttggttttagaatcgtcgtaataagtggaagcggtagttttcggttgagttggaggcggttaatatggcgtacgcgtcggcgtagattttggtgagtatgtcgttggtgtttcgggatagttcgttgttgcgcgtgtcggtgtcgcgttcgttcgtttttttcgcgtcgttttattattcgggaagtaatttttcggttttatttttttataatttatataataagttcgattattgatcggttcgtcgtttcgcgtcgtttttagttgttcgtagagtcgggcgcgtattgtattgtaagtagggtttcggagtaaggcggcgtgtttttagaaatatgaagaaatatattatgtgtatttattagtttttatttatggtttttgttttattttttgttttgattgtttcgggtatttattggtattttttaagttagagagtttgttttttatttagatcgaattagtacgttttgaaaattattcggagtgagatgttttcgggtggtggtgggaaagggagttttggttagataggttgtggttggtagggaaaaaaattaggaaaatatttataaaattaggtatattttttttttatatatatatttgtatatatgtatatgtatatacgttcggttaagttaggtttttagaggttttggataattattaaattgttttttttcgttttttttatttcgaggatggtagggacgaaaaggggagagtttagatttgtaaatatttttaaaaagaaaaaaaaataaaatattttaaatatttttgttaattttggtgggtttggttattcggtatgataacgtacggaaggtttttaggtttttcggtggaaagatttgtatgcgtttgtttgtggaagtttggttcgttttacgtggagggtgggatcggggttaggggttaaaggtcgggattttggcgtcgtttagattgtacgtggttggagttgttcgtttatttttttttttaacgtttagaatcgtcgcgcgggttggggcgtatttcggttggaatttagtttaagagttcgcgcggagaaagataaagattgggaggtaggtttcgttatttaagcgattgttttttgggaataagcgagttgggtgtttagcggtatattttcggtattgggttcgttttgagtttggttatagtagttttcgttatgatatgttttgtgtcgcgtattttttttttaggggtataaagtaggcgatggcgttgtttgtatttagtaaagtttttattttgttcgtcgcgagtttggcgcgattagtttgtcgttgcgtttagttattcggtcggtggtagagttatgtgtttcgcgcggagagggaattgggcgcggtgaggtagttttgcggtttaggagagattcgaggttcgggattaggtaaagaaggtgagggaggtaaaggcgtttttttatatttttttgttgttaatagtttgtattggtttagcgtgtggttggattatcggttagtacgcggtcgtttgttttgaatggaattttgacgcgcggcgggggcgtttacggattttttcgttttgatatttgcggtcgcgtaggggttgggagggcgttgtatcgagagaatagtcgcg

SEQ ID NO: 6585 - DNA, 829 bp, Artificial Sequence; identical to SEQ ID NO: 6574
  Description of Artificial Sequence: Synthetic polynucleotide

SEQ ID NO: 6586 - DNA, 1328 bp, Artificial Sequence
  Description of Artificial Sequence: Synthetic polynucleotide
gcggggtcgttgcgcgtttttttaagtgtgttagcgggggaggcggggttggaaaggaaatttggtgaagggttggttcggagtttggggtggggatatttattgcgggatagggttagtaagaggattcgatacgtatcgtttcgagtgatacgtgtaaatgttaagatatagagatatttgtaaatgttatttaagagggtgaggacgggggagcggtttcgaggttgtgtttttcggggtaggtattggtttttgtggggttgcgggttaagtgtcgtttttttttaaggaattggtatttggggggggggggtcggtttcgtcgcgttggaagcgtaagtttcggggtttcggagatgcgtcggggcgcgtcgtttttcggggtagttttggatttcggcgcgtttaggcgtagcgtgcggtgttttcggcggggcgggtagcgagtcgttttagttcggcgatttatttcgggtttcgtagggcgcgagtagagtatcggttagggcgagtaggagggcgcgggcgggggatacgggtagcgggcgcgttgttatcgtcgtcggtttttagtgtagtagttttcgggttcggcggcgagcgttgtattattttacgcgggcgtcgagtcggggtcgggcgtcgcgatcggagggattttttgtttcggcgagttagtttcggagttttcgcgtagcgttcgcgtcgtcgttgagtttttttagttttttatttttaaaaaagttttttttcgtgtgtgtgcgtgcgtgcgcgcgcgcgcgtcgttttggtataagttagttttgatcgttgtaataaatgagtaaattgttcgagttggttcggggattaggaagagcgttagtgagagaaggtaggtttgtgaaatggatttacggttagtagttatcgtttttattatcgcggaataaattattgtttttttcgtattttcgttagttggcggcgtttcgcgggttttagagatcgttcgggttttttcgttagggtttcgtttcgagtcgcggttcgtttattttcgagggtgggcggtttagacgtggtttagtggcgttcgggcgttcggagcgtatacgttttcgttttaggatgatgtggtcgtagggttcggggcgttcggttgttaagcgtatatgcggcggtacggtttagttttttaggttgaagttggaaacgatgattttgttattcgtttttcggttttttgggaattttcggagtgcgggttaggtttttatcgcggtttatagttcggcgcgcgatttcgttcggttttaagcgtttaaaggggtatttttcgttcg

SEQ ID NO: 6587 - DNA, 2957 bp, Artificial Sequence
  Description of Artificial Sequence: Synthetic polynucleotide
tcgtttttttcgtataggtgttcgattcggagttcgggaggcgggttttttttttaggtatttagtttagcgttagtttgggtttatttttcgttattttatagcgcggggagtaggggaggtcgaaagtcgggtagtttggggggtcgggataattcgggttgtagtaatttcgggcggtagtaggattggagagttggtgtcggacgtattgtagagacgtttttgttttcggcgcgtttttcgatatttagtagagagtttggcgtttttcgttttgcgcgttcgaggttatagcgcggagaaatttggcggggtttcggatttttcggtttgggaaaagcgatgattgttttgaattgttggggcgttcgaaatttttagggtttcgatttttcgtggggtacgcgcgatttcggcgtagatgttagttcgttgtttttcgggttgagggagcgaggattttagacgattttagggtcgttgtttaggtttagtttcgcgttttttatttcgttatttcgttttgcggttttagtttggagatttacggattttattgcgattttttgcgtagtgtagtcgttttttatttttagtttcgagtttcgggtaatttaggggtttcggcgaggcgagtttttttggggcgagatgtttcgagtcgagtaaaggggtcgcgtattggacggggtttttaagttatagttttgggggttttgaggagtcgtggtacggtttagggtagtcggggttgcggggttcgtgaagttagacgaggttacggatttagggtttttgtaattaagatcgcgagcgattgtggattcgggacggatcgtataaaggaggaagggggaattagaggggcgttcggtttaggacgtgttaggtttgggcggggcggaaaattgatattagggcgaggataaggatttcgtttttttagggttgttaggggaggggttcgttatcgttattttttatgggttttggtttcgacggtgtttaaagggcggagggttgggtcgggttggtcgtattcgggcgttgttggcggttaagttggatgggtcgttagtgagtttcggtgcggtatcgttggtttaggttcgggcgcggttggatatggttatttattgcgacgatttgggttttttttcggtttcgttcggttaggtttaggttatcgcgtatttttcgggttatgagttaggggatttgggcgcggtgggcgggggtttttttttgtgggtgaacgcgttagcgtttagttttaagttttacgtttcgggtttcgggtttgcgtcgttttacgcggtttcgagttacggggttttcggttcgtttttcggcgtttcgggcggtttggcgggcgtcgatttcgtttggttgagttttttcggttagtaggagttgttgaggttggtgcggtcgttttatttttattcggcgtttatcgttatggttatttagagcgcgtcgttgcggaagttgacgtttagttagatttattagtacgtggttggtaatttttttttttataagcgtagtaaggcgggttggtagaattttattcgttataatttgtcgtttaacgattgttttaagaaggtgtttcgcgacgaggacgatttaggtaatagcggcgcgtcggttcgtttcgtttaggattttttattttttcgtcgggtcgcgggtatttcgggggtgggagtattttagataatttaatttttttttgcgcggttggggatattcggggaggagggagaaggggaagaagtgtttgggtatggataggtttttagatagcggttgagtttattataggttcgcgtttatagtgcggcggtttcggggtttttaatttttgtgcgttttttcggaggaagaagcgggagagttagtaagttgggtgattttgggagtgatttaatttttttgggttttagtgttttatttggtaaaatggggaagatagcgtttattttaaggatgggtaaaataaataggatgttcgtttggaaagttttggagtttatttgggggtttggcgtggtttgcgttgtttttggtagagcggttggcggagttttattattagtatttcgtaggtttttttttattttaacggggttcggttttttttagggttttttttttttttttttttggattgttattttttttttagttttgttgtggaggtttatcgggtatagagtgttcgttaagggtggaatgggggcgaggatttagattttttgtaagggttagtaggggatttttttgaagttgattttttcgttggtttatattacggttcgttaaagttcgaattttttgaattgggttgtttttttttttgtaggtaaaggtaattattggattttggattttaattgcgagaagatgtttgataacgggaattttcgaaggaagaggaagaggagagttgaagttagcgcggtcgtgcgttcgggagttaggagcgtgggaggggtcgaggcgttagcgttggagttttcgagcgcggtttgtttggatttgtaggtttcgttttttttattcgtattcgaggtcgttatttgttttttcggtttcgtttttgttatgagcgttttggttggcggttttggtatttttttcgggggtttggcgggcgatttttttttcgggaggcggttatcgatagtcgttatttacgttttttagatttttaattttttttttggtttcgtttttggttattagatcgcggtcgtcggttttcgttttagttattttttttatagtcgggaagggatcgaagtttgaagggaggttggaggttagtcgggtgcgggtttagaggtgttgagtttaggttttcggttttttttggtgatagttttacgtgttggcgttgaaggttttggtgttttgggaggaagcgtagagtcgggggcggttcg

SEQ ID NO: 6588 - DNA, 1860 bp, Artificial Sequence; identical to SEQ ID NO: 6360
  Description of Artificial Sequence: Synthetic polynucleotide

SEQ ID NO: 6589 - DNA, 1422 bp, Artificial Sequence
  Description of Artificial Sequence: Synthetic polynucleotide
tcgtgtagttcgttcggcggcgttttcgggcgagggtttggtgttggggagcgagcgcggagcgaggtgtttttttaaatacgttttgtagtgtgacggcggtcgttcggttggaagagttatttttattttgcggtaggagttcgttcgtcgttatcgttcgtttcggtttttatggttacgcgtttgttttcggtttcgggttttcgttgtcgtcgcgggaggtgcgcgtagaggcggcggcgttgttggtcgggttgggtcgttcgtgcgcggggttgtgatttatcggtcggcgtcgtagtttcgtaatttgttgataattcggttttagttcggtcgttgttttcgcgaatggagagcgggttttcggcggggggagcgtagcgcgtttgttttcgggagcgcggttcggtcgtttcggtagtcgtttcggttatagtaggtgggaaggacgcgcgggtttgggcggcgggagggacgcgcggggtcgcggttcggtagaaaagttcgcgtttcgaggtgatattggtcgcgaggaaagtagtttcgagtaattttcggtttcgttggggcgggaggcgttacggataatttagggttttcgtttcgcgcgttcggttcggagttcgagttatatttaggtagagtaggcgtcgcggtcgggttggggcgggcgggttattcggtgtcggttttcggtgtaaatttttcggcgcgtttttggttttgtgtagttcgagatggttgagtttggtttcggagtcgggagtggggcgtagattgatttttaaatatggagaaggagacgtatttgtcgttggcgcgttcggttcgagttttttatcggtttttatcggtatcgttttcgttagttttaggcgtagtttttaggtcgttcgcggaggggagggagcgataggggtcgcggttgttttttggcggggtcggggttgcgagttgtttttcgcggggatttttcgttcgtttcgttgatcgtcgttgtttttatagatgggagtagttttcggattgcgttcgtttcgtcgcggttattttgaggttaggggttcgggagcgcgattttttggtcgtcgtttgggattttgattttttagaggttatggaggttggcggggagtagggcgttatttgatcgtttttttttggacgttttttttagcggcgtttacgttttcgtaattttgtagcgtttatggtgagtacgggggtttcgggggttttgtagttgggggttaggtcgttgcgggggggcggttattcgtatggggatttttaggttggaaaagttgtggaatggcgagttggtgatcgggttttcgggtttagtgtcggggtgggaggttttgtggagtgggggtcggggataggtcgcgtgtttgggtatttttgtttttcgcg

SEQ ID NO: 6590 - DNA, 1479 bp, Artificial Sequence
  Description of Artificial Sequence: Synthetic polynucleotide
gcggttttttttaagttcgaagtagggattcggttttgcgtatttggcgggtgtgtttagattgtaattttcgtattaggtatttaagaacgtgttttggatatattcggcggtgggagcgggtgtttggtttgtattagggatgaggggtggagtagcgaaagcgttcggagcgcgtatttatttatattttttaagttagggcgcggtcgttttgggcgcgaggttttaagttaagtttcgcgttcggttaggagtcggggagtattttaggttttcggtttggggtcgtcgttattttattttgcggcgcgtatttttgatttggtttcgtttttcggcggtcgcgagtagcgggcggagcgtaagtagagaggcgttttgggttgtgcggtatcgttttttttcggtgtttggggagggacggagggatcgggcgggagagagagaaagtttgatcgatcggttggcgaagagttgtatgtaatcggtgggaggtcgggtcggttgggtttggggttcgggtttaggttcgtatcgtttttcggtaggtttttggcggtgagcgcggacggttcggaggcggcggttttgagttggtaggcggagggttgttttttgcgttcgtttgttcggcgcggttcgaggatgcgggggggcgatgttcggggttagggacgcgttttgttattaggcgttgtagttgttggtcgagttttgtgttcgtggggttttggagtacgatagttgttaggattttatttattatttgcgggatcgtgttagatttcggtttcgcgatttaggtgagtgtcgttatcgtcgtttggagggatttaagggttttgggttgggatttggggtcgtatcggggtttgaggtagaatagcgacgcggattgggagagggcggggggcggttatcgagttaggagagtgattaagaattagcgtattgtggtttgatgttgtaattaggcggggattcgggcggtggttattgtacggaggtcgatttcgggtcggttagggtagggttggagggattacgttcgttatttgcgtttttatcgttaaggtttttgggggcggttttttagtttcgagttacgttttttatttttcgggttatttgtatttagagcgaggggaggtcgcggcggtttcggagtcgtgggaagggggacgaggtcgaaggaaattttgggaagttgggagttggggacggtttcgggttggggtcgaattttatcgggtgttgtttatttttttttttaagcgtttagtttttttttttggtatggggtgagaagggcgggacgcgattcggcgttgggtcggggatagggtgtttttggttttgggtagacgggtttgaattcgttttcggcgggtcgtacggtatggaggtggtttgggtttgggcgttaggttcgattagcgattatcgtcggttacgatggggttcgtagattcgtcg

SEQ ID NO: 6591 - DNA, 446 bp, Artificial Sequence
  Description of Artificial Sequence: Synthetic polynucleotide
tcgttattcgttgataataacggaatcgtgggtattggttttttaacgtcgtttcgttcgttttttttagttagtttggtggatatttcggtgaaggttgtagatttttagagttattttttttttaagtagcgtttttcgtatttttcggcgtcgggaagtttagagggagttggtttgtttttatttttaggtgtcggcggcggtttttgtcgtttttcgcgggataggaaggttttgggtagtagtagcgatagagttaggataagtttagaagttagagcgattttttgtattgtggagtacgttatgattgtttacggtggtcgtaggtgtagacgttagtcggaatcggaatcggaatcggagtacgggttgtcgttttcgatcgaatcgcgggcggcgcggacggcgtcgcgcgagggataaggtgcgcgaggcgtacg

SEQ ID NO: 6592 - DNA, 2991 bp, Artificial Sequence
  Description of Artificial Sequence: Synthetic polynucleotide
gcgcgcgtagttagcgtttttcgcggatatagtagtcgggtgttggagaggtttggaaagggcgtgtcggagagttaagtgtagtcgtttagggttgtcggtcgttttttttttttttgttcggtaggggatttagcgcgtacgttagtgtggaggggcgggttggttggttagtttgcgggtttttgcggttatttcggggatttttttaagtttcgtttcgtagtgtttttattggtttcggatttttttttttttagttgttcgtttgggtttcggggcgtttaggttattacggataaatagtttagggcgtttggcgagaagttaggggtgaggaagttttggggcgttgtcgtcgttttttttaattataaattaggtcggataggagagggaggggtgggggatagtgggtgggtatttagattgttagtattttgttatttatagtcggggttttcgagcggtagaaagtttcggttattttttgtcgtttgggttgggcgaagttaggatcgtgtcgcgttatcgttaggatatggagttattgtcgttatcgtttcgcgacgtagatttgacggttttcgacggttttttttgtttttttgttataacggacgatttttatgacgattcgtgtttcgatttttcggatttgcgttttttcgaagatttggattcgcgtttgatgtacgtgggcgcgtttttgaaattcgaagagtattcgtattttttcgcggcggtgtattcggtttcgggcgtacgtgaggacgagtatgtgcgcgcgtttagcgggtattattaggcgggtcgttgtttattgtgggtttgtaaggcgtgtaagcgtaagattattaacgtcgatcgtcgtaaggtcgttattatgcgcgagcggcgtcgtttgagtaaagtaaatgaggtttttgagatatttaagcgttgtacgtcgagtaatttaaattagcggttgtttaaggtggagattttgcgtaacgttattcgttatatcgagggtttgtaggttttgttgcgcgattaggacgtcgcgttttttggcgtcgtagtcgttttttatgcgtcgggttcgttgttttcgggtcgcggcggcgagtattatagcggcgatttcgacgcgtttagttcgcgttttaattgtttcgacggtatggtaaggtcgggattttaggaagtgaggaagttagggcggcgttcgggatattagggacgcgttttcgagggcggggagttggttttgcgggaggtttgggttaggatttttttcgagagagaggatttttttgttttgggtagttgttattggggtagtttgttttggaagtgtgcgggtaagcgttcgagttgttttattgggggcgttattagaatattgtagcgcgaacgtgaagatttttttttttatttatttttatttttaaaatgtaaatttgcgttttttggtgattgttcgtttttggtttggttttgtatgttgtagattttattttttatttattcgtaattatttttttaattaggataggtttgggttcggaattagagttttaggttagagttagggagggggcggttataggaattggtgttcgggtttcgagtcgtttcgcgggtttgatttagtcgtttttgttgtttgtagatggattatagcggtttttcgagcggcgttcggcggcggaattgttacgaaggcgtttattataacgaggcgtttagcggtgggtatttcgggtttttttttgttcgtttttttttttttatggagttgttttggtttttatttaggacgtttttatttttatttatatacgtttatgttttgggaagtggtgtaggagatgaaatattaagtaagtagttttttgttttttggattgtttcggattttaattaaagtttttagtttttaatttgttttaaagtattgggttcgggggtgggaggtttgtcgcggttttatttttgtttattaatcgagtttttttcgcgtagaatttaggttcgggaagagtgcggcggtgtcgagtttagattgtttgtttagtatcgtggagcgtatttttatcgagagttttgcggcgttcgtttttttgttggcggacgtgttttttgagtcgttttcgcgtaggtaagaggttgtcgtttttagcgagggagagagtagcggcgattttatttagttatcggacgtcgtttcgtagtgttttgcgggtgcgaattttaattcgatatattaggtgttttgaggggatggtggtcgtttattcgttcgagggatggtgtttttagggtttttcgcgtttaaaagattgaatttaaatgttttttttttaatagcgttttaaaagcgattttttttgaggtaggagaggcgggagaattgaagttttcgttttcgttttatagggtaaggatatagcgcggttttttttacgtagtatttttttcggagatttattgcgatggtcgtttcgtgtttttcggtgggttagagttgaattttgaggggttaggtttagttttttcgcgtttttttttatgggggtgagattttcgtagatttaagttttgtttcgggatgtatcggttatttgggggggcgtgagatttagtgtatttcggttttaaatgtagtaggtgtaatcgtaatttatttttaattcgtttttcggtttaggattattttttgtaatatttttgtaatttatttttgtaaataagagttgttttgttagagtaggagtttttggggttgtatttatttttgaggtatggtgtgtggtgttatagggaatttgtacgtttatatcgtaggcgggcgagtcgcgggcgttcgtttaggtgattaaaataaaggcgttaatttatatcgtcgtggtttcggttttttttggatatgggtgtgggattcggaggaaaattcgtaaattgggttagttgttttttagcgacgtttgtaggcggtaggcg

SEQ ID NO: 6593 - DNA, 928 bp, Artificial Sequence
  Description of Artificial Sequence: Synthetic polynucleotide
gcgggggcgagggggcgagggttggtcgttcgtgaaaggaaaaataaattttaaggaagtaagaaatcggacgaaaggattttattttaagtgatttttttgaacgcgtttttttaaatttcgcgatagtttaaggagttgcgcggcgcggcggttgcggttaagatttgtgattaatgttatttgatttgagtttatggggttttgtgcgttttgttatttattgttatgtcgttatttttaagtttatttcggagaaattattcgcgttttttgttttaaggttgagttttttgtttattttttttttaagagaaaagaagacgggaggggaaaagagagaatcggagtttttggtttggggtttaaggtttttgtttacgttgcgggggaggtcgtagtagattcggttggggtttttcgggtttaggtggttaaagttgtcgaaatttgttttggatagtagaaagagcgtgtcggaacgtattttgggggtttcgtttttttcgcgtaggggagagcgagtatgtttttgtttcgggcgtcgtgcggtcgtagtagtagcgcggttttttttagtgcgagtcgtgtttggaatgtttcgggtaagcgaagggttagtaagcgaggcgaaacggatattataaagtagagagtggtgtgagttttttcgttttttgaaaagatggtaagttttcgtttcgggaaggttgtaacgttaaggttattttttgtaggtttcggatttttagttttttatgttttttgtcggagtagttaatagagtgagagcgtattttggaaagattggtcggatgtcgggcggcgatagggaaaagcgttcgacgtttggttttggggtggggggtgtggggagggggggtagggagttaacgggcgaggcgaaggaggagggttgcgaggttcg

SEQ ID NO: 6594 - DNA, 1267 bp, Artificial Sequence
  Description of Artificial Sequence: Synthetic polynucleotide
gcgaatttcgagtaattgtttttcgagggggttcgtgcgcgttcggtggcgtcgtttcggtttgggttttttcgaggaaaaatatttattcgcgagggttcggcggtttttcgattcggcggggatgaattgtggtaatttcggtagtttttatcgcggtgcggaagtaaagagggtaatattggcgattgcggttcggaggggttggagcgcgtgaagtcgtgggggcgtcgtgcgtttttcgttttttcgtttcggtcgtaggttttgggatttcgatttcggtgtttcgggtgatagcggttgcggcgtttgtagtttagattttcgtagttttgcgggcgaaggaggcgaacggaatcggtttttagtggggagcgtaataagttatagtagttaaatttcgcgtttttgttcgggtttttagacgaacgtagtcgtagcggggggtcgggtttcgagttttacgtcgtcgtcgtcgcgttagcggtggggggcgggttgggggcggggcggtcggggttgttttttcgggcgtatatgcgagcgtagtattcggcgttgtcgagttatttttttcgtcgttcgttagtaagtttggcggttttaagttaggcgcgttttaggatttaggtttatttgtttttatttagtttcggtgttttttgttaggcggggattttcgagagcgatgtcgatggatttgattttagttgtgtggttttgtgtgtgtattgttaggataggtaagtatgattgtggcggttagagggattcgggaaatgggggtgtttatagattacggcggcgtggggagatttggagtcgagttttgcgttggtttggggaacggcggtagcgtggatcggtttttgggatttttttgttttgttcggagtgatagggtgaaaatagggatttacgggtttgaagatgttttcgttgagtgtttttttttaggggattcggttttaggggcgtaggagtgaggggcgcggtcgagtaggcgtatttttttgttgttagtaatcggtttttcgttttagggagtcgaaattcgtagtagggcgggttcgcgtgtttcgagttttcgaatttgtaaggtgttgtggaaattattttcgtcgattttcgttaggttgggaaggggtagttgcgggagtcgtattcgtagagggagcgttttcggttggcgggcgcggtcggggttcgggagggcgcggtgcggcgagggtagagagttgcgggagaattttgggatttcgcg

SEQ ID NO: 6595 - DNA, 1225 bp, Artificial Sequence
  Description of Artificial Sequence: Synthetic polynucleotide
gcggaagtcgtttcggattatgtatggaaggttaattgaaaagattagtcggggcgtttgtggtagttttgttattttgtgatagtgtttcgtttcgggaaattgtatcgttacgataaacgggatcgtgataaaacgatttttttcgtttttatttgtagattatttagacgagattgaattgtatttgtttttttttcgaggggagtcgcgtttttagggtagtcgaaggtttggggttgagggggggtttttattaaggcgcgggtgggggtcggagttttaattcgatgagaagtgataggcgtttgggggatttgggtttcggtcgggattagcgtaagtagggattttgcggggatatcgtttttttaatagagtaaggtttggtttacgttttcggttttttttaatttttttttattgtttttttttgtttcgtaagttttatttatttttttagttatagagttttatttttaggtataggaagtttttcggaaaaagaaaggttgttttagaaagagatcgagagagattttttaaatttcgggtatagttacggtaatttttagtttgttaatgttaaggcgggcgcgtaaggtcgtttaaatttagatttttttttttatttattttaaaaaataataacgtgttagttattttcgtagatatcgtcggttggtgtttgtttaggagacgttagggttagagcgttatttttagtatcgaaatggtagagagaaagcgtagttttaaatttttttttagaggttaagttttaattattgtgttttttttttagggattgttggcgttttcgtttattggcgatgattatgcgtttagaattcgatcgcgaagtaattaataggaaaatatatggtgttaatttggatgtttcgcgtttcgcgtatattcgggaacgagcggtataaagttttgtcggtcggttcgcgatttcgcgtttttcggggtttgttagtcgggtcgtagcgataaacgtttagggttgcgcgttttggttggggttcgttcgagagatagtttgcggttggggagtttgagttttaaggggagagtttagtcgtcgaaggcgagtttatcggttaagttttggggttcggtaggttttgtataattattttcgtaaagttcgttatttttgtgttttttttttagttacgcgtttattagtttcggaagtattagggggcgatcggcg

SEQ ID NO: 6596 - DNA, 1627 bp, Artificial Sequence
  Description of Artificial Sequence: Synthetic polynucleotide
gcgtagtagagcgtcggagaggagggacgcggaggttatcgaggggttagtagggtcgcggcgttagggtgggggtttttaggcggcgttggttacggtttattcgcgagggcgagcgcgttcggtcggtcgcgttttttgtcgttcgtgttcgggggtgggattcgcgtcgggagttgtcgagtgcgtggagggagttaggtttcggttcgtttgatggattgatttggagatggatcgaattatattatttgtcgtgtatcggtttgttttgtttttgttttgttttgttgttgttgttgttgttgtaaggggtggtggcgagttttaggattttattaaggaagttaagatttaaggagatagagggatatttatttttataatatttttttttatttttttttttttttgcgcgtggtaagtttttttttttttttttttttttttttattagtttttttttaatgaggtaagatcgtttttaataatttgttaatgtttttgtggcgttcggtgggggtcggaatttgagatttcgaatcgttgtgtgtgtgtgtgtgtgtgtgtgtgtgcgcgcggtgggggtcggaatttgagatttcgaatcgttgtgtgtgtgtgtgtgtgtgtgtgtgtgtgtgtgtgtgtgtgtgtgttgttattggatagttgatttattttttaagttgttttttttgtttgtcgtgtaagggacgcgtaaagggttagagaggtttggcggacgcgttaaaattggtaaagttggcggtttagggggaggggtaagtggatttggaggtttttttttattgtgtatttttttggaaaaaaagcggagggggtattaagtaaaagttttttgttaggtagagttagttcggcgtttttcgtatatagttggggttagtaggggttgtttttttgtcgggtatagcgtttttaggagttagtcggggagagttgagttaaggtcgaaggagtcgtttgcgggtttagtcgttttttttcgttcgttggttttagagcggacgttgggacgttcggggtttggtagttttgcgttcggttaggagcgggcgggcgagtattagtttgcgttttggagaaggggcgtagcgtcgtagttgaggtcggagtagtttttcgcgggcgtaggatatttgttagtgagcgttcggattgtacggttttcgggtagtgtttgtcggcgaggggcgggagttcgggtgatttggttatttttattttcggtttaggttcggagggcggtcgttttttatcgtttttttttttttattggtagagcgcgttgcgggcggattttcgggttcggagtagtttatcggttattttatcgtttattcggttttcggtgttttttttcggtcgttttatttagtaatttttcgtgttttgtttttcgattggaaatgttttacggaagcgttttggatagggttttcgttaggcgataagagttcggtgttgagatgtgttacgtttttatttttttattaattatggatggaaataaataaggaagagttaattttgttgagtttttttttcggtaacgagaggcgttttgtagtcgggagggagtcgtcgttcgcgtcggtagtcg

SEQ ID NO: 6597 - DNA, 1857 bp, Artificial Sequence
  Description of Artificial Sequence: Synthetic polynucleotide
tcgcgttgtttaggtaaagggattcggcgattaagatattttcgcgagggtttagggcgcgtttttttcgttaggttttagatttcggttttgcgttatttttttttacgtttcggcgcgggcgtagttagttcggttttttttaggtttttaagtttcggatcgagtgtggggtcgtttttttttttcggaaggagttatcgtcgttttaagtggaagaggagaggaagggggcgggggagcggggggcggggagcggaggcggaggagggggagggggatttttttggtttttacgtggttcgggcgtttgtgaatcgcgtttatcggagggttttatagcgaaatataaaagtagttgggaagcggcggggattcgagtttttagcgtcgggcggagcgtcggatagagtttcgtagcgtttcgcggtcgcgatggggtcgaagcgttcgaagtttcggagtttataaattgtcgggttcgtttcgtcgtcgggattcgggtgtttgggttcggtttgaagcggcggcggcgtatcggtatagtcgcgggagtatgggtaggaggatgcggggcgtcgtcgttatcgcggggttttggttgttggcgttgggttcgttgttggcgttgtggggagggtttttgtcgtcgcggatcgagttgttcgtttttcggtcgttcgaagatcgatttttacggcgttcggttcggagcggcggtttcgcgttcgcgtttcgtttttttttgttttcgtttttggcgtgggacgttcgcggcggttttttgaaaatttttcgggcgttgtttattttggcggtcggcgcggacggttcgtttcggtagtttcggagcgagtttaggtggtacgtgttagttaggtagtttcggtcggaggagagcgtcgcggtgtacgggggcgttttttggagtcgcggtttggaggagtaggtgttttcgggtttttcggaggtttaggcggcggcgtggttggaggcggttcgcggcgttcggatggtggttttggagcgcgggggttgcgggcgtagttttaatcgattggttcgttttgtcgacggtattcgcgtttgcgtgcgttacggtattaattcggagtagatttagggcgaggttttgttttattatttggcgcgtttgttgggtttttagcgttacgtgtcgtcgttggtattggttcgggtggaggttcggggcgcgtagtgggcgtaggtgtaggaggagttgcgcgttgcgtattggatcgagggtagcgtggtgagtttgatacgttggttgtttaattttacggacgtggtggtgttcgcgttttggcgttcggaggacggtcgtttgcgtttttttcgggatgtcgggggtgagttggttaattttagttaggcggagttggtggatttagtataatggatcgatttaatttttttcgattatttgacggttaatttcgatcggttcgtaagtaatttttttagtttgtagtgggattcgcgcgttatgtagcgtgttattagtaatttgtatcgcggttcgggcggggcgttggtttttttggataatgaggcgggtttggtgtacggttatcgggtagtaggtatgtgggataagtataacgagtcgttgttgtagttagtgtgcgtgtttcgcgagcggatcgcgcggcgcgttttggagttgtatcgcggataggacgtcgcggttcggttgttgcgtttttatcggcgttacgagtttcgttttttcgagttggtcgtttttgtagatttttacgtttagttgttatagcgtcgtttcgattttttcgttaagtatattttgtattgtaaggttaagtacggtcgtcg

SEQ ID NO: 6598 - DNA, 2423 bp, Artificial Sequence
  Description of Artificial Sequence: Synthetic polynucleotide
gcgcgcgcgcgtttgcggaggggggtggtaaggatttagaaggggagtttattttttttttcgagtttagttttggggagtcgggcgtttaggttcgttaggttgtaaagagagttgagagttgtttcgcgtttcgcgtagaatcggcggtggaataattagcgttttaagtgtgtgtatttgggattagggggcgggggagggggatttgcggtttcgcggttaattcggttggtgtagatttggggattttagaagggatagtgttcgtttagtcgcggcgattgagggtttttgttcgggcgtagttcgggttagtcgcgtgtttcggggtcgcggtttttttcggaattttcgcgggcggggtttgtttttcggagtcggttggcggggggcgggcggcgtcggggaaggggtcgttatttttttagagcggcggggcgacgttaggcggaagggcgcggggcgcgtacgttttaaatggtattcgttgttattcgagtttagagtcgtgtgggtagtcgcgggttatataagtcgcgagtttggtcgtcgcggggtagacggcgatagtagcggcggcgagcgtttcggagcgcggcggaatagcgtttttcgagtttcgtgtttttcgacgggttcgttcgttcgttcgttttttcgaggagcgtcggttcgggttcgcgagggtcgtcgttatttcgtagtagatttggatttttcgttcggcgagttttcggttgttgtttttcggggggtttcggcgtagcggtcgttttcggagagtttcggcgtttcgtcgttcggtttcgtagacgtcggaggcgttatggtcgttaagttcggcgagttgatgggtatttgttttagttattaggcggtgatgtcgtatttcgtgtgtttggtcgacgagttttcgtagttcgtgcggttcgttaagttgtttaagggtcggggtcggttgcggcggtcgcgttagtttcgttttaagacgtagtcggtgattttcgacgagatttaggaggtggaggaggagggggtgttttttatggaggaggagaaggttaagaagtcgtttttgtagagtttggagtgtttgcgtcgtagtacgtagagtttgtcgttgtagcgggagtagtttagtagttgtaaattgaggaatagtttggattttagcgatttcgattcggttttgtaaggggcgtcgttcgcgggggggacgcgcgcgttcgcggttcgcgcggggatcggcgtgtgaatttcgagagtgttcgcgttttgttttcgggggattcgtaaggattcgggatcgtcgtttttcgcgcgttcggattttcgtttcgttgcgaatcggtcggtgcgtttttcgtcgcgttcgttttggttcgggagcgtcgggagcggggtcgtttttttcgtttttgtaaatgtttattttttaattttttttagtgcgaattttgttgtgagtgtgtgcggggaggcgcgttcgcgttgagtcggcggcgggtagttattttatgtttttgttcgatggtttgtaatttcgattttgtatatcgttttatcgtgttttttagcgtatatttatttatatttacgttaatattttcgttgaatatttttataattgttaggcgtggtcgttgggattttgggcgtagcgcggttgttattgcgtttggaggattgatatttatttttgtattgcgatggttgaaggtatttatttaacgatttttttatttggatatgtttgtgaggtttttgaaaggagataaataaagttaatatatttgtatagtgtagttttttaggtttttgattttttgtattttcggggtttaggtttttaagattcggggaggtgggggaggaggtggtagggggatgtcggattagggagtcgggagtggagttatttttataagtttcggttatcggaacgaggttgcgttatcggtgcgcgggtcggttgtttgtttttttaagtggatttattttcggtttagtgtgtttttgcgtttttggtttattttttatcgtcggtattcgggttgaagtgaagtcgtaggaggggcggaggtagagttgacgatggagagttttttttttcgtatagtttattttttagagttggggttagggttttcgtttcgtattcgttatagaagacgtatttttttttgcgttgatttttggcggcgggtggggagatgtcggagttagtaatgcgagatgtttgggcgttgggattcgagagtgggttggaggttagtttgggttggtcgagagtgtgggtgcgcgttcgttgtcgcgggtaggtgattttttgatcgtagttgatttagcgtagtgtttggcgtttttgcgttgcggggaaaatcgcggtcgttatgtttttagtcgttttttgcgtttcg

SEQ ID NO: 6599 - DNA, 1146 bp, Artificial Sequence
  Description of Artificial Sequence: Synthetic polynucleotide
tcgtcgtaggatttacgttgattacgtttaagtcggtttcgtttattcgtttcgtttatcgttaattttacgcgttttcgttcggatacgcgttttcgtagttttggagcgttcgtatttatttataagttttcgtgtttagttttcgtgttttaggagtttatatatatttcgatttttacgaagcgttttaggtttttattttcgcgtttaggtatcgggcggtcgtttttcggggtttattttcgttgtagaatttgtcgtcgaagttcgtgtggttgtagtcgtagtttatttcgtcgggggttagtacggtgtagaggtcgtcgttggcgtaggggttgcgcgcgggcgcgtatagcgggtcggcggtggcgtcgcgtaggttttggttgtttagtagcgcggggggtcgttcgtttagttttaggttggttaagaggtcgcggaagggcggttcgtatttgacggtgtttagcgtaagcgtcgagaggcgtacgtcgggcgggatgtcgtttacgaataggtcgttggttatttgtatttcgcgtcgtttggagcgtatttcggcggcgcgggtttcgtcgtttatcgttagcgtcgtgcggcgcgcgtcgcgggttagtagtattatgtgttagcggtcgtcggttatcggcgtgtttagttgtagcgtggtcggttcggcgtacgaaagcgtgaagcgtagtcgtaggcggtcgtttattagtagtagttttaggaagtcgtagtcgtcgtcgtcgtttaggtagagtagtagcgcgcgcgtggcgttggtgcgtaggttgaagttgagttcgtcgttgttcgtcgcgttcgtttagcgcgcgtagcgagtttattgttcggggtcgtcgtcgaattttaggtcgttcgcgcgcgtcgttagcgttagtagtagtagtaatagtagcggcggtggtgtcggtcgttatcggttttcggacgttatgtttacggcggtttcggtttcgttcggttttcggttttcgtttaggttttagagtcgcgggcgtatggggcgggagggggtcgggcgtttttcgcgttgagcggggtttttttgtaggtttatagtgttatgggttcggtcgcggggcgaggcgcgtagaggtttagatgtcg

SEQ ID NO: 6600 - DNA, 577 bp, Artificial Sequence
  Description of Artificial Sequence: Synthetic polynucleotide
gcgggtatagtcggtttttgacggcgtttaaggtttcgttcgtgcggcgttgtttattttttattattagagatcggttcgtttagcgggtaggttttattttaatgttaggttaaagtttttattttttggattcgggtttggcgttttcgttttcggcgcgtttttattcggcggacgcggtcgcgtataaggtttagtacggttcgcgttttcgtagttcggtcgcggttgaatatttttagcgcgaagcgggtgggcgttagtagtttcggggacggcggtttttaggtttgaaagttggcggttcggggttgggcgggggcggttattgcgttcgggagtagttttagtagcgataggagttgtagttagggcgttatggcgagggcgaagtcggcggttcggatttaatagacgttttatcgatttatcgggtatcgagttcgcggttagcggggtttgagttttttttttagcggggcgacggtacgtcgattaatgggcgttggtttgcggcgtttgcgcgtttttttgtttataggaggtacgtggggcgcgtagggtagggagagcg

SEQ ID NO: 6601 - DNA, 1721 bp, Artificial Sequence
  Description of Artificial Sequence: Synthetic polynucleotide
acgaagaatcggttggttacgtcgaagatgtttattacgtttcgttttacgggcgagagttttagtaggtttgggggcggggcgtaggttattgcggggtaggtgatttttggtttatttcgtttttcggtttgttcgttttcggggattttatttttggggtggggttggggataaagggttagggttttcggcgtagtcgtttttaagggtttttagagtttaagttgttttttagggttttcggagtttaagtttgcgttagtttagattagtttgtttgtgtaggggattttcggcggtcgtatttagtttcggatttttagacgcgagttcgattttagcggttttttagtttgggttaggtcggggcgcgtgtttcgggttttttgtggttgtatcgcgcgttttgtgtttacgggcgaaggcgttggaattcggcgttcggagttcgagtttttgaaggcgggaggcggcgttcgattttaggggttgcgttgggttgtcggagttaagagtgtttgcgtttttagtttcgcgttagaagggatcggagttcgagttcgtttcggttttcggggttttcgagtaggtgttcgtcgagggttttagagtgtgattgagcgggttggttcggcggtcgttgtttttcgttttcgttttttcgcgtttggtcgcgttatttattgtcgcgggtgttcgcgtgcgcgtcgtcgatgcggtcgtcggggagcgtttggaggtggaagtcgatgtttacgttgtagtagagtcgtcgtagtcgtttgatgtttagtaggtagtcgtcggcgtcgttttggacggtcgtttttttgggttgcgttgttatcggtaggcgcgttaacgagagcgttattaggtttttttagcggcgttttagttcggtttttagcgtgtcgttgggtgtagtgggtgcggcggcgttttttcggttcgtttagggcgttagtaaggttagtaggatcgtcgggagtagcgttatcgcggtcgtttcgggtttcgatatttcggttcgagggtcgtgcgtcggttaggcggttagtgcgttcgggaagttggggggtagagttgcgtttgtggcgtttcgcgggagcgtacggtcgatttcgggtaggagtgcgtaatcgaggaggtgcgggaggtaagcgacggggttttcgggcgtcgggttttatttcggttgtatggagcggcgagtcgggcggaaagcgcgcggttggagttgggattttgaggagtagtgcgcgtttttttgagcgttaggttcgttcgaggtcgagtcgttatatatatagttcggcgtttttttttattcgttcgttttcgcggggggtcgttcgcgtttttttgggcgttcggggcgttgtggcgttcgcggttggtcgtaggtcgtttgttaattagggtcgggggaagggaggaggttggggattagcgtcgcgagtgttatttggagggatttcggtttttatttttggtttcgttcggtttacggatttgttcgtttcgttttttggcggtttttatatttttgttttttagttagttttgttttttgtattttgtttttgtttgttttcgttttcgtttttttttttgtttcggtcgttttggcgtagttttaattcgggtattcgaagtttttagtgggcgtagaagttagcggttgttgtttgtttttcgtttttcggaggtttacg

SEQ ID NO: 6602 - DNA, 1721 bp, Artificial Sequence; identical to SEQ ID NO: 6601
  Description of Artificial Sequence: Synthetic polynucleotide

SEQ ID NO: 6603 - DNA, 615 bp, Artificial Sequence
  Description of Artificial Sequence: Synthetic polynucleotide
tcggcgtttgtcgagcgcgtagcgtcgggcgaggcgcgcgggattagcgggtgttgcgggcgcgcgggttagaggcggtcggcgttttttgttcggtgggttcggggtcgggtcgcgggggtttggggttcggcggggcggcggttttagtagcggcggcggcgcggcggtcgcggagggaggttgagcgcgggtcggttgtgttcgttaagggttttaggcgtcgcgttcgggcgtatttgtattttgtcgcgggaagtaggtagttcggtttggcgttggtttagcgttggcgttttttttggggtatcgcgggttcggtggattggttattcgagaaataggtttatttttttttttttttttttgtgcgggttttcgggacggacgttttaggcgcggcgtcgagtggaggcgagggggttgcggagggggaaggggttacgcgggttacggggtttaatttttgatttttcgcgacgttaagaatgtaggagggtagagttgagggagattttaggtggaatttttaggtggggaaggttgagttgtcggggttgcgggtatcgggaaggtttagggtaaggcgttcggcggtgcgtgttcggaatttcg

SEQ ID NO: 6604 - DNA, 1542 bp, Artificial Sequence
  Description of Artificial Sequence: Synthetic polynucleotide
acggaggcgcggcgttttttatagtcgtttttaatgaagggaagcgtgtttcgaagttagtttcggtgcgtttttttttttttcggcgtttttttttaaatttcgtcggatttttaaaggttggaataggcggtgcggttgtagttcgcgttgtaatcgtaggatatttgatggggcggcggcggcgggggtagggcgtagtttggaaagaagggggcgaaagaggttaaatggtttcgttcgtttttttcgtcgggagaattcgtagcggcggggtatagggggtttaagggttcgtttaaggttaagtcgtcgcggggggtagttagggggttttttttggtcggggagtagttcgggacgttttagggttcggggtatagtaggttttttattattgtcggcggcggtttaaagaggtcgggttttagtttcgggggttttcgtagtacggaggtttcggcggggaatacgtcgagaggttcggcggtaagtaagattgtcgttttcgtgtcggcgtcgtagtcgggttttagtagtttaaagaattttacggttttcgcgtttttttttaggtcgtttaagtttacgttcggtttcgacgggttatattcgtcgtcgtttgttcgggacggtttcgtgaagaaggacggaggtagattgcgtgttcgtagcgggatttttttggtttttgggatcgtcgtggttttcgcggggtttgttacgttttttttcgcgtttttagtgttcgtattttttagttcggtcgtcggcgtagttattttatttttcgtcggttcggtattttcggggacgtggcgtagcgagtcgaagagcgcggttagatttcggttttgtaagttggcggtcgcggcggtttgcgacgtttttcgtcggggggtagttttgtcgtgggtcggggtcgcgattgtcggggcgttaggggcggttagcggtcgtttggttggcgtgtcggcggcgttcggggagggcgggtcggggggcgcggcgtttatgaggtcgttgtagcgtttgatttgtttttgtaggtatttgcggtggtttatttttcgtttcgatttgttcggtttgtttagcgttagtttgatgttgttggacgtcgagttaatgaagttgagtagatcgcgggtggtttcgcgtacgttttttttttcggttttcgatagtagcgtattcgtcggagtttcggttttatcgttttcgaaatagtagtttttgtttagggtttcgaaggcgttttttagttcgttcggggagttttcgaagtcgaagggtacgaaagggtgcgtgttgaggagcgtcgtttgtatcgttatcgtcgcggttttcgggttgttcgtagcgttgttcgtgcgttttcgttagtttttgttcgtcgtttagatttagttttcgtttcggcgcggcgcgcgcggcgtagtttattagtttcgggtttggttcgttgcgttgtttttcgggggagtttattaggttttgtaagtaaggggcggagggagggagcgcgcggcgatcgtttcg

SEQ ID NO: 6605 - DNA, 1542 bp, Artificial Sequence; identical to SEQ ID NO: 6604
  Description of Artificial Sequence: Synthetic polynucleotide

SEQ ID NO: 6606 - DNA, 1768 bp, Artificial Sequence
  Description of Artificial Sequence: Synthetic polynucleotide
gcgcgtcgtgttttttatcgtttttttttttggttcgattggttttggttttttttacgtttttagtttttaaattggcgttcgttttatggttcgtgtaggacgttaaaagtacggtaaattttagggcgatttttagtagacgttttcgacgtatgatgtcgagtcgttatcggttttcgtcgttttttgtcgcgttcggggttcggtttgcggtcgtcgttgcgttttgaagcgtatcgcgtcgtcggggtttcgttatttcgtcgttcgtttttcgggtcgggtttttttcgttttttttaggcgttgtttttattttaggcggtttttgttagttgtaatatagagataaattttcgaggcggggagatttttagggtatcgggatgttgaagtttcgcggtttttatttttaagtttaattcgtgcgtcgtttgcgcgtggcgtagttaatttgggtaagggaagatcgtttggtttatagttggttggaaagtttaggttttcggcggtagtagtttcggtcgatttttcggtttttcgggtttcgttagaagagcgcggcgtaaagtatttatatttttagcggttttaagtttcgggcgagttttttgggtttattttttttagcggtacgaattgcgcgcgatgcgcgttttgaacgttttattttttagtttgtttttttcgttaggttggaagttagtcgcgtcgttttcgtcgatttcgggcgatgttatcgtttttcgaatatttgacgcggagttcggtattaagagtttcgggttaggaagttgttaggtaggggagggttagcgttagttgtggacgtttcgggatagttttttattttagtttttgtttttgttttcggcgcggcgtaaacgtaaaagttttcgtggtcgtagttttagtttcggtggtcgttcgattttcgtcgggatttcggttgtatttattggagaagcggcggtttcgattttcgaggaggcggcggcggttgtttttagtcgtggtcgttatagttattgttcggtttcgttcgtagttgttttagttgtggtttttgttcgtttgtggtatttatagtttttgtcgcggttttcgtagtttttttttttttttatttttttaagtatcgttcgcgtagcggtttttcgcgagagaaatattttttttaaaaaaagaaagaaaaagaaaatgatattttttttttcgtcgtttttattattattttatttttcggttttatttattttttttttttatttttttttgttagttttcgtttcggtgcggggtttttcgttcgtaggattagcgtagtgggaggaggtagaggtgattaggttttgttcggtttgggattttttgttttgaggtggggaggggagaaatgggaagaggtggagtagcggttttagttcgttttgcggttgcgaggtttagattcgagattaatttttttcgcgataggtgaagttttatcggagtagaaagttgttttatttgtattaagaatgcgcgttggagacggttgtttcggaggttttggttcgagagaaaattagttttcgttgttcgcgtttttcggtagcgcgttttttgcgtttttttcgtcggatatttagtagacgtcggaggtcgggaggttaagattgggcgcgtcgtaggtcgggatcgcggtagaggttgttgtgtcgatcgaggagagggttttgtcgtttttatttgttttgggtgtcgagagtttattttagacgcg

SEQ ID NO: 6607 - DNA, 2656 bp, Artificial Sequence
  Description of Artificial Sequence: Synthetic polynucleotide
acgtttttttcgcggtaggaaagtacgttggtgttattttagagttttagagggttgagggaagattcgagttttaaaattagtcgtttttaggttcggcgtcgggaatgttttttagttcgtcgcgtttttttcgtcgttttttttcgcgcgtttttttttttttgcgttacgtttttagatcgttagttattttcgtcgtcgaggtttttttttttttcgtttttttcgttcgcggtttgggaggaggagattgcgagagataagcgcgagggggagattggagaggggtttggtcgtgcgtcggcgtcggttgtgatggggagttcggagtagttaggcggcgagtagtagcggcggcggttgtagttcggagtagataggagagtcggcgttttttttcgtaggttgcgttgtgaattggtttgcggattgggatttcgcgtttttcgttttttttttttcgttgttgttttttttatttcggtttttttttttcgtttgcgaattttcggcggcggcggcggcggcgtttcgagcgtagagcgtttttgttcgcggttttagtttcggttagcgcgcggtgggcgttgcggcggtagtagtcgggggatcggttcgttcggagtaagagcgtcgagtatcgggtgaagaagattacgggggaggcgtttcgtagagtcgtggatcgttagcggaggtaagggtgcgtggggatttgtagcgtgatgatttggttgtttggtgtatcgattggagcgcgtttgtcggagtatagttttagttgttgggtgtaaatgggttgcgaggtgggttggggaggcgagagtcgacgaagcgcgtgggggaaattttttattttgtaaagttttaattttcgcgtagtttcgagtcgtcgttgttatcgttgtaaataggagaagagggtggtttggtttcgcggcgggagtcgggaggtttatacggagagttggttaagtttggggttgaggatttggggaggggttgcgaggggggttgcggattagtgtatttattttcggtttttagtcgtttttgtaggtggatgagaaggtttaggtggcgagtttgtttggtagtcggtgtttttcgggcgtagtgggggatgtttagatgtcgatggatgatgtatttaggggatttcgaggtgtaagttgggttatcgttaggcgaggcgcggcgtagagagggagtttagtttttattttcgttaggaaagggaaagggttattagtttgcgggttcgttttttacgtttgattcgggtttgcggggtttgtggttagggtgagatgtagtgaacggcggcggcggtttttcgattggggacgatattttttacggagtggttggggatagagattgtttttgttattttgataaggagagggaatcggaatgttttgcgagagtgtatgatttttggcgggcgtgtgggaaggttgtttgtttttgaaaagaaagtagcgcgggtttgattatttttaggagtgcggaggagttgttttcggattgggggcgagaacgttaggggtattagtttcgagtttaggttttattttcgggcggttcgggacgaattttttttataggttagtgtgtgtgtagggtaagtgtagggggttgaggggcgttggcggggaggtagtagaggtggtttggattattttggcgcggcgcgcggtgagcgcgaggatttcgttagtgggagtcgttgagttaaagtgtatttggtttttcggtttgtatgatggcgagttcggatatttttagttgtgttgtgatttgaattttttttttttttttttcgttgatttttgttatatgtgtttttcgagatggtttaatattgaatatgattgggttttgcggaaagtaatttttatttattttttatcgttttttttttgtgggcggggggtggcgggggcgtgtttggggtaaggatgtaggggtggtcggagtttggttgcgagttaagagagtcgtttgggttgttcgggatgagaggaataggggtgttttcggggtgtgggtgtgttggcggtgatattttgaggttgtagttcgttggaataatgggtttaaattaggcggtggagaggggttttcggaatggacgtcgggggcggggaggttgcggagattttgcgaggttttcgtgaaggattaggaggggttttcgggagggagtggcgtttgcggttcggagcgtgggcggtcggtggttttggtacgcggaatttggtggatttttagcgtttcggtcgggagttttagttttatttcgtcgtcgtcgcgcgtttaatgggatttagtttcgggtttgggcgaatttgtagtagtcgcggcgggagggagggacgttgggatcgcggtaatgattgaagttttttttttttttttttttttttttcgttttttttcgtttttagattttggcgcgtttgttttttaagttggattttatttttatttataagtgttagataaattcgcgagaattttttttaattcgtttcggttttagttagattagggagggcgtttagggggagggggcgagttgtttgggtagtgtttggggaggtgcgacgcgtttattcggggtttgagcggttggggtttttgtgcg

SEQ ID NO: 6608 - DNA, 623 bp, Artificial Sequence
  Description of Artificial Sequence: Synthetic polynucleotide
gcgtcgtagcgttttttgtttataaagttttgttagtcggagaaggtgtagttgttttaagagaagaagtgcgaggtattgggtacggttagggtcgttttcgcgttttgttcgtcggttcggttttcgtggggttcggtggttcgtattaaggggaggagatagagtagtaagaggtgagggattattttgtaggagttattttttttttgggagtttgcgggtcgggcgttttttttcgttgggatcggagcgcgtagtcggggtgcggggcgtatagtatataaggtcgtttcgaggagttagggagttcggacgcgcggagtatcgcgtcgttcgttattagttcgcggtcggtacgttagtttcgggtttgttggagtatttttatatttttgtttttattaggttgttagggagcgtttttgtttattgggtagcgcggcgtttttcgcggcgacggtgacgcgttttggttttgataagtttggttttttttattttatcgggtggcgtcgttgttgattttacgtttagtcgtttttattttcgtttgaaattttttcgatagggtttcgtttcgggggtttagtttttagcgcgtatatattcgcgtggtgtcg

SEQ ID NO: 6609 - DNA, 1967 bp, Artificial Sequence
  Description of Artificial Sequence: Synthetic polynucleotide
gcgcgtcgtttttgttgtttagtcgaatttcgttttttttagggttgcgttgtacggggttgttttttcgagtcgttagcgttcggcgttttttcggcgcgttcgttttttttattttgtgcgttcgcggcggtgggagtagagtcggtcggtttttggggatttagcggtcgcgttggtgatgggtagcgttttttttttaaaggcgggcggcggggcgggggaggtcgcggttcgggtggtgtcgtcgtacgggttcggatttcgagggggaagtggtttgttagtttcggtttcgggaagagtgaataataaggttagggtagtcgttttagatcgttatatttttgggtttaataaagttaggatcgttgttttgtttttttcgttttagaagaataacggtttgtaaaatggggtaaaatgggtagaatcgtacggtcgttgttgttggtgtgatcgttgttgtattttagtcgatatgacgttagttttttatttgttaaattgttggttagttgtaaagtttattttcggtcgcgagtattgaaggatgggagggtcgagcgtcgcgttttgataggaggaagtgcggaggggcggagggcgaggagggcgtgattggggttgtttggtgtgtgcgcgcgcgtgtgcgcgcgtgtgtttttatacgcgtcgcgtgtttagtgttgtacggggcgggagaagaatggtaggtagtcgttcgaaatatttcgttttgttttttttttttgggcgaggttttcgattttggtaaagtgtgaataatagggagttgggaggaagatagtagtgatgttgtcgcgggtggcgggggttgcgtcgtcgtttagagaatttcggtagtgtgtagggaggtgtattttattttggttatttttatttcggtttttttggaaaatttttttgtgcgtgtttatttttttttttagttgttatttttttatttttatttaaggatttgcgttttggttttgatggacgggagggaaggaagaaaagtaggggtcgtagagagttgggtgggttgggcggatattttgggcggggggcgtgtgttgggaagcgatcgaggaaagtcgggcggaggggttgtgtgtcgcggtcgtagttttaggtatcgttgtatttgttttggacggtcgattttcggttggggagcgtacggggcgggttagggagtatttagtgcgtttttttcgcgggcggtataagagtagcgttcggtcgtcgtttttagttaattcgggttttttttacggcgattaattagtgcgaagttggttgggcgggaagtcgcgagaggtttttattgcggcgcgggtggcggttaggagttgttaggatagtttttcggtgttttagtttaacggtttcgtttatttatcgttaagagaaatttcgttttgcggtcggtttttcgtttgttcggtagttttcgaggaaataaaatggagattaggtggttatcgggagtgtttttggttcggtcgttcgtgttcgtttattttcgttttttttacgtcgatttggagtattttatcgttttcgttagcgtttattttcgcgtcgcggaattcgggtttgagcgcgtcgtcggggagggtattttggtaggtatatttacgcgcgtgcgttgatcggtcgatcgcgggtcgggggttttattgacggcggggcggggtcgtggtagggttcggagaggaggggtggggattaagtttagttcgtttggttttgggttttcgttgttatttgggcgggggttatttcggttatgttttttttcgcggtgttcgtgggtgtcgcgacgcgatttgtttatatggggcgggggaaggggggtgtttttgagatattttcgttttcgggtgggagcgtgataatggagttcggatatttggtgggttttttgggggatcgtttggcggttttttttattatcg

SEQ ID NO: 6610 - DNA, 2558 bp, Artificial Sequence
  Description of Artificial Sequence: Synthetic polynucleotide
tcgcgatagttaaaaacgggtgtttcgtttcgataatagattttcgcggattttttggtatttggtttattagcgttcgcgaattttgtttcgggagatttattgaaattcggatgtttaagtcgggaggcgcgtagtaattaggaggatgagagggtcgggtttgggttaggaaagcggttttttaaaatagatgttagggggattgtagtttcgagttatgagaaaaaagttaaaggcgagatgatacgtattgaattggggtaaatattggaagaggagataaaattgcgtgtttgagtatcggggtgcggggagggggggataaaattcgtatttagtgtaaattaaaattttgggagtaggtgggggttgttgcgcgttttttatttttagtttttttattaaggattttgagtttttatgtatttttgttttttggttttttttttttttttcgttcggtcggtgagaggcggtcgtcggcgttttagtagtagttagatgttaggcgaagttcggagcgcggagcgtggggaagggaggggaagggaggggaggggaaaggaggggtggggcggggagcgcgcgcgggttcggttagtgcggggtggtgggcgggttgagttcggggacggcgcgggaggggggagggaaggggggtagttgtgggtagggagtcgggttcggtcgttagtattaaagatggagaggcgtcggggttttgtaggggagggggttcggcgttgacgtgggacgcggcggaggcgtagtagtcggtggtgatttgttaatttcgtagtagagaggagttgagggcgatgagagcgggtattgcgaattgtcgggcgatgttgtcgttgtcgtcgtgatacggagagtaatagttttttagtaatattttttttcgatataggtatatatttttcgataggtacgtatatttattttatagtgttcggttcggttgcggtgagtgaggggtcgggaagaggcgtatcgtttagcgagcgtcgcgcgtcggggtttttcggggttggagaggtttggggggcgcgcgttcgtttcggttattcggtcgttgggtttgtgttttttttatttggcgtgttttttttttgtcgttgtagtcgtcgtcgttatcggttgggggtcggttagaagggggagtttcggttgttagtttgggcgtagttgtttttttagttttttttttttagggtacggtcggggtgagaggtggggggcgtagcggtgtgcgggggttgagggcgtgagtagaggggtcggggattcggaggttttgtatcgttaggggttggcggagtaatagagttcgtgggtgtttttatgtatgcggatcggtgcgcgggcgtaagataaggttgtggtttatttatttgtgtgtttattcgtcggtcggttgggaagttagaatcggaggagttgacgagtagatttgggggcggaggggagtaggattgggattgtttacgttttgtttttttttgagaaaacgtggtgggtttttttttgattggatttgatttttattttttttttgtaggggagggagggaagttttagagggtttgtagcgttgcgggtttttttcggttttcggcgggatcggcggtgatatcggagttcgtcgtgcgttttcggtcgttttcggtgggtgtcggtttttgtatttgatgcgttcgggatgttttttttattttggcgcgttcgtcgttagttcgtatagcgtttcgtatattttcgtacgcgtttgaaatgcgtacggtttcgtcggttcgcggaattattcggacgtacggagcgtttcgtatcgattcgttcgtcgttttttcgagacgttcgtatcgtgtttgggtcgggcgcgttggtcgttggcgtcgttggttagaggtttgggatttagtcggtcgtttttagggggttacggttttgggtcggagagggagggcgggtagattttttttcgtttttttttttataattcgttgcggggtttttgtgtttttttttcgtcgcggggcgggttcgttttttttgtcgttttcgtcgcggagtttagttcgttcggattgtcgtcgttttttttcgtttttttcgttttttttcgtttttagtttagtttttttttttttaggagtttagtttttcgggaaaagttgtttttttaagtttgttgaagtcgtttttaagtttcggtgggggtcgttgggaattgggggggtgtgagagcgcggtcgattttcggagttcgggcgggttatcgtcggttttttttcgcgtcgtttggttggacgttgtagttagcgttagtcggatcgcgggcgtcgagcggcgggtgggggagacggttgttcgtgggcgtttagattttttttaggatttaaaaggtttgttttagggcgttaagtttttatttttttggttgtttttttttagtttttagaaatttcgatgtttgcgggaaagtacgcggtggttcggttcggttgaatgtttattttaattttgacggttttcgtttttatttcggggcg

SEQ ID NO: 6611 - DNA, 2558 bp, Artificial Sequence; identical to SEQ ID NO: 6610
  Description of Artificial Sequence: Synthetic polynucleotide

SEQ ID NO: 6612 - DNA, 1508 bp, Artificial Sequence
  Description of Artificial Sequence: Synthetic polynucleotide
tcgtttcggggcgagaaggagaaaagttagagggttgaataggtgacgttgagtttgttggagcgtgtgtgttttattacgtaagggcgcggagttcggtcgttttatttttcgttatttgcgcgttcgggggtacgttttttgcgatagtttggaatttagattatttgcgtttgtttggtttcgatttagtgtttaggtggttttagtcggaaatgtttgtttttttttaatttttcgatttcggttgtttcgcggattaggtacgtagcgttttagtcgtaggtttggatatgtcggatatttggatttatttttagtaatttttttttttcgggaagagggatacgttttttagtttgaagatttgtttttaggtttaattggttaggcgcggaagcggagaatttcgtattttggggcgcgttgttcgaggtggttacggtggcgtattaagtcggggttaaagtcggggtagaggggtggggtagggtcgggggagggtgatttttgggtttggagaataaatttgttattcgagggatttttagttttcgggatttttattatttttattttgtttttagttaatgcgcggataagcgttatgcggtgcgttaatattcgcgttagggttggggttcgcggcgggagagggacgtacggatatagcggaggaattagtcgtcgagttcgaggtttgaataagtaaggatttttaggttaagagttacggtttgaggatttttcgattcggagggtatttcggggttttagtgttattaagtcgtaggaagagggtaaggggttgggggaggggtttagggtagaattgtcgtcgtgtagggagtagggagatgaggggtttttttgttattatttttacgggcgcgttttaaaacggtagacgcgggtggttggcggagcggtcgggggttgatttttattcggtttttgttagggtgtttgttttttttcgttgcgttttattcggggttttgtatttcggtcggtttttttacgtatttggagttcgtcgggtatttcgtttcgtcgttagtcgcgttattttggtttcgtcgttttcgtcgtttagtcgttcgcgtaggttttatttttgtgtaaagagtttaggagtaggaggaaagttattagttatatgttataaagaggttttatttttcggggaggtggttttgtggtcggtcgtgcggtagcgtttttttttcgtttagcgcgtttttagtcgttcgtattcggcgtttcgttttttttgttttttagtttagcgttcggttgcggcggcggttttttttttttcggtttttcggtttttgttattcgcggggttgggttaggcggtcgtttttttcgttttttcgcggtatttcgggtggtgagcgtcgcgcgagttcggagtttagacggattttagttttataagtttaggaataggagcggcggttcgggttagatcgtttcgattcggtttcgttgtttgagaggcg

SEQ ID NO: 6613 - DNA, 1119 bp, Artificial Sequence
  Description of Artificial Sequence: Synthetic polynucleotide
tcgggcgcgtaggcggcggttagcgttggagttttagttagttttttttttttacgtgcgcgttaggttttggttattttggtaattcgtttcgtttagacggtattaggtagttgaatttagttttttgttacgggggaaaatgtttttattgaagcgtcggagcgtagtttttgttttttattgtaagcggcgttatcggattttatttgtaaatttattagtgtgcgttcgcggggagggggttcgggaattcgggttcgggtaatcggcgtcgtatgttaattagggggcgttcgttttcgttttgttcgtggtttttttttttcgatttttcgacgtttcgggaggagtggggtcggagcgtagggttgggaagggttttaggatttaggaaggagacgggtgttttttagagaggattttatttttttcgaggttcgggcggttttcggtttttttttggggtgtcgtagtttttttcgattcgttttttcgtagtcgtagtcgttcgggtttggaggtggtcgggtatcggtgtcgacgtcgcgagggtagcgttcgcggcgggaatattaatgtattttaaagggtacggtcgtcgtcgtagtaggtaattagttggatcgcggcggagcgcgcggaggtggttgttggttgtaaggattgcgtttagttttcgtttcgtttttcgaggttttcgcgtgggtcggcgggtagtgcgtgggttataggaagcgggttgattggattcggtttaggatttcgtataagggtagttttttgtttatagttttttttttagtttttcgtttttttttcgtttatcgtttttttttttcggcgatcggtttcgtcggttgcgggggggtggggggggtggggtgttttgtgtagtcgtttattttttgtttcggtttcgtgttttcgttggggattgtttgcggtgagtttgtcgtacgtacgttagggtcgaggtagtgatgcggggtagcgtgggaggacgggttgcggagttcgcgttattttgtttgtggggagcgttgtgtttgtttttttgttagcgcgtttagttgtttcggtcgtcgttacgcgggattgtttgttatgtcgttatcg

SEQ ID NO: 6614 - DNA, 1119 bp, Artificial Sequence; identical to SEQ ID NO: 6613
  Description of Artificial Sequence: Synthetic polynucleotide

SEQ ID NO: 6615 - DNA, 653 bp, Artificial Sequence
  Description of Artificial Sequence: Synthetic polynucleotide
gcggagaagttaggagcgatgaggggcggggcggttttcggcgtttttttttttagtttcgttttcgcgttgtcgtcggagagggattcggggcgtagtcgtttcgtttttgtcggggttttaggaggaatttaagaaaagagagatggagggaggaaatggtatcgttttaggaaggggtaggatttttaggatcgaaggcgttttttttttttttttttttagcgatattgggaaataaagtttcgcggttgaaaagaatattacgcgcggttaggattcgagtagggttttggggcgttaagggcggggaaaatagggtattcggagtgtaggagattttttagggtcgttttttttttcgggggtgttttgaggaatcgcggcggggattcgtcgttggtagtttgcgggttttggtgttagcgcgtatgggcgggttgtgcggacgtggttggttttttaaaggttttagatttcgttcgggtcgtttagttttttaaagttgtgttttaaagtttaggggagatagcgaggttggggacgtcgggaagtttttttgaggtgtggggtttttgagtagaaacgcgcgggggattgttagggttgtagaaattttggttcgaggcggtggttggttcgttttattttcg

SEQ ID NO: 6616 - DNA, 1768 bp, Artificial Sequence; identical to SEQ ID NO: 6606
  Description of Artificial Sequence: Synthetic polynucleotide

SEQ ID NO: 6617 - DNA, 1101 bp, Artificial Sequence
  Description of Artificial Sequence: Synthetic polynucleotide
gcgttaagtcggttttttaatttggtttgttgaacgtaaatcgttgagagtttgttgtatcgttttttggggtttttggttgtcgagtttcgttaaggtaaagacgttagtaagcgaggaagcgtagcggaagaaaaataagcgggcgcgcgaggggagttttaggagggttgtcgagtggttggtaggcggttttcgtttttttcgggtggtttcgtcggcggttgacggttcggaggacgcgcgtttcgaaaagttagatttcgggcggcggcgcgttacgtcgcgttttttcgcgtttttttttcgttgcgtttcgggaaaggaatttgttttttcggttttaggattggggagtgtgtcgcggggtcgagggtggggaatagttagagggagacgcgaattaggtcgttggcggagggtttagggggagcgtagaggcgacggtttttatgtcggcggttaatatgatggagaatcggtcgttgttcgttttgtaggtgttcgagtcgtagggtgcgttcgagggtagttcggtttggtttagttcgtcgatttttacgtttcgtcgtcggcgttttaagatgcgtcgtatgaagaacgtataggagtagagtttggaggtcgggttggttcgggatttgttcgtcgttttggttttcggtaaggagtttttgtagttgtcgtttatcgagattacgttttttagcgacgaggatatttcgtggtttaattgttttatatttagcgcgttttcgcgtcgaaaacgttttttttttcgtaagtggttgagggtgagggagcggaaggagtgtagtgaaagtaggtacgttttcgtttcgttcgttttttttttttttttttcgttttttttagagtcgtttagggtttcggggtattttgggggaaacgttttgggggagaataggagttcgttattagaggcgtttttggagggcgttgcgtttggttttagggatggtggtatttagtttttacgcgtgttattcgttttttaatttagggtgaggggttttatgttgtacgatacgtttacgtggggttttacgttgtattttattttttttgattttcgtagcg

SEQ ID NO: 6618 - DNA, 1101 bp, Artificial Sequence; identical to SEQ ID NO: 6617
  Description of Artificial Sequence: Synthetic polynucleotide

SEQ ID NO: 6619 - DNA, 2341 bp, Artificial Sequence
  Description of Artificial Sequence: Synthetic polynucleotide
gcgtggttcggagagcgtggataaggtaatttgttttggatgttcgggagaagggagttcggtcgaaagggtttagtttttcgaggttgttttaattggggcgcgcggcggtttaggagggaggcggggaggttttcgggttgggtcggggaacgtcggtttttaggttgggtagggaggacggtttagagcgcgggttttcgggttttatttcgggaaaagtttgggtttgttttgcgttgttgcgtgttgcgtttttgggatttgttgattgttttagagggaacgtttcgcggtagtgttagttttttggggattaggaagggcgatttttgtttgggagttagtgtttgggtcgtcgggttcgggtaagcgttgggggtttggttcgagaagatgcggataggtggtttagggcgtcgcggattttcgttttttgcgggtatcgggagtttagggtcgaggcgcgtcgtttcgaggggtttttttttttaataatgcgttcggaatggagttcgcgttttgatagcgcgggttagttcgaaatcgtttagaattcgtttcgatgagtgggtgagtcgttttgggagtttgtcgcgtttcggtagcggagggtttgagtggaaaaatttttattggatgtattttttaatggttggtttgtttcggttttcgttcgagtttttttcggtagtaggcgttgggttattcgtagttttagttaattttttttttatattttttttattttatttttaaaaagtttgttttcggttggaaaaagtattaatgaacgtatttgtgggaagaaacggaaagtgaatgagttaggagggttattttcggttaatcgttttaggaaaagtaaagaagttaaaggtttttggttttggattttgggggaaggtgatggggggaggtttagatttcgggaattagggcgcggacgttgggcgtggatttcgttattgttttcggttagtttttattttttaggagtaagtattttgtgtgcgtagcgtatgaatgtgtttgggtattttcgcgtatatttatatagtgtgtgatgcgaaaagtaggattagtaggggaggaagagggggtgtggggggggagggaagatgagggagagtagaggggagagaagagagaggagagttcgaggcgagagagagagagagagagagagagagagagagagagagagagagagagagataggatttttttttcgattcgtaaagtgaagttattttttaaaattagttgaaaaaaaagttttattcggttaattgtttttttcgtttcgttataataataaacgtgtataggggagtgagggtagggcgttcgtagggggtacgtagggagggtttagggcgttagggaggtcgcgtcgggttaattcgaaggggttgcgaggttaggttgtaatcgggttaatgtgtggaatattggggggttcggttgtagatttggttaaatggacgggattattaaggtaagcggcggggtaacggacgcgggcggcggggatcggtcggggaggcgaagcggcgggcgggtaggtgcggggttcgcgtttcggaagacgtggtttttttttttttttttcgcgtttcggtttcgcgtcggttttttcggcgttcgggtggcgagttttattcgcgggttagtcggttaggcgttcgtattgagggcgattttttttcgaaattttagtttttaaagtggagtttcggttttttttttatttcgttgttcgtcggggttgtaggaggggacggcgggaaatcgggggattttagggtacggaacggagttaagggcgagagatttcggggtttattatttttatcgatattcggggttttcgtggttttagcgttaggtattgggtttttttttcgtagaggcggaatacggcgggggcgggggttgtagtcgttcgggttcgggtttttgtttggtgggttttggggtgggtaagtggtttcgttgtacgagggtaggggtgtaagtgagtgtgtcgggggatttatttgagcgggtttttttagatggaagtttttgtttatatgttagcgttttttttttttttcggtatttagtcgttcggttttaggcgttggagagtcgtcggtttcgcgggatttttgggtcggtttcgtcgttttttcggcggggaattttttttagttttcgttcgtatagatttttagcgtttcgagttttcgtttttcgcgtttaggcgtgcgtcggttttaggattagggtttttggagttgtcgttttcgaaagggttttgcgtttttcggagtcgttttcgttgtaggggtcg

SEQ ID NO: 6620 - DNA, 3857 bp, Artificial Sequence
  Description of Artificial Sequence: Synthetic polynucleotide
gcgaggggcggggggcggggagggaggcgggtcgcggcgttggtttcggggttcgcggtacggttttttttgtcgcgttgtttagggttcggattttgttcggcgttgcgtttatcgcgagggtgttagattcgtcgcgtcgtcgtcgcgtttttttagtcgcggttttttttttcgtcgtttttttttgtttttttagtttttttttttacgtgtggatgacgttaaaatttcgcgaaaaagtcgcgtggtggtttttcgagcggaggcgcgatttcgtcgtttagcggttttttttcgggggcgtttggagggggagaagggcggaggcggtcggtttttttttttttcgggaggtaggatttttcgacgtcgatcgtcggacgtttttcgttttaaagtttattggaaaatttatttttgtaaagtaaatgtatttttagagttattttcggtcgcgtgaggcgtgttttaagttgaattagataggaagagggggaagttcgggttttttaatttttttttttttcgaagggaggggagtgagatgttaggtgggtgatagacggtaggcgttcgtttttttaatttacgtttgtcgtatttgtcgttttagtaatttagtttcgtttaagtcgaaattcgtcgaagggagtgcggatgtataggtttggcggattttgtttttttttagaacgtagcggtttagcgtttcggcgggcgcggttgcgattagagggtttcggaagcgagtgaatatttgtaatcgtattgttcgtttttatttattttgttttttcgtgtttttcgtttttcgacgttttttttttttttttgttcgtatttttttattttgtttgtattttttttttttttttgatgtgttttttatgtgttttttcggatttatgtgttttttcgtattttgttagtcgggttttcggttttgattgatcgtttatttttttacggagaaatataaatatagttttattttttgggggagtcgaggggaaggtagtggtttttatttttgagtttgaatttagttattattcgttttttatttggtttaggcgtttttgcgcggagaaggcgggattcgaattcgcgttgttttcgggttttgagtcgatcgcggaattatttggttgggaggtattttttaggtaagtttgggagtatgtgtgtttagtgttgtaggtttttgtagaaaagtgtttataaatatttaatattttgttgtattttttatttttaggttttgtatattttttaatcgaaattttaaaacgttagcgtagagggtggggagtcggtcggaaaaagaataaaagtttaataaaattggcgttcgttaaagtttattattagttttatatgggatatatatatatgtattttttttttcgtgaagggtgaaaaggagataaggaagaattaataatttattttttttcgtcgttttttattttcgcgttacggtgattagtttggattttaaagttagagtataggtttttgcgtttttttttgaaatcgaagtttatattgaaagaaagtgtgtatttttgtttagaaggtaatatgcgttttttcgcgtgttaggtggagtgtattttaataagatattagggttttaatatatggttggagtggcgattaaaagggaaaatttagtttttagtttaagttttttagagatatttttgttaattttcgtatttttttacgttttattttacgtgtgagagtttgtaaaattatcggggattggattcgatggcgagttttacgttcgggaatagttagtaatcggaaggggaagtggataggggaattttaagaggcgagtttgttacgcgggaagcgttcgaatttgcgggtttttatgaatgtagagggcgtcgggaagggggggtattcggtcgcgattttttttgttttttttattcgttgttttttttttcgttggaatttttttgtaaagtaagacggagtagggggagggggagagggaaggggcgagagggttttcggtttattttcgagacgtgaggattcgttatttaggtatttttttcggggtgggttgggtttcgggacgattattcgtttttttttcgttttcgttgtttttatttcgggagatttagagttttggatgttttttttcggagaagggggggtgtgcggagtcggggtggaagagattttgttcgtagagttatattaagtgatgtttagaggttgggagtttcggcggtttttgttttttgtttgtcgggttagatttatattttaaaaatatttttcgttttttttttttttttcgttttttttcgttgtaattttttttgattcgtttaaaggtggtttaggtgaaattggagtaatttttttatgggggttttaaaatgtaagtgaatgtttttattcggggtgatttaaaagtttaagtcgggaagtttaacgtgattaaaattaataggtgattgttcggggtcgattgtgtgcgggtgtatacggtattcggttcgggtgttattcgcggcgttggattgttttattttgagtttgtaatttgggttttttagcgagttttttttttttttgaaagttaatggtttttatagtaattagatatttttttcgttcgtttttttttttttttttttttatatataggagatgggatatttattttcgttgttattgataaggtcggaggcggtcgggtttttttttagttttcgttcgttttagcgttcgtttttttttcgtttttttttggtttttttttgatgtagtggggaacgcgttttattaaaaaaaaaaaaaaaaaaaaaaaaaaaaagtaatttgttcggtaataattagcgcgtagtagtaggagttttagagttattggttatgtaaatagagggaggggagacggcgttttaaatttttttttatttttttaaagcgatattttttttttttttttttattatttttttcgttttattttcgtttaaagaggttggtttcggggtttgagttaatcgtttgtatttttagtttattcgtttttttttttcgttttgtagggaatttagtgtacggtttatttagttcgcgttttatttcgttttgttggtttttcgcgtttttgttcgggttttttttttcggtgagggaggtatttagtcggtttcggtgtgtttagagagttcgagttacgttatgttcgttgtacgtgttagtttggttagtatattagggcgttggtttttttttttttttttggagtgaaatatattaaagggcgcggtgggggtggggggtgacgggaggaaggaggtgaagaaacgttattagatcgtattttttgtaaagatagttttgatttaagtatgcgttagagtacgtgttagggtcgatcgtgttggcggcgattttatcgtagtcggtttttagggagaaagtttggcgagtgaggcgcgaaatcggaggggtcggcgaggatgcgggcgaaggatcgagcgtggaggttttatgttttcggggaaaggaaggggtggtggtgtttgcgtagggggagcgagggggagtcggatttaattttttattcgttttttttttttttcgggttattttttagaaagttgtatcggtgtggttacgtttagcgtagatatttcgggcggtttgttagtagatgtaggggcgaggaagcgggttttttttgcgtggtcgttggtcgcgggggaatcgttgggagttttgttttcggtttgcggcggttttagacgttgtatcgcgtcgttttacggcgttcgaagagtttttagaaatacgatggtttttgttcg

SEQ ID NO: 6621 - DNA, 1439 bp, Artificial Sequence
  Description of Artificial Sequence: Synthetic polynucleotide
tcgttattatcgttattttttcggaattttttgggttcgcgttagttttatttggttacgattcggtaggcgaaggggtgcggaggcggttttattagttcgtttttagttttgtttcgagagagaagttcgttgagagggtagatagttgagaaattcgattttaattttttagtcggcgtttttcgaatcgtttcgagagtttagattagtcgggtagtggatttcggagtaaagtgttatgtatattttggagaggagggaggcgtggagggaaagggcggtaaaaatgaaatgtttttaagttagtttcgtaatttttttcggttcgagggacgggcggagggtagaggaggtagcggcggttagcgcgaggtgagggatttatttgaaggtgaggacgtagagcggtcggtaggatttgtggttggtgttttcggttatgtttttgttttagaagtcgttggtgaagatgttttagcggagcggggcgtcgggtcgtacgtcggggttgtttacgatcgtttatacgtcgtcgtgtacgaattcgttttgtagggagcggtcgtagtataggtagtttgtttcggttagtagcgtcgcggtttcggtcggcgttagttcgtagtttcgtcgtcgggagggtgtgcggttttcgtcgtcgtttcgggtagaggtggttattattatcgcgtcgtcgtcgtcgttgttgttttggtttttttcgggcgtttggtatttttttttatcggggtttcggcggcgcgcggcgtttgttcggaggggggttcgggtatggtgttgcggtagttggattcgtcgcgagtttttcgcgtttcgtcgtcgtttgcgtcgcggagttggtttagttgtaaataaatagtagttttttcgtttttttcggttatcgttatttttttcgttttattgcgtatgttcgttcgtttttttttttatcgttttttaatttcgggacgcgggtcggttttttcgtatagttcggcgttttttgttttcggttcgttttgtttgtaggtggatcggggttcgcggcgcgcggttgttcgggagttgcggggaaggatattttaggtttttatttgcggtgttcggttgtgtttatttttacgttttcgtttttatttttttttttcgaatggggttgggaaggggtatatttggcggatttttttcgggggatttaggagggtttagtaggtgcgtagtttggaatttttatatttattttttagggagaaaagtgtcgttgtttttcgggaagttttcggttttttagtattcgggataatagtagcggcgttcggagagacgttttttattcgtttcgcgttcgcgtttagtcgtcggttttgtgtttttttgttcgggtttttttttattcgttcggcgcggcgtttcgtttggcggaggaattcgcg

SEQ ID NO: 6622 - DNA, 1288 bp, Artificial Sequence
  Description of Artificial Sequence: Synthetic polynucleotide
tcgataggttgtagtcgcgggttatttcggaggttaaggtagttatttttgtaagggagttttgcgtttaagtatggtttgttcgtttcgtttggtttttattaataaggtcgggattagcggtcggtggaacgagcgagagtagttttagttttataggtgagtcgtttttataagtagttaagtcgcgagtcgtttcggcgtcgttatcgttcgtatttatttttttatttcgggagggagatgggaggcgtgggagaacgcggagaggcgcggcgaggttgggagcgggagacggcgtcgggaggcgggaagcggattagagaatgggagaagttcggtaggtggataggaggaaataaaatttaaacgttttattttcgaagtcgttaggagttgagcgaaggaaggagcgaggtaggaaagcgtggcgttttaaatatgtcgcgggagcggcgcgggaggcgtagaatttcggagtttgtagtttagcgcgcggggttttagcggagcgcgaggacgcgagcggagttttttcggttatttgtgttgttttcgttttggttgtttttgtttcgagggaagatgttcgagtattttttttattttatttggtcggcgaagtatagttcggtgacgatgtgtagagttttttggtatagattgtttatttcgttttttttgtggaaatttatcgtttggtttttttttcgtttttttttttttttttagttagtcgttttttttttttttcgtatttttaatttttttggcgttttaagttatagttcgttcgcggtgattttggttggagattgcgtcgttgagagtcggtaatttttaggagttttacgttggttttatggcgggagcggagggcgtaggggaaggagaggcgcgcgaggaggttgcggttgtcgcgaggtttgcgttaattttttcgtcgcgcgagcgagtcgaggcgcgttggaattagagattcggtatggagtgttgaggggaggggggagtcgtaaaaaagttaaagtaagttttcgattcgtaagtacgttttttttttttttttagcgtattggtgtttttggcgggtgtttggcggcgacgcgtttaatcgtagttcggcgcgggcgttaggtgataggcggcggagcgcgtagattcggtttttcgcgttttttgaagaagggattcgtgagggagggagggagggagggcgggcggttcggcgtttttgtcgaggtcggggatgtttatcgttgtttagagttggttcgaggagtttttttcg

SEQ ID NO: 6623 - DNA, 1006 bp, Artificial Sequence
  Description of Artificial Sequence: Synthetic polynucleotide
gcgcgtgaagaatttagattttttaatgcgtatattatttttatacgtagggtcgaggcggtagcgcggttcggagggggttcggagggaggggtcggattcgtttcggcgcggtttcgtcggggaattagttttcgagtcgaataaaagtagttaaagattcgtatattcggtagaaggggggcggttttaagaaagttcgggttggggcggtttcgtattttttcgtttttttcgtcgttcgaatttgttgtaaaggtagagataatggagaaagtttcgggagacgcgcggagagattgtttttttggggagggaggggcgggtcgggggaggcggggtaaggaggagggaggggtcgtcgagggcgaggtcggcgtttagcgtcggtttttcgtacggttttttggatgttaaattcggtttagggagtttaggagtcgttgtagttttagtttttttttttttttttttcgatgattcgggtaatgttaattttttttcgggattgaaagttttaaatttaaggtgttaagttgatgggcggtttttgtttttatttttcgatttcgggcgcgtgttttgaaagataggagagaaaaaagattatttagttgtaggaggtaaggttggagcgagtagcgttcgtttgttttttaagtaaaggagggaagtttatgtgtattcgtgtattgggtttcggagtagtttcggggtgtagggtattttttttttagggcgtgcggaggaaggttattaaaatacgttgtattgtcgaggtggagttgggtaaagtaggtagagattggtggggacggatggcgagtttgggaagtttcgggtgttttggtggagaggttttttgtcgggggcggggcgttggagagttttttcggcgcggagagtttttcgggcgcggagagcgtagagaatttggttaggaggtgttggatagtttcggaattcgcgcgttttttgttaaataaagcgtggagattcggattcg

SEQ ID NO: 6624 - DNA, 1185 bp, Artificial Sequence
  Description of Artificial Sequence: Synthetic polynucleotide
tcggttttttttgggcgtagtgcgtatcgtcggcgtttttagatttttggattattcggtttgggggcgcgggcgcggttggggagggaggggagagttggtttatttggcgttgaaggttggaaggtatagtttcggtttttcggagttcggttcggtagtttcgtattgttcgtagagggattgagtatttgaaaagtttatcgcgtttcgtagggcgtttcggcggggttaatttgttcggttgcggggtatagttttaggggaattgggttagtaggtaggggtcggagttgcgcgttcgcggtggttagggcggtcgtcgggtcgtggggcgcgggcggttgtagtttgggcgttggggcgttttcgattcgtagtaaattttcgattaggaaatttttgtttaggttgttaaagtcgggcgtagcggggaggttgaggagcgcggaggaagttataacgttttagtacgtatcggcgtgggttgcgatcgcgttggggagtatagtgcggcgttaatcggtttgttgcgcgttcgttttgcgttcgtttgtcgttcgggcgtttcgtatcgtatttagagtcgtagtttttcgtcgtcgtttttcgtagggttggagcgcgcggagttaggtagggaggaaaggttattcgggacggcggcggatttggaacgatattatttatttgcgttgggcgtttttttaagggatgggaggagtgagtgtgggagggggaagttgtgagtttttttggtcgatagcgtaggttttgggagcgtaggggggagtttttttttttttttatgtagatttggacgggttttttttttgttttttgtttttttttggacggacggaaggtgtgtttagtttatttatttatgttattagttttataaagtgatagacgcggttaataataagggtagtgttgtggtaaggggaggggattcgtagtgggaggaggtgggcgtggaggcgacgtgaatcgggcgcgttcgttattttttcgttgtcgtgtagagtcgtggtattttcgttagagtttaagtagttttttaggcgtggggtttggtggacgttggtttggagcgttcggagggcggggtgggggtgggggggacgcgttgtcgtttggggtgttttcgcgtatttttgttgggcgaattttggtttttcg

SEQ ID NO: 6625 - DNA, 409 bp, Artificial Sequence
  Description of Artificial Sequence: Synthetic polynucleotide
tcgtttttcggggaaggggtttttgaggttcgggtggtcgtttgggtaatcgtagtttgtttgcgttttttttttttttcgcgtgggttttagtaatatttattgtagtcgggttaggcgagtcggcgcgtattatcggcgcggggggaggagagggtcgggtttgggaagatgttgcggaggacgttgcggattcgcgagttcggggtaaggcggcggcgtatcgttttttttcgtcgttttttttttatttcgttttttatcgtcgtttttagttttttttcgggatgagagagagtcgcgttgcggagtaattttagtggatgggttcgcgggggttgagcgggcggaggacgcgggaatttcgtgatatcgattagttgacgttgttcgcgtgaaattagagtcg

SEQ ID NO: 6626 - DNA, 1813 bp, Artificial Sequence
  Description of Artificial Sequence: Synthetic polynucleotide
gcgggcggcggaggagggttggcggttagatatagtatcgttggagtttagagagtcgggtagaggttggcggagagtcgaggttggtttagtttttaggagatcggcgagttggggtgtgtgggagcgggatgtttttaaggcgaaaagaagcgttagtttcgtaagcggtttttatttgggttgtttaggtcggatgtttaggagtttatagtaggggggatggagcgaaggatcgaggggttgggaggcgaggtcgtagcgtattgacgtaggttagcgaggtcgttggtttcgacgtagggcgttcggtaaggtgtttggtattacgagagttaatttttgcgcgttattttcggaggttagtgcgtttagggcgcgtcggttcggtaggagggtgggtgttagtttttttttttatttttcgagtttttttttcggcgtttacgtgggcggagtagcgcgagggtgtgcgtggtaggggtcgcggcggcgtgtgtcgtgcgtggggtggggtgcgggttgggcggtttcgttttcgggtttcgcgtcgtcggggcgcggtttttagttttattttttttgttatttgggcggagatttgggggattgtgatttattttgcggaagatacggaggggacgggtcggttatatttttcgcgttatttcggtaggtatcgggtgggtttttttttcgttttttggtttgagggcggaattcggagaagagtggaaataggggtggcgtgaaggagagttgggggttgggggcgggatcgggagggggtgttgggggaagcgacgtagcggttgggagattttgtaagggggtttgaagaggagtgggggatgggtatggaagggtgggggattattgaggtgggatgcgagagtggaagggggatttagagggggcgcgatggtcggaggagggggagatggacgatggggcggggcggtatcggtcgtcgcgttttttgtcgttaggttcgtttttcggtcgtcgggtttacgggttttttttggttagcgttcgtttttcgtttttcggcgtatttgtatttatttgttcggcgtttaggttcgagtcgggtagtagtagcggacgtagcgagcgtagtttcgcgtcgtatttttcggtcgtttttttttcgttgcgagtttacgtcgttgtcgtcgtcgttatcgttttaaaaaggataaaacggaatagaaaatgaatgtatgtataaaaaaaatcgtaaaaagtaattgaggaggatggtagtcgcgcgcgcggttcggcggggcgggagtcgagaggtcgcggtattggtggtcgcgattcgggtaggcggtcggcgcgtgtcgtacgcgggtggttgtagttttttcggtcgttcgcgttcggtttaggtacggtatcgttttttttttcggggagttttttcgattggtttgtttttttgttagttaggtaggagggcgcggcgttcgtttcgtttcgttttcgttttcgttttgggtagatgtcgggagtttttttgtcgtcgtgggagggggagttgagttgtcggagcgtgcgtattgggttagcgggcggtcggggtagggttggggtttcggcgttgagcgtttttagtcgcgtcgggtagtttggcgtttcgttgagtcggagtaattttcggtaggagtttttaggttttggttaagtttcgggattcgggaagttatttttgttttcgggggttcgagtttggagtggggtttgtaggtaaagcggggttggggtcgttttggtcgttagtggttaggaagacgtagcgatttcg

SEQ ID NO: 6627 - DNA, 1294 bp, Artificial Sequence
  Description of Artificial Sequence: Synthetic polynucleotide
acgtttttttcggatgcgcgtggagcgttttataggatcgtcgttttttgcgcgttggcgcgtatacgtttttcgttagtttgggcgtcgggtttcgaattttcggtttgtaaatttgcgtattttttttcgtcgcgttcgttagataatttggcgaatagttcgttcgttcgtatttcgtttttttcggttttttttttaaattttaaacgtatcgtcgtgttttaaagaaggtgtttacgtcgtttttagatttcggagcgttttttttttattttcgggattttttaggtcgtttatttttttcgtttttcgtttagatttgagagggatcgaaaatatattttcgattcgggtagttagggtcgaaattgttaagaggagaaaaggtaaagcggaaggagggtggttataaatagatttttttgtttttttttaaaaggatattgtcgttttaaaagtttttttttcgggtttttatttttcgtattttcgtattttgggggagcgtatttaattgaggtaacgtagtttttttttagtgtttgtagaaaaattaaagttaggggggtgagttcgtcggttgttaattttttcgtcgtttttttcgttttattttgttttcgtaagtcgagaacgggttgtaaaagtttgtaatatttttggggggcggaggggggaggggaggggggtttttcgggttcggggcgtcgtcgtaggttcgcgcgcggtcgtcggatttcgcgtttcgggcgttcgttttcggtcgtttttcgtttcgcgttcgggttttcgtcgttttttttttagtttttttttagttttttatttttgttggtgttggaatagttttgtttgcgtatcggggtaggcggttcgtttttgcgggcggatttttggtttagcggggtttttttggagtcggcggtcgcgttcgcgtcgttgttgtttggttcgttggcggcggggtcgggggttgtcggagttgattttatgtttttttttaatgtagagatcgttggagatggcgagtttcgagattttttttattttttgtttttagagtaattttatggtattaaaaaaaaaaaaaaaaaaaaaaaaaaaaaaaaaaaaaaaaaaagaaggagaaggcgatcggcgaaagtaggagggaaaaagtaggcggcggcgggcgggtaagtaaaagcgcgagggagcgcgcggagtgtttgggtggacgtgtgtgtgcgttcgaaaggggataagaggcgggtttggttataggtagcgttagcgagagtttttttagtcg

SEQ ID NO: 6628 - DNA, 939 bp, Artificial Sequence
  Description of Artificial Sequence: Synthetic polynucleotide
tcgatgtcgagagtggttttgttggagaatcgtcgcgtttgtagtttttgtattttttttcggagttgcgttagggaattacggacgaattggaaggggtcgagaagaaaggttttggttattatttttagttttaagttttttcgtttttttagattttggatttttttcggggaggatttttaggagttttttggtagtttttcgtcgtttagggtcgatttttttatttttttttttattttcggttttcgggcgagggaggtttcgcgtcgttttttagattggttgcggtcggaagattgtagtcgttttgagtttattttttgtttttttataattaaggagtatggtggagttgggttaattttaggtatagtttagtcgagttaggcgaggtttagagagatttgattcgtttggtagttttaacggatttgttttcgtagtcgttgcggatttttcggtcgttatggcgattgtgaaatgtggggtggggcgtatgcgttggaagttattcgcgcgggtagtttttgagtgtttttttacgtgttttttagcgcgagtagtattttcgtttttgcgttttttagagcgtgtagttttcggtgagggtagttttacgtatagttttttatattttttttagcgtttgtagttttcggtgcgcgtaggttttaagtttatatgcgtagtttttattttgcgcgtagttttatgtatagtttcggacgggtttttagttttattggcgtagaatttattatcgtttgttttttacgcgttttattgggagtgtagtttttatttcgagcgcgtagttttacgtagtttttttatattttttttagcgtttgtagtatttttagtgcgtatagttttgttagtcgttttttcgggcgtcgtttttgtattatttcggtttataattttgcggcg

SEQ ID NO: 6629 - DNA, 939 bp, Artificial Sequence; identical to SEQ ID NO: 6628
  Description of Artificial Sequence: Synthetic polynucleotide

SEQ ID NO: 6630 - DNA, 899 bp, Artificial Sequence
  Description of Artificial Sequence: Synthetic polynucleotide
tcgaacgtagttacgcgtttattggttttttgtttttggcgtttttgggtacgggggagttggggcggtttcgtttgcgtacggcggtgtcgggattgggggcgggtacgtcgttttcgttttttacgcgttcgttcgttcgttcgttttcgtttttttcgtttcgagcgattttttgttttagttttgtaggtttcgtattgtagatgtttgttggtttttttgcgttcggcggttttcgcggtgtttcgtaagttttcgtgattttttagtattagtcggttgtgcgttttttgtttttacgggtcggttagtcgtagatatttatttagtttcgcgagtttagtcgtttagcgagtggggtagcggggatcgagacggacggtagtcgtgttagagttcggggcgttttcggatgcggtaggataagttgatcgggtttttgaggcgcggggggagatgtttgaagcggtagggcggcggcgtgggtattattttgagtaatgtgtttaagaagcgtagttgtatttttcggatcgcgtttcggttgttgtgtattttggagtcgggtgaggattttagggttgtagatggggcgttgtaaagtagcgtcggggttgttcgcgtttttgttttagtttgatttcgtttaggtcggggagttttggggaaagttcgcgtgttatttggtgcggggtatcgcgttggtatttgtagggagcgattggtttggaagggtagagggtagacgggggtttgggtggggtagcggttattttaggcgcggagaattcgttgtttttatttttttttcgcggatttttattttgcggtttgtgtgttcggtttttttcgcgtggcggggaagtgcgggtggttgttcgggtttttagaggtcg

SEQ ID NO: 6631 - DNA, 899 bp, Artificial Sequence; identical to SEQ ID NO: 6630
  Description of Artificial Sequence: Synthetic polynucleotide

SEQ ID NO: 6632 - DNA, 547 bp, Artificial Sequence
  Description of Artificial Sequence: Synthetic polynucleotide
acggtagatttcggagggggtgtttaggatagtgacggttgatatgaagttagcggtgagggatagcgttacgggtattgcggttattttgcggtcgtttattaggaagtttttggaggtttgttggtcgtttttagcgaaggcgtagtagatgtcgatggcggtcgagatgattagtatgttcgcgaatattacgtagttttatattacgaaggtgtcgatgtttcgtggcgtgtttatggtcgtacggtcgtttgagttttgcgcgtaaattggtggtttcgcggcgcgtagtcggagttcggcgcgtattttttatttcggatttttggcgcgtaggcgtggcgtttcgcggggattggaggcgttttttaggtgtcggttttcgaacgtatttcgaggcggggtgagggttggtagtcgtttttgtattcgtcgttgcgagtcgcgttttttaaatttaggtatgggatttcggaaaatcgattcgttgttttgagtgtttattacgtgaggaattggagtggtcgagttcgttaaggcgtcg

SEQ ID NO: 6633 - DNA, 2505 bp, Artificial Sequence
  Description of Artificial Sequence: Synthetic polynucleotide
tcgagttaacgcgttttagtggtaggtggcgaatggtcggagattcggttttttagtggtgtttatcgttacgggttttcgttcgataggtttatttttttttatgttggagtaaatttcggttgaaagagggtcgtattaattggtttgcgtattcgaagtgggaatagagagggaggaaaattatgttttaggtgttacggggggaaaaaagtgaaatgcgaatcgtaggggagagagcgatcgttaggtagatattttgtgaatcgcggtggagagtatatttaggtggggaggttatcggtttaatttattatttttcgggagaatgcgggtagggatagtagtagggggtagtatttacgtttttacgtttgtaagggttttttaagtttttggttattgttttttattttttgtagtttcggtgttcgtcgggggcgtgtgtgaggggcggggtcgtatggggaggagggatttaaaaaaaaaaaaaaaaagcgaggtaattagtatttttcgattttattggtttttcgtcgtttttgttttgtatacgttcgttttattggttgttcggggtttgttggggttcggtaaggtttgtagtcgttacggtcgttgttgcgtttcggtgtagggtaggttggcgtcgagcgaattagggtcgggaattgggagtcgggagtcgggagttagttgttcgcggagttgcggcggcggcggtatttggggtggttttagttttacgaatatcgtggtcggcgttcggtggttattgcgtttagcggggtttagggaagagcggtttagatattttttattttggaagaaaggggtaagtttcggcgggagtttttttttcggtttggttcgttttttattgcgtttagtttcggttcggattttggaagatgattttagggtttgttttgtatattttagcggcggtagtttcgggaggtagtcgaaagtattaatagttggtagtagcggttagtggaaaagtgagttaaggcggcgcggattcggtttttttcgcgtttcgcggtattcgttgtttttcgtcgttttttttttttggtttttaggcggttgtagtatgaagtggcgtagcgatggttaggagaggtaagaagttcgtggtgagaacgttggaggatttgacgttggattcgggttatggtggcgcggcggattcggtgcgtttttttaatttgtttttgtgttgtttcgattcgtattcggcgttttcgtatggcgggagttgttggtcgtttttagttgattttatgtatagtcggtataatagttttgatattgttaatattgttttggtggaagatttcgaggggttggattgcgtcggttagtattgttcgcggttgttgtcggatttagacgaggttttttggattttttaggagttggaggcgttgttgttgcgttcgcgggattttcgggtaggttcggcggttttcggcggtttgtttaaggacgcgttggttaagttgtcgacgttggtgagtcgggcgttggtgcgtatagttaaagaggcgtagcgtttgagtttgcgtttcgttaagtgtattaagtacgagatttagagcgttatggagatcgtgttgttttggggtttggtcgcgtattgtacggcggttgcgttggtcgtattgtttttttataatatgagtagcgtcggcggcgatcgtttgggtcgcggtaagtcggttcgttgcggttttatttttttcgtgggtcgcgtgtatcgttggatggtggatagtcgcgtggcgttgcgtatttacgagtacgtcgttatttatttgatagtttgtatggagagtttttttcgggatatttattcgcgggtcgtggttttcggggtgtttcggagttgtagtggttttgggttaggttcgggtttcggtttaggttcgagttcgggttttggtgcggttttcgcggcggataaagagcgggaggcgttcgggggaggagcggcgagcggcggcgtttgtagcgtagttagtagcgttagcgggggtagtagttgttgcgtttcgtcggtcgtcgcggtcgtcgtagtttcgtcggtagtcgtcgttaattattattattattattattatgcgttttacgaggcgtttaagtttatcgtggagattttggagtatacggttaataacgattcggagatttggggttttttgtagttttattagtatttgatttgcgggaagaacgttagcggtaagtgtttgcgcgggtgttatttttttttatttaatttggttaatttttggcgtaagtttgtttcgcgtttttttttcgcgtttttttagttacgcgttgttgttttaagtcgttgaggaggcggtcgggttggaggtagttagaataagaggttgtttgtttgtttttgtattcgggtgcgcgtattttacgttgttggtgttgttttaggttcgggagcgcgaggtttcgttttcggtgcggggcggggcg

SEQ ID NO: 6634 - DNA, 1587 bp, Artificial Sequence
  Description of Artificial Sequence: Synthetic polynucleotide
gcgcgtttcgatagtttttaagatggtcgttaatgtgggatcgatgttttaatattggaagcgatttgatttacggcgattttaggttagtgcgggtagcgtcggtcgcgcggtcgtgaggagttttcgggcgcgttttgggcgtattggggaggttttcgggcgggtaggcggacgttttggggcggcgggcggcggttgtcggggttcgtcggggttcggtcgttcgttgtttatcgataggtattaggaattgatttcgtcgttgttttttgttcggtttagttatcgattagttgtcgcgattatggagaagcgttagtgagttttcggtcggcggagcggtcgagcggttaggcggtcgggcgaggagcggggaaggtaggggttacggtttcgggtagggggttgttggcgggaattttcggcggttttttttgagtcgtattttgcgcgttttttaatttcgcggcgttcggggaggtcgcggagcgcgtcgtttgttagttcgtattcggttggggtttcggcgagggagggagggagttggcgggtagggaggaggaggaggagaggaggaggaggaggagagaggaggagggagtcggggttggcgaggaggcggtttcgcgtttcgtcgttcgtcggtattttagttttcgtcgttcgtttggttgcgtagttcggacgcgtcgttattcgggggtcgtcgtcgtcgtcgttagagtcgtcgtcgtcggattggtcgtaagcgtcggtagatttttttttttcgggtcggggttttggggttcgttttgttttttgtttttattttttcgttttttttattttttttttaagtttagatgtagacgggcggtggaggtgggttcgggcgttcgtaagtttgcgtttttgtttttagggcggtggagagtcgggagcggcgtagagtaggtgatttttagttttcgggtttaagggaatttttaaatgagagatttttttgtttgttttgttttttgcgttttttttcgttgtttttttcgttttttttttttcgtttttgttttttttttgtttttttttttttttttttgttttttttttttttttttttagggcgatttttcgaaattttattattttttttttattttttttttgtgggagtttgtgtgttttttttagatttggaggtgttttttgcggatttcgtaggagtcggggttgggaggtggaattttagagaacgtatcgtggaggcgcggtttcggtttttgttttttttcggagtgtttcggacgcgtttggtaaggttttttagttttggagtttcgtaaagtttcggcgggtgcggcggggattaggggcgggaaaatggtgcggataatagggcggttagagtattttgttttgatcgtgatattcgcggaagacgcgagattattagtttggagataaaaagggatttatttttttttttttttttaattcgtcggtaaatttcgttaagttttttttgataagtggttttagtattcgcgtttttttttcgttttggtcgttttttagttttcgttttttcgaacgttttatttttcg

SEQ ID NO: 6635 - DNA, 5693 bp, Artificial Sequence
  Description of Artificial Sequence: Synthetic polynucleotide
tcgcggttgttgggagagtattggcggtgggttgaggtttttggagagttcgcggggtggagatgggggtcggttttttttcggcgtttagtcgaggagtagttgttagttgagtgcggattcgagagagaattttcgagggatatttacgttttttatcgcgtttgcgtcgggcgttttggttttaggaggttgtttcggggcggggttttcgggggtcgagcgcggggggcggttcggcggttttattatacggcggtttcgttgagttcggggttgggatgcgataggggttcgttgtagtcgttggtgtcgtttattgggaagggcgggttgggttcgtcgttgaatatttcgtcgggtatggggtgtagcgtgttcggtaggtttggttcggggttcggtgtgttcgggtgcgagattatgtcggtgaatttggggttgttcgcggcgtgcgggtcggcgagcggcggttttagcgtttttagcggcgtcgagtcggggttagaggtcgttaggaagttggagtcggtcggggattgcgtttgcgaaggcgggtcgtgcgcgaagaagtcgtagttgtttttcggcgcgtagtagtcgttttggtagtttgtggagggggagcgggaaggagatagggcgcggtgagagaaggcgaagtaggcgggggattcgggattcggggaggggattcgggcgggcgagagaggggagcgcgcgatatcgatttaaggttagagagatttgcggaggtcggcgttttttgagacggtggacgtcgtaggtttacggggagggttggggagagagataatgagagatttcgaaagggtaagagatttagattgttagagattatatatagagacgggagagatttcgagatcgtgggggatatacgcggtaaaaattcggagattttagttataggttttttgatatttagagatggagagagatagaggcggttagagacgtagagatagataatgatttttaagtgttttagggtcggtgagagatatagagatgcgggatagcgagagatagacggagagatcggtagaggggtagagagaaaggcggaaaagagatttagagatgcggagttcgcggttgagattcgaaagttcgagatatcggagggtcgcggaggagtcgaggagacgtagagagaggaaagacggtcgcggttagagatacgcgtggaaattttcgggggcggtagcgagggagttaggagtgagttcgaagatggagagaagtcgatgcgtttagagaacgtaagacggtggattagagatgagttttaggaatttttagagaagcggaggttgataggttcggggagaggaatcgggtagggataaattagcggatagagtagagcgcgaaatggttgagatcgggaagcgatttggtcgggggaaattggattcgggtcgcggtaggagcgattggtgggttgggtcgggcggggcggttttggcgttttaaattcggtttttgcgttttattaatttagtttaagtttttcgtttcgttaagtacggtcgtcgcgtcgatttcggtgagattatttgtatcggtttagtttagtttgagaaagagaaaattgagttttagcgatttgggagagggggaggaggatacgaagattttttgggttatggttagagtttcgcgggttttttggggtagaagttcggttttttagttttgtttcgggttggttttgttagtatttttaggttttgaagtatttgaggatattgagattttttgagaagttggtgatagttatgggtttttttttaaggaaaatgtaaggatgagaattttgtttataaatttaggaggtgtagggatttcggattgtaaatttattttgttttaataaatttgtattaattttttgatcgttttatatagttttttttttagaattttcgggatattttgtttttttttattaggtggggttttgaaggattgacgtgggggacgttacgaaaggattattttgtattaggtattcgttttgtacggcgggaaaattagcgagtttagaagtttgagttttttttgtaaatttattttttttgttgagttttgggattttagttaaggggcgaatttttgatgttttttgttatttttttttttttttaaattttgaaatttgtttaaatggggggtgtttggaggcgtggtttggaggtagtttaagtaatagttaaaacggttgttaattattttttaaaattattaatttaatttttttcgaaagtgaaggggaagatggggagcggtaaatttggagttttaaagggatagggatgggagacggtcgcggttcgcggcgagtcggaaaattagcgaaggtcgttgttttcgcgtcgtgcgcgtcgttttcgtttatatggcggtcgggtcggaggtaattggaataaacgtcgtttgaaaagggtataaaagtcgtagttggggttttgttcgcgtttttacggggagtcgtcggtttcgtcgttcggtttttttttcgttcgttgtcggtcgttatcgtcgggattttttagcgcggattaggcggggttgtttcgttgggggttggggagttttttttattattacggggaacgaggggtttttagtatttagttttttattttatttagcgcgtagggagaggaggcggtgggataggtcggggcgggggcgaagtggttttcggggaaattttggttaattatttaggcggggaaaaatttcgggtcggtatcgtttttattatttcgttgtttcgggtttagattttgtagggaaagaggtaaatttaggtggagagagtcggtgagtggagatttcggaagatacgtttattattcgggttttttagggttgggggtttgttcggggttgggggtttgtttagggttggggggttgtttagggttgggcggttggggcgttttagtttgagttttgttattgtttggggtttttgttttgaaaagtatagtttggtattttgtttataatttttaggggtttcggttcggttttaaggtttaatttttttttaggttttcggatgtgttgaggttagtgatggggttattttttttttttttttgcgtttatttgggtgtttagtttttgttttgttaatattgttattgaatttattttttaagagaaattgtttttttttaatttgcgttataatttagaagtgtagatgttttttagatatagatagttttggggtttttttaaatttagaagttttagaatagaagaggagaggtgtttttttgagtttttagttttgggaagaataggatagtgagtttggtgagtttaagtaatgcggtttagggtaaggagttgaaaaaatcggatagggggagttgggatggtttattaatttagtgtgagggaagtgagaggaggaaaagttgaggtggtaaggggatagtttattttaggtttaagtttggtattattatttgaagttttttgtaaattggggtttttcgttttttgtagttttaaagacggtggaaatttggggttggtttaatatttgtgtttttagtttgtaggaattttaggggtttcggggttggagggtggattatagttttgtttagagtaattgtcggtatttgggttaatattgttagatgttgtgcgtatatatttcgttatatggaataggagttgttgttttcgatgttagtgagtaggcggtttggaatgaatttagatttttattttttttttttatattattttttagcgttcggaatttattttatgttaagtatattaggtatagggcggtaggaaggttgtgcgtttgttcgtgggggtcgtatgtatgtggatttgttagtattggttttagtgtgattggtgggagtgtgcgcgtttgtggagttgtgttttcgtgagtgtatttgtgtgtgagagggtggaatttatttatacgtgatcgtgcgatcgtgtttagacgtgtgtttttggagtttttgaacgtaagtgtgagtgtattttgtgttttgcgtgggtgaatgtgttattgtatttcgtgtgtgtttttgtgtgtattattgtatgggtgagattatgtatttgattttgtgtttaggatatgtgggtgagtgtatatgtgtttgtgatcgtgtgtttagcgagtgggcgatgttttggagcggcggaaagcgtgttggtcgggatttttcgtttttagttttcggaataggataggtgcggaatagcgaatttcggggcgttttttattttcgtagtaggtgtacggggtggattttaatattttagattcgtttaagcggtcgtttagcggacgtatgcgtcgcggatttcggaagaaggcgtgttttcgggcgtttagggcgtttagttgttttattcggcgttttttggatcgtcggttttgaaattatatttgggatagaggagggggttgtgaatttaggattaggagtgttttttttttttttttttttttttttttgattgggttgtttttgttgggtttttgcgtttttttcgtattaggattttttcgaggcggggtcgggtcggattaggtcgggaggggtggagagaggtttcggcgaattagttaagggtgaaggatttcgcggattcgtggggcgatttataaagatttgggttttttggttttcggttcgttcgcggtttgacggttttataaaggtttttttttcggtacggttttcgtttcggtttttcggtttcggagttagtttttggtcgtttgtttgttcgcgtttcggcgtagggagggagggggtatcgtttgtttttttgttcgaaaggtggaggtaaagagggatttcggattttagagaggtttataattttttataagtaaggcggggggcggaatttagagaggtaaagtgattcgtttttaaatcgtaatattaggaggatagtagggttagatggaatttttcggtttatagttttcgatttcgggtaagtgttttattcgggcgtacggtttgtttttagattagaattaggcgcgttcgtagttaaggaagtttggcgggagattttttcgaggttttcggtttttaggttagcggggttaaggagttgtgttcgtttcgggtcgtatttggatgacgcgtatgttgaggtcggttttttgcgttagttgttcgcggatgtggcgcgtgggtttgggcgtggcggcgaaggtagttttgagcgtttttagttgtttggttttgatggtggtgcgggggtcgcgtcgtttggtgttcgagttttgtttttcgttttcgttgttggtcgtttttttgttcgacgaggtcgagttgttcgtttttttggggtcgttttgtagtgcgttttggaggttcggggataaattgcggttcgtataggatgatattgcgggcggacggatcgggaaggggatagcggcgttagcgacggttagacgtttttttagtttagtggcgggttttcgtcggtttaagttacggtttgtttaggttacggttagtttcgttggatttttttttaaatttgcgatagttttttttttagggattcggtgttcgtttattttttttaggcggggttgggtttttggaggggcgtttttaagtttttttcgcgcg

SEQ ID NO: 6636 - DNA, 589 bp, Artificial Sequence
  Description of Artificial Sequence: Synthetic polynucleotide
tcgtttcgttttcggggttttagggaggcggcgattggagtttcgttgtttatttataataaaagaaagtagggttggcgtttttatacgcgtttttatttattgtcggtcgcggggagaattttatttcgcgttttcgttagggtttcggggagttttgggttggcggaggcgaataagatgcggtttgatagaattaggtcgtgtttttgtaaattttaatgtcgtttcgttagtcgcggcggttttttagattttatttgtcggggagtttcgagtcgcgtaaaatttttgtaagttgtgttttgtagaatgtaaagtcgggttggaattcgttattttcgtcgttttagtcgattcggtcgacgagtttttttttgagtttttcgggttatttgtcgggacggttatttcgttcggtgaagtcggtgtatttattatattttttgttgtttttagtagggaagtcggcggtgaggcgggggagtaggtatggtggtttcggggtttatgcggggtttattgtttatttagaatagcggttattgttgtttattagggcgtatttatcgttggagttttcgcggcg

SEQ ID NO: 6637 - DNA, 1294 bp, Artificial Sequence; identical to SEQ ID NO: 6627
  Description of Artificial Sequence: Synthetic polynucleotide

SEQ ID NO: 6638 - DNA, 1373 bp, Artificial Sequence
  Description of Artificial Sequence: Synthetic polynucleotide
gcgagcgtttggcgttttttggggcgtagtttcgagagagtttttttcgggatttcggacgtaaggtttttgagtggttttggaagttggatttttcggggattttgtttcgaattttggttatttggaagtaattttatcgagcgttttttttattgtttagtttcgaatcgtggcggaacgcgtttttcggtttttttagagttttttttgcgggagaagtataatttttttaggttttggagacggcgtttttatattttaatttcgtttagacggaagaagtgagaggtgcgggcggtttcgttatgatcgcgggaggagagcgtaaggaggtttttcgtaaagttggaggttaggtcggagcgatgtttcgggagcggagtttttttagtttcgggtttttagtcgcggatagttggtagtgttaaagatttcgttattatttgcggttcgtagttgcgattcggtcgtagagtcgggtatcgaggaaggcgtaaagttgagtttgggtaggtataacggtttttagggattggtattttttagttcgggttgttcgcgggagggtagcgagttgtgttaagggtttcgttattatcgttagcgtatagttcggagttaagcgcgcggttgaggaacgattagggttttgtaaagttggagtttgggcgcgtagattttcggatcggagttttcggtttgaggtcgttcgttaggaggaaaatgaggtcgttcgaattaagttgggacgcgtagtaaagttcgagtttttcgcgtatattaggggttcgggcgggagcggggagttttggggacggagaaggggcgcgggacgtttggattaggaatttatttgacgtcgagtcgggtagcgtcgaggttgttttttcgcgttgcgtattcgttcgttcgtttcgtattttttttttttttttcgggcgttcgcggtcgtcgcgtttcgggttttgaatttttcgagttcgtcgtttcgcgcggttggagggcgtcggttgtatttattcgttttttggtaggagtcgcgcgcgtttttttttttttttttcgttttgtgtttttaagatttttttttatttttttttttttagtttttattttttttttttttttttttttttttttgcgtttttttttttagttttagcgaatttaagttcgggacggaggttgcgggttttttcggcgtagtgttgggcgtttcgcgcgcgtttttggtttatttcgttcgttcggtcgttgttcgttgttcggtcgtttttcggaggagtcgcggcgttaagtagttttttatttagcggttggaaacgcggtataaatatgtagggattgagtcgtgagtttagcgagggtcg

SEQ ID NO: 6639 - DNA, 1524 bp, Artificial Sequence
  Description of Artificial Sequence: Synthetic polynucleotide
gcggttttgcggattttaggtttaagggggtatcgttttaaatattcgacgcgtttttattattagttttttattggtaggttttaagcgggaacgggattgggaaggtttcgggtttggggggttttatttcgatgttttaggggcgttttgaatttagttttagttaggcggcggtattttaggtagcgtagggagcgcgatcggttcggggagggggaggacgcggcgttttcgttttttttcggttcgtttgtttatttttaggtttttttgttcgtcggttttttggttttgtttattttggggttggtggtgggcgcgggtcgggtttaggtttatgttcggttttttttattgtttgttttttttttttattattttattttatttttttagtgttcggtttcgtttcgttatcggattttttggaatgggggacgcgggcgcgaaatacgaatttagttatcggtagttttttttttacgtgcgttcggttcgtagcgtagagggcggttcggggtgggggcgttttatttttgttttttatggcgtgtacgaagtttttttggtatagttggttgcgaagttttttttttaggttgaagtcgcggacgttgacgattttttttacgttcgataagttttcgttttcgtcgtatcgttggcggttaatcgggcgttgcgaggatttaaattagagagttcgggatattattgtgggggttggaggtcgttttttaatttgggtttagtattaataggtgtagtagtcgagcgttttttgtattttattattgtaatttaagtaattttgcgtaattgttaaagatgttgaaaagtaggataaggagaggggttcgtatttcgagggtttagttgcgttttacgcggggtattttttttcggtgttttcggaagtattgaagggatatttggggatttttttttgtttttcgttttcgaaatgtgttgggtttcgtttattcggtcgggagtttggttatgtaattcgcgaagggggtttcggatacgggttggcggggtaaatgtaggttttaggaggagtcgttgcggcgttcggttcggcggtaatagtagttttagcggtcgcggcggtagagtcgggaagtcggaatcgggggtcggcggtatttttaaagttggagtcgttttcgagttatcggggaagttggaaagttgaaatggaagggttgagattttagtcgttttcgtcgttcgttcgttagtgtaagaagaggaggtggggggaggagaatcggggtttggaagggggagaggtagacggttcgttataaagttcggatcggagattttaaaacgtattagtagttgttttatttttttataagcgcgcgcgtatatttattttttaaggagatttttttattatttttcgtatttttttgttttttttttttatcgtttagcgttcggttttttagttttttagatttcgggcgaatttcgagttcgtttagtttttttttacgttttttttcg

SEQ ID NO: 6640 - DNA, 1009 bp, Artificial Sequence
  Description of Artificial Sequence: Synthetic polynucleotide
gcgtttgtagcgaaggattcgcgtgggagcgagaaatgtttttgtttagtgtttcgcgcgttggatcgcgggggcgagtttgagggtggagaggtcgtcgggtggaggcgcgtaggggtgcgtgggtgggtgcggaaggagtgtagggtatggaggggaattttggggcggcgcgaaggaggagcgtttggaaaggcgcggtgtttggttatagaggggttcggagtgggagtgtaggggtgcggggagggagtgtagggacgcggggagggagtggaggggtggggacgtgttggaggggcgcgtttcgatagaattggagaaattggaaaagtggaggggcggggtagtggttggaggaatttttgaagcgacgcggggaatatgtgaaggagtgttatgttggaatttggaggggaggggggatgttggagaggtatacggtgatggatatggaaggattcgggaggtgtggagtggtgggttcggttcgtcgcgggaaggatatagagggatataggttgttttggagaggcgttttcggatatttggaggggcgtatagtgttgggatttggcggcgtttggggcggaggggcgcgtcggatttagtcgggcgcgttcgggggtcgggcgtagtgggagttgacgggcgtttagtcggcggcgttttgggttcggttaggcgtaggacggttttggtagcggtgtagtagtttaggttagtttttggggggtttttggttttcgttttttcgcgcgtttcggttagtatcgttcggagttcgggcggggaagtgggcgttcgcggtttgggaagttgttttttcgttttggagtagagtcgtcgttgcggtcgttgaggaaggacggagtagaggttcgcgttgtttggggagaagattgtggtgttatttcgtcgggaatgaagggaaatgtagcggttgtttgcgtttcgggattttaagaagtatagtaggtaaagagaatagttacggttcgttatttcg

SEQ ID NO: 6641 - DNA, 961 bp, Artificial Sequence
  Description of Artificial Sequence: Synthetic polynucleotide
tcgtttttttcgatatttaaaagtttcggttttgcgtaatattgcggattttttttagtttttcgttcgttttttttttcgcggggtttcgtttagggtcggtttttcgtttttacgtcgtagttcgggttagcggggttcgtcgcggtggcgttcgcggatgttgtcgtattggtcgttgcggtacggacggcgtagtttcgggcgcggttcggtataggcgtcggcggttttcgttagttagtagttcggcgaggcgttggtttatttatggttttcgggcggcggtttttgcgtttagttttgcgcgtagttttcgtttttcgttcggggtcgtcgagttttcgatacgggcgagatgttgaacggcgtaggtttggataaagtttttaagatgtttttgtcgcggaggtcgaggattcgttcgttcgtgggtgagttgggaggggcgcggcgagggagggtgggttcggggcgggggcggcgcggggcgcgtttgcggttatgcgatattgtttcgttcgcgtttcgtttttttttttgggttttttgggttttttgggttgtaggattcgtcgacgcggcgcgttggtcgtacgggggttgggcgtcgttgtatttgcggggttaaaaggttttaggtcggggcgaggtgagcggcgggcgttagagattttcggttcgtttttgtatagatgtgtgtgtgtgtgtgcggtttttttgtgcgcgtgttcgtgcgtttttacgcgcggatgcggtttagggatgcgatttaggcggtagttatcgcgatggtgggtacggtttggcggcgtagagaagatgtagttttttttgtcggcggtcggtatcgttgtgttgtagagtttaaaagtagagggggaaaaaggtattcgaagggtttttcgagtgatttttattatttggagtttcgggttttcgcgcgtttatagcggcgacg

SEQ ID NO: 6642 - DNA, 961 bp, Artificial Sequence; identical to SEQ ID NO: 6641
  Description of Artificial Sequence: Synthetic polynucleotide

SEQ ID NO: 6643 - DNA, 980 bp, Artificial Sequence
  Description of Artificial Sequence: Synthetic polynucleotide
gcgtgagcgaggtaggtatatacggattcgcggcggtttgtttgtaatagcgttgggaatgtatattggaaaattatattttgtatgttgaaaacgaataattgtttgatatttgggttgttgtcgagaaaattacgcggtagcggtaggtttcgagttaggggtcgttattttcgatggaatatttaaatcgtttatttttatcgaatttttattttttaaacgtatttttcgcgcgcgtgtatatttttaaacgtattttcgatcggaataaagaggggttttagatttttttcgtgcgtacggggtagtcgggagggttacgagagggaggtgtgtgtaatggaagtatcgagatagatagatagatagatgtttatgtattgttgtcgattttttggcggcggggacgggagtcggacgcgagggggatagatagggtgcggggataggcggttcgcgggggcgggggggttatcgagggggttattttggttcgtttaggtcgagggggttttttcggtgttttcgaagcgcgtgggttattcgtgtcgtatgtcggcgtagttgttcgttgtggtaaggggggggcggtcgggtttcggagcgggtcgggagggcgcggggcgcgtatttcgcggtaggtgagcggcgcggttgtaggtgagtagtagtttcggttcgcgcgtttagtttttttcgtcgcgttcgttcggtttatacgtttttcgcgcgcgcgtcgttttcgtttcgcgcgcgttcggtcgttcgttcgttcgtgggattttcgcgaggtcgcgcgtttttacgggttagggttgttttagggtgcgggtaggcgagggcggtttaggggcgcggggcgaggggcgaaggagttaggaggttgagaattgtatggtagttttgtttgtttgtcgcgttgcgcgttttattttagtcggcggtttcgggtttgtatcgggcggggtaggggagcg

SEQ ID NO: 6644 - DNA, 408 bp, Artificial Sequence
  Description of Artificial Sequence: Synthetic polynucleotide
tcgtattttttgaagttcgttgggcgcgttttgggttgtttttttttgagtagtcgggtttagagttaaggcgcgatgattgtcgcgtaagttagggtttacgcggtcggggtttttttttcgtttcgggcgtattagaggttagaaagcggaaagcggttttgttaggttaaggtcgatagaaatcgagagtatgtcgttatttgtcggagagaattgttttgttaggttgttataggtgatttgttcgcgcgagttacggtttttgcgtagagtttttttcgaaggggagagttagagttattcgcgggtttggtcggggttttttttagttcggcgtttacgtttcgcgttttgcgttcgtttttgcggttgtttatgtttaggtgtttcggaagaggcgtcgcg

SEQ ID NO: 6645 - DNA, 2190 bp, Artificial Sequence
  Description of Artificial Sequence: Synthetic polynucleotide
gcgtttcgaaatttggttttttgcgtttaggggaacgaggtataaattttcgttatttagttttattgagtagagattgcgagttcgaatttttaagtttttcggggttttgattttttaatggcggcggtttaattgttggtaaaattttcggtttttgattgttttatcgttcgttttttaaacgtttagcgaaggttgatttaggtggcgggcggattttatcgattttttaaattatatcgtttggttaaaatcgttcgtttttttttcgttcggattttaaaggttaggtttgtaagttagtaagttaacggtatttgggttttgggttgtttttgtgggttagggttattgatgttcgcgatacggattggatcgcgtattacgtttgttttcggtagaggttttattcgggtggttgagcgtagcgtattggggtttcgcggttcgagagcggcggggaggagcgggcgttcgtcgagcgtttttcgggatagttcggtttggggatttaagcgggttatgggatgtcggcgttggtttttttttgagatttttttgttttttcgtaggtacgagttttttttaaatcggttttttttttatattttcgtgacgcgaggtcgcggttagtgtttaatattattaaagtttcggttttagtttagtttcgggtagtttggtaggtttttaggagtttttgttttcggtttcgggggattttgcgtatttgttttaggttttttgggaatgggttttgggtgttaggtaggtttcggtgcgtgttgtttttagtgtttagggtttcggtagtgagattttaattcgatagttggataagggattagcgattttgtcgtaaacggatagttttagcgcggattcggtttgagcgttgatgttcgcgggtttaggttagttatttttcgaggcgttttttcggagaaagggcgtagcggttttaagcgtgttcgttgtaattagtgttttaggttttcgtcgtagttagttttttcgggttatagtttcgttttttcgcgtgtatttcgttttggtttcggaggttttgtttttcggtcgttttatcgtagttcgttttaggtttcggtttttagtcgcgttttatttgtgagaagtagatagttgagtagcgcgtatagtaggatttcggtgttttagtagttgattatggtgagcgcgacgcggtttgttcgttcggtgttcgcgtttttcgcggttaacgattcggtcgttagagttcgttttttcgttcgtcgtcgtcggtttcgcgttttgagcgttcgtttcgcggttttagttaggagataattattttttcgggtaattttcgtcgttaggcgttcgttggtcgttgtattcgagtttcggagttcgtttcgagtcgtcgtcgttgtcggggaggagtcgagaggagtgttcgtttggcgcgtttcgagtttttcgcggatttcgatgaagagtagtcgagggcgggggcgatttataatttttttttagtttattttttatttcggtatttttttttggtgacgttaaggggttttttattttttattcgtttttttatttattttttttttttttttaggttcgtttttttgcggttacggagaggggcgggggtcgacgagggcgggtggttcggggtcgagcgcgcgtggggaggtgttggcgacgcgggttcgggagcgcggtttcggtaggtttagggtttttgtttcgcgtttttttgtttttgtttttttttttgtttatcgcgtttaggaaatttttgtagattttttttattcggtttatttagttttgggggtcgttcgaaattggggaagggataaggttgaagtttcgtcgtttggttttaggggcggaaagttcgatttaagggaagttggtcgcgttttcgcgacggtgtttttggtacggaggattgaggcgtagttcggttgtttttttttgtttgtttttttcgcgttgtttcgtcgtttttgatttttttagattgtttcgagaagtttaggaaggtatcggagattttcggtataaggtattgaatttggagcgtttgaggggaattgacgtttgtttggtatttttgggaagattgcgaattagtttaggttttaggggagcgtgttcgtgtttttttcggtcgtattgatgtattcg

SEQ ID NO: 6646 - DNA, 2190 bp, Artificial Sequence; identical to SEQ ID NO: 6645
  Description of Artificial Sequence: Synthetic polynucleotide

SEQ ID NO: 6647 - DNA, 679 bp, Artificial Sequence
  Description of Artificial Sequence: Synthetic polynucleotide
tcgagtggagagtagcggtcgtagcgcggcgttaggttcgggttgggttggtcggcgcgaattttcgggggcgtttgggcggttaggtcgggtggcggttgcgtacgtaggagtattttttgagtttagtcgttcggtcggtttgattcgcgggtgatcggatacgagtaacgcgtgcgtttcgatttgtgttttgcgcggggtcgggcggggatcggtcgggggcgtcgcgcgttcggtcgggttgattgtcgggggcgattttcgcggggtaaggcgggggcgcgggagtagcgcgtagttgcggggttattttatttgagcgttttgaggttagggtcggggtttgaggatacggcgttgggtttcgggggacgcgggtttacgtcggcgttcgagcgttattttttcgtttttcgtcggtttacgtagtttcggggttcggtacgtgaagtgtcggcgcgaggttgtttaggttatcgtatgggtcgggcgataaataatcgtataggatatataatattttggattgttataagtttttcgtaggaaaagataaataatatttgaggcgttgcggcgcggttttttcgggttgaataaaaattaggaggtggggggcggtggggcgaagtaaataatagaatcgaagaattgtcgtacggagtttgggtcggcg

SEQ ID NO: 6648 - DNA, 2013 bp, Artificial Sequence
  Description of Artificial Sequence: Synthetic polynucleotide
tcggtagatttggagacgttttcggttttttgggagtttttgagggtttaggtcgggtggggcgcgttttgcggtaagttttttttttttagttatcgttttgaggagtagaaggcgcggggatatatatatatacgttcgggtacgtcgtcgtatttttttaattgaattttggtgttttttttttgtttgtaaagatattttaggttttgggtttgggagttgttttcgcgcggttttgtttgattttagcggggttatagtagtttggcgttcggagcggttttagcgcggcgtcgcgggtttaggtgggtgttttagagagcgggcggttgcgcgattgaggagttggaggcgtattttttcgttcgttagacggttcggttcgcgttttcgttttatttttttcgcgtttttttttttggaaaggaaggtcggagttgtatttttaaagcgttttcgtttttatttttttcggttcgtcgcgttttaggggttttataaatttgttgtaagtcgtcggggttgtagttgtaggtaagggtgaggcggggtcgcggtttgggttgtcgagtacgtttttttttagttttaagcgtgtacgttttttacggacgcgtatttagtattttattttcgtcgttgttttcgaggttttcgtttaattagaggtcgcgcgcgtcgcgtcgtcggcgggtagatatatcggtttttcggtttgcgtttttgcggttttggtttcgttgtagcgtttcggttcggttatatttatcgtttcgggcgcgtcgttcgcgcgcggtttcgtttcgggtcggtatttttcggttcggttgttttcggttttcgtttcggtttcggttttcgtttcgtagggttcggtttcgcgatggtggtcgcggcggcgagcgcggtagggagggcgtgtgtatgcgcgtgagagcgcgtagcgtgtgtatgtgcgtgtgcgcgggagggtttcggtttttttgcgcgtttcgtttttgttttttgttcgttacgatgcgatgtcggtagaatttttatcgcgcgtttttattgttcggcgtttatattcgcgtatatacgcgtatatttaggcgcgtatattcggtttcgtattttcgattcgtttttttggagcgtttataaagattttttgtcgggacggtcggagtttgcggagcgcggttttgggttttttcgggattcgtcggttttaggtgtttcgttgtttttcgtagggatttcgcgggcggttcggttttcgtattttgtttggtcgggtcgcggtcgcgtttttagttcgaatttgggtttaggtgtcgattcgggtttttcgtattttcgcgggaagcgtcggtttttttcgcggcgtcgtcgttttttttttttttttttagttcggttttttcggcgtttttttgttttgttttatttgtttagttcggttttcgtttttttcgttgtttttcgtttgtttcgtcgtcgttttttttcgcgtttttttttttttatcgttttgcgttgttttttatatttttcgtattatagcgggtgtcgttcgtcgttcgcggggtttagggttcgagcgcgtagtgggcggcgaggggattcgttacgttcggtttcgtcgtttttttcgtttttcgcggtttcgcggttgttagtttcggtttggcgttagggtggcgacgtttcgcgttagtttcggttgtcgttgatagtttttatttcgttcgggtttaaagggatagcgtattcggttcgatcggttttattcgggggtttcggggaagggatttcgttgcgcgggaatagttcggggcggtggtatagtcggggtcgtgcgggcgacgtttttttcgtcgtcgtggagttcggttttcggggttggaggtgagttaaggagaaggacggttagattacgttatttagggggcgtttagcggttaagtttttgggtcgataatgggtgtgcggcggtgtaggttgagcgttttggattgcgtggcg

SEQ ID NO: 6649 - DNA, 1501 bp, Artificial Sequence
  Description of Artificial Sequence: Synthetic polynucleotide
tcgaaagaggggcgcgggtgggcgcgttttttcgcgagtattttatttaagggggaattttttttagcgtacggcgaagttttttttcggttgttttatttggtagtttttttaggatttcggttagtttttaattggttttagtaatgtttagtcggagtttttttgggttttcgagtgggagaaaagtgagagtaggtgtttttttagcggcgcgtttcgttagggttcggtaggatttcgtttttaagtcggggaaagttggtcggcgtttttttttttcgacgaagtcgttttagggttgtttttagaggacgcgcggtaggtaaagagaatgaatttgagcgtttacgaaacgttttgtacggttttcgggagttgggagaaataggtgttttttttcgacgttcgcgggcgacgtttgtcgtattttgttcgttgtcgcgtttttttcgggtatttttcgttttcggcgtttttgttttcgtttttagtgttagggcggaggtagtttcggttcgtaggtaattattgttagcggagttcgtcggggagcgggggtgggcgcgtcggcggtgggcgggcgggcgcggcggggcgcgggtataaaggggcgcggcgcggggtttcggagtttggttttcgcgtagtatgttcgttagcgtttcgtcgcgtcgttcgcggtcgtcgtcgtcgtcgttgtcgttgttgttggtgttgttgggtttgggcggtcgtcgtttgcgtgcggagtcgggcgacggcgcgtagatttgggttcgtttttcgcggttttttgttttcgaggtcgcgggttttttttagggtatttttttcgacggttttttttgggtcgtgggtagcgtcgtttattagatcgagggcggttggtagtagtacggtaagggtgcgtttatttgggatacgtttatttattattttttggtattttcgggagattttcggaacgttagtttgtcgttgggcgtttcgtcgtcgttgtagttcgttatcggggacgtagttagcgatagttataataacgtttttcgcgatacggaggcgttgcgcgagttcggggttatttattatcgtttttttatttcgtgggcgcgagtgttttttaatggtagcgcgggcgtttttaatcgcgaggggttgcgttattatcggcgtttgttggagcggttgcgggagttgggcgtgtagttcgtggttattttgtattattgggatttgttttagcgtttgtaggacgtttacggcggttgggttaatcgcgttttggtcgattattttagggattacgcggagttttgttttcgttatttcggcggttaggttaagtattggattattatcgataatttttacgtggtggtttggtacggttacgttatcgggcgtttggttttcggtattcggggtagttcgcggttcgggtatttggtggcgtataatttttttttggtgagtgcgaggggttaggcggagggttacg

SEQ ID NO: 6650 - DNA, 668 bp, Artificial Sequence
  Description of Artificial Sequence: Synthetic polynucleotide
tcggggtcgttcgtacgtaacgttttcgggtcgggttaggttggttagggtagggcggtcgtttttcgaggaattgcgggcggggcggcggggttaagttgagcgttcgttttgttttcggcgtttcgcggttgcgggcggagcgggttttgcggagtttttcggtcgtttttttcgtagttttcgtttttagggaaggtaaattacgtatcggttcgcggagagacgtcgtcgggggtttttgtggtcgcgttgggggtcgttttttggtgttgttttcgtcgggttgggcgcggtcggggttgcggggttgtagggttggggggcggcggcggggtcgggttgggcggtagtagttgttggagcgcggcgtttcggttgcggttattagtgtagggatgtgtttcggttcgtttttattgaaatgcggcgtttcgtatagttttattttagtttttttttttagaggagggcggcggcggcggcggcggcgggcgcgttttttttttttgttttattcgtttatacgttttttcgttttttttttttttttttttttttgcgtgcgcgtttcgtcgttttcgttttttttggtagggcgtatttattacggttgcgttttaggttttttttttttttagcgttttttttttatcgtagtaatttcg

SEQ ID NO: 6651 - DNA, 1006 bp, Artificial Sequence
  Description of Artificial Sequence: Synthetic polynucleotide
tcgggcgttttgttcgttcgttcgcgcgttttaggatttaaagtcgggttttaagtcggcgttttacgtcgaggtttcgtcgtagttttcggagttggtcgtagataagaaggggagggagcgggagagggaggagagtttcgaagcgagagggtcgagcgttatgcgtcgcgttagtagagattatattaagtatttgcgtggttcggaggagatgggcggcggtttcggagtttcgtacgagggttttttgtacgtttcgtcgtcgtttgcgtcgtattagttttttgtcgtttttcgttttatgttcgtggtttttttggggttggggttgggttaggttgtttgtagcgtcgttttgtttttttattttagagcgtaggtgagtggttatttttttaggggatcgcggttgagagcgtttatttttttttttcgtatttggaaattgagtttggcggtagggttgggttatttagagtttgtatatttcggaagggaaagtgattttagaagggagagaggaagtgttgagtttggggataatttggcgtagggttgtcgggcgtattttgtttttttttcgtttacgtattttagtttttcggtgttttgggggcggatttttttggtcggacgatgggtttgaattttatttcgttttttcgttgggaaataatattggttttttattttttttggtagtgattgtatattttttttttttgttattttttatttgaagttaagaattaatttttgtttacgtaggaaaaaagatgagcgtttttatttgggtatttattttttttttttcgtttattattcggcgggtttcggtttttgcgtttggttgttttgtaggtgtgttggggttacggtgttggagggttgcgcggagcgggaggtcgcggtgttcgtgtttaggtcgtttaatgggtgggtagaatgatacggcgcgattagagaggcgcgggttcgggatgggggttttgcggttgtggcg

SEQ ID NO: 6652 - DNA, 867 bp, Artificial Sequence
  Description of Artificial Sequence: Synthetic polynucleotide
gcgcggaataaggcgttgattgttttttagttttttttttttcgcgttttttcggtagtagcgaaaattcggaaatttgattttggttttaggagagtcgggttttatgaggtgtattgagtatgttttgtagggttcggcgtgggagggacgcgttggcgttttttaggttcgggcggaagcggcgttcgtaggcgttgaaagcgagcgattttttgagttcgggtggttcggcgggtaagggcggcgcgggagattcgtagggcgcgggcgcggattcggggaattagggttatcgttgcgggcggatgggggttatcgaggcggttcgtttttaggcgtatatttcgtatatttttttgttaagtgaaggggttaaaatgtatagatgggggagtttatttaggaatagaggcgcgagacgtatagttatttttgggttgggagtacgagttagtagattttcggagcgcgttaaacggataatatgttcggtgttgtaaatagaggtttttgttggtagggatattggaaagaagggcggagagggagtatagcgaaaggtggggatcgtagaatttggaatttttgcggagatcggaaagaaaattaatcggagtattttttatatgtagagttacggaaattgttttggaaagagaaagtggtagcgtttgggttttttcggttagttcgggttagtcggttgcgcgtgcgaagttttttttagcggagcgggatcggtcgcggcggtggatcgtggcggtttttgtatttttgttttagtcgcgtttggaaatttgagttcggattcgcggttgttgtaaaattcgtttttagtttattttattgcgaattttgttttcg

SEQ ID NO: 6653 - DNA, 1072 bp, Artificial Sequence
  Description of Artificial Sequence: Synthetic polynucleotide
tcggttgcgtcgttttagtttagggacgttttcgttttcggttgttatttatcggttatcgagcgttcgtttcgtttcgggtttattatgtttgttgtagtttggttcgtattagaggcgcgataataaataagtgtattggattgggttttgtattcgtttcggagtagttgttttagagattcggtgttgtttatcgcgttgttattttttcggcgttcgggaggaagacgtaattttttcggagttttttttagagttatcgggttgttaggataagttataggtatagaacgacgcggttgttgttcgtttttttttttttttagaaattttaaaggatgtcggtgatagagagttttaattaatgacgattgtgcgtcgtatttggggaagggatatagaaaaaaattttgtaaatatcgtgaggatgaaattgttaaagggatgtaagagttttttaaatattaattaggggtcgcggcggcggcgggttcggcgcggagatagcgtcggcgggattttagcgcggtggtcgtcgttgcgttggggggcggaggatagcgtaggagttgtagtcgtcgttttcgttggagtagtcgaggggtcggtgttatttttgttcgtttttttattattatgtatagtgtgcgttgtaagaagaaggcgggagatgtatgtatattttcgcgattcgttttttttggttcgtttttcggcgtgcgttattgattaggggggaatgtggtgaagacggcgaggaggagagtcgaggggggaggggagggtcggtcggcgcgaatttaggtcggagggtgcgaggagttagaggaggttggagggggcggcggttatagttgggtcggagaaagttgttttttatgtagatggtaattgtgagtatttttgtgggggggagggtgtagcgaaggttgttagggatttcgcgatcgcgttttaatacgtattggagcgagtgtgcgagtgattatgagtgtgagcgggtgcgagcgttcggcggggttgatcgttacgttggcggggtcggcggggttaggtagtttttttcgcg

SEQ ID NO: 6654 - DNA, 1633 bp, Artificial Sequence
  Description of Artificial Sequence: Synthetic polynucleotide
acgcgcgtatatatattcgttttcgtttgtttatttttttttcgggggagtcggcgcgcgtttttatttttgtcgtatatttcggcgagtcgagttcgtagcgttttaggattttgcggttcggaattcggattgtagttttgaatttttatggtggttttttaaatattttttttttttttttttttcgttttgattgtatcgtttttatttgggggttagaggagtaaggtagtagtttttttagttagtttttgttggtttgttatcgtttatttggtttataaaagtttgttgagcgtagtttagagggttgcgttgttcgttttttcggttggtagaagggggtgacgttgggtagcggcgaggagcgcgtcgttgtttttggcgggttttcggtttgaggggtaaggtgaagagcgtatcggtcgtggggtttatcgagttggatttgtatgttgtattatgtttttttggatcggggttgtgatttttttttttttggggttgttgtttttttttttcgtcggggcggatgtgaaggttcggagttgcggagaggttcgttaggcgtacggtgttaagggatttagtttggcggatattttttattaggagatcgtaggtaagcgcgggcgcgttgtaggggtaggttgtagttttcggttgtcgtacgttttattggtcgttcggcgtttttttttttttttttgttgttgagttggtgtttattttttgttatcgttatgggatttcgcgttttcgtgttgggcggcggatgtttttgcggttttttcggcgggggaaggtgtgcgttttcgtcgttttattgtgtgtatacgcgggagtattttggttttcgtttttcgttgttttcgcgtttttttattttttagttgatggtttaggttcggttggttagggagttcgggttatttcggggcggttgtaaggcgtagacggagagtcgagtcgggcgtttatttcgcgttttggttcgggtaaatttggaagaattgcgatcgtagtttgtttagcgttatagtttgagtggcgttttttttattttcgtttttgcgtcggtaggggcggtggagagacgcggagggtttttttagttttttttttttttattcgtttttcgggcgatagagcgttcggcgttcgggtcgggggcgggtaaggttgggagggattttcgtcggggatttggtttttggacgtcggcgttttaaggttggtttggggattttacgggttgtttgttttagatgtggggcgggttttttcgttagggttttttagtgtttttttagttgttgttggttatttagggttcggggatattttgttattcggtttggagtcggtttcgtttgttagcgaatagttaattttagcgggtggtttagttggggattcgggttcgggttcgggggtttcgtgtttttcgtatgttcggttattggtattgttttattaagagtttgagagcgtttattttttttttcggcgttagtgtgtgtagtatttggttttcgataatttgcgcggtagtttgggtgtttgtttttcggtttttagttttaatcgaattcgagtttttttggggttttgtgaatgaaacgtgtcg

SEQ ID NO: 6655 - DNA, 1143 bp, Artificial Sequence
  Description of Artificial Sequence: Synthetic polynucleotide
tcgcggagttttcgcggagatttgttggagttaggttgtttatttttatttttttattcgcgcgttggtttagaggtttatttaggtagcggttttggtgtcgagggggtaggtgtagcgttgtagtgatgtttagtggtttcgtttttagttatttgttttttaatatttgttagatgtttaggcggggtaggttcgaggtgtcgtcggttttgggttttttaagttagtttaggggtatttcgcggtaggcgttttcgatatttacgcgtaggaatagggagggcgtatcgcggttttcgcgtttcggttaggtcggtaaggattttatcgtttcgttttcgggtggaggcgtttttttttatttttttttcgcgcggggttttcgttcgtagtttttttagtagtttttttcgtagttttagcgtttttgagtcgttttggttcggatcggttaaggaattaacgagcgcgtatcgcgggtttcgggcgtagggtacggagtcggtcgcgtcgtagtttttcgggtatcggcggcggtgattaatttgtaattttagcgtttagagttgttatggtgttcgcgggcggcggcggcggcgatagtgggcgatcggtaggattagtgttaggcgcggcgtttagggcgggcggggacgcgggttttttatttacggcggtttagtttaggtagcgcgttcggttcggttggggtcgcggtttacgttcgtcgtgttatttattgagcgtcgtcgtcgtcgggtaggttgggggaggggtgggagtcggagttttcgggtttttaaaaaattattattttatttaaatttttaaagttagttttgttatagggattgtagtgatgtcgaagggcgggtatcgtagaggaggttgcgtcgtagttggtggggagcgttagggtcggtattggtagtttttttttgtcggttgttattcgtagttagttttatagtaatagttaggtttttatttgcgagtttttttcgggggtttttcgtatttaatagtacggcggcggtgtgtacgggagttcgtcgggtatacgcggggtatatttaagtgtattgttaggaggtcgggagtttagcgtgcgagcgtgaggttagattgtgtacggtatcg

SEQ ID NO: 6656 - DNA, 1143 bp, Artificial Sequence; identical to SEQ ID NO: 6655
  Description of Artificial Sequence: Synthetic polynucleotide

SEQ ID NO: 6657 - DNA, 1371 bp, Artificial Sequence
  Description of Artificial Sequence: Synthetic polynucleotide
tcggttgagagcgtatggcgttttgagtagtgtaggtttcggtatcgagggcggaaagcgttttgagtttatagtcgtacgatagatcgtcggtttgggttttttaggaattttttgtagttttgttcggttttcgattttcgttatttattagtttttttaggtatttaagagttttttagcggcgggttagggtcggttttttttagtaggtttttttggagagcgggaggaagataggaggcgttttttcggtggagggttttttagcgacgtagttaggagcgttaggaggttataatcggaggagaggttggcgttttagttttagttttagtttcgaagcgattttttttttttcgaggtggttttggttaagtttttagttattttcgttaaatgaggaggtgggcgggatgtagacggtggagcgggaggtttgggcgcgttagtttgggagttagtgcgcggggtagggcgacgggtagcgcggggacgcgaatttttaatttttgcgtttaagacgaaggattcggtttcgatttttttattattcggcgcgtattagcgttcgtttagtgatttttaggtttggtggtggttaggggtgggaggtgagtcgaaagggaaaaagttattttatttaagtcgtcgtcgggttggagttagtttgcgcgggtttcgagttttcggcgacggcgttagtttttttcgttcgttcgcgcggtgttttcgtcggtagttttttcggatttcgcgttttttttcgggcgttcgttttttcggagttttaacgtttgtgcgcgtatttggtagtagagatagtagtagtagtagtagtagtcgcggcggcgatagtgttaggggtagcgagagcgggttagagtttatggttggtggtcgggttggtcgcggattcggacggtcgggagcgggcgcggcggtcgtagagacggttttttttcgcgcggttttagcgtagattttagatttggagtcgtgcgggcggagacgcgcggggttttttttcgtttcgtcgtcgttgggtttttagcgttttcggattcgcgggaggataggaattattcggagtgaagttgcgttaggtgcgggcgggcgggcgggcgtgcgcggggcggggcgtacgtgcggtaggggaaggggttttaggttttagtttttagcgtcgggcgagtttttttttcgtcgggttgggtgtttcggtcggcggcgttcgattagatttgagtaggtgttgttattattattaggaaggagagggatttagtttttgttttaggttttcggggcgtgtgtagttttcgtagggggttgggattatcgggttaggcgggcgtcgtaggagagacg

SEQ ID NO: 6658 - DNA, 1545 bp, Artificial Sequence
  Description of Artificial Sequence: Synthetic polynucleotide
acgcgaatttcgcgggtggtttcgggtggtgggttttttttagcgcgtagttttcgttcgtttttttttcggcgttgtagtcgcgatttgggatcgaacggatatcgttttttcggggtttcggcggcgttttgatttttattttttttcgtcgtagtttttggtagggtatttttttggcgcgacgtcgcgttttttttcgggatcgttttttcggttttttagggtgcgtttagttgttgttcgtgcgtttcgttagtttgagcgtttcgggcgggcggcggtggagaagtttagtttagttttttttagtcgcgttttcggttcgcgttgtttttagtttgtaagtttatgacgtggcgacgtcgatcgagatataaagatcgaggttgagatcgttaggggttgagggtgaggtcgcgtttcggggtcgttggagcgcgggcgttatgcgagattgtttcggttgcgcgtcgttttagaggagttcgagcgttttttttagtcgcggcgcgttggttttggtcgggattgtagttaggtgggcgtcgcgcgtgtgagcgtcgcgcgtgtgagcgtagatttggattcgggcggcggaggcgaaagtcgttttattcgcggggtgtaattttgggcgcggaattcgggttgtcgggtgatagtgattagttgattttggagtttatcggaggcgcggtatcggaggtcgtgcggattattgtcgaatagtcgttggagattcgtagagaagggcgggttttgcgttcggggcgtttcggaggtaagttcggagagttcgggtcgggcggagggcgggagcgtacgagtgtgtgtgtgtgtgtgtgtgttcgcggtgtgttcgcggttcggtgtatacgcgcgcgggttgtaaagttaggagttgcgggagcgtttttttgtttcggtttggtttcggagtattgcgggtcgcggaggtgtgggggtttttgtcgttgcgtttagggtagcggcggaaaaggtgtgtgcggatgcggggcggggtcgtatttggtggatagagtagggattcgggaagagaagttacggaagatgattatgtagtttggggtaagtttttttggttgagtatcgttttaggaaacggtgttttgagggttaaatatgtgagttatttgtgtaaaaagtttgatatattagaggcgcgaagtaagatggaaagttggataagttttaggtggatcgatcggtgtatttaatttttaaattgagatttttagttacgttgatgtggaatgggatcgttgtttttttcgagggtttgataaggatgtttaattttatttgttagaaagtacgggagttgggtttggttcgcggggagcgtaagttcgtttatacgcggtttaatttaggtaaatgtagtatgttcgatttgttttgtcgttattttttcgaaagcgataatttttttgggttatcgaatttattagagtagttatttgttttttcgtcggcggtgcggggagcgtaatatttgagtagtttaatttttatagcgcg

SEQ ID NO: 6659 - DNA, 1545 bp, Artificial Sequence; identical to SEQ ID NO: 6658
  Description of Artificial Sequence: Synthetic polynucleotide

SEQ ID NO: 6660 - DNA, 1027 bp, Artificial Sequence
  Description of Artificial Sequence: Synthetic polynucleotide
tcggtttcggttttagtttcgataacgtttttagtgttcgtagaagcggttttcggatagcgaggatagttcgtcgtcgtaggtttattcggcgtttgatggatatggtggttacgttttggagtataacgtattgtattttattgcggagaggacgggttagagtatttcgggtttttcggttggggtaagggttagcggatgaggggaaaaggtggggtaagtcgttgcggggagaggattagtgcggagggtaggattacggttagtgtggagcgggtgggtagaggtggaagcggttggtgggcgtgagggggcggagtcgggtagttcgtggggcggggtaggaggcgagggagggggcggggttgggggcggagcgtatttgtggttgcgtagtaggcgtattagcgttttggcgatgacgtttattttcgttttgggcgttaggtggaagtagagttgcgttatcgttattattatcgcggcgttgcggttttgtagtaggggtttggtgttgcgtagtagtagtcggtggtcggggtttatgatatagggttttcgggagggggcggtcgcggcggtcgtttttttagatttcgcgtttttggtttcgtttttttttgagtcgtagaaggtttttttcgcgtttttttttagtagggatttttggacggggagatcgacgggtttgtgggcgttttttcgggatatatttcggttcgttttgtttgggttgggtttatttacgttttgggtggggtttaggaattgcgtgcgggcgtagcgggtgagtatgttgatgatgattatttggttttatttttttacgtcgattagtaggttatagagttttcggtagtttttgtgaattaggtcgatgcgtttcgggtagatttttttaaaggttattattatattgttcgttattagttggggaaagaataaagacgagagggtgaacgcgaagggtggaaggtcggttgtcggttattatttttttcggagcgtttttatatacgtatcg

SEQ ID NO: 6661 - DNA, 693 bp, Artificial Sequence
  Description of Artificial Sequence: Synthetic polynucleotide
acgaataaacgttttattttcgggtagtcggcgggtgcggagcgagtattcgtggggcgggataagtgcggaagtcgttgcgttttcgtttttttattttcgggggacggttatttttagggttttcgaggagttcgtttcgtgtatttaggttttaggtcggtttttaagttttggttcgtcgttatattagcggttttttattcgtaagtataaatgtgatatagatattagtttttcgtgtttttggtttttagggttttttttatcgcgttttagtatttgtagtttttttatttttatagcgttcgtcgtcgttaaggtaatagagggatgttcggtgatagattcggcgtcggttttcggcgtcgtaagagaagcgttcgcgcgggcgttttggattcgtagagttttcggcgttttcgaagtttttggtgtggtcgggattcgggagaaggagtagggttggtggggttgttgtagtcggtgagtgtgtgttggcgttgggggttggaattttttaggttagtttttgggcggtgtcgtaggattttgttcgttgcggttttgaggcggaaataggggttggggtcgagcgcgggttggaagttttggtttttggagtgtcgtttttagtttggggtcgaggcggtcgtttgtgtagattcgggatttttaaatagaacgaattcg

SEQ ID NO: 6662 - DNA, 1496 bp, Artificial Sequence
  Description of Artificial Sequence: Synthetic polynucleotide
acgtcgagcgattagatgtaaaattttttagcgtttgaaattatcgcggacgtcgtcgtcgtcgtcgtcgtcgtcgggtgggagtcgcgaggagcgtttagtggcgcggtttgtcgggtatggtggtcggttcggcgatcgttgattcgtcgggttcgggggttttggaagcgaggcgcgtttttcgatttcgagattttgtagggttgtaatagacggtggggaggtaaaaaaaaaaaaggaaaaggaaaaaatggtgttaaagttattaagttttatttattgggtagaattaaaacggatatattacgtatttgtaaaatatatatatttatttttatatatatatatattcggagttcgaggaaaggaagagaaggaagatgtagtaggagttgtagtagtcgtcgcgaatggttcgtcgcgcggttgtagaaatgtataagtgtttcgagttttacgaaacgtacgggttatcggagcgtttttttcggtttttttttttttttttttttttttttttttttttttttgtcgcggtttttttttttcgtttttcgttcgggttgggagcggtaggagagcggaattttttttttttttttttttttatattcgttttttttttcgtttgtttttttttttttttttatttatttatttatttattcgttggttcgcggttgtagtcggtatcgttattcgtagtttcgcggtagttcgttcgttttacgtttcgtagcgcggcgttcgttagtcgtagttcgggggaaatcgagatcgaagggaaaaagttgtatttgagattgcgagggtcggggttggggagggagagttggcgagttggttgtacgatacggaaaggcgtttttttttttattttttggttttcgcgttattcggttttgttgtaattcggatcgcggtaggaagtgaaatgaacgtggcggaggtgattggggagtgtttttaagttttgggtggggggcgtttttaagtttgggtgggtggggggcgtaggtttacggacggcgacggggggtgtcggagcgtatagatattttagagaagtatttagagtcggggatcgggatcgtagacgcgtagtttttggtttgaatgatatttattttcgtaatttagagtttggggttttggttttggttgggaggggattgcgggatatggtacgttaggtgtttttcgtgttcgttgcgtttttttggaggtgggttttgtattcggttttgagtaggtatggatcggggaaggaagaaataggggtcgaaagggttgcgttggagagtcgaggtggtttcgggcgagttgtgcgtgtaagagaaatggtcgggggaaattgagatgtaaggggtatattttggtaagcgttacgttagtatcgttagaggtcggtttttcgggtttagttttcgggtgagttgagttggttgtcgggtgagggggcgggcgggttgtttttttcggattcgggggcg

SEQ ID NO: 6663 - DNA, 5820 bp, Artificial Sequence; identical to SEQ ID NO: 6416
  Description of Artificial Sequence: Synthetic polynucleotide

SEQ ID NO: 6664 - DNA, 699 bp, Artificial Sequence
  Description of Artificial Sequence: Synthetic polynucleotide
tcgtggtgggcgaggtattcggggtttttttttttttggtttacgaatttttaatttcgaacgttgtgggattgtatgggtttttgttcgggttaatgaaatgcgttgtcgagaggaggttgcggcgcggtttgaggtcggatttttataggtcggagagttttttgtcggtcgcggtcggatttttcgggaaatgggattagagcgcggagggagtttggttaggaggttttttaggatttagtcgcgacgttgaaaagtatgaagggtcggaattaggtatttatttagcgagcgttattaattcgaagttatagcgttaattttttgattcggtcgtttttatacgtagcgtcgggattagaggcgcggtcgtcgttcgtttcgtttttatattttaaacgcgttcgtttcgcgttttcgaggttgcgggtttagggttaattcgtcgcgtcgcgttcgtttggttcgagcgcgcggcgggtcgggttcggttagttggggcgagtcggtttgttcgttggttcgggcgttcggtttcgggttgggtaaggagcgtttggttatgagtcgcgggatagtttaggcgggacggatgcgttttttagggtttaggcgaggtcgcgcggtgtagaatcgtcgggatttttttaattcgggtatgcgtatttatagtagcggtttttggaggtcgcggcg

SEQ ID NO: 6665 - DNA, 1845 bp, Artificial Sequence
  Description of Artificial Sequence: Synthetic polynucleotide
tcgttttttcgtcgcgcgttgggggttgtttttaggtgttggtttttgtgtcgagaaaattttgcgaggaggcgagggagttggataaagagcgggcgagggagggcgtttgttagtttgaggggtgcgtcgggcggtgcgcgtatttttttgggtttagtttcgtattcggtcgttcgcggtggttagagtttagtttttttaggttaggagtggcgttcggttgtattttcgcgttttcgggagttgaataaagttaggcgggagaagtaaaggttagcgtttggacgttggagttggtgggaggaggcgagtagaggcgcggagtaaagttgttaaattgcgcgcggagtcgggcgtggggcgggggaagggagaggagggagggaggggtaggcgggagtcgggagggagcgagcgggttcgtcgcgtttgagtaatttttgtttgtcgttgtcgttgtcgttgtcgttgtcgtcgtcggttcggattcgttcggagcgtagggtgtttgtttagttgcgcgcggcgcgcggaggtttcggcgttcgtcgttgcgtttttcggtttttgtttttcgcgtcggttcgcgtgggtttcggcgggcgcgaatttattatgtagttgtagtttcggagttggatgttggtcgcgtttacgttgttcgtggttttttttattttcgtagatattttagagatcgaagaagaaatcgggtaaatagttgtttttaggttcgtgttacgagttttggcgggatttttttttttttttgtattttttatttttcgattttttttgtgtgcgtcgcgtttcgttgtagtttcgttggagagatggggacggtttggtagaaggtggcggcgataggggttcgggacggtttggggagaggagggtgggggcgcggttgttgtggggtgttttcgggcggggtttacgggaagtttttagttggttcgcgtcgggaagcggattcgtttattttgtttttttgtttggcgtgtttaagcgtagtgtcgtcggggtcgagggagggcgtcggggagtgtttcgggcgggcggaggggtcgagagtggagggaggtaggagtttttttgtttttagtacggtcgttttttcgttttggtaaagtgggtagggggcgcgtagggatttttgagttgggggaggggtttttggggtcggagcggagggcggggttttgtatgggttattgggaagcggaatgttttttgtatatatagataggtatacgcgtttttcgtcggttcgggagttcggcgtaggagttggtattattagagaagggttcgtatagttggattgagatttttcgttttcgtttggttttggacgtttagttaagttacggtaatttcggcgattttgggtttttgtgcgttcgtagcgcggagacggagatatttcgggaaagtttgtatcgtcgttcggtgggtttttgggtttttaggcgggcgatttggcgttttttttttttcgatttcgttagaggtagggtgggatcgcgagttcggattttttcggtttcggattttttggagtgcgtatttgaggcgcgggacgtatcggttgtgtgttttaggggttgagattcgcgtttcgtttcgtagttttcggttcgtcgggtcgggttttttttcggaatttttaaagggcggtagacgataggtggggaggtagtcggggttttgaggaggttcgaggagagttttttggttttgggtaaggggaaggtgaggttttaaagagggtagaaggtttttttttttgtgggatttgtgttttgttaggcgtttttttcgagtttcgcgtcgcgtgcg

SEQ ID NO: 6666 - DNA, 1844 bp, Artificial Sequence
  Description of Artificial Sequence: Synthetic polynucleotide
tcggcgattttttggtattttggatagtttttcggggagtagtttatcgttaggcggcggttgttaagagaggaatttttttgacgcggagtttgtcgtttcggggttcgtttttcggtaggttcggggagaggtggggtgataatgggttggggtgcgcgcgtgttttataggtgcgagatagagcgagtcgtcggggtgtgagttagcgcgttgggggttaagaagttgggtgaatagttacggaattttatttacgttcggtttttttatttatttcgtttatagcgcgtgttttagtttagggcgtgcgtgcgttcggtgttcgatttcgggttgtgtgtgtttatttggcgagatgtcgagagcggggggagtgtttttgtcggtgtatttgggtttaggttaggggattttttttttttattttcgcgtgggtgtgggggtgtgttcgggttagggcgcgtgtgtttttgtgtttgtgcgtgcgtgtgcgggttagggtggtgggatcgcgtattagggtagggtgtttgcgtttgcgtttgggtttgtttggtttgtatgtcggcgcgatttcgatttggattcgtgtttttggatgtcgagaggttagcgtggtgggggtgtttagtttttcggaggagtattatgttttgatattttcgttttatcgttttaaagttggtttggggtttcgtagggagtggtttgtatggggagggttcgcgtgttgtgtttttgggaggggtaagagagtgggggcgtagggggcgggttaggtttttgggcgcggcgcgggttcgggggattcgcgcggttgacgttaggttattttttaaatagagtcggtagcgcgtttcgttcggtatttttcgaagagttagatcgcggtcggcgttagcgttatcgttcggtttattcgttagttcgtatagtcgcgtcgtcgtcgagcgtttcgtgagcggcgtttcgaggattaggaatggggtttcgggcgttgggcgcgtttcgaattcggcgtacgtaagagtttgggagcgttcgagtcgttcggttgttcggagttttatcgtttaggatcgggagatgttggaaatgtaatcgtttgtttttcgaggagtcgttgttttcgggattttttggtattgtgcgtattttggttagtagttttcggagaagacggcgtttttaacgttcgattcgcgtggtcgtggtagcgttacgcgagttttttaggcgatcgtagggttatagtagtttagtcgtcggtgttttttcggaaattatgattttcggcgcgggtttatggagttatggtttatagggttttgggtcgcgcggggttattttagtcgcggagggcgcgtaggttgtttttcgtttttacgttttcgtttttttgtatttatttgtgttatagttttttgtgttgttgcgacgatttgggtcggagtcgttttttcggcgcgtttcgttgttttcgcggttttagcgcgggcggttagaaatttttttagaagtttcgtttttgtgattttttcgggtcgacgtttagcgagtttagcgtttttagcgcgttcgtcgtcgtcgtgttcgtttttcgttttttcggttttaattatttcggtttatttaagttgggtattaagcggttgttttaagtttttattgtgggcgtgaagaaggggggtattcgggtcgtgttggagtttattcgagtatattcggacgtgcgggttttgggtacggaattttatttttttgataggaattacggtcgcgggttggattggtataggtaaggattaggagtttcgtttcgtgcgtcgggtttttgatcg

SEQ ID NO: 6667 - DNA, 1480 bp, Artificial Sequence
  Description of Artificial Sequence: Synthetic polynucleotide
gcgggtgcggtttttcgggagttcgcgggatttttttattttttattttcgtttgggaggttcggcgtgggttggcgatgggggtggaaggttttcgggtttgtggatttgcggtaggaggggcggttggtagtaggagtttttgtattatttttatttttaggggcgtttcggggtgggtgggggtatttagtgtttcgcgaaaggaagaggaggagggggcgagcgtggagatgagtttaggagcggaaagtagcgcgcgttttttcgatcggtagcgggggtgggcgttttttcggggcgcgggagcgtttttaaagtcgcggggcgttcgtagcgggtaggagttttgttttgtatttttttacggcggggcgtttcgtacgtttttttatgttggttttcggtttcggaacggcgcgcgttttttgtttcggaacgtcgtttttagttaggcggagcgttgggagttgggtttaggcggcgggaggagggcgaacgggttcggggttcgggtttcgatggtcgcgtcgtttcgggggagtcggagtcgagttggtcgtcgttcgcgcgtatttattaagttcgttgagttttttttcgtacgagtattagatgtcggtgtggaaatttttgaagaggaagcggtcgtcgtcggttttttagttgtagagcgcgtcgttaggggggtcgtttttcgaggcggtggcggcggcggcggcggcggcgggggcggcggtgtcgttggtcgtggcgttggcgttcgagttggggtagttggcgcgttcgttttggtcgtagttcggtttggggattcgttgcgtgttttggtattagtgcgtggtgaggaaagcggtggtggcgaatagtagcgttagtaggtttagggttacggttaggagcgttcggtcgcggcggttagtttttatgtcgttcgcgtcgtcgggacgggattgtatcgtcggggagtttcgcgcgcgaagttggtagttggcgtttcgcgttagcggtcgttgttcgtcgcgtttcggggttcgggtgtttgagatcggcggcggcggacgcggcgcgggtttatgttttttttaatttcggggtgggggcgcggcgcggggggcgtgcggggcgggttggcggggcgggcggcggtggaggagcggttacggcgcgttcggagttcggagcgcgagtgtatttcggttaggagtcgttggcgtttggtagcggttacggcgtagggacgcgcgttttttcgtggggagatatttgtaggcggtcggcgatattgtttcggagttcgttcgtacggggagagggggtcgttacgtcgggcgcgggcgggggtttgggagtggagggacgttttcgaaagaaattcgagttagggtgagggtttgagacgtaaggagaattttaggtaaggcgtttttgagaaaagatttttacggcggacgtggggtaataaaattcgtcgggagcg

SEQ ID NO: 6668 - DNA, 5065 bp, Artificial Sequence
  Description of Artificial Sequence: Synthetic polynucleotide
acgagtcggggatttgggggttcgggcggtcgtagtttagtgggttgaggtgtcgattagggttacgtttcggagttttgtcggggtttagtttttttttttatattttaaaatgtcgtttagggcgtgggtatttcgagtggtattcggagtcgttgagatttcgtcgagattgttttttgtgcgtttttttatagtcgagaggttagtatcgtgtcgggacgattcggggattcgagttcgggcgtcgttatatcgtttcgggcgttaggtttgggagttttgaggtcggtatcgtgaaatatttttaggagtaaggagggattttaggtgttttttttttgtattttaattttttgttcggattttttttattttttgttatagtttttatatataaattttgttttggatttgtttagttttttcgggatttatagttgtcgtttttatcggagaaaataagtgtttttgttttaggggggattttattttggttggttattcgtaaatttggaaaattattttatgattttttttttgatttttttggaagtagggagtattacgattcgtagagggcgtatatcgattagaaagattttggggggtagagggtgtaagtgttgtgggaagagatgcggagataaattttgcgagttagatttcgatatttttttcgttcgtttgtatcgttttcggaataattggcggttagtagtattttttatttcggtcgtaattttagcgggttaggcgttggcgtttcgatattagtttttatttttttgtagttttgaatttttaaagatattcggttttgtttcgtaggtcgagggggagtgtgcgtgggggtaggggggcgtagcgaatttttttacgttcggagtttagtttagcgttcgaagtaaatttttttatcgttggtagtaaggtcgggcggcggaggtcgggtcgggtgttttggggtcggcgtcgggagcgttaggggtttcgtgcggttaggtcggggcgatttttattcgtatttacgttttatggggttttcgggttttggtcgcggttgggattttcggaaaagtagggacggagaagttaggtcggtatgttcgttttttttttttcgggaggatttaataatttcggaaagattttgtcgggagatgtgttcgtttttttcggggtagcgggggaaagtttagtaaaggtatattgaaaattaaaaagaaaaaaaaaattacgtcgagtggaagaagtaatcggggtcgcggcggcggtgaggtagggggcgcgggggttagtcgcgtgtgagtgggttcgagtgtgcgtgagtgtgagtgcgtgtgtgtgtgtttacggcgcgggtcggagtatttattatttcgtcgggggagcgaggttatttcggggtcggattggaaatgttgaggtttcgtttgtttttttcgcgatatgttggtttaaatattagttggggtagaataaaaaattattaaaaaaaaatttttttaaaattacggaaatcgagcggcggcggcggcggcggtttttttcgttcgtcggttcgttcgtttttttttcggtttttcggtttcgggcgtagcgcgtatgtgttttgttataattatgattattaataatgtattgcgattaattatagaggggttttttgaaaggcgattggtatcgggttagcgttatttaaattcgttcgttttaattaattagttcgtgatttgttgtagatttttgttttttcgcgcgttggtttaataagtcggtcgcggggttggttttgcgcgtcgcgtcgttcgatattgggttaattttttttgcgatcgttcgggatttcgcggttcggtcgtcgggggtcggttttttttttattgcgggttcggcgtttcggtaggcgtttttcgttttttttttttttttttttttttttttttttttttcgtttttttttataatttcgggttgggtcgatttaaattagtatgtttttttcggaattgagtcgtttcgggtggggggtggggtcgggcggcgagggttggggattcgggttgtcggcgcgttgcgaattttttaattcgggggcgaggcgcgtcggttcgcggggggagggagtttcgcggcgggattaggggggagggcgtttcgtttcgtgagtgttttttcgtttttttaagagttattagaaagtagtttatttttatttttattaaaaaaaaaaataagcgagtggggaagagttagttttacgtcggttcgtttttcgtttacggttcggtttttttttcgtttggttcggcgttttttcgtttcgagttttttattttttggatttcgggttcgcgggggcgcggagaagaggatttaggaaaggtttgggaatttgatgggtttgtggttggggggaggggtagttttttcgttattttatttttttttcgttaggggtattgattttttagttttttgtttgttttttcgttttttttttttatttcggatatttttaggataattagggttgaagttttcgggagaagtagtttcgagttcgtgggataagggggcggttcggtttcgtttaggatttttttcggatttttttttcggttgtttcggttggttgtagggcgcgttatttcgcggggaggcggcggtagcggtggcgtcgtagagtttcgggcgggcggagagcggggatcggtttgggtttcgagtttagtttcggtcggggggaggggaggggttgcggtttatattgagcgtagtagcgagtatcggtttagggagatatagttcgggcggattcggtattggattgggttagtttttgggatttttgggtatttcgttttggggagggggtcgcgttttagtttttcgggacgaggtggcggcgtagagtcggaaagcggggtggggggagggcggtggggaggtgttttgttcgaggttgtttggcggcgtcgaagttcgtttttattttttgggtatttgtcgagcgcggcgttcgaatttttcgttttattattattttttttaagttgagatgtaatttttttattttcgttttagagtttagagttaggagttcgatttttttgtcgggtttaggcgttcgcgaatttgagattcggtacgcggtttagtttagtttttttttttcgcgtttcggggttttttcgttttaaggttttcgaagttttgcgttcgaaggattaaattaaattaaatttcggttgagtaatgggggaggaggggggtgtagatatataatttttgttttattttacgattaggaaaggagagggtttataaggacgttttaattcgcgagcgtttttgagtttggtcggtgttacggtcggttcgcgcgaagtgggtatcggtttttcgagtcgatttcgtgtatttcggatttgtattgcgtttcggtagaggattttttttttttttttagttttttaaatttttttttttaaggtgtaaatgtgtgtgtgtgtcgatgaatgtttttgttttttatttgttgattttatttttttttattggtataattttttttttttttttttttgttcgttcgttttttatttttttttttatttattttttgttttcgtttattttttaatatatatatttatatttttttcgtttcgttttttcgttttcgttaggttttgatgggtatagtagattttgataaaaagataaacgaagttattagtggggttgatgttgaagaatgaagataataatgtttttataggtggtgttttaaatgttattattttttattgaatatttaaagagatttttcggtaaagatggatttgcgtatttttggggtgtgagcggttcgtattttttagatttcggggaacgtgtacgggagtacgtgtaaatttcgtattcgtttttattttataaataggggttttcgtatatttattaatttatattgttttaggtatacgaacgcgtttgtgtgtatttgtatatttttttttcggaatgtgttcgtgtttggagtcgttcgtatttttttttaataattttggttttttgaaagttcgggtttttcgggtatcgtatgtagttaggaatttagcggagttggcggtttcgtaaagttttttttttggtgcgcgtcgcgtgcgtagtaggaagttttcgggaataattttatacgtgtttgttatttggtttacgtgtgatttaagattaagtgtaggaaaaaaaaaaattttttttttttaaaaaaatattataataaataattaaacgaaatgaatatgcgaaaagtagttacgcgatgtttaattaaaaatgggcgagtagagacgaataaattgggggatttaaattttaataatttttttcgtttttttgcgttttcgacggcgtagaggcgggcgtttcgatttgcgtttggcgtttttcgttaattttttgtttgttttttttttttcggtggtttcgggaaaggagatgggaggtggaggagggggggatgggaggagggggatggtcggaatggcggggagaggagaattggtttttattgttgatggtaatatattaattacgggttattgtttcggttttaagtttcgtggttcgttggtgcgggcgttgtagtgttagggcgttggcgaggtttcgcgtgtcgcgatgtaaagaaatatattaataaaaatagaagtagagtgggggttattttttatttttgtgcgggtcgaaagtaggcggcgagcgggagtgaggtgttatttttggagtttttttacgcgttttgtttattttagagatttgcgcgttttacgtgcggtagtatttttttaattttgggtggaggtggggtgggggggggattattggggaattcgggtagcgaagtttggatttgtaggtttcgttagagggtttggtatttaggggttgattcgtaatagcgaatggggatagttcgaagtgaggcggtagttgcgtcggggtcgcgattttattggcggagaggaatcgtattcgggggaggcgtttggcg

SEQ ID NO: 6669 - DNA, 2372 bp, Artificial Sequence
  Description of Artificial Sequence: Synthetic polynucleotide
tcgcgattgcgtaaatttcggttttgatattttagttttaggttttaatttcggaagggtttaggtttaagtttgtacgtcgcgttgttatggcgatcgttggttgtttttttcgttttgttttttgagtacgtggtattaggatttcgcgttttttttagttcgagagttaggtttggtttagagtcgggtttattagtatttcgtttgcggcgttttttcgatttttcgtcgtgttttattaggttcgtttatttagtagcgatagattttcgtcgttcgcgcgattttatcgtttttattttagttttttttcgagggttcgtagttcgttttgttttcgagcgtgtttagcggttttgggtattggcgcggttttatttagttatgtagtgtttttttatatattggtcgcggttattggttgtagattcgtcgcggaaagggggcgttttgagtttcgttcgtaggtagcgcgtttcgagagattcgttttaaggtattttcgtaataattttgtgggggtatttaattttttcgtgcgtcggttaagatttttttatgttttttgtaatgtattagattagggaggtaaatatcgaaggtatttgtattgcgtttttattgggatgcgttgtgcgtaagagacggggatcgtttgttgtaaaatcggatgatcggagacgtagggagttaggagtgggtttttttaggatttattttatgtagtttttatatggtttttagagttttgatttcgtggttggagtgtttgtttttttttaagtattggtagtatacgggtattttgtattgtacgtagtatatgttgtggttttttagttcgtggtttgtgtaggtggagattttgcgtgggtttagttttcggtttatacgattttgggtcgggggtattaggcggtgtttggttaggggttttcggggcgggtggtagcgtaggcggtacggatcgtagtagaagatatcgtattgttcgtatatgacggtggtttttttgggcgttttttcgtagagttggtatttgagggtcgcggttttgttttgttggtagcggttaattattttttttagtacgcgatttttggggaagtcgcggagttttcggttatttaggatgaggttgcggtgatattgggggtaggtgatataggagttgcggggtatcggggttagggtcggtgataagtgggtggtcggtggcggtatagtcgggggaaatacgcggacgtcgttgggggatttttggtacggggtagtgggggcgttggcgaatttttcgtaggagttatagtcgttgttcgtttcgttgtataggtttattttgtttaggtttagatagttatagtcggagatttcggagttcgcggttcgatggttttggggggatttagattttggggtttgtattaggatgttgcgggcgtacgtttgatataaattgtgagagtagggtaggatgatgggttttcgatagaaggagtcgtatacggggtattttaattttttttttattttttttatggggatcggtttgggaggagatagcgacggttgtagcgggtgtttgagttggcgaggtggtcgacgggttcgttttgtttagtattttggttagcggcggcggttgtggtggtggtgttttttcgcgtagtattggtacggatatttagagaggcgttagttttgtgagtcgtagtcgcgtagtcgtcgcgtcgcgcgttagttcggatcgtttttatttgtttttttagtttcgtttcggtttatgagtagcggtttattgggcggggggtaagagatcgaagtttttattggttattagattcgttcgttttttcgttttcgtaggttatagggggttcggtagagtttgaggatagggtagttttcgttcgcggttgtaagatttttgaagggggtcggcgtgcggaggttaggggatcgggaaggaggagttaggcgggatgatttattttcgttcggtttattttcgattttcggtgtagttttttaggagttgggggcgtgagaaattttttttcgtagcgagtgggttgtcggagggggttggggtttttcgttagcgtttgcgtttggtttttagttttgagtttcgcgtttatttatcgcgggcgagtgttgcgtagtacggaggacgttttttttttttcgttgttggtagttttcgtaggcgttttattcgggtttaggtttttgtacggtagtggggttttttttttttttcgtgaattcgttgacgtcgtgttttggagtttttttatttcgggagtttgacggcgttggcgtaagttttggcgatatttttggttttttttattttgcgtttttcg

SEQ ID NO: 6670 - DNA, 2372 bp, Artificial Sequence; identical to SEQ ID NO: 6669
  Description of Artificial Sequence: Synthetic polynucleotide

SEQ ID NO: 6671 - DNA, 2372 bp, Artificial Sequence; identical to SEQ ID NO: 6669
  Description of Artificial Sequence: Synthetic polynucleotide

SEQ ID NO: 6672 - DNA, 2142 bp, Artificial Sequence
  Description of Artificial Sequence: Synthetic polynucleotide
tcgagggtagcgtttcgcgtttgattttttcgtaagcgtttatttgtttttaggtggttaggaaggcgtgggtgggggtaaagcgcgtagagcgcgggaagttagcgcgtatatagcgggcggttaggtttagtattgcgggggaggtgttttttcggtataggattcggtttttgtcgtggttcgtgtcgatgttcgttagaaaaggggcgatggtcgggaagtcggtggggaaattatagtttatatattgcgtttttttggggaagttttgagtggagatgatgtcgttggtgtttatttgggagaggagagggataaaaaggtgatagtcgtttaagtttaaggacgttattttttcgcgtagggagggaagggaattgatttaggtaaaaagtttttttttttttttttattggttagggagtttggatttagggaaataagcgtaatttttgcgattgttttagtttcgcgttgtagtaggtttaggggttttaaaattcgtttatttatttttttattttttttataatttcggagttttatgttttcggagaggaagtttttaggtttgaagagggaatattttagtttcgtagacgggtatagttttttcgcggttttaattgtaaagttcgttggtcgttttagtaacgttattttttttgtttgggacgcgtacgtggttgcgaataatttttgtttttttttttaggttatttttgtttttttatagtagcggggtaggtagcggtatcgttttttggtcgggtattatcgtaagggtgttggggggttttaggagtggggtttgtttttttttttttggaggtagggttttcgtgagatcgattttagggaagaagttgcgggaaaagtgttaggagggggttgaatttacgtagaggttgttgaatcgggtttcgtagaagtgtaggggattcgttagttttattacggttgagttttcgtcgtcgtttttttgtaggagttggtttttttacgatttttcgtgtgggaagagttcgtttgggtgtagcgtcgcggttcgtaatattagtaacggtagtagtagtagtattggtaacgacgatagtatcggtcgttcggttattcggtttttttttatgttcgttcggtcgtgcgtttattcgttgtataacgcgtttcgtttcggtttttagtttatttttcgcgtcgcgttagtttcgaatttggattttcgcgggcgtttgggcggggcgggattttaggtttatttagtaagttaattggttgaggttttcggttggggattaattatcggttttgagaaagttcggtagtggttattatatttggttttcgttaatttttttaaggtagcggtcgttggagtagcggggttggcggggtaaaagtttttggttagggttgtttggagttgttttttttatttcgtttttagggagttttcgggttatttttttattcgggttgtttcgcggtttttaaggagttttattttcgggattaaatggttcgtaaggtttggggtagcggcgttgtaggagatgagtttagcgtaaagggaatttcgtagcggcgagtgcggttgttggtttgcgcgttgtggttttaataggttggtagggcgcgggcgggtggcggggttgcggtatgagttttgttttttgttttggggtttcgggcgtttttggttttggaggtttggttatcggttcgaaaagtaaagggatattgtcgtggttttttcggtcgtttcgttttatttagagacgttttgaggagaagcgagtttttgtacgaaggtagagggttgatttttaagttttgtttttttttcgaaggtcggtcgttagggaagatttggttattttttggaagtattttttttcgggaaaatcgtagtaggaaagattatgaaatattattgtgtgtgattcgtttcgtttggggagtaggatgaggtatttcgtttggttattaggtagaaaggggcgagtcgcggggatgggaagattttgattttttgtttattgttgcggtcgtcggagatgttttttttcgcggttacggaggcggtaatttgagttgtttcgtaggattggaaatcgtataatttcgaaattagttgcg

SEQ ID NO: 6673 - DNA, 544 bp, Artificial Sequence
  Description of Artificial Sequence: Synthetic polynucleotide
tcgaatttgggcggtcgtcgggtagttttttcgttcgattatggcgattgatagtgagtgcgtttcggtcgcggaggttaggggtggggggaggtcgcggtgtttagggtgggaagttcgattttagacgttgtttttgtgttggttcgcggtagtagcggtcgggttttttttcgttttttatttttggttgtttggcggggtttgaaagggtaggtggttttggcggcgcgtttcgcgagggatgtggtagaagggcgtgcgtttggcgtcgaggcggagggattttcgatgtcgtgtggtagcggggtttgttatcgtagtttttcgcgggtattgtttttaggtttagagttagtttttagcgagtcgggtaaacgaaggtattgcgcgtttttggcgttgtgagtttaaggttcgtttcgagttttgggtcgggtttgtgcgtttgttttttggggattagggtggtttgtatggttcggttgttcggtggtttacgggttgtattcgtagcgggtagtataaggtcggttggagatcg

SEQ ID NO: 6674 - DNA, 2002 bp, Artificial Sequence
  Description of Artificial Sequence: Synthetic polynucleotide
tcggaggttgtgtcggggttcgttaaaggttataaataaatcggacgggtgggaagtacgttttagcggcgattggatttttaaaaatttgttggtagagtgaaaataaaaattgttttttaagttggtaaaatcggcgttttagacggtgcgtaggagggttttgcgaggtttgttttcggagtttcgcgttagttttgtaggttcggttgggttcgtagttcggtgttttattcgtgggtcgggttcggttgcggggttttttcgtagtcgggatatttaggatagtagcggttggggagtcggggttaggggtttttttgtaattttaatgatttttattattattattcgtaaaggataaacgcggttaaggtcgggttttatagtggttgtgttggttatcgcgtggaggagtgtgcgttaatttaggggcgaggggggcgcgttcggtgtttcggggagagtttagaaggaagacgttttatcgtggtttttatagttagggatagtttgggtgttagaaatttttagagagaattcgaggggttgatgttttgggttattagtttttggtgtttgtggggttttttgcgcgtttatttttatttttttttttttttttaggttcgacggattttttcggaggtttaggatagtgatttatagtaagtggtgatagtggaataacgtgatagttcgttgtatttgttagttggtttttgggtaggtttattcgtcgggttcgattttagagtcgagttttcggagtcgtcgggtaaagttttttttttcgtttcggtgtagtttcgcgtttttcgcgttcggcgttgtcggggaaaagtggtataataggaaagtttcgttagagggttttttttagtcggttttttcgttataaaaagttagattttagtcgaggttttgattttttttaaatatacgtttttttgttcgcggttcgttattttcgttcgggtttcgggttgtgtagtttttttttaggtttgttcgggtttatgtttttttcgaagcggcgggagtcggtgtagttttaatttttattgcgtgttttaggtcgttaattagttttgttcgcgtgtcgttggttcggaggttgtcgcgttagtttttgcgtgcgtttgagcgcgttggagtatttgcgaggttagggttgtcgacggcgagaggatattttgaggaatacggtgttttagtttcgttttcgtttttcgttcgagttggaggttggggcgcgttgagtcgtagcgtttggataagtgcgcgggtcggagtcgtttaggtttgtattcgggggttcgcggtcgacgtatgcgtacgcgcggtggcgggtttgtaggttcgaaggttcggttttttttttaaattcggagcggggaagtttaggggttgagagtttcggttcgggtcgtaggagttggggagcggggacgcgggtaggttaggtttttttatttgtcgtcggggttttttttcgtagtagtaaaggggttttagtgttcgtggtagtgtatgttttagcggatacgttggtttttaaatttagagattagaggggcggttgagaacggggcgttcgttgtgtgtgatttttgatcgtggaggaagggcgggagtcgggagtaggcggtggggttcggggttaggtcgcggtcgtcggttttcggtaaaggcgttttggtcggggaagggggcgagggtgggcggtcggtttttgtcgtcgtagttatatttgggacgttgaaatgggttttggggatagagtttatttttagcgcgttttataggagaagttcgtagtttaggtttgggtcgtgtagatcgttgggcgggttcggggttcgaggagagtaatacggcgcgaggtttagtcgcgagtaataatttcgatagtacggtttttcgaagacgtgtttcgggtatcggggttgtgagcgggggagtttcgggttttgggttcgtttggtacggggcgggggcg

SEQ ID NO: 6675 - DNA, 983 bp, Artificial Sequence
  Description of Artificial Sequence: Synthetic polynucleotide
tcgttttttttcggtttttcgagcggagtgggtaagggaggggggtgaggaaggtacgcgatgttttcgtcgttcggcgttttatcggtcgtagcggtttatcgttttcgcgggttgttcgtcggtcgtagtcgcgttcggggtatgttagttcgtcgtcgtcgttttttcgtcggggttcgtgggttcgtagttgttagggagttgcggggtagcgtatttggagcgcggggtttgggagggagggtgtttggggttagggcgaggggtttcgggaggggttttttcgtacggattttagaaagagggaaatttcgatttagagcggtgattggaatttacgttcgggagaggttcggagtttcggtcgcgggcggcgggggatttttgtaggaaggggtaggaaggtaagtagttcggcgcgttttggcggtttcgagggatttgggttcgggtttgcggtcgcgtcgtttgggttttttttgggttgggagcgcgtcgggttttcgttttgtacgttgttatcgcgggagacgtttcggtttcgtcgcgcgtagaggggacgcgcggagaggttggtttttgggcgagcggagagttttgtttattaagttgtcggaagaagttaaattaaaaagttaatttttaagtttttaaacggaacgttattttattagttgggagatagcgtcgtattgattgataagtcgcgtatatttattttcgcgcgcggaggggagatttttagaacgtttttcgattagtagcgaggaagtcgagttcgtatttcgtatttcgtatttcgtatttagagttttcgagggacgaatttagatttaatttttgtttcgcggttatttattttagtcgttggagtttggcgttcgcgtttttcggtcggtagtacgttaaaacggcggcgcgttttgatttggatttcgtcgagttgggagttttaggtagtaggcgggcgcgcggtatcg

SEQ ID NO: 6676 - DNA, 947 bp, Artificial Sequence
  Description of Artificial Sequence: Synthetic polynucleotide
gcggagcgcgttagagcgcgagggacggagggagaggaggagcgcgggagttgcggaggcgatttcgcgaatttattattgtaaatatattcgggggtgttaggaggggtaggggtgggggtcgcggcgtttatattagttcggtcgcgtcggattgaggtagtagtgtggtttgagtagtttttagatttacgtcgggcgggcgtagtatttggagcgagttttgcgttcgttttcgcgtagcgtcgtacgttcggtttcgagttgttcgtatatacgcgtcggaggagagttcgtttagttttttcgtcgagtttcgggattttttaaattcgaggagtttcggcgtcgcggggtagttttttgtcgtttttttcgttcgttgtattttttttggggttcgttggtttggcgaagcggagagggggaggcggaggaggagagaaggcgggggtcgcggcggtcgaagttaagagaaagtggtatgttcgaattttggaggcggtggtggcggaggacgggggaagacgatgtcgtagtttcgtaggggacgtaggcgagagtaagcgaggcgagttgggcgtttcggtttcggttcgttgcggggaggcgcgcgtcgttttgaggtttcggttttcgtattttcgcgtttcgacgttgcgggcgatagggtttggttttagtagtcgtcgtcgtcgtcgtcgtcgttattcggaggatttagtaaaagtttggatttgggggagggcgcggcgttgagcgggattattattagggttggaaggagatttcgagaatttttgtaggtaacgcgcgtttttaattttttttttttatgtttcgtcgttgcgttttcgtttttttttagagttttttttggttttcgcgggtttggtagaaagtaagagggaggcgaagtttaagatttcggggatgagtatcgagcg

SEQ ID NO: 6677 - DNA, 1362 bp, Artificial Sequence
  Description of Artificial Sequence: Synthetic polynucleotide
gcgttttttttattcgcgtttttaggtttttatgtacgttacgtgggtgggagcgtgttttatatattcgcgcgtttaaagttatattcgttacgttttcgtcggggcgggtttatcgcgcgtttttgggtgtcgagtttttataggttatatagtcgttatttgttgttgtatttttattgcggggataggggtatttagtgttttttttcgtttttttcgtttcgcgaaggttttttattttttagggttaggcggaggttacgtttttttcgggttttttttttaacgcggagagggaagcggagggaggagtttggttcgtagtcgtcggtttttttcgtattggagttttttttttttttttttttcgtttttcggttgtcgtagttcggttcgtagcgcgcgttagcgggggtttttcggagcgagtcgttaggtaacggggttggtttcgtagacgcggggtcggggaagttcgcgcgcgttattagtagcggcgtcgcggggcggggggcgtagagattttttttaatttcggtttgttattatttggttcgcgcgtagtttcggtttagaatgttttaatttgcgtcgattgttgtcgtcgaggtgttttttttttgtagggatttcgacgtcgttagttttttttttttttttcgtaggtgcgtattgttgtgtttgcggtcgggtgggcgtttcgtcgttgcggtcgcggtcgtcgttggtaagttgcgttttggggtttggggtaggaagtagtggggggcgttcgaagagtagggtagttacggttatcgtggtcgtcggatcggttatgtgttaaagtttttggggttcggcgtttcgttgggcgcgtagcgcggggagtagacgcgtcgtgggtggggtagcgcggtgttgttggcgttcggttttcgcggggtgtagttttgcgcgtttttatgttgttttttttttttttttttcgcgttgttttttcgaggttttttcgtcgagtttcggcgcggggtatgaggagttttcgggtgtcgtttagagattagtaggttgcgcgtatatttagttagcggtagacggggatatgagtagcgcgtacggggtttcgcgttcggcggttagttttattcggcggcggttagcgggttaacgttgttcgggagaatgaggtaggagtcggcggtagtttttttttttttttttttttcgtttttttgcggtttcggcgtttcgggttcgggtcgggttgcggttttgttgcgtgtttcgcgcgttttttaatcgttttcggatgcgtttttcggtaagttaggtttttcgtttcgcgaataaagtttttttcgtagggttcggaggtcg

SEQ ID NO: 6678 - DNA, 1092 bp, Artificial Sequence
  Description of Artificial Sequence: Synthetic polynucleotide
tcggattttgggaggagcgttggcgtggaaagttaggttatttcgattttggtttttaggttcgggataacgtgttagttttaagagagcgttgtttatagtttcgggtgggttgggtttaattgtacggggcggggcgttaatagtttaggatttgggttgtaggttggtttttgtattaattagcggggcggtttcgggttttagtttttttatttcgtttacgaagggaggcgattgcgagcgtttggggtttttgacggatttcgtttcgggggtggggcggggagtggttacgtggaggggcgtttcgttcgtcgagtttcgttttatttcgtttcgttcgttttcgtgttcggggtttttcgtttagtagagatttggagttagaagtttagagatagtcgagtgcgtcgtgcggttttcggacgttcgttgtttagttcgattttcgttaattgtgtaggcggttgattcgtagcggtagcggtagtagcgaggattcgagcgttggttgtagcgatattatggattttttttttatggtcgcgtaggtaacggggcgttttttttacgcgtttcgggtcgttaagtttggggaggttcggggttacggtttcgttttttacgttggggttgggtagtggcgttcgttcgcgattcgcgtttcggttttttgtttcgagtcggatatttttatttggtgtacgcgtcgggggcggcgatcgcggttttttcggggtggggcgggttgcgcgtttcgtattttcgcggttcgagttgttttcgttcgggtttttttcgttggtaggaaggttgcgaggagtttgggtagttcgagtcgtttttttttgtttattttttattgttgttttttttttggggtttcggagttttttaaggtcgggttagtttagattcgcgcgaacgtggatgggtatatagtttcgtttttttttattttgttttttcgaggcgttagtaatttgttttttgtcggtgatttcgggcgttttttttgtcgtcgtttgaggaaggttttgagattcgttttgtgatcgtgattcgttaagcgtcgacgcgtcgcggtcg

SEQ ID NO: 6679 - DNA, 1092 bp, Artificial Sequence; identical to SEQ ID NO: 6678
  Description of Artificial Sequence: Synthetic polynucleotide

SEQ ID NO: 6680 - DNA, 1092 bp, Artificial Sequence; identical to SEQ ID NO: 6678
  Description of Artificial Sequence: Synthetic polynucleotide

SEQ ID NO: 6681 - DNA, 580 bp, Artificial Sequence
  Description of Artificial Sequence: Synthetic polynucleotide
tcgttcgggttcgcggattgtcgggtcggtttttagttatcgtataggtgttttggagagtgcgattattttttgtttttcgtttcgcgtcggttttcggtttagtgtttcgttttttttggagtacggtttgcgtatgcgcgcgttttagggtttagttttgtttttgtttcggtttttgcggggatggatgttttacgtagtaagcgagtaagcgagttttggagatcggggttttgggtgtgcggtcggtttagtgttacgcggtgagataggtatggttattaatttacgttaaggcggttgtgtatttggtatagaaaatattgttgttgaatgttgtttttatagttattcgttagcgtttattgatgagaggtgttattacggatattcggttttgtttcgtcgaagttttggtttattaggattaaagttaggttttagcgggtttttttgttatttttggacggtttcgcgtttttttagagtttgatttttttttatttttgtagtttaagtcgcggaagcgtagatattcggtttttttcgcgtgttttatcgggtttttttggatacg

SEQ ID NO: 6682 - DNA, 888 bp, Artificial Sequence
  Description of Artificial Sequence: Synthetic polynucleotide
tcgtgggaggttagagcgggcgttgttcggcgttatttttgtagcgttcggatcgtttcgtataggtaggggtggtgtttttttttcggggtatagaaacgttatatttcgggggcgtcgtttagaggttgtttttgtttttgtgtttttttatgaggttttgttttataaaggtagtttgagttaggattttaaagaggtttggttatcgggatcggagggagtttcgttttttaggtcggttttgtaaacgcgagtttgcgttaaggcgttttgcgggtttgttggtggtatcgaggggtagcgcggggttagcgttgggagtttcgaatttatacgtttcggttagttgttcgggaagcgtttaagtatacgtttcgagttttagattggattaagttgtttaattatttattttttttttttttaaggagaagtttaattggagaagattcggtttttttcgttatggtaggttttttttttttgattcgtagttgtaggggttgagggtaggcgtaggttcgttttggggtcgaagttattatcgggtttcgaggttgtttttttaatattcggtttgtacgtttggcgggggcgtaatagtgttttacggttcgggagttcgtttttggtttttgagtaaggtattttttttatttgtcgtgtgtttagttgaatttagtatatttttttcgtatttttcgtttttttttttttttttttgaatttgtttttttgttttgcgggtttttaatttttttcgaatttcgggcgttcggttcggtttaggcgagcgttcgcggttggggacgcgggtggggacgcggcggtttgggcgttgtaggatgcgtttggtcgcggaggagacgattagggagcgggtcg

SEQ ID NO: 6683 - DNA, 1483 bp, Artificial Sequence
  Description of Artificial Sequence: Synthetic polynucleotide
tcgaatattgatatcgttttaaagttgtaatttttcggtttcgttacggttttttatgtataaagagagggaattagtcgtcggtgatttcgacggttttcggattagggatgtttcgagttcgagcgggtagggtgtttagtagggttaggtgatgggaattatggggttatcgagtacggattttggttttttcggtggtttttgtgagttttggggttaggcggggattggaggagcgttcgcgtcgggagggagcgtatcgcgttacgtgttcgttcggcgtttcgtttttatttcggttacgtttttcgcgttttttttaaagtttcgttttttagtttcgttattttcgttcgtttcgtttttcgtagttttaagtttagcgttttcggaggcgcggacggtggggtttcgcgttttttgtgtcgggttttgatcgtcgcgcgcgtttatttattttagcggtcgcgggcggaggggcgtacgcgcgcgtagttttttcggagggcggtggggcgaatagtaacgcgcgtattttagtttttggttgttgtgttgagattagttcgcgcgttcgcgcgtttttttttcgaggattcggagtcgttcgcgtattcgttaggggtcgtcgtttcgagttttaggcggacgcgtacgcgttttcgtcgttcggattttagtcggttcgtttttcgtttttttatttttcggcggcggtttttaggtacgcgttcgcgtatacgtcggttcgggtacgcgttcgttaagatggtaggggtcggggtttagttgttagtcgtcgtcgtcgcggttttttttcgtagttagcggtttcgacgtttattcggagaagatgagttttcgttgtttttcgtagtttagttagacgcggagtcgtcgcgttcggggtcggttttttcgttagcgttcgcgtttcgcgtttcgtcgtcgtcgtcgtcgtcgtcgggtcgtttttggttcggcgcgttcgttttcggtagcgataatgaggtgagtcggggtcggcgtttcgtgggaggtggtagcggttagcgtcggaggggttgggttgggggttcgcggtgttttcgagggcgggaggggggttttacgggcgcgggggtttttagagaatcgcgggggttttgtagagattcgggggtatttagagcgcgggaatggtttcgcgagagtcgtgggggcgtttggagagtcgggagggtttgtagggtttgtggggggtagtgttttgtaaggggtaggcggcgttggttttggttgtttgtggggtttttttaggtttcggggggtttgcggcggtttgggaggtagattttcgcgggtaggtgtggtcgtgtttcgatcgcgcgaggatcgaagttggcggaagtttttgtgcggtgttttttagttcggaggaggttggtttgaagtttttaggcgttgtcgaagtttttttttgttagcgtttagagtcgcg

SEQ ID NO: 6684 - DNA, 3714 bp, Artificial Sequence
  Description of Artificial Sequence: Synthetic polynucleotide
gcgcgcgaggttggggtagtttataggaggagcgcgggattcgggtttgagtttgtatttaggtagagcgtttattttcgtttttagtttcggattttgaaagtaaagtcgtcgtgttcggtagttagttcgaattttttagtttttagggagtcggggtcggggtagggaaggttacgggtggcggtataatcgggattttggagtggaggcgtagattgcgggtttcgttgcgtacgtttcgtggttcggttggggtgggttttggaggtttataggttaaggttgaacgggggttttggagcgtgggcggggtggagtgtataggttattgggttttgagcgtttttatgggttaggattttaacgcgtcgtgtttttaggatagattggagggggaaggggttgcgattatgttttagtcggaagggttttatagtagtcgcgttgttttttttttgtcggatattcggtagtagatatcgacgtttgggggttagcgaggtaggtgggcgcggatcgcgattcgattttggtttttaattttcgtttagtggcgcgcggggtcgtcgttttatatttttagttcgcgtggttggtgtttggttcgtcgtcggggcggaaggggcgttgtcggcgtaggtgggcggggtcggagcgcgggggcgcgcggcgcggagcgagcgtagggttcgggggcgcggggcgcggaggatcgggggtttgacgggcggttttgcgcggtgcggggcgcggcggcggcgggcgcgcggttagtgaacgcgcgggcggggcggcggtggcgggaggtattaggggtcgtttttcgcgttttttttttttatggcgttgttttagtcgttcgagtcgtttcgcggcgcgtttcgtaaggtttttagtttgttggagatgggggcgttttgtttggattcggagattattttgggttttattagttattttttgcggcgacgaggtaaggtgagggttgtcgggaggggggcgggcggcgtaggcgtcgtttcgttattttgtcgcgcggttcgcgcggtcgggggtgttgcgtcgggaaggagacggtaggttcggagtcgcgtttcgtagttcgggttgggattcgttgtcgtatttttttttattagcgttgtttaagtttttttttgtttttaaggttgtgttttaatcggatttattcggaggttgtggttagggcggagagcgtagcgtagggattttcgggtttattttgcgttttgttaggatgggcgaagtagggggtcggggtttttgattgatcgtgagttttcgaggtgattttagttttgtgtatttcgtgttttgcggatatgggatgtgagtttgtgtttttcgaagcgtcgcggcggtagaagcgttgaagttgcgggtgtggttggttaggggcgtaggatcggtgttttcgatcgttgcgtgtttttgtgttgcgtgtgtgggtggggggacgggatatagagagtgtgtgtttcggagtagtggagcggcgggaggcggtgttgtttgtcggtagtgcggggtggggtttgggtgttgtttttagtatttagatttagatgtgggttgacgttcgtttttattttttaggttgcgaagagacgggtaggggaagcgttttcggttttttaggttgggtggaaagcgattgtaggtttacggattttagaaagagtggagagtttttgttattttattttatatttttttgcgttttcgaatttttaaggttattaacgattcggaaagtcgggaggggattatttattttattttttggggagtgcgtgcgtgggcggggaggtttatttaagtaaaagggggtgggtaaaacggaaagggttattttgacgtattgagtttttgcgaaggttttatcgtatgtgtcggtagtcgcgtgttttggttttcgtcgggttacgattttcggagttttcgagtgcgttttaggtttgggacgcgcggcgttgtttttttagtttcggagtcgtgtgcgtagcggtcggtagggggtattcgcgttacggggagttcgttcgtcgcgttcgtttggtttgattcgggttttggggttgattcggagtttggttcggagttgtttgcggtcgcggatgtcggcgatatttggggttcggttaggtatagagtaattggtcgttagggaagggcgggggggcggttttttagtcggagataaataagtaattaatttcggagttgagtttttatttgttaggtttgttgataataggttcggcgtacgttcgtaggatttttcgtttttcgggcggtacggcgcgtatatttatttgcgggtatacgcgcggttgtaaagatacgtgtcgttcgtagacgcgtcgaggtatagatacgtcggcgcggtcgttgttcggttcgaggcgtatatcgcggcgatattaatttacgcgcgatagttagatttaaagtggttcgcgatatgtagagtacgttgggtttgttggaaaggcgtttgggagtttcggggtcggggtttcgtttttttttcggtttatttcgtcgtgggttttgggtaagagcgtttttttcgtagttttagttttttcgtttgtagagggaggggcgtcggcgttttttgggagacgcgtagttttggtgtttcgggagaggggcgggaggcgtatgcgcgcgcgtaattagattttcgtcgtcgtttttagcgttttttttcggggtagggatttatttaataggttggggtttttggagtgcgcggggtcgcgtggggaagcggggattttattttttttacgcgtcgtttagtattgggtaagggcggggtattttttgggttttcgtttttcgtcgttcgtttcgggagttcgagtttcgttttttttcggtttcgttttcgtttttcgagcgcgtttatcggagttatcgcgtttttcgcgatattcgtaggttttgcgaattttcgagcggttgggtcgggttatgggggcgtttcggggtcggattacgtagtcgcggcgttttcggagagttagcgtggtcgggagcgtttgtcgggtttttttcgcgtttcggttatggtcggtcgcggcgtttttttgtgcgttgcgtagttcgcggtacgcgcggttcggtttggagagggaggcgggcggcgggggttcgggacggcgaagatattcgcggtgtgcgttggatttttgggggtcgggttttttgttgagggtagcggattcgtaggcgggattttcggggatggagggagtgggtgagcgttagggtcgtgtttagggtttttaattttggtaagagcgttacgttggggtagggcgcgtaggggtttggattcgacggacgttttaggtttattgttcgttttcgtttttatattttgtaggtggtcgagggcggttcggttcgcgagtcgtcgtcgttgttggaggtgttttttcgaaagaggttattcgtcgggttcgattaggatttatgcggtagtcgttttgttttcgaaggcgtcggggtcggtttagagtagggttattcggtcggcggaggcggttggtgtcgttattgttatacgaagttggtggagtttaagcgataggcgtggaagttggttagcgggttcgggattatttttcgggtaagtgatatttttttaggtcgattttttcgagtagggttacgtcg

SEQ ID NO: 6685 - DNA, 1266 bp, Artificial Sequence
  Description of Artificial Sequence: Synthetic polynucleotide
gcggcgaggagggttgtaggtgaagcgcggggagagggaggtcgttcgtttcggttttttttttaggggttttgcggttggttagcgtttcggttgtattttttggtgcgcgtcgcggcggcgttataggtttttcgattttttgattatcgttttcgggtcgcgcgttcggtagtcgggatcggtgatggcgcgggattgacggtcgtttttttttagatttttttgtttcgtttggggttcgttggggttgcggcgtcgtttcgagttgtatgtggggcgggcgcgttcgagtttagagcgagcggttttcggcgttttcgaggcggtgtttcgtcgcgttagagtacgaggaggagcggcgggtcgggttaggttttttacgcgtcgtagtttcggagtacgggtttttcggaggggatttggggcgttttagtttaggaggaaggattcggaagtagaagcggagtcgcgagtcgagtcgagttattgttttcgttgttcgcgggcgtcgggtgggggtttcggcggttggatgggtagcggcggcgcgggtcgcgggcggcgatgggcgaggagtagagtacggtgagcggcggcggcgggttttaggagtcgtagattttggttagtggtattgcgggttattttgagttttcgaggttttagggggatagcgttcgggcgttttcgttgcgcgtcgttttcgcggagtcgagcggcggtggttgcggaagcgattggggttgcgcggatattagcgttttagagttcgcgaggagtttggggttttcgggttggagtaagagtcgagtatcggcgtagtttgcgggattggtatttatcgggttttttaatttttagattttgttattgtagttggagttggaggaggaagaggaggaagttggggatcgaaaagagggaggggatgaatagtaggaggcgtttttcggcgaagagttggagtttaggattcgcgtgggggtcgtcgacggattggttttggacgtgttgggttagcggcgttcgtttttcgttaagagataagttttttgtttcgtgtattgcgtggagagcgatttgttcgaggttttcgtttcggagtagttttcgtcgttcgcgtcgttatttggggtttcgttagtgttgaatttttttagtattcgtttttttttttttagttttcgattgttttttttaacggattttttttttttcgacggcggtagtatcgagttggagttttatttggcgttcgagtcg

SEQ ID NO: 6686 - DNA, 1316 bp, Artificial Sequence; identical to SEQ ID NO: 6563
  Description of Artificial Sequence: Synthetic polynucleotide

SEQ ID NO: 6687 - DNA, 10783 bp, Artificial Sequence
  Description of Artificial Sequence: Synthetic polynucleotide
tcgcggagatatttcgagtttcgtaggtgtttgagttgcgttgcgcgttttagtcgggaagtttttttttatttaatcgcgtcgtttcgcggaaagtttgggtattgtagacgtttttatcggtttatcgatagttggttttgaagcgggggtttagaaaagtaaaggggatagtgtttggagttacgatgtttttgatgtgaggcggttttatttaataattaacgaattaagttggaattgtaggttttatttttgttggggggaggattttaaggaatgttatttttttgttttttattttttgttttacgtttagttttttagaaggtattaggcgtgagtagagtgcgaggcgtttatattttcgtgttttttttattttcggatatttttgtattttagtcgaggttttagtacggagtgagggttgtttggggtgttttgttgtgtgtggggcgtttttgtttttcgggttttgattttacggtttgggtcggcgaggcgtttttttttggcgtttggattgtgcgtttgtttcgtttttaggcgacgaacggtaggagtcgggggttcggcgggattcggatttagggcgggcggaaggcgagggtttttttttttcggaattttcgtttcggaaatttgtaattaaatcgggtttttttttcgtatcgttttcgcgttttcgggtcgtttttttacgcgggtatttatttttcgggttttcgtagtatcgtttttttcgcgtttattcgcgcggtcgacgtcgttaggggttttgagatcgcggagatagcgcgttttggcgtttggtggggtttttttagtggttagagcgtttttggattagtcggttgtggtttgtgtttaaatacgatggaaatcggggttgggacgggcggtggtacgtacgtggaggagaagaggtatggcgggaaaattatagtcgaatataggtcgattcgtattttttaggtattcgtcgtcgtttgattcgcggttttttttaaggtttcgattcgtcgttattttttggtattatttatcgggtttcgattcgggtcgcgagttcgttgatgcgtagttgttttcggcggttttcgggttttgttcggattcgcgcgtagagacgttcgggaacgttgggttcgggcgttttttggcggcggtagtacgcggtatacgttcggtttttcggttcgagggggcgcgtggagcgtacgcgggattcgcgcgcgggtttgggttgttggtttatattttttcgtttgttcggatggcggcgttgaggtttattcgtttttttattaataacgatgtttcgggagggaaaaaatagagtttttaaaaattagagtgcgagagaggagtgtgtgtgtgtgtgtgtgtgtgtgtgtgtgtgtgtgtttcggggcgttggtgaaagtaataaaatttagatcgtttttttggcgagatagcggcggttataatgcgtcggggggattaggggtttatttgtagattttggataaaagatgatatatcgatacggtttagagtgttattgcgtttggttttttagggagttataagtatatattttttgaaatatcgtttagtatagtatttaattcgttcgttatttaatatcgggaggggaattttagtagcgtataagcgcgttttcggttttttggttttgggtggggagagtttaaatgagaaggatttggtatgtttagacgtttttttttttggtttttgtttttagtttaagtaattatttagcgatgggttttaataaatacgtttgagaattgtttttatgttcggtaaatattggattagttttttaatgattaggtttttgaaaaggttcgagaaatatatattaggttttaattaagtttaatagttaataggtaaggaaataagttatttttttatttgaggtggggaatgttgggaagggggatttttatttttattaaattatttgattttattaaatatgatcgttgtattaaataggaaagggggcgtatttaagttttttattagtcggaatttttattagtttagttttgtttattaagggtcgagtgattttgtggggaatatatttgggttttagtttttatttttatagagtttagtataaattatttttgtttagtatatatggtttatttggggattgtttatgggagttttgatttggtaattgtaggggagaaggtatgatttaaattattttcgattgtttcgcgttaatttggatcgtttagaggaggtaaaaaatgggtaaattttttggaagttttgttgtgtttttttggtattgaattttgtaagtacgcgatataggagatattgaaaattaaagaggaagtattttttttttttaatatggggagagacgttgttggaagaagtttttgaagtggttttttatcgtattaagaggttagtgggatggattttcgcgtataatttaaaggaacgcgcgcgtttttagtttttcggggttggtaattaagtggttcggtcgggcgtaagtcgttttggaatcggttgtagtttaagtttagttgggttcgggattgagcggtatttttggttttttagaatttttttcgcggtgagtggaagggcggtttcgcgcgcgggcgtttcggggtcggtcggttgcgaaattagggggtggatttttatttatttaggagtcgttaagttcgtaggggatcgagtattatttaggttttgggtattttgagttgttttttgagttttaggacggttcgatggtgtagagtttttaggtagaagttagttttttgatatatatatagtagtgagtaaagtgcgtataagtgagttaaattttgaagacgtaggttcgcggatttttattttagcgttagagttaaggagatagaagagaggaaggagagaagtgaggaagggagagagattatgagaaaaagagattatgaaagtagagaaagagattatgagagcgagattatgagaagagagaaaaagagagattttgagagagagagatagaatgagagagatttaatttttagtgttacggggtttaggcggggtaagcgtttttcgaagttattaaagataggggtggttttttttttttttttttagttttttttttaatagatatagtacgaatttttaatgcgttttttttttatagataataatatagggtttgaaagtcggatataatttaggttttgtgcgggttttttttcgcgttttttcggtttagttggttatatggaatttagtatggagttcgtggatgataaagggatttagtgataggtttaataaaattttaaggagatttttgtttgatttcgggatttattgtcggcgataagcgcgttgaatggtgcggggtggggcggggggtggggggcgggttttttttttttttttttttttttttgttttcgcgattttttttttgtttttttttaatatgtacgtttttaatattttcggtttttagtttttttattgtgcggttttgtatcgttcgttgtagattgggcgaagatagattgttgaagcggatttcgcgtcgggtgcgtttttagggcgttggggttagggttatatagggtttcgtaggcgtttttattgattttatggggattcgaggatagagagaggcgggcgtcgggtttatttttcgggttttcggtcggttataggagcgtatatttagattgtaggttcgcggttttggttatagttttaaatttgtttttaatgagtaagtggtggaagtttgttagggtgaggattttttacgtttttttttttttttttggaaatttgagggttttttgtgattatttttattttggaagttttggggtttggaaaagttaaaatggttttaggttttttgatagtttcgttttaagagatttgaaatttttatttttttttttaagaggattttgggattaggggaagttgtaagtggatgttgagtggttagtattagggtaggttgggcgtttaattattgtataataaattatttgggagaaattcgttggtttttaaaaatagtaagatataagtttttaaatattgttaagttagtgtggagaataaagggagattttttagtatttagaaaaattgtttttttttcgaggatgagttcggagatgggaaaggatttttattggggtattagaaagattttcgagtttttaattatttaggggcggtgtggaacgcgggaataaagtgttatcgcgtttttgggttgttgcgtagagtgttatcgacgtatagatttggtcgtacggataattatgtttgttttagatattgaattaaatttgattattaattatagggagcgagaaagttagttgggatcgttttttttgttcggtttttttattgttatttaattttttagttttgatggtgtagtttcggagagaatagagatataatttttaaatgcgtcgacgtttagttttttagcgtttgtagtattcgttgggttttgagttagagttttaagtatttttagaaattcgcgagatagaggagaaaggtttattttttagttggttaggttttttaagacgttttttcgcgtggttaagtgtgcgttagtatttgttaaggagatttttttttagtaataagggtgggacggaattcgtttttcgtcggaaagatggatgcgtttttttcgggcgtgttcggggttgtgtgtttattttttattcggggagtttattttatttttaaatttttattttttagtaatttatttagttttacgtttaagggttgatttggggggatcgtatattttggttcggatcgtcgaacgttggagggaaggaggttcgggatttagttttcggagagaggtttggaagttcggaaaggatgggagcgtaagggaagggagaggtatggtttgttgggattgttaaagattttcgttttttggttttttggggttaaagattttagggagggttgtagtattttttttttttttcgagtttagaatttcgcgtattttttttaagttttttaagttaaagtttcgcgcgttttgatcgtttttatttttagttttagcggttttttaggttagtattagttcgtagattttgaaaaggagtggggagtggggagaaggtagttagttttaattttagatttttatttatttatttttttagcgtgaggtaagttaaatgtaataaagtgaaagttatcgagtgtagtggttttaatagttttttaggttgaaggagttatttatagatttgggttagcgaggggggtttgtttttttcgtttttgcggttttcgaagttattttttttttcgtagtcggacgttgtcgttcggggtttagatagcgcgcgagattaggggagatgcgggggagggtgggcggttttgggttttcggtcgatcgttcgtaggtcggaggtcgagcgttttttttttcgttttaattttaggcgcggggtgtagtttgtggtcggaggggtttgtatcgggagtttcgttcgttttagggtttcggtattttcggttttttcgttcgagaggaatcgtttgtgggagtttcgcgggcggtcgggttcggtttttaggtttaggttttcggttcggcgtagtaggataaacgggagggtagggatttttttttttttttttttttaaatataggatttttattaaaatttttatttaaaaaatcgaaagttttttgcgttcggcgttgttggggaatcgcgtcgaatagttgagttttaagttcggggttgaaggttcggaggatagggtagagggttttttgtttatagggtttttttttttatatttgagaaatgtttgtataataaaataaaaagagaaaggaagaaagtaggggaaaacgtaaaaataaaaataaaataaaaaataaatttaaataagttataaagaaaggagttggatttagacgggaaataggtcggttttgaaggttattttggtaataattattatcgatatttataacgaaaagcgaaatttgttattagttgttagaacgtttatatggttataaatatttagtatttttttatttttttttaaaaaaaggaagaaattttttgtatttttaaagtgttttttatttgttttagaagacggttgataatatcgttatttatataaatatattttataaaatgtacgaaagtaggggtggggggtcggtttttttttcgtttttaagtgacgatattaacgttgggacggtttggttttttcggggagaggtaaagaagcgaagttgcgtaaatattttgtaaatacggcgtagagtttagtttttttttaaggtttagaaggagaggtatgggtagagttgggtgggtggaatttgttattttaaggagacgtaggtaatttttcggcgtttttttagtggagtcgagagttaattcgattttataataataattataataataataataattattataaggatcgaggttttttcgtcgttatcgtcgtcggggtggggtttgggtttggggtcgcgagtttcgttggggcggcgtttattaagtttattgttgggtttggattagggggtgtgttgtcgggtattggggggtgttggtcgagttgtattgggcgttgtattgtatgtgttgtagcgattgcgcgttgtaggtagaaaagggaatgttcgtttggaaggtggcggttgttaggttttgggttttgagcgcgtgatatggtttgtcgtttttgattaagacgggtacggttattcggcgcggcgagggtaggggcgttatttttatatttttttcggttcgggcgcgttttattttgtagcggtggttttggaattagattttgatttgcgtgggcgtgaggcggatgaggttggttaggtgttcgcgttcgggcgtcgataggtatcgttgttgtcgaaagcgtcgttttagttcgtaggtttgcgttttggagaaaagtattcgtcgttttcgttttttgtcggcgtttttttcgtcgttcggggtttttttgttattgttcggtgattcgtcggtcgagggtttcggggatttggagtttgagttttgagggggcgtttcggtagttagatcgtgtattggggggagggggagagagaagcgcgttaggcgtttggaggtcgcgcgtagtttgtattagattcggagtattttggatttttcgtgcgattttggattttcgcgtttggtagtttagtttcgttgtttttgttatgatttttgtttttttttacgtttgacgaagacgtcgggattttttagggtaaagagggaaattcgtaggagtgggggttaggggttcgttttttaaggggtttatatagtgtgggtgagaatttggggggggaagtggtattgaagattatcgcgggttaagggtttcggcgtttttaagcggtttttttttcggcgagacgtgggtagatttttaaaagaaatattttataattttagtattgatcggttcggttatttaaggtaggtttttgggggttttcgtttttgttttcgggttttttagatattttttgtattgtataaagcgttttttatgatcgcgtagggggtagggtgagttatttatattcgggttattcgaagtttttttattttttattcgtattcggacgaggttcgttggttatttttagggcgttaggttagttttttttagcggtcggagttcgggggttgcggttggagttatcggttcgggttgatattatatattagtttttgggaggtatagtttttttttttttttttttttaatttttcgtattgaaaaaaattttggagattaagttttttttcggaattaaggaggtttgaagaggagggtagaggatattttatataggtgttaaaaatttttttacggattcgagtgagggggttcgggtttatatggttttttttttttttatttttagcgtttaattcgggttgcggttgtaggaatggaggggattacggtttcggtagttaagttttgttatttacgggagtattgaaggttttcggtgttggttagttagcgcgtgtacgggttgtcgttgttgtcgtagaaggggttttttaggggtaggttttgtatcgcgtttagggcgttttgttttagcggttcggtttttttggttggttcgggtttttcgtttttttttttcggattttcggttatagagttttttttatcgttggtgttcggtaggtttaagatgtttttgatcgaaaatttcgtttttgtgttggttagcgatatggttcgagattttaaaatttatgtcgtaaagttgtagttttatttggttaattcgtggcgtttttttgttttggcgggcgggggaggggggagttggggggagggattgggggaggggaggggggaattggttttaattattgggataattattatttttaaaaagagaaagaaattggggatggggaggaaaaaaatgaagtttaatttagtgtttttttttgttttttttgaaagtacgcggaaatggacgtaggaagtcgggcggtttgcgcgtcgagcgtcgcgggtttcggttttagtttttaattttaggaggggtgttaaggcggcgttagttcgggtttcggcggtcgttcggcgcgcggtggcggttggtggcgaggaaaaaatgggttattgttcgagcgattagtttatataaggttgggttttatttacgaatttggggaggcggggagagggggagaaagagagggagggagggaaagaaagagggagggagggggagcgagagagggagcgggagaagggtggaaaaaagggggaagagatattaaaaacgtaaaggttggttacgtgtgggcgggttttgggagttaagtggatgaagatagtatttgtagatgtgaaattgtgggttttggggagtttcgcgtttttagttaacggttttttagagtaagatgagaggtgtaacgtgttaattaattgtaaagacggggcgagtttttttttttttaaatttagtatttatatataaagggttatcgcgtcgttcgcgagtttatatatttgaaagggtcgttttaataaattgtattttaaaaaaggtgggggtggggaggaggaggggagaaaataaaatagaaattaggaggagggaaaaaattttttttaatatttatcggtttttattttttcgttttcgcgcgtttattttcggtaagtcggaaaattggcgatttgtggcgtttttggaaaagggggagggggcgaaggtcgagttgcggaaattttttttttttatcgttggtggttgtttaaataagattcggtttaaatggtaagagtttaatttttgtaagttttttaggttaatattttggttgaggtttaaggatgagtgttagaaatgataaggtaagtaattgattttagttaatcgcgagagagtttaaaatttaggagagagtttcgtttcgggtcggttagagttattattaagcgattcgtttttttttagtcgttttttatttgttaaagatttatttattttttttatttcgtttttttttattttttatttttaatttttcgtttttatttttttgcggttaaggaggacgcgtagtttattttttgttttgcgggcggtttcggggagggcggggtaagagtgaggagttttaatttcgtttggggtcggattttggttttgttgtttttgggttttgcgggttttttttttcgggtggaggaaagggtagacggttttgtttttttttgttttttattattttttttttttcggttttttttttttttagtttttggttagaggtggagtagcgggaaggcggcggggcgggattgcgggggtgggggtgggggttgtgtttttagtttgggtgaagatttagaaagttgcgggggaggggggtcgttgggtggttcgacgatgtttcgttttttttttagttttttttttttacgcgagttttttagtgtggtttttttttggacgttttgggtgcgttcggagtacgcgttttacgtttttaggttaagttaggttagtgtgaagtttttagttattttcggttttgggaattgaattttttcgggatttgtatttttttttcggcgttggggttggaaaagattacgtcgtatttgttatttttttttttagttaaaatttttttggggggggggtgtaggggtgtagattggttatttgatgttcgttcgttttagaggagtgttaggaaggagttttgtttgggggcggggaggggtatagaaggttatttttgcggggtttaggtttagtttttttataatttgggttttttcgcgcgggttaagttgagcgcgcgggtatcgggtttttttcgcgcgtagttgtagcggacgtcgtcgcgttttagttgttttcgggttgttagcgttgggtgagggtattttttttcgagtcgttcggcggttttttgtagttttagttgtttcgtttttagtatgtgacgtgggtgataatggtttaggttagagtaagtttttcgtcggcgcgttttgggtggtcggattcgggtaaatataaatataaatcgattgttaagttgcggataatgagcgaaatgtagataaatgtttcgttttcgttggaagtttttgtttcggttcg

SEQ ID NO: 6688 - DNA, 810 bp, Artificial Sequence
  Description of Artificial Sequence: Synthetic polynucleotide
gcgtacgggtcggggagggggttatcggatttggatttcgggatatttcgggggtttggggggcgggtcgcgcgtttatttgcgttttcgtcgtcgaaggagtttatgtacgggaagtagatggcgagcgtttcgaaggaggcggatagattgaggcggttttgcgagcgttttatgttcgcgtcggcgtcgggcgtttcggtcgcggcggcggcggcggcggcgggcggtttgggtagtttggtcgttttatttttgacgcggagtacggcgcgcggcgtggtggcggcggttcggggtcgggtcgaggtttcgttgcggggttggcgggcgcggcggggtcggcgggcgggttaggagttggcggcgcgcggagttcgaggcgcgttgtgttgttggcggcggcggcggcggcggcggtggcggcggcggtggcggcgtagcgcgttttggttcgcggcgtttttcgtcggtagcgcgaggcgggtttggagcggcgtcgtagttaattcgtgtcgtcgggggagggggcgtcgttgcggggcgtgggagttcggagggcgcgggttgcggttttttttagtagttttcgggttcggtaggtgcgcgcggggaggtaggcgtcgggcgaggttgtttgggttttggttcgagggttgttttcgatttcgtttcggtttttatttttagtcggtcgatttgcggagaggtcggcgtttagttttttatttagataggttttttttagagatattggcgcgttcggaggggatgcgtttaaagggtttcgtttaggcgggtcggtattcg

SEQ ID NO: 6689 - DNA, 1142 bp, Artificial Sequence
  Description of Artificial Sequence: Synthetic polynucleotide
tcgggggagaaatttcggtttatagtcgggatgcgttttcgtcggggttatcgcggcggcgaacgtttcggatttcgtatttcggtgattttttgggatgaatcgaagtcggattcgtattttggtcgtaataagcgcgttttacgtcgttacgtattagcggtgattttcgagttttttgtcgttttggttttttcgtaggcgggtttcgaggttttcgtagggagtttagggttacggttacgtgtagtcgttttcgagttcgagtttgtaggttcggggttcggttcgcgttttggtggcgttcggcgaggttgtagcgcgtaaagtttttattttaagttttcgtcgcggcgttttcgtttcggagttggttcggtcgcggttttcgtttttttcggttgtttacgggttcggggcgaggacgcgagaggggtttggaagtcgttcggggagttcgttttgtttttcggagtcgtcgttaaatttcggtttcggggttcggtttagttttcgttttcggagttacggtcgtttcgtttttgtttttcggttttcgtcgggtttcgagtgcgtcgggagcgcggcgtagtagtcgtcgagggagggagcgaggtaggaggcgggacggagggaggggattgagcgcggggcggggagaaggggcgggtagtcgaaagcgtagcgtttggtttcgtttcgtttcgggatagtggtagcggcgttatcgttacggggcgtttaggcgtttaatcgggatttcgtattttggattcgggggttttggcgcgtttgttggattgcgtttttcgcggttagtttttgagttcgcgttcgggattgttcgcgttacgttttttttttcgttgttttttttttcgtttgtttttttaggagcgattattttgcggttttttcgtttgtacgcgatagtttttaaggttttcgcgtttcgttgttttggagttttacgtattaggcggcgcggtagttttttagggtcgcgcgttttgttagtttttttcgcggtgtaagtgtttcggtggtttcgggttcgcgtttttagtagtatcgttttagggtttatatgtgttagatattaaaattttatttttcgttgtttcggggtcgcgttttacgcg

SEQ ID NO: 6690 - DNA, 2885 bp, Artificial Sequence
  Description of Artificial Sequence: Synthetic polynucleotide
acgttgtagataggcgcgttgtagggcggcggttttttttttttggtattatcgatagtcgaggaaattgggttaataaagtcggatattgcggcggggtcgcggggcgtaaatcggcgcggatagatgggttttcgggggtattttgttcggttttttggatttcggatggtggtagagttgggagttgcgtaggacgggtattgcgtagcgtattttcgtttatattcggcggggtacggggttcgtagtagtttatttattcgtagttcggttttttttttcggaagggagaggggatcggtggggagggggtttgttggatattagggttagacggggtttttttttgatcgttagggttaagtagggcgcgggttgtgaggatttttttttacgtagtttttcgaggtagagggttcgtaaagcggtttttatttaattttatttcgcggacgttttaggtagcggatggcggcgggggggggaggttaggggatatttaggggataaattttttagatttcgaggtagtcggcgacggcgtttaatttttaaataaatagaataaatttttatttggaaaaggtttttttcggggtttttttgcgttcgcggtttagtttttttgtagacggttatcgtgggtttttcgtagggttgcggagtttcggagttatcgaggtgggaggtgtcggttacgcgcgtttttaggaatagagtattgttttgtagtttagtacgaagggtcggttggagcgggagcgcgaggtttattgtaagaggattaggagttagtaagttcggttttttttcgtttttatttttcgtgcgttcggggttaggatcgtttgttcggaatttgattagtgttcgttttcgtcgtggttttgggatttcgcggtggtttttttttggggacgaacggtagtgttcgaaggatgttttatttattttcgtttttagatttgttgggtttcgataatatttagtgggtgtcgcgagttttcgggcgtagagtttagcgttcggttttcgagtttaatttcgcgtttcgacggttttggcgtttttcgttgcgttaaattgtttatcgcgtataggttggaagcgaagtcgggttttttttttttggtttgtagggtttttttaggttttttttgttcgggtagagagatagttataggggcgatcggaggacgcgtgcgggagggtcgggggttcgcgcggttacggtttttcgtgatagtgtttgtaaagcgcggagggcgtttcggagaaggcggcgtatttgttagggtagggttttagggcggcgtttgcggagaaggggtatatagtggtttggtcgaagggcgttaagggcgcggcgtttacgggcgcggttaggttttggttttggttgaggaaggttattaggcgtcgtatttcgtttagggtttgcgtttgtatgaggatatagtttttggcgagtagtagcgtggcgattttggagagtttgcgtatcgacgggttgtgcgcgtaggggatgacggttcgtagttcgtttagcgcgtcgtttaggtcgtgtatgcgtcgtcgttcgcgcgcgttgatgttgagtcgtagagatcgttgttttcgcggtcgtcgtcgttcgttcgtcgcgttttttggttcgcgtcgtcgtcgtcgttgttcgaaggcgtcgttttcgttttcgttttgttcgtcgttgtttttcgtcgtttgagttggggcgcgaggtgtaggcgtcgcggggaggtcgtcgttcgggttcggagtgtcgtagtcgcgggtcgtttcgggttttcgcgtcgtttcgtaggcgagattcgtagtcgtcgtcgcgtagtcgtggtttagtgttaggtacgcgtttttcgatagcgatttgagttcggttatggtcgcgtcgtttgggttcgggggttcgtcgggtgggcggatgtttatgtgggtgagtagttttcgaggtcggttcgagttcgtcgttgtcgttgtcgttgcgatgaggttttcggttttgcgcgtcggtttggtttgtttgcgggttttagagtttcggcgttcgttgtttttttcgtttttttttttttttttatttttttttttttttagtcgcgacgcgtagggggcgggttttatttttttttcgttttcgtttcggttttaagtcgcggaggcgttcggtgggatttcgttgttgtttaattaggggggatcgggtgagtttttttttttggagtcgggttttattagcgtcgtaggtttataggtcgggggtgggggttttggatcgaggggcggcgcggggcggcgcggggcggcgcgcgcggttttggagcgttagtatttgtttttcgatttttcggtcgtcgttttcggtcgtttcggggatttcgttattaaacgtacgcgttttaggtgggtattcgtttcggttcgtttttgagtttgattttagcgtaagagtttttggcgatacgtaggggttagagcgggggggcgcgtcgtaatagtagtagcgttagcgttaatattttgtttcgttgaggggtcgtttcgggtcggggttagggtcgtgggcgttttggtgtagtcgcggcgtagcgtgtattcggagttcgtatattttttgttcggggcgttttgtggttaggtttgaggggtagagtgagagggagtttttagaatttgttgaaaaacgttacgagcgttgtaggtcggggagggcgggaaggtggagggtagcgcggtttggggtttttcgggggtgggaggggagttttgtgagttgtaggatcgttttttttttgttagtcgttttttgggtatttattagcgaaacgcgtgaggtttggtgggttttttcggagttttcg

SEQ ID NO: 6691 - DNA, 1460 bp, Artificial Sequence
  Description of Artificial Sequence: Synthetic polynucleotide
acgcgtatgagagagtagagcggtagcgacgcggtcggatcggtcgcgggggttgcgggaggaagcgttgtagggattcgggcggcgtcggcggtttagtcggagatgtacgcgttgtaatagatcgcgttgttggcgttcgatagcgcggagattaggttgtttttttttgggtaggatatggcgcgcgggtttagtttggttagtgttacgtggtacgggagttcgggggcgtcgggtcgagttcggttgtagttgaggtattggtcgaattcggtgaggtttacgtcggtttatagatcggcggcgggttttagcggttcggcgttttttagcggcggggtttcgggcggcggcgatagcgggtcggggtacgggtcgggcgtgtttagggtgtcgtagtataggttagcgagcggcgtcgcggggggcgcggttttgagcgttttcgttaggggagtttcgtagtaatcgtcggggtttcgcgataattcggtgggcgcgtagggcgcgcggaagggtcgtagcgcgtagttttcgggcgtcgcgggcggtgggaagaaggtagtttcgtcgggttttaggtcgtttagaggcgagcgttcgggcgtgggtagttttaggtcgtcgaattcggcgtttagcgggggtagttcgcggaaggcgcgagtcgagttagacgtcgcggggaaaggttcgggcggtggttgcgggggcgttaatttcgggagtaggaggtcgggttttagtcgtcgggttttgcgcgtttgttttttgcggcgcggtcggtatttgtagttggggtggtcgcgtaagtgttgtacgcgtagtcgttcggttttttttacgaagggtcgttttttcgtcgcgtttagttttttttacgttttgtttgcgggtcgtgggcgttagtgagtggaacgtcgtcgggcgggtgggcgtcgagtttttcgtgcgttcgggacgtttcgcgagggtttggcgtagttttcgtatttcgcggttcgggatttttgtttttttcgttttatttcggttcgagtttttttcgtttttttttttttttttgtcgttttttcgtcgtttatttagtattttgttgagtatcgcgttgtgtaggttcgggttttgttgagttagtcgtttgcgttcgttttttgtttatattatgaaggcgtttatgggtcgtcggatgcgcgattcgtttgtcgtttggcgtttttcgcggtcggtcgggttgaggttatagcgtttcggttcggggttgcgcgggggattgcgttgcgggttgggcggcgaggcgggcgcggcgggcgcggcgagggcggcggggtcggcggcgaggtcgcgcgtgttagcggcggtttcgtgtttcggggtttatgtatagtcgcggcgggcgggcgggtcgttttgtgcgtcgtagtcgggcggcgatttttgtattttagttgggcgcg

SEQ ID NO: 6692 - DNA, 1560 bp, Artificial Sequence
  Description of Artificial Sequence: Synthetic polynucleotide
acgttttgtagtgtcgggttttgcggcgattattgagttttttcgttttcgtttttagttttttcgttttcgttttcggttttcgtttttttagtcggtcggggttcgtcgtttacgatttcgtacgtgtcgtcgacgtcgttttgtcgatttcgtcgtaggaggtggaattgtagtggtgtcggcggttttttttttggggcggcggtggcgaggcgttcgttggcggcgggtagcggttggatgaaatacgttttttttagtaggtagaaggcgtcgcgtacgttttcgtagaggttgagggcggtagtcgagttgggatcgttatttacggtgtcggagtagaagtagtgcgttaggtcggttttcggaagcggcgtttcggattcggatttgcgttttacgttttggagcgtgaagtcgggcgttaaaaagttgttgtcgggtcgtagttttagatttagttgttggttaaaggcgtgtaggcggaggcgcgtggtttcgtgtttcggggcgcgttttagtttcggtattattagtttttcgtttttttcggaggggcgttcgagtgcgttcgatacggttagtagcgtcgcggcgagtagtagtagcgtgggtattggtttaaagtttcgagatttcggagttcgtttcgcgttttttatgtcgttgtttagtttgcgtttttcgaatttttcgggtatagttcgttgtattggagttttaggagatatcgttcgtagtagcgtacggagcgagggatttttagttcgggtcgggagagtaaagtttcgttggtttgttttggattgttaaaattaataatttttattattcgttggaagggcgcgtagagtcggttatagtcgaagttttcggagttattaaaaggaggcgttgtagttttgtcggcgcgcgggaagttttttttttagcgtaaagttggagatattgagaggtaggcgtaggtagagtggttttgttgggataagaagcgttttggggcgttttcggggttgaggtaacgcggagattggtgtttggcgttttttttcggttttcgttttggttgcgatgttgtttattttgtttagggttttttttttttcgttcggtagcgtattttggttttgtaatagtttttggttcggagtcgttttttagcgagtgtaagaatcgggtagtcgagcggtttttttatagtggattagtgaaatttttatttttattttattttttttttttggtttttttttattttaaagacgtcgttttcggtttcgttggtgttaaatcgcgtttcgcgttgcgggttcgggagggggagggggtagttttcgcgttggttttacgttattgttcgttaatttaggggcggaaggggcgttgtgattagtattttgtattgttggggtcgttttagggagaagatttttttttttatcgtttttttttttcgtcggttttttggattattttttttttttatcgttcggttgcggtaatttagttatcgcgttgggttgcggtttttaggagggagggttcggttggagaacg

SEQ ID NO: 6693 - DNA, 5118 bp, Artificial Sequence
  Description of Artificial Sequence: Synthetic polynucleotide
tcggtgtcgggagttttgtttttcgtcgttatttttggttagttttgcgtaagaacgtcgttttgtttggtagttaggtcgagacgtagtttgaatgtgagtaggaattcggagaagggaagggagagaattagaaagaaggttcgggagggattcgggaagtagtgggaggtttgcgttttggagtttcgcgagagttcgtcggtttggtacgggtttttttcgggtcgttcggcggtttaataaaggtcggtttcgatacgtattcggttttttgtgggagagaaatataaagaagagggaaaaatacggaggaggttaatagtattaggacgcgggggttaattaggaattttcggagtcggggtttattagtttttgtaaatgagtattttattttttaggaaggggttttagttgcgcgcgttggtgggaatcgtagtgtttgggattcgtttaggtcgtttatttcgggcgtcgggcgtaggattcggataagttttggggacgtttttaggacgtattagggtaagtttgggtatcgggatttaatttttagttatttttgggacggggtggggaggtataggagatatatcgagaggtatttagtattcgattggtattagggttaagggagtttaggggcgatatagattttttcgattttttaagttatttcggcgacgggaggatgttgagggaagtttgttaggtgaagaaggggttagtagtagtatagagttttcgattttgttttttaggttttagattcgcgttatgttaagacgggtttttcgatttttatttttgatttttaattttagttattggatcgagcgcgtaaagaatttgagatcgtttgtttttatcgtcgtaagtcggtcgtaggatagatattagtgggtagtaataaaaaaagaaatcgggtttcgggatacgtgtcggcggttggattaattttagcggttgtaattaaggagcgcgtacgttgcgtttgttggtgtttattagttatattggtaggcgtataatttcgcgtttcgattggtggttttatagcgcgtattatatatggtttcgttgttgttggcggggtaggttcgaaggaggtatttataaatgttcgagttttttttgatttttattttttcgttttttgcgtcgttcgagtgatagattttattaattgaacggttatgggttatttttgtaatcgttggacgatataatattacgttttagttttttatgttttaaatatatatttaacggatggttgtagagttagttgggaaatacgcggattgaaaaataatgttttagaaggtacgagattggggcgaaggcgagagcgggttgggtttttagcggagatcgtagagggagatatattttagaattaggggtaataacgtgggtttttttttgtatttgtttattttgtaattttgttatttgaagattaattatttattatgttaatttgtttgtttgtttttaaaatcgtatttgtatagtaaaagttttttaataacggaagtaattcgacgttttttatattttttaggagattgtgtgcgtgtgtgttcgcgcgtgcgtttatagtgttaagtgttagtattcgagatttgtagaaataaatgtttgaattcgaaatgtatgggtgtgagaaatttagttcggggaagagattagggattgggggagataggtggttgtttgtattataaggaatcgttaacgttagtatttgtagtttaagtagggttgttttgtaaaggtttagtaattttttttgtaggtttgttgtatacggtttttggttttttttatttgtaaaatgggtgaatgtattcgtattttagttattttcgtgaggtgtttttttagttcgggtttaattttttatcgttaagagtttttaggttttagagttagtttgtaatcggtaaaatatgttttaacgcggtcgcgagtggttttatttcgttgtttggtttatagcgtggagaagttttgtttaggtttgaaatttttttttgtagttttagaaagtaggcgattgggacggaaggttttttgttaattttttatagcggagttttgtttggattatagatgttagcgttgtttttgttttaaggcgtgtggtgattataaagacgatattgaaaatatttattattattcggtttttttgttaataaatggaggggtgtttaattataggtacgattttgtttttgtgttagcgcggttatcgtgcggaaataattcgtttttgtatttatattatttttaatttaaaggagagttgtgaatttttttaaaatatttttttggagttcgttttttttttttttgttcgttttttattttttaagtttttgtttttagttgggggcgttatcggttgtcgtcggagttgtagttacggttattttttagacgcgcgagtagagtattaagatagtggggattttgtgtttgggtatcgtttatatttggggcgttaaatgtttacgtgttgatgaaattagtgagatgggaataggcggcgggaaattagatagaggaagagttagggaggagattttagtttcggattttgggtcgttagggtttttcgcgcgtattttaaaaggtgcggttgcgtggggtattaggttagtttgttagattttgtagagtttttaaattattttattttttaatttgattttgtggtggtcgtattttttatagaaatttgattacgtttttttttttttttggttttaagcgcgtttagttttttttttattttttttgagtcgttttttttttttttttcgttttttcgggttttttttttagtttttttttaagaatttttcggttacgggcgtttattggttgtgcgtagggaggaggcgtgtgttcggtttggcgagttttattgagcggaattagttcggatgatattagttttttagtttttcggcgggtttagtttattggcgaggtagtttttttaggatacgtatattgtttttcgttttcgttttcgttatcgttgtcgtcgtcgtcgttgttatcgggttataaaaatcggtcgagtttttaaaggtgcggatgtttattatagatcgacgcgatattagcgttcggtgttaggtttttttttgaggtttttcggagcgagttttttaaatcgtatttagagtaagtgttttcgttttatagtagtcgtagtttagattttagggatagattttttttaattcggttgtgatttagaatgtttcgatatagggggtttggatttttattttgcgggttatttttttagagcgattttgtttttttgttttttttatatttatcgttgtattttttttattaaaagcgagaagtcggagcgataatagttttttttgtttaagttttagttagttggtgagtttttcgtggtttttagatgtagtatatggattttgggtttcgcgtcggttttgggtgtatgtgcgtgtgcgtgtgtttgttgcgtggtgtcgatggagataaggtggattcgtttgaggaattaaattattagttttttatttagatttttattttttttaaagaaaggtttttattttttattcgtttattttagttcgggggtttagtttttttatatttaattgaaagttcgaagtttttagaatgttattcgtatttcgagggttattaacgttttttgaaataatttgttgtatgagagtagaggggagatagagagagtttaattataggtattcgcgtgtagttaaaaggagggttagagatagtagcgagggggacgaggagttacgggttatttgtgtcgggatttcgcgttgtggtattgcggtgtaggcgggagtagtttttttgttttttattgatttatttttttttttttttttttttttttttttttattttttttttttttttttttttttttggaagttttcgggttcgagggaaggaggattttgcgaaagttgcgacgattatttttttttggggttatggattcggacgttagtttggtgtttagtcgttcgtcgtcgttagagttcgatgatttttttttgtcggttcggagtaagggtagtagcggtagcgtttttattgggggtatcgtgttttcgtttatttcgagtgattgttcgtcggagttgagcgtcgagttgcgcggcgttatgggttttgcgggcgcgtattttggggataagttaggaggtagtggttttaagttattttcgtttagtatttcgtcgtttacgtcgtcggcggttgcgtcgtttattaagaaggataagaagtaaatgatagagtcggagttgtagtagttgcgttttaagattaatagtcgcgagcgtaagcgtatgtacgattttaatatcgttatggatggttttcgcgaggttatgtcgtacgtatacggtttttcggtgcgtaagttttttaagatcgttacgttgttgttggcgcgtaattatatttttatgtttattaattcgttggaggagatgaagcgattggtgagcgagatttacgggggttattacgttggtttttattcgtcggtttgcggcggtttggcgtatttcgcgtttttgttcgtcgttatcgcgtattcggtagtagtagcgtacgtcgtatattatttcgcggtgtattattttattttgtcgttcgtcgtcgtagcggttgttgtcgtcgttgtagtcgcggttgtgtttagcgtttttttgttcggattcgggttgtcgtcggtcggttttattcgtttatcgtacggtttatttaagttttcgtttgttgtcgcggtcgtttcgttggggggcgggggcggcggtagtggggcgagcgggggtttttagtattggggcggtatgttttgtttttgtagtatgtgttaggtgtcgtcgtcgtattattacgtgtcggttatgggcgtcggtagtttgtcgcgttttattttcgacgttaagtgagtcgattggcgtcggcgcgttttggcgataggggagttaggggtcgcggggaagcgaggattggtttgcgttgggttcgggagttttgtcgcgaggaggggcg

SEQ ID NO: 6694 - DNA, 1423 bp, Artificial Sequence
  Description of Artificial Sequence: Synthetic polynucleotide
tcgtattcgattgtacgcgtttttttgggatttcgtattggcgagtcgtttttttcggcgttggacgttttatttgtttcggcgtcgtcggaagagttttgtagagtgagtttttagggttatttcgttgttttttttttcgttttcgtagtcgttgtagttagcgtgggagtcgggtaggtcgcgtggggcgttggatttatcgagaggttagcgtcgtcgtcgggggagggcgtgtttcgtacgtgtgtgttcgcgcgtgttcgcgttcgcgtgtgttagcgcgcgtgttttggtcgtgcgcgtcgagtcgggtcgtattaattttttcggcgtcgacgggtttagtttatggtgtgggcgtcgggtttagggaggtttcggttttcgttaatcgcggagtagggcggtcgtttcgacgcgcgatttgcgaattcggagtgcgcgtcgggggcggggtagggacgcgtgggcgggaatgtacgcgcgtggttaggtgcgcgtgggtgcgagcgcgcgggagttttcgagtgcgcgcgtgttcgtgtgcgcgtgggtgtgggtgtgttcgcgtgttcgtgcgcgcgttttcggggttaagagcgcgggtcgcgcgggtaggtttggatattacgcgttttgttcgggtttaggacgcggttggcggtttcgggaggaagaggaggaggaagaggaggaggcggaggaggaggaagaggaggagggaggcggaggagtagaggttgggacggtcggaggagagagttcggttttagtaggaaaggaatttagtacgcgattattggaggggcgaggagtaagggaaggattagaggggaggagagggggttaggggagggaaagtgtgggagggggagtcgcgggggtgcgcgttttttttaattcggggtcgtttttagcgagaagtgatatttttttagttttattgaaaatcgttgtaaatattgaaaatagtaaaagtgaaaacggttgcgatattaagacgtttataaaatgatcgcggattgttttcgatgttgatgagaattgggacgacgtcgcgtagagcgttcggagggagaggcgcggtgttcgggatttcggtcgtggggaggagtcggatatagtcgtcgggacgcggggatgtcgagggtatcgcggtttggtttgatcgacgtacgcggtgatagtcgtttttgggagacgacggcgtttgtaattagtagtttttaaagggtgtagttaggaggtttagtttgttcgttttcggggttcggggttaagttttttttagaagttttcgtttttacgcgaatttcgatcgtaaaatttagtttatttgagcgtcgtttttttttttttatgtttttcgggggtcgttacgatcgtttcggagcgatttttaggaatttgtttcgtagcg

SEQ ID NO: 6695 - DNA, 1384 bp, Artificial Sequence
  Description of Artificial Sequence: Synthetic polynucleotide
gcgtcgcgtatagaaaaggaaattttatttcgtttgttaagggtagggtcgggttagtggtaggagaaggttagttgcgggcgtaggtaggagcggatttaggagtcgcgtcggggcgtagagtcggacgtttcgaggagtttgcgcgtcgcgttattcggcggaagtcgcggtttatgcggggttttttaggtttatttaacgtttcgtaggcgtggttggtaggaggggttcggtcgtgtttagcgtttttagacgtagttttttttgtcgtagtcgtcggtggtcgtgggtcgtcgcggcgttgagtattttacggggaagttgaggtcgggacggtcggtgtagatttaggcgtcgtagtataagaggtagtcgtttattatgagtagcgcggtggtcgtttagtcgatgtatagcgttgcgtttagttcgtatttttgcgatacgggtatagacgggtcgtaaaattcgcggacgataatgttggcgaattagtagagtggtacgagcgttagtagttcgtaaaataggtagagtacgtttttcgtgagggttatacgcgttttggtcgggttcggggttacgtaggtggtgtattgcgcgttcgttagggttacgaagagcgtaacgaacgttagtagtacggcgtttacggtgagcgttcgcgtcgtttgtatttcggtgtttagagttagtatcgagtcgtatattttgtattgtatgtgttcggtgttttgtattacgtacgatatttatagttttttttaggtggtttgcgtcgttacgatgttgtggtttaggaaggcggttatttgttatatgggtagttcgtacgttaggattagatttttttagtttattaggtatagtattaggtttaggatttttaacgttgcggattttatggttagaggcgagacgcgtattcgaaggttcgtagaatttttaaggtcgtgttgcgcggcgttttgggcgggttttggtgtttttgcgttcgcgttttcggtttttggttttagttcgtttgtttcgcgggtttgtcgtattttttgggtttgttagtttttgtcggggggtattttttttgaaggttcgggggcggattttgtttttcgggttcggtttttcggttcgaagtagttaattcgtgcgcgggttatcgtgtcgtagttaattatagagtttttggtagttgaagttagggaaataacggtttttgaggggtagttgagggcgcgggatcgtttttcgttcggtagtcgtttttagttttattcgtcgttgttttagtcgcggtcgagcgtattttgggttggtttagggcgcgttttttgggtcgtttttttgcgcgtttcggtttcgttattttagaaggcgttcg

SEQ ID NO: 6696 - DNA, 1361 bp, Artificial Sequence
  Description of Artificial Sequence: Synthetic polynucleotide
gcgttttcgattttcgtcgttgggatttttcgtcgtagtttttgttttagtttgtgttgcgggtggggtcgggttgagtagttcggcgttttttatcgcgttttttatcgtatcgttttcgatttaatttcgttttcgggcgtttattggtttgtagtattttttttttagtttgtgaagtgagtagggggaggcggtggtcggtcgtttttttttagcgtttagtttggtttcgcggcggaggcggcgtttttttcgtaggacggagttaagttggattgtcgcgtcgcgcggggcgggtaaagggggcgttgcgttcggtttcgggtagggagtgacggcggcggcggcggtttcgggcgagcgtggttttcgcgtgcgtatacgtatacgtcgtcgcgtagggatatacggatttcggtcgttagtcggttatataggcgcggagattcggttcggcgcgcgtttttcggcgtatacgttttttattttcgcgtcgcgcgggtcgcggatttgtaggttgcgcgttttttgcggagtttgtttcggttttacggataggtttcgtagtgagtaggtaagggtcgtttcgtcgcggttgtttttttacgtttcggtcgttttttttttttttagaattttcgtttagtcgggatttcggatttttttttttggtttggcggttttcgttagtcgcgatttttatcgacggagagcgggcgagggtcggcgttaggtaagttttttagatttgaaatgaagttttttttcgtcgttgcgttttttttgcgcgttaggttgatattttttaatttaagtgtttggcgttgcgttcggggcggtcgatcgtcgtagattgtcggggtgggggtcgatttagttattttacgttttttttgatgcggagaagggagattaggggggtaggtaagttatgcggtcggagggattcggagggatatgtttttttatttttaggtggacggacgtatttacgcggatcgggaaggtagggttggagggtttttcggggttaggtatcgtaattcgtacggggtttgaggggtgggtaagtaatgtgttaggtgggggttggggtaggggttagtgtagaatgtttttttgtggtgatatattcgggattgtttaaaagagtgtcgttttcgtttttcgtggcgcggaggggttggggttggggatgttagggttttagtggtttttagaagaaacgttttgcggggtttgtggggaaacgtatcggtttttttaggttgaagtgggttcgttgagatttttgtttgtcgttttagaggtagaagtttttgcggcggttgcggggggcggaggttatattttcggcg

SEQ ID NO: 6697 - DNA, 1175 bp, Artificial Sequence
  Description of Artificial Sequence: Synthetic polynucleotide
acgttgtttggtcggagcgttttataattcggttaatggggagggagtcgttcgttaagcgtttgttaggtttcgattaacgggatgggtttttttcgttagagtatattgttttaatttaggagcggttgtaggatttgagttaatgagacgtaattttcgttagtcgcgcggtgttcggttaataggaggtcgttcgtgttcggtagcgtgggaggtgtggggtggcgggcggcgttgcgaagttgagggagttgcgcgcggacgagttatagtttgttatagggtgggtgcgttcgttttgtttagttcgttcgtcgtttttcggttttttttgcgcggcggtttttggatgggggttttttttcggggggttttaggcgcgggtaagtcggtcgtcgtttttttaggtttcggggtttcggtcgttgggggcgcgcgggcgggcgaggttggcggtacggagcgtttggttttttgtgggggcgtcggtttttttttggggttttgcgcgtttagggttatttcggcgcggtttaggttgcgagttttgtcgcgtacgttagcggttaatatggaggtagtttcggcgcgtttcgcgggggatcgtcggcgttcgtgggttttaagaggtcggggcgcggcgcgcgttcgggttttgggcggcgagggcgtagcgagggttgtcgttttttcgggtagtttcggggggcgcggcgttgggtcgcgggttcgggggttgtcgtgttcgatcgtatgcgtcgatttgtcgttgggcgttcgtttttttttgttggggttgggcgcggtttcggagtttggcggcggtggtgagggcgtacggttagttgtagcggcgttgtgtttgtcgtggatttaggatattttaggtttggtggcggggttaggtggcggcggttttttgcgttcgggcgatggcgatagcgataggtttttaatttcgtttcgggttcgggtcggtcgggtttcgcgtcgggttacgcgcgcgtatagagttttttcgggtttttttacgttggacgtcgatcgttcgttgtcggaggacgcggggaggggtatcgttttttcggcggaggttggcgtggttaagggtataggggacggcgtcggcgtttcggtagggatagtggggatttcggggtttcggtttttcg

SEQ ID NO: 6698 - DNA, 1087 bp, Artificial Sequence
  Description of Artificial Sequence: Synthetic polynucleotide
tcggtattcgcgtttttgtgtttttggtggtttcggcgttttttcggagcgcgcggtatgtttgtttttatacgtttagtatttttgtttttagagtaaatttattttttagggtatacgtagaggggtagttaggtatcgtttttattttgttttatttaggtcgcgcgtatttcggaaatttggatttcgcgattagtttttttttgttttttttcgaggattttagcggtagtgtgttttggatttatttgtagtttttaagtttttttatttttgcgttttttttaggcgtttttgagtttgtagagtttacgatttttaataggttgtttcgaagtgtttttttttatatcgttttaggaatgatttttttatattcgtttttcgtaaaaaaaagttggtttaagatttaggcgttttaaggattagtttaggtttttattcgacgcgggttagggggtgttgttttggtagtttcggagtttcggtaaagagtaatttgtagggaggcgttacgcgcggtttttattattcgttagagattcggtttatggggttaaacggaggggtttgtgtcggtcgatattttaagttttgtcgcgtttttttcgtcgtttatcgtatgggatcggcggaggagaaggcgcggtcgcgggttttttgaggtagcgtgtttcgtttcgggaggaaagtttgtgttatatagaggaggcggcgcggggaggatttgggcgtcggtgggtggaggcgtgggcggtggcgtcgcgtggtcgtgtgtttgttttttcggcgatcggtgcgtttgtttttcgtcggagttcgcggtcgtcgcgttttcgttcgttgcgtttagcgttcggcgcgtttcggttttagtttcgacgcgttttcgtcgtcgtcgtcgcgcgttcgtcggttatattttttttttttttgaatttatgtgtaaaatatgttacgttgtatttttagggaaagtttcgcggtttttgatagtagtcgttggagcggtgggttcgtttagtttttttcgcgttttttcggagtttcgttcggttatttttacgcggtcgagttgtaagcg

SEQ ID NO: 6699 - DNA, 693 bp, Artificial Sequence
  Description of Artificial Sequence: Synthetic polynucleotide
tcggtagttaacgtttagttttcgttttttttttttatttcggatttcgtaatcgcgaggcgagagagtagcgtcggcgaggtattggttgggttttgattgttacgttaattttttgttgttttttttagtttttagtcgtttcgtttttttttttttatttttagtttgggtttggaggcgatttttttttattgattgagtcgattgtatttttgggtaagcggcgttttgttttttttttgtttttgtttgttttttttgtaaggttacggcgtttggagtagggtttgtagcggtcgtcgtagtaacgcgagttaagtcgtgtttcgtacggtcgttcggggtcgtattttcgttcggtggcggcgttcgaagacgttagtcgcgttacgtattgtttgcgtttcgcgttttagtcgtcgcgtattaacgtcgtcgttttcgtcgggagttaagttcgtcgggtcggttcggttttaggtgggtagttcggtttgtagttggttggaggtggcggtcgttgtagttttggtagcgggtatatttttaagtatacgtatttaacgttttttttttgagttacgaggatggagtagttatttcggttcgggattggcgtaaggtaaggtgtagtcgtttgttgtttttcgtagagcgcgggattatttttttgttcgggtatttaggtcg

SEQ ID NO: 6700 - DNA, 5065 bp, Artificial Sequence; identical to SEQ ID NO: 6668
  Description of Artificial Sequence: Synthetic polynucleotide

SEQ ID NO: 6701 - DNA, 307 bp, Artificial Sequence
  Description of Artificial Sequence: Synthetic polynucleotide
gcgcgggggtcggattatgagtcgttgagtcgggtaaattttaggttatcgagttagcggattttcggagcgtagttttgcgtcgcggagtaggttttaattaggcggcgaggcggttatacgtatcgagttagcgattttcgggcgacgcgcggggttagggagcgttacgatggaggcgttaatggttcggggcgcgtttacgggttttttgagggcgttttgttttttgggttgtttgttgagttacgtcgtcgtcgcgtcgtcgtttattattaagtttttcggcgatgtcgtttttaaaacg

SEQ ID NO: 6702 - DNA, 1563 bp, Artificial Sequence
  Description of Artificial Sequence: Synthetic polynucleotide
tcgggtttcgaaaacggggggagggggacgacgttttagaggtttttgagtttttggtttttttcgattttaagggtttttttttttcggtttttaggcggcgacggcgggtagcgcgaagtagtaggcgtaggggcgttgggatggggatgtttttgtaggtttaaggttttttttgggagtttaaataaagattacggtagcgtcgttttttttttcgggaattcgacgtcgcgcggttatagggggtttggaggggcgggtagggtttcgtagcgtatttagtatagttcgcgcggcggagcgggtgagaagtcggcgggggcgcggatcgatcggggtgttttttaggtttcgcgtcgcggttttcgttcgttttttcgttcgtttatcgggtattttagtcgcgtagaaggcggaagttacgcgcgagggatcgcggttcgttcgggattagttttaggttcggtatcgtttcgcgggtcgagcgtttatattcgttaaatttacgcgggtacgttttcgcggcgtatcgtttttagttcggttttcgtttttgtagtcgcgggtacgcggaggggtttttggttgttcgtatttgtattcgcgcgtcggcggcgtcgaagtttcgtttttcgtttgcgcgtttgtttcgttcgtattttcgcggtgagtcggcggcgttttcgtttttgagtttagggttagtttttttcgtcgtcgcggttgttgcgcgcgttttcgtttagtttagtttagtttcgagtacgattttagttttacgtacgattttagtttcgcgagtttcgtatcgattcgttttcgttttatttcgttttcgcgggggcggcgttttttttttttcgcggttttcgtttttttttttcgttttttcggtcgcgttggggatttttagtcgtcgttcgcgattttttatcgcgacgttcggaggcggcggggtttttttgttcgggcggcgggtacgggggattattttttacggtgttatcgtatttatttcgcgtttttttttcgttttttggagtttatcgggattaggtggcggcgggtgtttttttgggggtgcgcggttatgtaattggtggatttttttaaatcgttttggaggggggagcgcggcgttgggggcgggagagcgtttttggttgtgagttgtttttgtcgtttcgtttcgcgtttttttgtcgtttcgtttcgggtttttcgcgttttttttttcggttcggtcgagcgcgttgtttcgacgtcgttatttagagtcgggtcgcgtcgggcgtcgagatgaaggtgttgggatatcggttggagttgtttataggtatcgttcgtttgtttcgtagtcggtcgttatttttcgagttggagcggatttcgggcgcggcggtcggggattggggcggttcgggtttgagtaggaaggggtgcggattttaattaagttttagttttgtgttatttgtttgtgtgcggagtttagtttcgggagaggatttgaggttgtggcgagtttttggcgttggcgttcgggttgcgggagtatcg

SEQ ID NO: 6703 - DNA, 512 bp, Artificial Sequence
  Description of Artificial Sequence: Synthetic polynucleotide
tcggtttaagttagcgtatttcgtcgattttttgtttagtttaaatttcgaggttgggtaaggtattggatttacggttggatcgattcggggtagtttttgggtgaatagtagcgtgttcgtcggtagagaatcgagattagcgagtcgattatgcggttgtatagattttacgcgcggtcgagcgcggtggtttgtgggtttttgttgttttttttttagggttattatgaggttttcgcggaggggtgatagggatcgggtttagatttgttaaatgttgcggaggtagaatttgatagtgcgggagggtaggcgtttgggaggtaggagttggtggagatgatagcgtggaattcgtgagttttacgtaacgtttttttgtcgtttagggtgggtttttagaagtatagaaatggtcgggttgcgggatattatagcgaggaattagcggagtataggggttttaggagcgtcgggatatgttaggtcgggtagatagtttcgggtcg

SEQ ID NO: 6704 - DNA, 1070 bp, Artificial Sequence
  Description of Artificial Sequence: Synthetic polynucleotide
tcgcgagaagtataaaaggggaggggcgggtcgtgtagttaagaggacggttaaacggggaggttttttttttgttttcgtagatgttggagtagcgattggttcgggagattcgtgttttggagagaagtaaggagtagttgttttcggagagtgagtttttcgcgttaggtgggcggggggagggggatgtgttcgggtttcggttttgtttttgacgttcgtttatcgatagggaggttggtgcgcgttaagttgcgggaggtggagcggcggttgtattcgtcgtttgaggtcgagggcgttatggcggtgaatgacgggtgagaggggaagggaggagtgggcgaggagggtaggggtagggcggaggggaattcgtttaggtttttcgtttcgttttcgattgtcgttttttcggtttgtgtttttttcggcgtcgtcgggttttcgcgtttcggtggtttttttttcgttttttggattttcgtttttttttttttgttttttcggtttttttttcgtaggttgaaggcggagttggagatattcggggagtaggttcggagcgttttcgaggtcggggtcggcgagggagaggtagggagttcgaggaagggaggcggggcgggtagggatcgagttaggagagagcgggcgggggttttgggagcggttttcgagagtggggtttgtggggagtagggcggtttcggggatagaggaagtcgcggtggaggtttagggtagacgcgggcggacgcgaggagcgtaggaatttggttcgtagttttatttagttttcggtaggtcggatttgagttttttcgcgttcgcgacgaggaggatttcgagtcgtcggtggttgtttttgacgttttttaggttagtaggattcgttcgttttcgattttttttcgagattcgttaagaaataaaggcgatgattttcgattatgttcgcgtttttcgcggagtttgtgttatatcgtggagcggggcggggcgtgttgggatttcgaggcggggtttttgtcggattttttttattagtcgagtttcgggcgtcg

SEQ ID NO: 6705 - DNA, 766 bp, Artificial Sequence
  Description of Artificial Sequence: Synthetic polynucleotide
acgaattattatttaattcgttggcgtcgttgttgttgttattggttaaggtcgcggcgatcgacgtatagtagaggtagtatagttggagcgtttgtaagagaaaaggtgatatcgcgcgtgaggggcgcggcggggttggcgtcgggcgttttttgttattcgttttcggagtttcgttcggcggtatttgttttggttacgcgttttagtttcgttaggtttttcggcgggttcgaattcgtagtcgggaaggtatacgcgagtaggagggcgtattttatggttaggtgcggacgcggcggttgcgggtggttagacgcggtaggcggagcgtacgggcggcgcgtatttttttcgcggtttcggagttcggcgttttaggtgcggttttaggtgagagtcgtcgtcgtttatatcgtagcgggggcgcgttgggattttttttttttcggtcgtttgcgcgtttttttttttttcggcgcgggtttgtcgagttgtagtttgcggtattttagagggtacggggggttttttgggtcgggattggagcgtaaacggttgggagattgtcggtgtttgttcgttcgtttgtgcgtttgtttgtgtcggtgtgagcgtttgaggcgatggggaagatagcgttagttggtttttttagcgcgtcggagtcgagcgttcgtttttttatcgcgcggtgattggcgattagcggttttcgggttcgttcgagttttcgggttggtgtaagggcgtgggattttcg

SEQ ID NO: 6706 - DNA, 363 bp, Artificial Sequence; identical to SEQ ID NO: 6479
  Description of Artificial Sequence: Synthetic polynucleotide

SEQ ID NO: 6707 - DNA, 2919 bp, Artificial Sequence
  Description of Artificial Sequence: Synthetic polynucleotide
tcgagtcggattttcgcggagtatttattagggtggttagttggaatcgcgtgttagatttatatgaaaaattcgggagaggacgggttgtcgttgttcgagtcgttttttcggaagtcgttgtttattaatttttcgtatttttttttgtacgcgtttttttcgcgtattagtttggagattttttgtttgaggtggtcgatttgttgtagtagttggttttttttcgattttaggacgtgtttttgttgtatttttttgaagcggtaggattgggtatagtcgcggttttttagggttcgttttttttgttttagtcggattattttttttttgttgatttcgcgtagttgtcggtttagttcgcgtatagatatggttattagttgttcgtcggagaagcggtcgtcgaagtgtaggtcgtcggcggcgtggtgcgggtgtagggcgtttttcgttttcgtcgcgttttcgtcgttttcgtcgtcgtcgtcgtcgtcgtcgtttttagcgttggtcgggttatcgtcgttcgcgtttttagcgttatcggtcgaggcggtcgcgttgttcgcggcgtcgggcgcgtcggtcgtcgggtggtggtggtggtcggcggcgtggtggtggtggtggtggtagtgcgggttcgcgtcgttttgcgcggcggtcgcggcgattacggcggatattacggcggcggcggggtttattttttcgtcgttgtcgtttaaggaggcgtcggtatcggtttcggtcgtcgcggttagttgttgcgtttcgcgcgcgtagttatcgaagtcgttttggagttggtggttgttgttgatgagcgtttcgatcgcgttttcggggttgaagtttagcgtttcggggtttagttgttgcgggtagtcggttatttagtagtagttttttaggtgcgttttttgttcgttgttcgagttcgggttgggcgtcgagaagttgggggaagggggtatcgagttgtacggcgtgtttatgggggtggaggatagcgagttttcggcgatgagacggtcgtattggttgatgatgcggtcggtttttatcggttttttttttattttaaattttattagatcgaagttattaatatattttatggttaggggattggtgggtaggtcggagttgtttattgttagttttgatgttatttttttgtcgtcgtcgtcgtcgtcgtcgtcgtttcgttagatgggttgtaggagaggggttagcgggttgtgttgggtggttagcgggtgagttagtttgtcgggttggggcgtttttagtttgcgcggcggtggttggttcgaaattttcgagcgcgtttatatatatattttttcgttttgttcgcgtttttcgcgttcgtttttttttttttttgtttacgttaatgtgttttttcgttcgtttcggtttttttttgttcgttcgtttttttgcgcgttgagtcggcggttttaggttcgggaagatttttcgcgagttgcggtggcggcggtggtggttgcggcggcgaagttggaggagttcggttcggtgcgcggcgtttttcgttcgtcgtttcgttgcgcgttttgtataaggaagggttcgtttcgtcggttcgggttgtaggtagggcgcgcgcggcgttcgttcggggttggaggcgcggcgggcgtttgttcgggcggcgcgggttttggtacgggggagttaatattttatgtttttcgtttttttttttgtttggttttttttattatttttttttttttttttttttttttcgcgcgttttttatttttgtgtaaagtgtaaggtagaggtgtagttcgattggaggagagggaggggggagtttagtttttttttgtttttttttaaaaaagtaaaatagcgaagttttggggaaagacgaggtagagagtaaaggggggagggggaggttaagtcgataagtagttcgagttatagttagaagatgaaaaaagattttaaagtttttgatttagtaagaagagtttaaagtaattgttgagttttatagtattcgtgacgttaggtttaaatgagaaattgattggtatttcgggttaatgggaggcggcgagagcggtcgcgattagtataatagtatagaaataaggaaatttttcggagttgttaattagggtttaattagttgattgttagttgggacgggttggtttaattttttttgcgtcgttgtttattcgggagggaacgaggttcggcgtaaagtttggtgtaagaggggaaggagtttttttagaggggtttcggtaattcgggcggatttgggagggcggtttgtttttttttggagcgcgagataggttttttattcggagttttagttcgttgggggtttattcggttgggattggtttgattttttttttttgtttgttttttatttttaggattgtgaattcgttttttagtttttttttttcgtattaattttggtatttaggtgtttgtcggggattttttttttttgagtttggtcgtgttcggcgtttaaatttggttttaattttttgttcgtttttcgggcgttcgtgcggggaagggatcgggaagggagggatgtagtggggtgttcggatcggggttgcgggttgggcgtcgttcggttatgcgtttgtttagaaggttgggtattcgtggagagggaaagtttattttatttttttttttataacgaggtaaaataagttgtttagaggttattttttacggagatcggttgttcgttggcgtcgcgtgtttttggatagagcgagcgtttatgcgagataatttcggggaagtttaaagttaggttagtcgggtttagtttttcggtttttgattggtcggagtttggtttttgagatttatattgcgcgttcg

SEQ ID NO: 6708 - DNA, 2267 bp, Artificial Sequence
  Description of Artificial Sequence: Synthetic polynucleotide
tcgaaaaatcggttttcgttttttattttcggtcgattcgttcgtcgaggtggttgttttgggaattttttgtttttcgtttaggagaggaaacgtatattcgggtcggacgtatagaagtcgtattttggttggggttataagtttgatagttatcgataagtttttatttataggagtacgcgacgtgttttttttttaagggaaaggtttttttttttgggttttggaatgggtttgaagttagtcggttttagtttatagggtgaatgaggggtgggtatagttcggtcgcggttttagtatatacgggcggacgtaggggcgggggagcgttagtttcgtagtgtgttcggagtttagcggttttgagtcgtcgttattagtttggtcgttttttgttttacgtaagtgaagttagtcgtttagggttgcgtttttagttatttgtttttttatagaggtttatattttttttttcgttgtttttatagtttggttcggggtttgtttaatatagatggacgttttttaaaggttgtgcgcgttatcgttgttattcggttgtgtcgaggttcgcggtcgttaggattttagggatcgtatgttaggtagggtttaggatttttagcgcggattatttttagtttgcggggtagcgtcggggattcgggtaggagggagaggagtaggagggagttttggatttttttttttagatcggtcgtcgttatttttgttttttttagggtcgttttcggtttttttattttcgggttttcgttacgcgggtcgcggggtttttgttaggaaaatcgggcggttttaggggagttcgcgagatttttagcgttcgggcgcgtcgtttttttcgaagtttcgtcgtagttttcgtaggttaggttttgtttacggggggttgcgtttagttcggatgggtgggcgttgggcgggttggttttattttgtcgtgggtattaattttgaaaacggttcgtgcgttcggcgcggttgcggcgtagattcgggaacggtagtcgcgggcggagtcggggtagagcggcggcggcgcgcggggcggatacggtatttacggtcggggggttcgggggattcggcgggcggcggacggcgtatattcgcgattcggttcgggagtcgttgttttttttagtttggttttcgtttttacgatttaggggcggttgcgcgttgttttttggcgtcgtatcgggtttaggcgcgcggcggggttggggcgcgcggggcggtcgtttgggttatgtcggggattcggtttcggttatttcgcgcgggaataaagcgcgtatttcgttcggggcggttttcggttttcgcggttcgcgtcgggtttagtcgtcgcgtttgtggttttaacgtcgcgcgttcgttcgagagttttacggggtttcgcggttttcgtttcgcgcgtttcgttttcgttttttgtttttcgtcgtcgtcgttgcgttatttgtttttcgttcggcgtttatggcgtttagtttcgtttcggggcgtcggtttggagaggggtttttcgtcgtcgagagtcgtttttaacgttttcgttatcggggcggcgttttaagaattggttgtgggggtcggggttgtgcggagcgtcgggagtagggagaggggagaggggcgcggggagggggcgacgggcgcgtcgttttttgcggggggcggcgcggggaggcgtaggcgggggcgagcgaagaggttgaggggtgcgggcgtcgtggagggggcgcggttttggggggcggttttcgtttgcgtttatttttttttttttcgtaggtcgcgtatatttatttcgtagtagtcggcggtcgcgggtttcgtagttttagaatcgcggtttttggcggtcgcgcgggaggttgaacgggagttggggggtgtggggggggtggggaggtggggagttgggggggaggtcgttttttcggtcgtcgttttcgttttttgtttcgcgttcgtttttagcgcggcgtttggttcggtttggggttattttcgtgcgtggtcggtaggggtcgcgtttttttcgtttagtttttcgggcgggttcgatgcgaagttttcgtttttcgcgggtttcggggttaggttatttgtatatattttgtatttatttgtatatcgtgcgttttatgtttatttgtagaaacgtttcgagtcgttgttttgtttttttcgtattttttttgtcggtaggttttttttttcgttcg

SEQ ID NO: 6709 - DNA, 265 bp, Artificial Sequence
  Description of Artificial Sequence: Synthetic polynucleotide
tcgcggttcgcgtgggttttaggcgcgggatggcggcgtttagtagcgcgggttcgcgtagggcgcgtagcgttgggggtaatagcgtggggttcggtcggtagtggggcgcgggttgcgcggtaagtagtttttcggagtttagtattagttttagtattatgtagggtatttacgaggcggaggttagtaggcgtcgggttcggttaaagtcgttcgtagtttttagtattcgcgttttttgttttatcggtcgtaggttgcg

SEQ ID NO: 6710 - DNA, 374 bp, Artificial Sequence
  Description of Artificial Sequence: Synthetic polynucleotide
tcggggagggtagtcgttcgtttttttcggcgttgggagttttcggttggtattgcgggaggagttttcgggtgattcgcgggttttgaaatcgtcgttcgggagttcggggtttgcgttgcgtttacggggcgagcgagggagaattgacgtttttcgttcggattttttttttttttcgagaattaggtaggtcgcgtttatttttaagttcgattgttttcgcggtaatatttgtgggaaatattacggtggattttgtgggtcgttgagttttttgattttcggtttgttttattttgttttgttagtgggttttgcgttcgcgttaataattcgaatgggtacgtttttgcgttttagaacgttgttcg

SEQ ID NO: 6711 - DNA, 1133 bp, Artificial Sequence
  Description of Artificial Sequence: Synthetic polynucleotide
tcggcgcgggtcgttttcgtttttagttttaatgttgttgcgttttaggtcgtttcgtttttggtaggttttagtttttgatttagtttttcgtttagtttttgagagtagttttttcgcgggattggtttgtgcgcgcgcgtttgcggtatcgtcggattaggggtcgttttcgagcggggagtttaggaggacggttaggtggtttgaggtagaggcgttagggaggatggagaagggatatttagggtttaggcggggtgggggtagggagggcggcgggatagtaaggaagtgggtgtatttgggtgatttagttgcgtatgagcgggtaggggttcggggcgcgcggattttaggcgttggattgcggcgtggagtagcgttggggaaatcgcgtcgggtttagcgaggattgttgggcggggcgcgcgaggagcgaagttggtcgggggcggggtttgagtcgtgtcggggcggggtttagattcgggttggtcgtggtgggcggggtttgagtcgtgaaggggcgggttttgtaggggcggggtttcgaggggcggagtttgcggtgattagcgagggggcggggtttagagttattaagaagcgggatttagtgagggttaaacgtggggcgtcgggggcgtggcgcggggcgtaggtgtacgtaggttggtcgcgggcgcgcggggttcggcgggagtttcggggtggttttcgcgtggggtcgggggcgttcgcgcgggcggggcgaggtcggggagggtagttgttcgtttttttcggtattgggagttttcggttggtattgcgggaggagttttcgggtgattcgcgggttttgaaatcgtcgttcgggagttcggggtttgcgcggcgtttacggggcgagcgagggagaattgacgtttttcgttcggattttttttttttttcgagaattaggtaggtcgcgtttatttttaagttcgattgttttcgcggtaatatttgtgagaaatattacggtggattttgtgggtcgttgagttttttgattttcggtttgttttattttgttttgttagtgggttttgcgttcgcgttaataattcgaatgggtacgtttttgagtttaagaacgttgttcg

SEQ ID NO: 6712 - DNA, 2358 bp, Artificial Sequence
  Description of Artificial Sequence: Synthetic polynucleotide
acgatatttcggtttgttgttatggaaataggggcggattaaggttggagcgtggagcgtagggattaggtttttcggttatttgagttttcgttttagtcgttttcgtagggtcggggtagttagtcgtaggcgtcgcggttttttagttttttggtcgggttaggcgcgggggggatttcggcggggcgttatagtttgttcgggtttgggaggggagaggtagacgtagaggttggaatagttggtggcggggttcgtgggttttcggcgtgattatttgtttttttagggttcgggggacggcgtttcgcgtggtaattacgtgggggcgcggcgggattttttcggtgttcgtattaattttgtcgcgtttcgtatcgggtcgggttgttggggcgtttagttacggtggtcgcgaagttagttgtttttaagttgagttgtgtatcggtcgcgtatattggcggtacggttttcgcgttttttcgtttttagtataatgaaagtttgaggaattggatattaggcgttggtcgttttttatttttagtcgttgggtgtttagagtttatttttagcgattagagtagaattgtagagaagacgttcgcgttcgggtttcgtttggggagttagggcgcgcggggagcgttcgggtcgcgcggttattgatcgttggttgtacgggggcgtcgtgcggattcggtttttataaagcggtagaagtaagggcgtgtgttcgcgtagggaatggaggttgtaagtgtaaaattttattttagtaaagtaaaggttttaggaggtcggttttttttttattatcggtcgtttattttggttttcgattgattttttcgggtcggatttttaggtttggttattcgatttatggagaaaatttcgtgttttataattggtcgttgacgggagttgagttttagtagtagtttttcggcgggtgcgttcggtaaaatttattagttcgtcgggggttattttttagatcgggagtttcggcgtcgggcggcgttcgggttcgcggtttttttcggagcgtatttaattttaatttgtttttgcggttttaatttatttttgcgaagtatgttggttacggggtcgtcgtttcgaggtcggtttaggcgtattttttttcggggtttagatttaaatttttgggcgttagttgtagttaattcgagcgcgtcgaggcgggggtaagtcggggattcgttcgtgttcggtggttcggtttcgtaggggtatggtgagttttagtttcgcgtcgagggtatcggcgttcgtaagtaatcgtggtgttgttcggtagtttcgcgcgtttgtttagtttcggggcgagcggtttgtttcgcggagtcggcggtttgtttttgttattcggagtatttcgtaggcggttttgaggggggacgtcgttttttggtcggtcggtcgtagttttttttttttcgttttttcggattatcgtcgtcgcggttgtagtaaaagggcgttcgtacgtatcgtcgagtttcggggaaagcgttcggcgcgcgtttgtaggatcgagcgatcggcggagcggggcgttttttttttttttttcggtttttttttttttttttttttttttttttttttgttttttagttttttttttttcgtttcgtttttcgttttcgtttacggagcgttttttatataaaatttatgaaagtgtttttagttcgtagtgtcgagcgtcgttttatttttaaggtagtagcgtttagtcgcgcggcgtcgttttttaaggtgtttttattgcgttcgttttcggggaagatgttcggttcgcgttcgtttaggtatttgtttttagtttttaagtcggttttcggattattttacgttttttttcggtttcgtaggttttttggagttcgaattcgtagtttagttttcgttcgttcgtttttcgcggttggaggttatcgggagacgcggttgggacgcgaggatcgtcgtttagagtacggatcgcgagttcgttttttgtttcgttttttttttggttagcgtttttttttttagtttcgacggttttttttcgtattgaatagttttagcgaattcggttgtttcgtatttcgagttttaggatattgttttttcgtggggagaggaggggagtaagtattcggaaagggttagttgtaaattttagggagaaggaaggattcgtgcgggttcgggtgggtcgttttcgtttgggtggggtggcggcggggggtttttgattttttttggtttatatagatttcgtcggggggttcgcggaaaatggaggaggcgtcgtttggaaagcgggtttcg

SEQ ID NO: 6713 - DNA, 1050 bp, Artificial Sequence
  Description of Artificial Sequence: Synthetic polynucleotide
gcgcgcgtttcgggagagttgtgtttttcgcgaaattcgtgcgttttagtttagggttttcgggatcggtgttcgttagtgggtataggacgtcgggtgttcgaagggttgtttggagatgtaattgattttggcgggtattagaatgacgagtggtagtagtaggagcggggtgacgaataagattacgaaggatttgaatttggagatatagtttagcgtcgaggttatcgcgcgggagggagattggcgggcgagacgagtgaggggtagttagaggcgtcgcgggtttaagaaggggttatagttttcggggattggggagggggcggtgataatttcgtttcgtacgggggcgttttttcgcggttttggggcggggttatttttcggggtttgtgggacgcgtttgtttttaattttgttattcggcggcggtgggaggcgtttttggattttaacgtttcgggttagttttttaggggtagtttgggttttagtatttcgcgttgtttaagttttttttgcgttgtcgaggtagaggtgcgtttcggggttgttaagcggggcgtgttttggttattggtgttgttcgttttggcgtaaggcgttttttcgcgttcgtatttgtttttttttgggttttgaagggtttcggatgaaattttttgtaggtttttgggttttttaggtttattttttcgattttttttttttttttatttttttattttcgttttttcggtgttttttcgagaggtgtttttttacgtttcgcgtttttcgtatcgcgggtttcgtttttcggttttttttggttttttcgttacgttcgttttattttaggtgtaggatttttttttttcgttcgtatttttcggttcggagtttttgggcgatcgtatagggaagcgaggttattgtttttttttgttttaggggttgtcgcgttttagtggacgttgtatttcgtagacgttcggcgggtagatgcggatacgcgttttggaggggttttatcgagttttagtagtcgtagttgttcgttcg

SEQ ID NO: 6714 - DNA, 1731 bp, Artificial Sequence
  Description of Artificial Sequence: Synthetic polynucleotide
tcgggttcgtttcgtttatcggtattaggcgaggtttttgtcgtagttgcggtcgaagaagtggggttcggcgtttacggcgcgtacgtcggggtgtacgcgtaggaattttagtagcgttcgcgtgtcgtttttttttatttcgatgatgatggtttgcggtagttgtttgttgttttcgtttaggagtagcgttagggttttcggcggggtttcggttacggtgttttcggtttcggagtcgttcggattttttgataggttaggggatttttttttttaggtcgttttttcgtcgtcgtcgcggggcgcgggcggtcggcgttttcgttattgcggtagttgtaggaggcgttttttttgtgtcgtcgtcggttatatcgttagttttttcgggttttcggttaggacgtcgttattaggggttttcgttttttcgtcgtcgtcggatagttttacgacggggtcggatagggtttggtagcgttcggttaggtagtagaagacgtaaagggacgtgagtagggagtagagtattagtaagaattttcggaagatgttgcgggatagcggttcggtcgaggtggagagggtattggtcgggttcggaggggttattttagtcggaggcgacgtcgggtaacgcgtcggttatgttaggtttggatttcgataggtgttagagtattttttcggcgggttagcgcgttggacggaggttatatcgtcgtgcgtttttgtggtcgtgcgaattgtttcgggaggtagcggtcggggtttcgcggggaaacggaatttcgggggtttcgcgtaggatttttgtttttagtcgagggagcgggaaggggaacgcgggttcgtgtttaagaaattatcgttttagattcgtttaagttttgagtttggggtagttttggtttttcggtttttcgtaagagtcgtcggaatcggggttttggtagcggtgtcgaaggcgtgcgttttagtttcggtttcgagagatttttcggcgcggattttcgtttagcgattttgtattattggttcggttttcgtgagggtacgcgcggttgtcgggtttttgcgtttcgtgcgttttagatagtggcgagcgatagtgatttttagtttcggttttttttggtttttttgttcgtttgggcgcgtttttttcgttcgagtttaggtttttttagttaaggagcgaggttttttcgagtttttttgttcgagcgggagataggaggttcgtgtagagtcgtttattttttttcgtagcgtcgggttgttttaaattgtttttggattttatttgtgagtcgcgtggttgggttgggttgggttgcgcgggatttgttagcggttttcgttattttgttcgtaggcgtttatcggttgttttttgggtcgtcgttggtcgtcgttatacgtgggacgtcgagggtagtaaatttgttggtgacgttaaaggttcgggtcggattagttttcggacgagcgtagcggggcgcggattagcggttaggcggggttagacgggcggggtgggatggagaaaaggtggcgcgggtttcgtagtagtcgtttaatggtattggagagggcgggggcggtaggggcgacgttttttttttagtgttttttattttttttcgcggtttcgtttttttttagtggattcggtgtttgcggcggtttcggggttgtttgagtgatagttaaggtcggtcg

SEQ ID NO: 6715 - DNA, 3535 bp, Artificial Sequence
  Description of Artificial Sequence: Synthetic polynucleotide
tcgtttttttgggttcgttttttgtttcgaagttaatagtaatttttgatcgttttatatcgtttagaagtttttttatattttttcgttttgggagcgggttggttgttgagttttcggagaagcgtttgtatttgtatggcgttcggggtttttggtaggtagagtagttcgttattttggaaggtcgggatcgtttattttatttcggtttatagttttttttttgcgtagttcgtttttgtagtttttgcggggaagtgtcggggttgttcgaggtttagtttttaggattgtaaggaggtagtttcggcgtgcggcggtgcgtatagtttagagtggttagggcgcgagagtgtaacgtttttttggtttcgagcgcgtcgtcgcgtttcgggagtagattttcgtttagtagttatcgtcgtttcgatttttcgttttagttgtagtttttgtcgggtaatatgttaagagtcgtcgtcgttatagttgtcgtcgttatttggggaagagtagtagtagtagcggcggtcgcgggtatacgggggtaataaatcgagttattcgggcgtttagcgtgtcggggaattttttttgcgtttattgttcggcgggatttacgttatgtgttgagttatgtttttggtcgcgttcgcgggtagcgtatggggtagcgtttgagtggcggtagattttgtttcgatgttttcggtcggtttttatcgtagtcgtcgtcgttttcgtcgtcggtgaggaggaagttcgcgttgtttttcgttatgttttgcgtttggttttatatgtttttgtattcgtgcgtcggtttttgcgtcgtcgcgtcggggttgttgtttttgggttttgggtttcgcgtcgtatacgattcgttagttttggttatagtttcggacgggacgttttttaggttgtcgtttcgggcgtcgttagttattttattggttttaggtaaggagatggtcgagggcgttgcgagttcggaggagtagagtttcgaggtgtcggattttttaagttttatttttagtttttttagtgggtttgggagtaagtagttgtcgtaggttattattatcggcgtgaagaagggcggtacgcgggcgttgttggagtttttgcgcgtgtatttcgacgtgcgcgtcgtgggcgtcgagttttattttttcgatcgtagttacgataagggtttcgtttggtatcggtgagtttttttgttaggggtagggtttttatcgtcgatttagattttgagttaagggagatatggcgtatgatagggaattggtagggttatagtttcggattattcggggtagggtagggaaattacggtagattgcgtagcgtattttgttcgggtgcggtgagggttgcgtttcgtttggttttcgttataatttatagaaagttttcgcggagtattggtgtttttgaatttattaggcgatttcgtcgtaaagaagaagggtagcgattgagatcgtttttagtaaagcgagttattttttaattatgggggtattcgattcgaatcgtattttatgattcgttttaaatttttttttttcggagttcgagacgttgggaatgttttgagtttttttggtcggttttcgtttttaaggaatttttagagtagtttttgttttttagatggggagagggggtgggggtcgcggcgtttcggcgaggtcgtagagtttgttaattttttgttatagttcgtttggttatcggaattttaagggtgttagattcgtttcgttcgcgagtcgtttgggttcgggagggtgagtcgggcgggtggttcggcgttttcgtttggcgggcgggcggcgcgcggagcgtggagttgtgttggtttttgtcgggtaaaggcgcgtattgtaatcggttggagcggcgcgaggttttgaaggcgttcgggttttcgggtatcgtcgttcgttttcgtttttttgttttcggtgttgggatagggaaagtaaggacgcgtgttttcgcggggtttttatacgttcggagtaaagaatattcggggtttattgattgagaaatgagggttgtttcgaggtcgcggttttcggaaattttgttttcgagtcgggttgcgggttaggttttaaagggatagtggtttcggggttataattattatttttgtttattgtttttcgtagttgttggtttttggggtgagttgttgggttgttcgagtttcgggtaaggcgcgagtgggtaggaggtttagatttcggttttcgataattgttttcgattaggggtttaggtaacgatttttatattttcgttggggtttttattcgtaattttagttagtacgatatttagatatttttttaggtttaattagttttatagacgtttaagatttgggaaaataaaagaggagaagataattgaatttttttttttgtgtttattttattgtcgggatttgggtgggttggagaataaaagagggttgatttcgcggattaaaacggttttttttttagtttcgttttatttttttttttttgtttttaatggttttttattattgttaggagttgtttaagtttcgaggtttagttaatcgtgatagttattttttttatcgttttcgggttgtgatttattttcgggatattggtggataagaatggggtttttggagttcgacgtttggatttacgttttggttagtcgcgtgaattttggtgtttttatttgtgtagtgggaataatgtaggttttgggtagggatgggaagagtgaatgcgttggtacggtaaggtgtttcgtaggtacgtgagggtttttttaatcgttagttattgttatcgattgtattgttatgatttttattattattattttttttttttttgggatggtgattttagggttaggcggtaggttataattagcgtttttttaggtggaattcgttagagtttcgaggtagtttaggattttttgagattagatatatttgggtcgggttgggaggaattggtaggaaaaggattgaatttttaatgttaggcggttttgaagtatttggggtaagttatggaaatttttataggaaggtttacgtagttttttaggcggttgttttttatttgttacgttttttttgattgattaaaaaacgttgaatgaagaacgaagtcgcgtggaaattttcgtcgcgcgtttgtagcggatagcgtagttcgggaggttcggttgtcgatttgcgttcgggggttgcgttgcgagcggttacgtatggcggttggattcgggcggtcgtaagggtttggttgggtcgcgggaggcgggaggtttttcgttttttcgagttatttttttgaattgataagtaggattttcgggtttagggggtatagggttcggggcggtgattcggcggatcgggttgtcggaggagtttattgtaaatgtcgtaattggttttaaatattgcgtttttggattgtattagtagtttttggcgcggtcg

SEQ ID NO: 6716 - DNA, 2896 bp, Artificial Sequence
  Description of Artificial Sequence: Synthetic polynucleotide
gcgtgggcggtgagcggtcgggagaggggcgggttagttgagcgtttaattatagtttcggggttcggcgttcgttagttgtatttagaattttttttatcgtggttttgttttgtggcgtttaattacgtgtttttagggttttggagcggttgttgggattgtagcgaagaggggttcgcgttattttcgttaggttttacgcgtcggttttgagtgcgtttttttcggtcgtcgggaaatttagaggcgcggtttggttttaaggttttcggtttcgtttttttttgtttcggtttagttttcggttgttttcgggtcgcgatttattttttttggcggtttttgtcgtatgtttttgtgttgcgttagaattatcgagttttagttttcgttgttttttcggttagtaggcgttttttttagttggggagggttttttaaattttgtgtttttaggatcgcggggtcggtaagcggtaggatttttaagttgcgtttttgatgcggttaggggaggcgcgcgatgaaggtttttttttttttcgttttttttttacgttttatcgttattatacgtcgcgttgcgtcgcgatttcggcgttgtttgttggcgttttaagcggtttttttgtcgcggtgcgattttcgacgttaggaggattaatttttattcgttaggttttagattttacgtagatttagttatatacgtaatcgtttgtagatatttattatagttttttaagttaatttaaagtttcgtataggcgtattgtttttatatgcgtagttttacggttttatatatttattagtttattcgtaaataggtttatatggttatataattgttttttggatatttagttttacgtaggtataattttatatatatataatcgtatataggcgtaattttatttacgtagtattttacggagttatataatttttttataaataatcgtatagatatagttttacgtagcgttatattatttagttaaattgagatttagaaatatatttattagtttgtatttagatttttttttttaagtttcgtgatatttattcgtaggatagattagaaatatatagttatattgatatatatacggatttaaacgtatagttaagattttattcgtaggttcgtaagttattggaaaaatattaaagcgttttttttttttttttttttatttttgatatatatacgtttgcgcgcgcgcgtatttttatatttatatttttcgtttttaagcgcgtcggagtttcgtagcgggtgatttcgaggtttcgcggtgagagttaagggagcgttttttcggcgtttttttttttcgtttttttttcgagtttatttttcgttttttcgttcgttttttttttttttgtttttttttttttttttttttttttgagtttggggcgcgggttgcgcgtagttaagtttttttatcgcgcgttttttttcgcgcgcgtttcgcgttagtatcgcgtttatcgagtggatgcggttacggggtcgtttttaattattttttgattttcggcggtttgtgaataatggttattgagggcgttcgtaggggttgttaagaaggaaacgcggggcgcgagaggcgcggcgcgcgcgggagcgcgagggaaaggagcgagtttggggtcgttgtaagcggttggcgagagaaaggattcgtgcgagcgtttatatttgttttttttaaggattttatttggttatcgcgttttggaagaggcgagagggagagcgtgcgcgagaggagagagacggcgggggaaagggagacggcgagacgcgtagcgtcggcgttcgggagatttaggaggagttcgtaggtattgttggcggcggagttttgtgttttcggcgggttgttgtgggcgttagggtttttcgagttttcggttcgtcgtcgcgcgtagatttgttcggagttcggggttgtaggttggggtcgtcgttcgtcgcggatatttttttcgcggcgttaggattttggttggagttgcggatttgtatgtttgggggttttttacgttggttgagggaatcggttttagaagaaggaattttttttttttttttttttttttttttttttggtcgtttttggttatagtttggttgtgttggggatttttttttttttttttttttataaagtattggtgagcggttttgacgaatgtggtattggcggaaggtatggggttgagatggcggggttggtggttacggatggggaggcgagagatgttagagaaggaaggagttttgtttaagttcgtaatttgcgtttcgaagttggtcggatcggggagggcgattcgcgcgttcgattttgtttcgggtaatcgatgggaaatttttcgagagcgcggtttttttggggattcggcgtttttgacgtttttaggcgttttttcgggtcgttgcggttttttttcgtcgttcgttagcgtttaaggtcgcgttttttttattttcgtttttttttttttttcggcggttttcggatttggatagagttgtaggagtggttttaaatattttttttggagatttttttttatttttcgtacgagagtttgtttagtggtttttttgttttgcgttttagttttacgcgcggtcgagtggttaggttgataatgaaatttcgtatttttgtcggggggagtggggtggggaggaggttttttttggggttgttgattttgggtttcgggtagggggagggggtttttgggggaggggtttgttttggttagagacgtcgatttgggatggcgtcggggtagggagggggttggggggtgggcgcggcgaaggcggtaggtttgggttcgcggtcgggggtcg

SEQ ID NO: 6717 - DNA, 2567 bp, Artificial Sequence
  Description of Artificial Sequence: Synthetic polynucleotide
ygtttttaaygygggagygtagtgtattttagtggataaattygagaatygtaygttgtttttygtttttatttttgtttttttygttygyggttttaattygggatttaaatgtaygagttyggtgaatgtttyggtaggagggygagggtttagaggtagtttgtttagtaaaaaygatagttgtgttttggtgggttttgggttattttaggtagaagttagagaagttygagaatttyggygggttggtaaagtttgtygagaagggtttttttggatatttttattaygggttttaggttygaatttttttttttatttggttttggagttttagatatagataagtttygggygygtyggygggygtatgtgygtgtgtgtttatagyggggtggtygtyggagttttttaagaattttagttttttygttttagttgttygttagttgtgagygttygtygggttyggaggttattygtaaatagttgggtyggtagttgggagtttgggaggtttttgtttagtttyggggtttygagaaaggagaagggggagyggagtggttgtttggttgtggttttttttaatttygtttgygaagttttygttgggagttyggagttttagtttttttyggtagtttyggttttygygttygtygygtttagyggtyggygtttygtttygggtttyggggaggaggygygtyggggtagtyggttaggatattgygttgttggtttttagagttgygggygygtttggtyggttttatttttygggttgttggggygggygtygttgtttygatttyggaygygyggaattttggagattyggtygtttttygttagggtygyggtgttgttttaggtttygggygggygttttttttyggttatyggtgtatttygttgttygtttgygggaagygaagaggggttttttgatttgtaatatagaggaaagygtygttttygtttagtttggtatttaygygtttataygtattyggygtyggtygggtygtttatttgagttttaaaagttgttgaatttatatggttaygtttyggggagyggggttttagatttggttygtttaggttatttgygyggygttygygttygttygttttygtttygyggygtyggttttyggttttyggttygtygtttttygtygttygtyggtygyggggygtatagygagttagagygyggtygygyggggttttatgtyggtyggygygtygtygtygttggggygtatggtttaggttgggyggttygygggggygtatatttttyggtyggggygyggggttygyggtttttttygtyggyggtatagygaaggyggtagygaggyggggygtgtttyggygttgtygyggygtagtaaagggttggggagtygyggtttygtttttyggggyggygaggagggaggtyggyggygttgtygtttayggtgygtgtttttyggygygyggtttttgtttttagtyggagtttygygtygatggggyggygttgtttagggtttggggtgaygygaygyggayggaygygagtttttttygygttgtygggtyggggggttttgttagaggtttygtygtygatyggygttatttaagttgttygggggtttygtttgagygttygttttgtagayggtygyggttyggagattggtaggaggygggtaygagaggygygyggggygagggygtygtggagygyggggygtggggaygygyggyggyggygtygygyggaggaggygygyggggatttyggggtttygtygttygygtttatygygttygtygtagagtygttygygttgtttagtygttttttttttygygtttgttttttygygygttygttttygtttttyggagtyggttttaatttygttygttyggttyggtttaygttattygtttttttygtttttygaaygggagttygagtttttggtttggtttyggtttttgttygtygttttattttgygggggtyggggtygtygygggtggtggggggygttgtgtttagtaggggygatagygtaggyggggttttttgtagtttttttttttattttyggtygygtttyggtttttattttgygaaaggttygagagaggtygtaggttaggattggatygtygggygtygtyggatggtgttgttagggtaatyggatggtaygygaagtygttygaggtttygattyggttaygggggygtttagtggattyggagagttattttggggagggggyggtttygaagaaggattgggtgggggygtatggagygggggttgygygaaaagttttttggggyggagttgagttaygygggtygygtaggagygtttgttygagggtygtttaygagggatttttttgttyggttgygygggtttttgygttgatgaagttatygygtttygggtyggagtttyggygtttttgtttygaatttagygaagttyggttttatgtttttaattatttaayggttttttatygtttagygt

SEQ ID NO: 6718 - DNA, 573 bp, Artificial Sequence
  Description of Artificial Sequence: Synthetic polynucleotide
ygttgttygtygggtyggtggygtttatttygtatygygttgtttygttyggggtattatggtttggggttggattatgttttttttattttagtyggygttttttatttaygygygttgagggtgyggtgagttgagtgyggggttaagtatgttttggygtygatttygtttaggggtttaggatttggygtttaaggggttttttggygayggagattttygaygtagtagygattygyggttgtttaagttgatttygttygygtttygagyggttttgggygygyggggtttyggggattggaggatttyggggggyggygtygygtggtggtyggaaggggaygttaagttyggggtgggygtyggaygtttttygtygygtttgttygttttgtttatygygattyggygggtygtgyggaagygggggttgttgyggtttttgttgtygttttttttgttgtyggtyggygygtttygggaatyggygtttaggtagttagggtttggagagygygagygttttyggaggygygtggttagggaggatttygattttttgggygt

SEQ ID NO: 6719 - DNA, 383 bp, Artificial Sequence
  Description of Artificial Sequence: Synthetic polynucleotide
ygttygtyggtttttataggggygaaattaggtatttatygtgayggygagygtgatagygttyggttygattttgtttagatgtttatagaagatggagttgaygaggttgattataaagattattaattgygtaagaaattgyggaggygyggaaagtaaggygygtttatagtygtttttttttttggaagttygygtttatttttgygyggyggtygtttyggaggygtygggttgggygtgaggaygtygtatttattattgggttygygagygtygttagtttagtygttttttttygtaggttygggggtagygtatttygtaggttttataagtygttaygttattygagggttyggagtygttatgggggtygg

SEQ ID NO: 6720 - DNA, 853 bp, Artificial Sequence
  Description of Artificial Sequence: Synthetic polynucleotide
yggygyggggtgaggttygggggtygttttattgttgaggttyggtyggttggggtygtygttaggygygttggttgggtagtttttgggagatgaagygaygtaggygttttaggtattggttgtagagttygatgtygttgtgttyggygttttttatttatagyggttttatygttttggggtagygttygtagagygttagttygtgygagaagtygattatttygtttttygtgtygtggatgatgagtaygggygaygtgatttaggatattttttygatgttgygggaggggygtggagygggtgagatttagygttyggttygggtttygtttygttttygttttygtttygttttygttttygtttgggtygtttatttagggaaggygtygaagtagtaggtygttttggtgttagggaaggygaygygtatgttygaggtgagyggygagtgtagtattatygyggtatattygtagygygaggttaggtttayggtgggtatygtgtygatgttttgtyggtataggatgatgttgttygggttgatgtygtatttggtagygtyggagtagggttagtygyggttttygaygygygtatattttttttattagygggygttttygggtttagtttyggatgygattttttagtttttttatttagttaagttagtgggttaggtttaggttttatattagtttygagggttatttttagtttttaatatygyggyggtgggygaagttagyggtttygtttygttttttgygttgtygtttattggygttttttagttaggatttgtagggatttygtttayggagtgtttttggggygg

SEQ ID NO: 6721 - DNA, 1062 bp, Artificial Sequence
  Description of Artificial Sequence: Synthetic polynucleotide
ygaggaaggaaggtgggygtagaagttattttaggygtgaygygtgaygttyggggtaygggygtyggggggyggaaagygagggttyggttgggttagggatattyggggggggtygaggttttgggtttyggyggagggaggggattgggagggaggttatygtttygggttaygygggtgattyggygggggagttgggggaggggyggyggggttgggttggggttttygggtygggattggggtygggttagtttattttttygttttggtygaagygtagttygagygtygygaygygttttaygygtaggaagtygtyggggtygyggtygtatatttygaatatttygygtaggyggygtayggagygtagtagagtygygggggygttygattagttygygtygttygttattygggtyggttygtagtttagttyggatttttygttygtygygttygtygtttgttygtygtygttatygtygygygtttttyggggtygttygtttgggtttgygtygygtagttttygttyggtggyggtygyggtygattygtgttagtagyggygtygtagttttagtygttttggaggggaagggaggggaggggagggaaggagaagagtggggaggggaaggaggaggggtaatagggggyggggaggggaggggygggggtygyggygaaaatgggagggagagggggaggyggygggggyggyggyggyggggaygttgtagataaaaggagttygygttttttygagtggggyggtttaygyggggtyggtaggygtagygagttgttaayggtygygtttttygygattttagttttttttygygtttttagttttttttygygttttygagtttatttttttttttggatattyggagttatttaaaggttttgttttgtyggaggatttygyggggtygygttttttttygttattygtgttygttgtygygtttggygtttttygagygtttaggatgttttgggggttttttgtattggygygtttygtgattgtatttatttygg

SEQ ID NO: 6722 - DNA, 918 bp, Artificial Sequence
  Description of Artificial Sequence: Synthetic polynucleotide
ygygaagttttygyggyggagagygttgygyggggagataaagggaagggatagggatygtagggatagggataggagyggttgtygggttttgggttttygatygttattagatatgttttygagtagtygaggtaaagggaayggatgggaaaggaaaatagaggagyggtttagaagggyggttygttgyggtggtggggygyggattygggaattyggggygggtagggtaygggygtattttttttttttttttttttygttygaggtyggtagygtttttygtttygygttatgtatatttattgtggtgatgagagttygygtttygtgttygttayggttattgtgygtttaataaaaataaatattgtygaggagtygtygygatgyggggyggaygygyggttyggaaaggggagggggttttaggaagagttatattygygagtygggtttgggttaggggygaggggagagygttaagattgtttygtygtygagggygtygatggaggtataggggttttygtggggygtttygagagatatygtgtttggtyggygggaygtgggttggttttttattygayggagagaagyggtatttttattttygggtatygggtttgggtttygagygggggtttttggaatataaggtagtgggggtagaygggtttgggtttattttaggttgggaaggggtttgagyggggygttttgattggattyggttttggyggatygaaggttttaaaagattttgtatttttaaagatttttgtagatygttatygtttaaggygttttaggttyggttttatttatgggaagggtaggaaagaaagttgggagygttttggggygyggggtagagatagyggtgttggaggygygttgtggaggyggygg

SEQ ID NO: 6723 - DNA, 865 bp, Artificial Sequence
  Description of Artificial Sequence: Synthetic polynucleotide
ygagttgtgtyggttttygygttttttttattttttttttttttyggattttygttttttygyggagaggttttgtygttttaagagtygggttagygattgataagtaataaaygttgagygttyggttgygttggagtygttyggagttaggggtttttyggggygtaggtaggygtttttyggttttygggttagtttttattttaagattttygtttttttttygttttgatayggtatttaggattttatttattgggtttaaattttataggttttttttatttaggttygttttttttttgtttattygttttygtttttgggttttttttttggggtgttggttgggagaattaagtttygttgtttattgatattggttttygtttttgyggtaggggttttaaagtggttttaggtattaaggtggtgagttgtgaggggtttyggtatttgygyggttttttygggggttgtgygggttgggggtatttagaagttyggtattaygtaagaatygtgttgttagygttttygggggttggggagygagatagaggttgygttgggtttyggtggttttttggtttttttaggtagttaatattataattttttttgggagggggttygtagaagggygygygttgtttttttygttttttaagttgtagyggggygggtygggagttagggttagggtttggagatttgggaggggatyggtgttagaagygaagagttagggttagaaagttaggttaattaaggggggggyggtgyggataaagayggggtgggggttggtyggggtagttatttagtgattttatttttggttttyggygggygygtaygt

SEQ ID NO: 6724 - DNA, 408 bp, Artificial Sequence
  Description of Artificial Sequence: Synthetic polynucleotide
ygaagyggggagaattyggttgggttgayggagaygttatatygygttaggggagtaggagttttttyggagygggaggyggggygtygtgtggttgygagygygttttttggatgtttyggtyggygygggggtgggtgggygttttygttttatttttggtttygggyggttagtygyggtgtgttyggagggttttgygagggttgtgggtggygggygagttttagyggygtagtagaggaggggttttygagygagygtattagggagaagggggttygtgtaaattttaggttgaygatygygtaygygtttttygggttattagttttgtygtttttggtggggtatatygaggagatygtygtggggaatyggggatyggattgtttgatagtygagygt

SEQ ID NO: 6725 - DNA, 2245 bp, Artificial Sequence
  Description of Artificial Sequence: Synthetic polynucleotide
yggattttgyggagtttygagtttygggtgaggygatgtttagattggygygaagyggggtgtttyggtagtagygtagaggtttattygttttttyggtyggttgtagygggygygtttatattttgtaaaattaaaaygttttggaaagygtttggggttgtaagtgaygtttgataygagyggygggtyggattgtyggtttttyggtttttttttggtttatataattygygggtygtttttatygtttaygaattttagygggtagaygttggaygtgyggtttggttatttttttaaattttagygttygattygygtygtagggtyggtygygtagygyggggatygygggtgtttaggttyggagaaygagygtygygtttttagtygyggtyggggaataggaattgtygttagaggtatygttttttttttygagattgygatattgattaagggttygtaggygygggyggtatttattttttyggattygtagttygtygyggaggggaaggggtaggaygygtttttaagattagggygggggygtgyggagtyggggagttgtttgggggygttggggygaggtgggaatttygttttagagtttttagtttyggggtygaggtttgtaggaagggygtgggaggtggaatttttttttttttaggygtttgttygagagtttagagygatttttggygyggagtyggttattygggtgggyggattttttttttygttaatatttyggyggtttygttaygatttttttttttatttgagtttttttttgtttatttaattttggttttaaaggtttagagagttaggttgtttyggagtttagtttttttygatttaagtayggtttttttagygttttygtttttattatatttatagtttagtttygtttygygttygttaggggtygggggygttagygttygagggatggtyggygggttgttattttgaygagayggagttgygggtgtttttttattttygggttygttyggttatygttttgaatgttygggttttayggatattttagagggatyggygggyggttgygggttygggyggtayggggtgggyggtygggtttttyggtygttgtttggtgaggagatgttyggttyggygtttttyggtttygyggttyggttyggttyggttyggttttygttygttttttttyggggaagtttggtygtygtttttygaygtagttyggttygyggtygttttttgtyggtttygttttygttattttttttayggttygygtygtttttygtttyggtttttygttttttygtttagttygtttttttttttttttttttttttttttttttttygttttttttyggtttttttttygygtttygtttttyggtttttttttagttttttttygtttttttygttttttttttttttttyggttygttttttgtgtttygtygttaggattttttttttttgygttyggggtttgyggtagttttyggggygygttggtagtagtggyggtygtygtagttyggggagaagtygggaatgggggaagggggtygyggtaaaggattagtttttygttyggtygaggtyggggtttgggaagttttagggatttggggtgatttgggttagggtgtttaggtgaatttatgagggygaggttattgggggttagggaatagggyggtttttattgagyggagtygtygyggaatttagtgaggttgygatttgygtttgggtagttttygttttgyggttggttaggaggagtttttygtygtttttattttagtygygtygggygttgggttygatttttagtatttttggtattgatgtgtttggtgygygttgagaygygaaygttttgtaagatgagtttttatttattygtttttttttttttttatttgtttattttataaattgagtgtttggttattttggtttaggtaagaggttggatttgggaattttttggatttgggagttttaggatgaaagggagayggyggtgttttgtaggataagygggtattgaaygttgtttaggggaaagtygggygygtattgygttgtagygyggygaaygttgttaggagttygygggtagggygtggggaggatatagygttttttttyggtyggtygagttttttgggtagyggtgggttttttygttagatttyggggtygt

SEQ ID NO: 6726 - DNA, 2972 bp, Artificial Sequence
  Description of Artificial Sequence: Synthetic polynucleotide
ygattattttygtttttttaygyggttttttagggaagaagygaggygtttgagttagattgggttggaatagtgyggtaggggttygtttttygyggagttgtttttttatttattatttatttagtttagttyggtygtttaygtaygtttatttgttgttttygttttatttttattaggygtattagttagttyggyggttttggttatagaygtttgaatgataaagtgtttttattatyggygyggttygttagtygattygtygggaygygttttggttttagtttttttttttttatygyggtttaggaagaaattyggatygygtatagttattttagatygagtagtygygygtygaggyggaggygggagtygtaggggttgtagayggtaggtttttgtyggggtatatttttttaagygtttaggttttttaygtttagtttttttttttttttgggttttygygyggggattttygtttttgtttagattyggagtttaagtygttgtttttttgggattyggtttttttttttygtttttttggtttaygttygtttattygygtttgagtagygtttttaattagyggygttagttagtagaygtgttygyggtygtttttaaattttyggaygtagttataggttttgatagttttagggaattggggttgagttttygggttggggttygtattyggatagaatttttgtttattttattygtaggttttatygtygayggattttggggatagtgttaatttttttygttttgttgggaaaygtagtygtgatttygagttgggatagyggttgttttttgaaaaggtgggggagtatygagttgggaattaggtyggggagtttagttaygattttggtttaatttgttgtgagattttggttaagtygtttaaatttttagagttttagttttygtatttgtaaagtyggaatttggggygtagtgttttgatgaaagatgttggyggggagagtgaagaygtttttttygttgttagattttttagggtattyggtttatggttataaagtaggttatatttgataatttygtyggattattyggaggattygtygatttttgtygagtyggtggttygggatatygygttatagaattygaggygttygggygttttygtttygttaggtgtttagyggtttgtatygagagttaggagaggtttagatyggatttygatttttygaggygygggagtttayggagygyggtgggygyggygttygggtygygtagttaggtggggagyggygygtagttttagattygtaggtaggtagyggyggattgtatttgtttygtttygtagygttttttgtttgtygtttttygtttgygtagttagagttgygygyggttaggaagggttttygtttagtgygtttyggygttttgtatttygagaygtagttatygttagttygggtaggggtatattygtttygtttttygygattygttgygttgttttaagtygtgagaataygygygtyggaggagttygtyggtygtgggggaatttygggagygggttygtttyggygaagtgggtattttttttttagttttagattygtagttttaatttygggattgggagaggtygygagtaggagygyggggataggygttggaaatgtttaagtttttgtttttttttttygttttattgttttttagygggtaggygggatttygattattttagggttygygtttygttttgttttttttttttttgtttttatttttttgtygttttygtygtygttttttttttgttttttttaatttattttttaatttttttttygttttttaattttttttttygaygttttttttttttattgtttggtyggtttttattgtttttgtygggttttttttgtttttagttttttygattttttttattgttttatttygtygtttygggtttttygttttagtttagttygttttttttatttttagttttygtttagttttttttttttttttygttttggttttgttttaygattttttagagatygagatgttgaggggaaagttttttygggatttyggtattygagtgttttttttygaagaatttgggtatyggagagttttatgtttttttttgaaagattttttttagtttttttatygttttttgyggtatttgaggatyggtattygtgtttyggttttgtttttatttttattttggagagtygtttttgygtttygggaattttagattttttttygtggtttyggtattagaggtttttttttattatttatttttagtatttgggattttaatgttttgttttgtttttttggtggyggygttyggtttttttyggagttttgatttygggaaagggagygggtttttttyggttaatatttatttttagaagtagtaatagtagtaggygyggttygtttatggygyggtyggtggtatttgtttttatygttygtttttygyggtagygttygatttttagttyggttygttttgyggattgatggggttgygttgygttgygttttagygttttttttgttygtyggagttggtygyggttyggttygttttggttgygggygggagaggttgggtgaagttagtgttgyggtttygttttygtttygtttagttygtttattttyggaatygygttygttygttttgtygtttyggggtgggaagtagaggtaaagggagggygtgyggtttttygtatttygttgygtttttttttgttttgttttttagagttttttatttatttygttttggtatttagttttyggttygygttattgygygttygtttyggatgttgtgggttyggggattagggygtttttattgyggtttttgttttttttyggttgyggttygt

SEQ ID NO: 6727 - DNA, 1026 bp, Artificial Sequence
  Description of Artificial Sequence: Synthetic polynucleotide
ygatygttygggttygagtagygggggygtttttagyggyggtaggygygggtgygggggagaggagtagaaaagagagtagtttgaggggtygagggagtygygttygaggtyggygyggtggggatygygggtttattattagttaagtttagttatttaattatttgtagagttgttgtaggtataggtttaggttttygttttttattttttygygggtgatgygttttgatagyggtygygggagygggggtaaaggyggtagttggggyggyggyggyggtayggtygagtgtttyggggttgtygtygtygtygtygygtttttttttttttttttatttttaatygtygtttttttttygggtttygggttttgtttttggttttttttttttgtygyggttatygtggtygtttttttttygggtttttttatygaagtttyggtygttttagtttttattagtttaggttygggttygggttyggattygggttygggttygggttygggttygggtttyggtttyggttygtygtygtygtayggttygygaaattygtttaggaatagttttaggaagygtyggtaagttttttttttagggatgtagtyggttatygttgtttatgttttagggtagatygggaaaggggttgggggaagtttaggaagggtaaggggttgtttttgagtttagggtttyggtaagggyggttaayggtygtatyggtaygagygattagtattaggttgtttggagagggttttygtaggygtgygygtygtygagtatygaygtgygyggttygggggyggagygygtygtttttttyggatttggagggaaagttggtggygggygygygtagggtttagyggyggtttattttttatttttayggagagtttagtttaygttgtttagagattgtygttatggtaatyggttttaattaagtattgtagggtttttttygtygagttygyggagtttaaaggatattttattygttygt

SEQ ID NO: 6728 - DNA, 10207 bp, Artificial Sequence
  Description of Artificial Sequence: Synthetic polynucleotide
ygttggtttygtygttagttttttgggttttttttttygttggygttgtygyggggttataggttttatttgagatgttagtatgtgttgggagaggtggaaygggaagggygyggyggtgtttgttgygttggtygygggatttagttygtttgygtttagtttygyggyggttttaggttygttattttygtygttgtygtygtttgttatygaggttagtaggtgatttatgtttatggyggagaaggygttagggtttatggtgaattgtttagggtgtaggaagagyggttggtyggtttttagyggtttaaagaattgttgttygtgtaagtggttggaaaaggttaggtygggtaggtgttyggygtttaggggggaygtattgtttgtttgtattattagyggygttaggttttgttttttgttttyggtygtttttttgygtttttygtttttttttygagtttyggygygttttttttttaggttttttaggtygaaygggtygttttygtygttttyggtyggttttttgtttttttygggattaygtygttttygggygygttygggttyggttaagygagtggggttggygttgtttggagtygggttgyggtttagyggygttttygtaygtttttygtttaatygtttaggtttygggtygttgttygyggygtaygatttttttttagttgyggggagagggygygyggattataggggtttgggyggaggtygaygagtaggattagggatattygggaagggttgttttyggggaggttgagtyggaggagttgttggagtygggtaaagggtagttgtaggttatttaatttaagattttagatttatagtggaaggaatttagttttggagaggaaattttatagttatagaattatayggygtttaaggggttaggttyggagttyggtyggattttttggttatyggggatygttttygtaggggagtttygggayggaaattttattttagatattygtygaygttttttttttggttttttaggttagygggtggtttagtaaaagattagtttagygatttgaggatttttygtygttatttttttgtttttttttyggttygatttttatttygggttyggtgtaggygtagyggattgggygttgygttyggggaggtgggtggttttygygyggggggagggtygtaygaygaggygtttgatttygygttatygygttygggtttgtagtgtttttygtataagygtagagayggtagygttagttgttttttggggatgagyggatgaattaggttagyggggagtttatttttttattttttttgttygttgttttygygggtattygttatagggttgttgttttyggttttttattttttttttygtyggtygttttyggtgtttyggaagtttttggtaaaygggttgttgtygatttttagttgtgtgatttgyggggattaagggggyggygttaagttaggtygtggtttttttagygtggtyggtggtatttygaggttagygggtgttggtygtagagggaagattyggggagygtttatttggtatttattygtttgggatgggaygtttygagttgaggtyggtgggagggtttygyggaaagygayggggtttgttttttaaaagttttattygaggaattatttttagataggtttagatagttttatataggtttaaagtagtgttatagtgtyggaattagtttaagtatgtatattygttygygggtttgygtaagttaaaygatttygtattygagtaggygygaatagagattgtagtttataygtaaggttgtaggtatatataaagttaaattatatttaygggttygtatataygtaagtgtgtatagatataataaaygtttayggaattaaaygaatttatatgtttttataggtatttaatatattttaaayggggtaygtatagtttagygtatattttggtttataaagttataaygatyggtayggatattygtatttttttttttattygatagtggygtataagggtataggtttagaggggtgatgttttgttttattagaataagggtggagaagtygtaagtagaaaaagttttttgattggaaggtaattttttaagygttttttaaggggtttggggtttagattgatttagagtagtagttaggagtgttttggggggttgtgttatttgttttattttttggtttttttygagagagtgaaaattgggtttygggttttgagtatyggtagagtttgggtagattgtttygggygttttttttttatttatatttttatttttgagttaagaaataaaygaataaaatgtaaaaatgttagygygggttyggagttttagttaattgttaagtaaatatttttattagaaygayggtttagttgttygttygttttaggggagtttgtgtgtgygygyggtgggattgagagggygttttgaggattttygtgagtgttgygygtatggatgygaggttyggtgttygggggygggtygtaagagygyggatttygtgtagggggtttygaggggygatgaayggayggttgggtttgtaygtgttgaggggygttagtgtaggggtttagtttatygttygtygygygtattttgttattttggtaggtagtgayggygatgaagtyggttttygggaataygtaggtgyggaaggtgttgtaaggtagttttaggatgtygttggttygtattatgtggaagygyggttggtatttgtgtatggagtttaggatggtttgyggggagggtgggggttagtyggtagttattagtttyggttygagtttttttattttttgggtatttgatttttttttttttattttttttttttttttttttttttttttttttttttttttttttatyggtttttttttttttttatttttttttgtttttgttttttttttatttttattttttttttttttattttttttttygtttttttttttttatagttttttttttttttgttattaaaaaaaattttttagttggaaatagaaatgagatagagtaaaaataaaataaaataaaaaataaaataaaaaaattaattaaaaaataatttttttttataaaagaaatttaaataaaataaaataaaatagagttttataattttatttttaatattttttttttttttggtattggtaaattttttaattttataaagaggagattttaattttygggggtttattaattgttttattttagaatgggtagttttttttattttatgaaatattattttygttygttggggttttgtttaggtataaatggagagaatttttaaattttttttttttagttgggtatttgtttgtgggaggagggaaaggttttagggaggttgggggggtgggtggggagggtggtttaatttttaaattttttagttttgggggagggttagggaygygggttttggtagaagggtgatggataagttgaggttatgggtaggttttttaagttyggtatttataggttaagagtagggtgattttygtggtttagtattgtagatttagttttggtagtatttgtttttttattgayggtataagggattttttayggtttgaggaattgagattgtgagttgttagttattgattttattattttttaggtttgtaaaggagagygttggggtttaggtttaggtttagtttaygtagattatagggtagtgattygggtaggggtattttgggggtttgtttagygtttttttttgggagattttgtygttttgtttttttgtttagttgtagtgttgggttaataagtttttgtatygtttttattttgttttaatatttaygaagtygtgtttgttagagatgttgttggttagttttagtttgtggaaggttataggtttagttatttattgttttttygtggttgggttgtttgggtggatgtatatgygtttgggtattttagggtyggttttgttygttattatttagygygagttgtggaatttatagyggtaatygttagyggttataatgtttattagtaggatatatttggtttttttgtttaggtygttgattygtattttgaagggggggaatattygtttgggagggagggaagggaggagattttattggaatyggttgttttaggttttaggattttattttttttttatttattttttttygttgygtatatygttgtygtttggttgttttttttgtggtyggttgttttgtttttttattattgttyggaygattttatttgtggttgttgtttttaggagattttatttttgtttgttagatttttttttaaatagttttttttaggttttgtgtttagatttggggattttttttttttttgatttgagatgaaagttgatgtttaggagagaagtttaggttttttagaaatattttygtttttttttaattttttygaaattygtttaggggaaatatttatttgggayggaagtttttagaaataaatttggagggtgtttgtattgggaattgggttatagagtttgataagatattttggtygtgtagttygggggaagagggtgaattygaggtttggattttyggtggttgagtygaagggtggaggggtyggggttgtggttttttttaggttttaaggtttggggyggyggatgygtttagggttyggatgttygyggtggagaaagggtttttagttyggtgaggyggagggttyggttgattyggggttygttgttaggaatygagtaattagygtggggttagttgggtttaggttttattaggggtttyggggtyggagtagagtttgagagaggttgaatttttttygagttyggagayggattyggaygtagaagagygagagygyggggyggaggagatygttagggttaagtygyggggttttttttgygttgggatttagaayggttggggttattttttagtagtatgttttygttttattttattyggaggattttagygtttttgttttaaaaaaaaatygtttyggtgttaaaygagaaaagttaatttggttgttygtgggagygaagygtggygttagggttagaatttggagtygggagtygggagtygggagtttttagttttgttttgattygtgtagtttygtgttttagttygttygttygttygygygttttttagtyggtyggtagttttatttttyggatttggtgatgattattttygtgtttagtttgtggaattggttttatagttttttggtttttagygttattttggggtygttttttatttygttttygggttttaggtttttgagggagygtagatgygyggygggygggtgygggtttagtgtygagaygtgtagtttygtttyggtygttgttgtygtygtygtygtygyggtygtygttttygttaggttygggtygggtagyggtttggttagygygtygggyggtagygygagtgtygggaagaaggagggttgygtygtygttagaaaggyggatatggggaagtyggygggtygtggygygtggaaygggtggtaagttatggygttggtygttagygtyggtttttttatygggatattyggtttaggygttygggggtyggggtyggggtygggggygygyggttyggattttyggttygggyggyggygygygyggtggayggaygattygggtggygggygtagtagttgtttttyggggtttttygttyggygtatygtaaggggtattyggttttgtgygygggggyggygggggttttgygyggggtygggttgggtygggttgagttggttygtttyggygtyggggattaygygygattggttagattttgtygtgatttttggaaaattgtgattattttatatgttttgtttagttyggattttttgygttaaygagttaggttttttttgattgttgattttaygttttttggattaattgtgggttttygggggyggggttttgatagtttaggttaagtttyggtygggagggggggtttgggagaaggtgtyggaagttttagtagtaagaaaatatgttaatagaataaaatattaattaatgaygggtygtygggtttygagatttttttttttgtttyggtttttatygttygttygygtttgyggttgtttgygtyggattggagagygyggagggtygatttgattygtygaaagggtttgaggygaggggagttygggtttyggggttttggggaaggattygtagtygtaygtyggttttaagtgtaaagtattgataygatttygagyggagagggggygttttttttttttygygtttagaggttyggtygttttggttygagttttagtttggttttygatttagtttygggtygtggygtygtttgggggtttttgygtttyggaaagagatagtaggtattggaaagygaggtyggtgggygggygagtygggaggttygggyggtygaggttygggagyggattttaggtggygggagttggtgagtggagttatggtygagttttgttggggtyggygygggygggagygggaygyggttttgygttggggaaaygyggggattttttattygygttygtttttatyggaagattyggaaggaatttggagtttttygtaggttygggtttygttttgagttttttagyggtygggaggagyggattttyggggttaggaaggtgagygtatttttygttgagtatagggyggtatygygygggyggatttyggattttttattygygatttaaygaattttygttttattyggtatyggagaygaaagtttttttttttygaaatatyggtttttttttttygttttgttaattatttttttagtttttttttatttttyggaagygtaygttttttaagttaaggagtgttgagtaaygygtgagggagttggggtgtttgygagtatttgtgattgaagtttttttttttgtgattagttttygttttttgtttttyggtagttttagttttttttttatgaagtgatggtgtgtgtgtgtgtgtgtgtgtgtgtgtgtgtgtgtgtgtgtgtgtygggtttygtgtggtgttttttgtgygtagygagagttataatttaaggtgtgtayggggagagtgaagygattaygtatttgtttttaatygggttygggygygaatatttaggttgatttttgaaggtygttttttgaaggaaaagatagagtatgtattagttaygggtgatatttttattygtataatygygtggtgggygygtatatttaatattgatttatgtaggygttygtttattgygtatatyggtygtagggtatttygttgttgaaygttgggagtagygtttgaaggtyggattttttttggtagtgyggattygggatyggyggaagtagtatggtttttgygatygttatttttatttttyggggtygattttagggtttttataattttttattatygtatatgtgagygtygtttttatagggttttttttaygatttygtttttggttaggtygtattttttttagtattttttttttggttagaaygaatttttgatttygagttgygtagtttaygtagayggggtaggatttattgtagttttttataggtaaatatttgttggttttattttaggygagatgtggtttttyggggagggattygttgtggataygtttgygtagtyggtgaggtgattagataataattagggtagttttttttagtygggaatttaggtatyggtttaggaattygtgaatatattygtaaagtygygygygygygygygygygtgtgtgtgtgtgtgtgtgtgtgtgtgtgtgtagatatatatttttgtttttgtaagagtatgtgtatatttaaatgtgtgygttttagatattagtttattttattagtttatttatagttggtttaggggttygaggtttgaagagtttgaaatatttaggtttgggttatttgatygagaaatttggyggygatagtgtagyggttgtatttggggayggygattttatttatagtggtatygattttttttttggtttttyggggttttgttygggttaggattttattattygtttygtttygyggtttygygattattttgaggttttgttgtagtygttttgaagagtttgtagygatttttagttaaattttttagttaggaatgttygaggtttatygaaagttggygttggggaggtttgggaggttttggagyggygtygtgaggttttygttgggttttttttttatttaggtyggttttttttttttttttaggaatttttttttttggyggagtttygggggtygagtgtgygtgtttttttaagaggtttyggggggygtttygygggtygttyggggttggagggggagggygygggygggggyggttggygttaggyggtygaggttttataataaagtttyggtttttgttatttygtatyggttaggtttygtagataggygggggaygygygttyggtygtttttttttttygtaggyggttttyggttagggygtygggygggtttgggttggtggygygyggtttgtgygtttygygtttttygtaatagtgaaatggggygggagyggggayggtttgggtygggtggggtygyggttttgagtttggygtggttgttttttygtttttyggtttygttatttttygtagggttaaggggtattgttgggatttttttygggttgagtttttaggtggtagggggttttygtygtttttttttttgtgtgtagggtyggggttgygtgatttygygggtagtgggtagtaggaagttygggttgtgyggtygygtggtagagyggaygayggatttgygttygagtgayggggygygggttgtagattggtttaagttttyggtggtagaygaatgtgtttaggttaagtttaggggaygtgtgtggtttygtgttatgggttygttgtgagggtgtygttaggtygtygattattgtttggaygtgaggagtgtggtggtgaaggatattttttggatagagtygttttttattayggttttttygtyggatygtatttttyggagttttggygttagttagttyggtttagyggtyggatygggttttttygyggttttaggtttggttggggtgggggtygyggtttyggtgattttagttygtagyggttyggttygtttygtttatttaaataaattgtygttgataggygygtagtttttttggagtygtygttttttygtygtttttttttygttttaattatttygygtagggtggggttaattggttgggatggggygggggaygyggggagagygggyggttygatttttttttggtygyggggtggttyggggaagygttttygtagttayggtttgtgtggtttygtttttggttttttygggggatgygagggtaaggtttagtttggtagttgtgggttttggaagggygtygttttgtatttaagggygagattaygyggtygagaattaaggtygtatttyggatggatttygggtgattttttyggagttttggggaattttttaattyggggagttgtagaygatttattggtttygggtygyggtttygygggtggtygttgtaygtttgagatatttggttygtagaagttaggtgtaygtttgtgtatygtygtgygttggatgtgtatggaggygagatygtggttatggatgtttgggattaygggagygtgaayggggygatygattgagtgatttgagagayggggtagagygtaggaaggatttttaggaygggtttatttgygaygggyggyggtgggggagtggggggtttgtyggygygtttataggttttgggttygygttyggaaaygttttygtagggagygggtygggatttttyggagtagtayggtgayggygtgttataattygggttttagttgtgtygttttygt

SEQ ID NO: 6729 - DNA, 2392 bp, Artificial Sequence
  Description of Artificial Sequence: Synthetic polynucleotide
ygaggygtatttgtttygagtgttaggtttggggaygyggtttyggagaggggagaggggttygggaatgyggygggaggggtttygaggggtagygggtygggtygggtyggggyggaggtggygggtttyggyggggygggttttygygggyggyggtgagagttttygtatagtyggttgygagttttgggagtaggaggygyggtgygtagtttagttygggayggagtygggygtygtgygagtttygggagggtygyggggygtaggggygggtyggggttagyggattaggtygygttattygttttygttttygttttgtygygttygggtttyggygttygyggagttgagattgagygygttagtttttyggggtygaggttttgggatagatatygygagggaggyggtyggygygggttttygtygygggygtagygtttttttttttyggtaagtggygagyggygggygaggggtattaatttygtygttaatttggggttgggttttygyggygygygagtaaggayggyggagatagaggygggatattyggggggttggatttaygtaggattttyggggtttaaggagggggyggttggaggattyggatttttaagaatttggttttgggttttgattygggyggtyggagagaaggygaagaagaggtygagtagataggygygyggyggaygygagagaaggaygygggygaagygtttaagaygttygtttttagggtygtygagttttttttttttttygtttggygyggtagtatygygggattaggggagtttgggttgtygyggatttaaattgttgttgttggaagtygtyggggyggagagyggggaatagggtygggagtgggggtyggggttgggatttattagagygaggggttggaaaggagtygagaaggtgaaagggggttgtgyggttttttagtttagtgttttagtttttttaggtttgttgggtatttgttgygtattygtttyggygtttagattttttttttygtygygagtttygttttttttttttttagttttgttttattttttttgttttagtttagtttttttttttttgygatttgggagaatyggagtgggtttttagagtagtggtattttgtagatgttggttygtgttyggttttygggtttttagagygtaaagggaagggtaggtagagagggtattgggygagtaagatttggygttgggttttggttgygtattagtygtttgygtyggtttttgggggtttygtttaggattttygayggyggggaggggaagtttygagttttttgttttttgtttaygygggtagggyggggataygyggagtaaaggtattyggtaatttgaatttttaggtgygtttygygattttgtaaggagttgttgggtgagtaagaygggaattttygttaggttttgatgtttattttattygtttattyggttttttagttttggtygtttaaggggatttttggttyggttttttagttttyggatggtggygttattttagtttagtttttgatttygggttataggaaaatygaggaaagatatttatttggggagggtattatttygttggttgtattttagagttygtttaggttttggyggtgttagtgattttgagtttgtttttaaattttygaagaataagagygtgttaggggtaggtaggtaggttygggatatttgggttygtttagggttttygggygggtttgggatggtattggggtygtttgttaggttggtttggtttttttattgygggattyggggttaygatttagtttgggggagtgggggtgggggtttyggagtygyggaygtyggyggggggtagygtggggyggggggygtygggtgygtggtgtttagtttggtygttaggaggygtggygygggttttygttyggagtygtygtygtygtygtygtygtygtatygygagtgtttttgagtygygggtgayggtggttttygttgttygygtttttttttttygyggggggagtttgatgttaygttttttatgaattatttatygtyggtttaaaaatatttygaattttatagttygagtgtaagagattgttgyggaggggagggggyggggygtttyggtggttagggggagttygggyggggttygyggagaygggggtygtagttttggaggagtaagaatttygtgtttttagtagtggggtaagttagaayggyggtttttttttttggygtttgggttygggttttggttgggtaaaagggagggagggaaattygayggtaaaggaggggyggtttatyggaagggtagggggttygg

SEQ ID NO: 6730 - DNA, 564 bp, Artificial Sequence
  Description of Artificial Sequence: Synthetic polynucleotide
ygtttttaaatygtttatttgygayggtttygygagygtgygtagtttagtttttttyggaygttttygttttygttygggtatatygtgtttygtatygaggtagagaggggtaygyggattttagtttttgygagtttttttgttygtygttattttatatttygtattgttttagttgtygttttagaagatgtatygtttggygygtaaagyggtgtayggtttttagttygygygtagtagtttggaggggygttagagttttygttttattttttggyggtattgttttygggtagttttttttttttttttttttttttatgtttttattttattttgggaygtttttaggatygaagaggtaggagggggatygygaggggaaggygyggagttggggaaggaggagtagygtygggygtagtagtttagggyggttygggaggttgygyggygttygyggatttaygttttaggatagaggaygtagtttygagtatygtaygtggtttttagattttttttatttttattttggygattaygagagggggtygg

SEQ ID NO: 6731 - DNA, 3277 bp, Artificial Sequence
  Description of Artificial Sequence: Synthetic polynucleotide
ygyggtatggtggttttygygtgtgtgtgtagygtttgtaggtgtttygtttagygttttttgtataatagttgtaggttggattygagggtttttttttttggggttttatagtgtttagaggtttygttagttttagatatygttttaggtttttttttttttttgaygtygtttattttttttttttgyggaagggggataygtttttttgtgtygaggtgttaggtygttgagatttgttgttttggaggaaaagttaggtagggtttttggttttgggyggttaggaaggttttayggttgttggggatagagaygyggggttaggttaagggttttygtttygtttaaatagtttgttttgggtagggtagggtttttttttygygttygygygttttyggttgggtayggttyggttttaggtttgaygggygyggtttttttattggaygygtgygggagggyggygaggttaaagygttggggttaggagggtattygtttagyggttttttaygggagttggggtagaagaygtygygatttygygygggtaatttttttygaggygygttttagttygtggygttgtyggygtagatttygygtggggatyggygaggttaattttttttgyggttyggggtyggtagagtaygtaaggggtygygggtygygtgggtttgggygygtygtggtgggtaagyggggttagyggagygggaattygtatatttttygagyggagtygaggataggttygtgygggtygyggggtttttttggygttaggaagyggyggtygaaggagataaygagaaygtagtttyggtttagggaggtttaaaagttgagatgttgaaygtagayggygggygttygggggttggggggygggtagaggtygttattttttaaaaaggtttttatygagtyggtttttgttttygttygaggggyggaygttygatttyggtattygggattgttygtgggtttttgttggttggggatttttagttttyggttgygygtagggaaaggttgtagaaygtagagattagagaagtygggggyggyggggaggggtyggggggttayggttgtagttyggtttygtagtttyggagttttagtttttttttttgtattaygggagygtggayggagggattttygaggttttgatygttttgatagtttyggggyggggyggggyggggyggttgygttagttttggttttgagtttttagttyggygtyggaattyggatygygatttygggagtygagtttygyggtttagatgaaggygygagtgygygggtgtygggtggggtgtttgagygagagyggagttttttaggtggaygtttttagttattttygggattttttttgttggtttttgggtttgagaagtgggygyggttggatagaygggaaatagttttttaygtataggtggatattyggggatatygggygygygyggygtttggtaaggggaagttgttggagaygygggyggttgttttygyggggttttttttygaagygtygttgygaaygtttagtttyggygaygtygtttgttygygatygggtyggygtygyggataggaaaggttygattagttaggtttgttttygagaagtttttagygtttygttygtayggggtggggattgatagtttttyggggayggggtygggtttatagagttygggagttgggggaggggaggygtygggggtttygattygtgggaagtttttgtatttaggttgttyggyggttttttaatagtatayggatatttaagaaaygyggggyggttyggtgattttygttttggatttagtggygtygygaggttttatttygagtygttgattatygggtattygggtgttgaygatttgggtttttgggtatttagttyggttttaaaygatttyggtttaagggtgtttagtgtagttaggagggtygaatygaattttatttttyggaygyggtggtttttygttygtttggagtttygtyggaggttyggggatattaygtaggtggtttattttygagttyggggtyggagttygatttttttttttttgagttttyggagttttyggggtagtagygtyggtttaggygggggygggggaggagggggtygyggtagtttttagaagggygggggggaygygagyggaggtagtttyggtggygygttygtgagattttygtygygtygygggttygggtygyggataattaaagygggatttttttttygttgaygtyggyggttygaggtttttttygyggyggtataaaaggygygggtttygtagygtaggyggtagtgggggtttgatagygyggyggtgtggatygygyggtygaagagygyggygtttagagygygggtygttygyggagttatagttygagtygggttttagtyggagtygagttttagtygagtygagtygggttyggagygttyggtgttygtagttatgtyggtyggtygygtygygygtatttgtgygttgttygttttttgttttttgggygtyggggtttaggatttygggtygaygygttttatttgtatttyggtgttygtggaygtygatatgtgygtygygttygtggtygtyggyggygtygaggagtttyggagtagygtgttgtagtttygygagayggtgttgtagtagaaggagattattttgagttagaaggagattattygygagttgatygttaagttgggtygttgygagagttagagtaygttggatttyggagtyggygaggttygggygggyggyggtygtaagtagttyggttygggtaagaatattatgggygatttgtttyggatatyggtygtygagaygtttagttaattygggtaaattttgtaatygtttaaaattygtttggagaatttygaggttygygygygttttyggtttyggtttttttttyggttygttygtttttttgtttttttttatttygttttttattyggttaggtatttttygttttygttttagtygygygggtgttyggtyggtgttttttygygtttgygaggtttygyggyggttattygttttagttttttgttaggtygttttygtagtygtttagaggggatygygtygygggttttttagtayggttttygygtttygtttaayggtgtggtttttttygtttttgtatttygtagtagtatagtygt

SEQ ID NO: 6732 - DNA, 5692 bp, Artificial Sequence
  Description of Artificial Sequence: Synthetic polynucleotide
yggaygttaattttaygaattttgttygggttgggggtttgggaygttttttttggattttaggattygtttgtayggagttatagaatatagygttatygttygttygagtttaggtattttttttttttttyggggtttgygtygtttgtaygttttttygtagattttygyggaaaygtgtatagtagggttttgaatagaatttaggttgttttgagtygaatttttttyggttyggggttgatygtgtttatttaagtygtygtttygtttttygtattttygaygyggggttatttttttttatttttttttttatttaggygtttttttygatagyggagggagagttaaaaatttataattyggyggygggattttgtyggttttagttgggygatttgggygtattygtyggygaygtagtttygggttttagygtatagaattyggtygttygtagtttttttygttagttaygttttttgggttttttattggttaagtygttygygttttygygtgattttattggtttgygtygggggtttagataaagggagtagtygyggagggyggtgattgggyggggttgggggygggtygggygggygygygggtygggygggagtygygygttggagaggyggggagtayggygttgggggaggggygyggtgtttygggttygggatygggaggygygggtgtgyggygaggttygggtgttttttttygtgggggyggggyggygggggyggggyggttttaygtgggtggggttgggygtttyggagggyggyggtygyggggygyggggygttgggatttygttygttttttygttttgtatttttttygtttyggggtttttgttyggayggyggtygtygtygtttygtttttttygagggtttygygttygttttygtagttyggtygggaatttgggaattyggaygtagaaggaygygttygagttaggattygtygyggggtttttttggtgggtygtggtyggggagaggaygygggttttggyggtygaagayggaygtagygttyggaaaggygagttaggttttyggtttttggygttttttgtgagttggttyggyggggtgygtygtyggggagggagggattggtygtggggygagtagtygggyggggagtggtttttgggggttttygttagyggagggttygygaggtygttttyggagygtygttaggtaygtgygttttttttgtttttygygtttttagagygtattttyggtagggaaygaataaaatttyggttggtgtgtaagagtttttygttgtaaaygtgtttttttgygggattyggggagtygtygaaygyggggtagatttyggtttaaagtgtttttgtagtttttattagggatttttttttatttttattttgggttyggagygggtgttagtttggaaatgtttgttttttttgtagtttygattgaattygtttaggaggaggtgygttttgtttyggttttagagttgggaggatygggttttgtttttygaagtttttttatttygtttttttggaaaatgyggattttttttagtagggatgtttagttttgagggggttgttttyggaggaagtttgggttgggaaagttygatattggttttaatttggygggtagttttttttgttttggagtagttttttttagttttyggagtttyggatttatayggttaggagaygtttatgggttttgggggtattttgyggggttygaggaggtygggtggtttgggyggggttygaggaggtygggtggtttgagyggggttygaggaggtygggtggtttgagyggggttygaggaggtygggtggtttgagygggttttttttttttttttatgtgtaygttaaataaaagaattttygaatagttttggggatagaatttttyggaatgtgagtttgtttttttygtttttttttttaggaaggataggggttttttaataaaggtaaggttgyggttggagygggttgaagggaaggagygttgttattttggggtatttgatgaaagagaaatttattttttttttttttttttaaaattagaggtagttgagttagagttttttttatttttttatttgattaatggggttttataygatgtttgtatttggggtgattgggtttgaagatttttagaagtgggaaaggattttgtttgtgtgggagattggaaagttggtttttattyggtgggggatagaatttttatggagtgaaatggattttaggttattttgyggaagattggaaatttaaggatttgaygggggggyggtgattttgtgtttttttttttttttttttttttttttttagtttagaataaagggyggaggygaaggaggtaagatgggtggtgggttyggaagtyggagtygaaagaagaatgttataaaagttttttattttttagttttygygtatttttaaatagtttattagagtttgggtggggataaagtgaatgatygtttagagtygggtttggtatttatggttyggttttyggygygggygttyggagttygggggaagtttttttagttygttttaagtygyggttggttagggygagagaggtyggggtatagygygyggttttttttgtygttttygaggatygagattyggggttygyggttttttgattgygtaagttttttygttttttttgtttttttttttttttygtygaaagaygttyggagygtatattygtttgtattaaagttagggattttattttttttaaaataaaataataagttataaaggtttttgattttagtggaaaaggygtygtagatttatggtttttttaaatttttatattttaattatttttgtttttagtttatttatgggtggtgattaataaaatgattttttattttgaattttttttttaatataaaaaatgtaagtttygttttttttttattygtttggatggatttttttygtgygggaagtaaagaaatttygtttttttyggttttatyggtttagggttgagttgttgttttyggttgagygaattyggtttgtygtagtattttttaagtattttygtttygtatatttttaattgtaatttaagggagaatatttttttygtttttttttygtttaagggtatttgtagggatttttttttagaagttttgtygtgggtttagyggttagaagggttatttygtagagygggttttygatagttttagttyggttattttttaaattgygtttttttgggtttygtattgggygygagtttggggygtttaagggtttttattgaggaggaaggttgtyggatygagttttygttatygtttggygtttttattttttatttttttttttttgttygttttttyggaygtygatttggagatggtaggaaaaaaaaaataattagatggaaattaaagattagtttgggtgygygggyggttttygtygggtygggttatgttyggttygygttttataaatttttttygygaygtgataatagtygyggtttygtttttttgggaatttaggaaygtatygatttttttygtygttygygtaagtttttttttygggagygagaayggagagtttttggtgattttgatttttggttagygtaggaygttttaggttttagttagggtattatgtataggagtggaggaaggtggaagggaaggggtttaatttttatttaagaaagygtagtaaatatttatatttygtaggttaaattaaatatattattaggggtygtattttttttttttygygtygtttgagaagggggyggaaggaaggayggagaagggtgaggggyggattaatttttttttggygatttttttgtttggttyggatattgttgagtygagtggggygtttaggagttagygaggggttttygaggyggtttyggttyggtttaggtgtgygggtygyggtggggygtaggttygtagyggagttaygagattttygygttttyggttgaygttygggygtttagggtttgyggttttaygtgygatttattygggagttgygttttagaygtttygtggagygggggagaatttgaaggaagtygtggygygtttagatattttaaaaattygaattaattgggaaaataggaagggygtttttaaaygyggagaagatatttyggggtggggaaggatgttttttaaaaattatatttttttgttgtggyggttgtttttgattttttttattattaaaagaaatgttgttaygtttaatttttgttgttatgagatatggagggggtagtttagtattttgaagtaatttgataagtttttaagtagtaaattygaaagggaggtyggyggtttaggtatagtttttttgtaatttgaatttataatgaaagtatttttttttatggatataatagattagattttataatttaatttatyggaatggtttygtttaagggagtttyggttgattttattaygttaagttaaattggatgtttgtggttttaaygaaaagygatygtgatataaaatatataatttttaaagtaaaaaattagygggttggattttgtttttttttttatttttgttttttatttttaattttttagtgtgggaaatayggataattatttgtgtgtgttggtttttatyggggagataggygttttgggtttttttttyggygggttagaggtttygtyggttagtgygtaygyggygtyggttttygattaaggtttyggttygttttgttggttygtttgaaaygtygatatttttagygtaygattyggggtttygggggtatttatggggttygaagtttttgtttgtyggyggygatyggatagttttttygggygygtagggtagaggaagygttttygaaagttttygtaygtatttaygagtyggttttgygygggtatagyggtagtygyggygggatattyggtagggttttyggygttattttgtgttaaaaattgygttttyggagattygggtatygtyggygtyggtagttagagygggatttagtttttatygygttttttattggagtttttttyggtttttyggygagtgyggttygtggggagtgggygtyggygygaggaagtttttyggttygggygatttyggtttttgagyggtttttttttaygtygtygttygttaggtygayggaggatyggggyggggaygggggttttagyggtttattttgttgttatttttgatttattttttagtaayggygygtttttttttyggttttttygygaggtttgttgaagayggatttagttttygtagagttggggaaggayggatggayggaaggtttagygyggtttatttttttttttygtygtttttyggttggtaggagtygtagygatagtttyggggagyggggtttgttttaagatttttttygyggtatygggagttaggygtggtyggaggtatygyggttgttttaygtggttttygtyggtygttatttygygyggggaggaygygtgygtgyggtgygtggtyggygggttgyggggaygygt

SEQ ID NO: 6733 - DNA, 7937 bp, Artificial Sequence
  Description of Artificial Sequence: Synthetic polynucleotide
yggygggtttttagygtagttttgygygtttttttygaatttattygygtygtttggtgatttttagggttttaggygtggtagttgtttttattttgatttttttygatatttatattaaagttatygggaagagggttgttttggaggtttgggttygttttgttaaggattgattttttygggtagggagttagaggggatygttygagaggattygtttttgygaggtttagtayggygttttaygttttttttttggagtaaattygtttygttttttttttggagtaaattygtygtattttygtttgtatygaaattttgagygtygtttygygttatttttagttygygttygygttgttttttttttygggtygtaggttgagaggttgggtygtattttggttaygttttgttyggttttagygggatattagaggtattygttaaggtaaatgtatttttgtaaatttattttygttttgatattttaaggttttatatagaaataggatttgttygttttatattagtagtttttattaaygttygttyggygtatatattattttaattygygaggtygyggygtattttggtttttttttttygttataatagtygttttgttttygtagaaagygtttygttgttttagtttyggaaygttttagggaggtgaatgtagaatgtagaaaagaggttttygtggaatttagatttgtaggagggggygggggagggtggygaggygyggaaaggttttaattttagtyggtttyggggttgttttttygagattttygggggagggtggttagggaagggtttttttaagtygyggygaygtagtttggggggttggygggaygygyggtttygtttagygtttaggtagttatygyggtyggggtygggaaatgaaattaaagtttttttgttttygggagyggaggggtgggygttttgtttygttttygaaygttttygtttygygttygtttyggtygagtattgatttgtgtgygaagttatgggtaayggygaygggaagtattttttyggttggaagtgtgyggggggttgygyggygggtttagtyggggygagaygygyggyggtagyggygttgyggtggtttaggttttygygtttygatagtagatgyggyggyggygtaaagtygyggttatttatgtygggtttyggtttyggttygtygtygttttttyggagtagygyggtyggggttygggggyggttyggygygygggyggygtagaggyggyggygttyggggttataggyggtggtggyggyggggtyggttagtaygygggaggattgggtttttyggygggyggtygygtatygagttagyggtygttgtgygggtttatggtttgtggaggtaaaagtagaggagataygggtgattggggggttyggttygttygggggttttygtttygttygtttatttattttttttattttttattttygtyggttygagygagyggyggttaggtygggtggyggggtyggggygttyggtgttttttygtygtaygygygygtagtttagtattyggggtttygygygygtaygtatygtttyggttaygtttggttyggggtagtygggggaatttagtygtattgttygtygtttttygttttygttttygygggtttttgtagttagggygtygyggygaagaggttgttggttttgttgggtgataaaaatttaaatttgygaagttattaygtatattygtatatatatatatatatatatatatttataygtatatttttttttttttttygttgtttaaaggtgtttyggaggaaaaggtttggggtttatattagttttttttttttttttattttatgtygaggtttagtttttattgtatttygtttaatygaataattatgttaattaagygagtaattttattgattgtaatttaagagttttttttttttttaataattttttttttttttttatttttattttttttatgtatttttyggtttatttttttgaatttatygtggttttttttttttagttttagygggattagtttttgtttttagtatygygttaggattttaggtyggttttttagagtttyggaggttygtaatygttatyggtattatttgggtygttaygtygtagtgttyggtttgttgtttyggagtygggagttttttgttgaggttgtaataattatttygttttttaattaaattygtttaggatttttttttgyggattgggggtttgggggtgtgtgtggggggggtgtttttagagttagaatgtttttttttaayggtttaaatyggttttgggatttttttttttagygtttgtyggggatygygagtagaggtyggttttygtttygggtagtatygggyggtttgggtaygyggggtttgyggygtttagttyggttttttagtyggggaaggtgggttyggtttagtataattttttgttagtagattttgttyggatttyggttatttaaaataatttttatttttatttttttttatttttatttaaygyggagtatttatttaggygaaattggggataattttagattttgggtgyggagggtyggagttagtgatagaagttgygtgtattatygtgtttttaggygttttttygaaggygttttttggaygtattttatatattattttttattttttaaataygtattgttttaatgtttattatttttaataaaagggagatggataggtttgatatttttaattaggaattttgyggaaaattttgtgtttttgtagttattttattatgataataaagygattaagatgttttttatttattgaatatttttttaaattgygatattttatggttygggttttaaaaygttttatttgtagattattttgtgtttgatttaatttataatygaaaatataatgtattaagtgaatatatatttgtttagttgataagtttttttaatatttattyggagagtttttgtattgtaaataaatgggtttatataaagagttttttttgtttggtaattatatataaaggygtttggggtttttttttttttggggatygttagtttttttttygggtttaataaatagttyggtttttaagtttygatttyggtttgtaaagygagygttyggtygttagggttyggagagtgttttggygagggggttgygagygtaggggttaggggaggggttgttygggttggattagggaygtgggggtttttagtttyggtyggygtttttygagtttyggagggygtygggygggataaagggaaagaaggaaagggagggaggttagaaatttgtagttttaaaggygtygaaggtyggagaggggtygggggttgygtaygygggggtgttaggttttttggyggtttttagggagtygtgtgtgttgtgtttttgttttgtggttgtttttttttttttttttttttttaataagaaattttaaagttgagaaagygygagttgtyggygattttygggaygygggttyggttaygaagtaataattttaattttttattttttgygggyggatygtaggttygattgttttttttttattagtttgttygattttttaagtaaataggaggtggattattgtygtttgtttgygtygttayggttttgatyggattggagagagtttttttttgtgtttttttttttyggggagaggtygygtygygttttygygtttgttygygtygggtttygggggtttggggagtttgaggyggttaggaagtggggygaggaagggyggttatayggttygagttgggagttttatagtttygtagyggygaygtygttattygtygagtgtygaggttyggggtttatttttagtttagttttaggagaggtygygtyggaggatygygaggayggygtygtagygttaggtygggttgaggtaagggaggaaatggagygaaaagtggyggygggtagagggtttygggygggyggagaatygttgaygagggtatttyggaaggaattgaatttaggagtatagggttttttttygggaaggtagggygtgattttggagtygtyggttttttttgtygyggttttaggygtggttggygygttttaggatttggagtttttataagtttgttttgttttttgtttttgtatttaaaaattygtttttttttygttygtttgtyggagattaggattttggttygtttgttttttttyggygtygttttygggagygygggygyggtggggtttgtaggtygggttgggattaggygygttttggggygygagtggttyggtygtygtygtagaattygttttttgygaaatagtygtattygttttttgggagagttatgagaattggggtygygtttgattttygygttygaagaaaattagttygyggatttygttataygggtygtgattygagtttygygygtygtttygaaygygygyggtgaaaaygtttygttgygtyggttttgttyggttttttttttttatttttattttttyggaaaaaaaaaattttgaattgggaaygaagattygaaaaattygttatgattattttttttttyggtttttagtttyggttyggaaggttttttagggtagyggtygtgggtattaygattyggttagtttttttygtygyggatygatygggtagggttaatttaggattgtttyggggaggggagtagggtaggggagygaatgttggggttygttygtgggttatttagaattgggygtaygttggyggygttyggatttygtttattgttygttyggtgttattygygyggttygygttagaygtagtttggyggtttttgttttgttttygagtatttgtttttaatgttgggtgtygatygagataataagygtttagagtaaagtaaggatgtattaygggggtaattttaaatygatygataagattttttagagaaaaaaaaatygtttatagtttatattttttaagaaaaaaaaaagttttaatattttaayggattttgttaaaagggaagatatatattttttaatattataattttgaattttttttgttaaaaaaaatgtaaaattttaaagttagaataaaaaataaaataataataaaaatataaaaataaaaaaaaaatgaaagtaattttagttatttattggaggttgttttttggatataattgaatgtaatataattaaattagtaaatgtgattttgttttgtatttttattggtatttttaatgtgttgattgttgtattgtaaatgtatygtttttataataaygattttagygagtttatttagagyggtttttaaatttgtagtttggygyggygagttaygggttttgtatattaataagttygtgttatttagttyggaatagttagygygttgattggtygygtagttttttayggtygggagttygtgttatttattyggygtaaataggttttttaataggttggygtygggttagggaattgttaattaggaagtagyggggttattattaagttygatggygtttaatttaagttyggygattgygtagtttttttgygtagattattgttgttgaatgggaatgtggtggygtagggygggagagggagttggagygagygagtgygygtgtttyggyggagggggaggygtagatatagatatagatatatatatatatatatatgtttaatttagtaggtttaaygtttggtttttgtygtatagaaggttaagggaagaaatattattattttttaaaagtagttgttttttttttttggaatttgtttggtaggtggtaggtaggttagatttttaagtttagaggtttttttaggttgtttggtttatttatygttttgaagttgttgtttgttyggattygagttygyggatgtaygtaygtaygttygttgtttgggtagtaaaagttttgaatagttygttyggtttttttttttttatgatttggggattagattttgggaagtgagttttgagtttttagtygtttatattattggtttttaattttatttttttttgttatattttgtaatagagtagttattaaaatgaaaattagggatttattgagaagataaggattgttttttttttatttatatttagatttagaaaatatttttagtttggtaatgggggaagygggtatggtgtggtaaattatgtatagtattttttaatgttgttttttgtttgtttatttgttaaatttttattttaattaaagtaagttattgaataatttttatygtaattagatgtaaattatttttaaaatatttygtaaataaatatttttgttagaatttggttttttatttaaatgttatttatttttagggagtygaggtgatgttttagtggygatggatatatttatttttgtttttttttttttatgtgaatttttgtttttttttttgggggaaaaaaggatatttaaattaggagttaattgatagatttataygtattygaaattttttatygttttatttyggtagggataygaaagagttaaatttaaagtttgttgtttttttgttttttygtttttattttygttttygygggatygttgggattggttggtatttygttagtggattgtttattatygagtgtaaataaggygttgattggttgttgtttagttygtattgggttttttgaaaaaagtaattattggtttygyggttttaaggyggtttaaggtygtttgatgaaaggagataagttggggatygtttttaggattttygygggtygatyggggtagttygggagtygaggtgyggyggagagttygyggattaaaggaatttggagagaaaggggaagygggyggtyggtttyggtyggttttttttttygtaggttaygtygatttggggtggggggttgygggtygygggyggggatttygggatttttygtttgtttgagtyggggtttaygtyggygttygtttygggyggttyggttyggaggggagtttyggagagttyggggttygtaggtaagtatyggygtttygygggtygggtyggggaygtaggataaggygyggggtttatttyggttggttygggagtggyggtygygygggttyggttttygttttyggygtttttyggtttyggyggtygggatttttygyggtygagtttttggttaggttttaggtyggygttttyggaagygaygtttggygggtygyggggtaygagggggagagtygggaagygtaaattttygaagygygyggagattygattagygygyggttatttattaggttgggggygattgaattaggtttttgggygyggtygtyggttgggggtgtgtggygtygattttygggtttttgtygtggtttygggaggttggagtagygagtagyggttttagygagtgtgtyggggaagygggtgttttygggtttyggtttygygggtgtaggyggaggttgttygtttttygygtatatygaggayggtyggttyggtttyggagaaatggygtttgagaaaggaggggaggggaaggttttyggattttgggtagggattygtygtyggggattygyggagtttttyggggatggaggaggygygagttggaagyggygygygagttygagygyggggttaatatygtggggtttagttttttttggttygggtaagtggaygygtttygaggtttygggtttaygtagggygtttttygtagayggygt

SEQ ID NO: 6734 - DNA, 1408 bp, Artificial Sequence
  Description of Artificial Sequence: Synthetic polynucleotide
ygygygyggtagtttygaggtagtagagygyggagtygggagygyggggagygygggtyggyggyggygagggaggaygggggygtagayggtyggygygyggygyggttattatgggygtgyggtgagtagtygttygggaygattttttyggttgygyggygttygygyggagtttttyggtyggyggtgygtttttayggttattatgaaaggtagggyggyggtagtttygyggggttttgggyggggggaaygggtttyggggygygygggaggttayggaggtgtttttygygygaatttttttttgggttgygggttyggggagtyggggttgttagggygtygggttygtgygyggatattgggggygtattyggttttygggttaggygyggttggagatttygaggttggggttttgaagygygtaagtatttttttttttatygygtttttgtaagtagtttgaagttttaagtygttgtttayggattttygtttttaattttttaattgaaaaaatttgtygaggagagtggaggtatygttatttttttyggtygtttttttaygtygtagygttttttaygttygtttagtttttttttttttygtttttagtygtttttyggttygagyggttttygygttggyggtygggtgtttttttygggattggggatgtttttygtgygttttygttatatttggtaatgattaggtgttygaggagtttagttggttygggaagtgtatttggtatttttttttattagatttatygattggaaaatagttgttttyggtttygygttttttttaygtgttygttttggggtgtgtttattggtgttttggggtgatatattttagttggttagtygttttttgygyggtgttttttgtaggtyggtttatggaagtgttagatgttatygtattttagaaagaagtaygagaaggattgtagggtagttttttgtttagtggaaatayggagatttgttagyggaattttgatttatgtatgagataagtaatygtagyggaggtattaaagagtygtttaggaatgggttygygtggtgtttatataaggtttygtgtgagagttgttggttttgtgttaggataatatagttttgygtgggtgygaaatgttatttgatygyggttatttygtttttagtygttatagatttggygatgtaatygttttgatttttagggttgtygttygagggaggygttygggaagttttaaggygtttggaaagtaatttttggttttggaaagttttttttttgaagggtagttttygyggaattaatyggagygatgatattttattaatttattttttttttaagggygttaggtgtttaygtygggagatttygg

SEQ ID NO: 6735 - DNA, 208 bp, Artificial Sequence
  Description of Artificial Sequence: Synthetic polynucleotide
ygttttyggggtygygatttttttygggaggtgtttgygaaggyggttttgtygyggtgggggtggggaggttagggtttyggatygttggagttggggtygtagttagtttttggygagtgttttttggttgttgtygtaggggtttgttttttyggattttttttttaatttygtyggatttttttttttttttttttaygttygt

SEQ ID NO: 6736 - DNA, 805 bp, Artificial Sequence
  Description of Artificial Sequence: Synthetic polynucleotide
ygtygttygyggagtttgattttgygttaggayggaggaggttgtgtttatgtaattgttttgaagtattgyggtggttttttttttygyggttgggagggtaggtaggaygaggttggtttttttygtayggtttttgggygtgggttttygtygtagtttygyggagtttyggtgttttttgtaatagggggyggggggaatagyggygagtagttttgggttgyggttttttttttaygttygagttttttgygtatygtygtygaggaygygygttygagtttagtttttaygtygyggygygttygggttttttgttgattttaggtaattttttygtttttyggagtgggggattgygagggggtttyggttttaygaggtgyggaggaagagttygaggtttggggygaggygygygggatagtggggttgaygygtggtttyggygtygygyggtttttygaatttygagtttygygttyggygyggtyggggtttttaatygttttttygttygtygggatttttatygggtygagtttgygygtygygtttttygttygtttygttygttgyggygtagtagtggttgggtyggygygtagagtttgagtttyggttttyggtttgggggtttttttgggatttttggtygaaggggygattyggttttygygtttttttttygttaatttgtataaatttttygttyggggygttatgttttaagttgtttttygggttgggggygagygygggtyggtttttttttyggggaggtgygggggatagggggyga

SEQ ID NO: 6737 - DNA, 2462 bp, Artificial Sequence
  Description of Artificial Sequence: Synthetic polynucleotide
ygagygygyggttgggaggygggtttagggyggggtagagygyggggatygttygggtatygggygtagttaaygagyggayggggagggygggttygygagggttgagyggygygggttgttataggygttygaagygygttgtaggtggtaatttggaggtgtygttatygtagttgygggaggagttygggtttggyggttttttttagtttttaggagttttttttygtygtygagttygagattggatttyggagaattygaaggaaagagtttttgyggagggatttgtgagtagttttatttttttttgtttttgygttattttttttttttaaggaaggttgtgtttgygggttgygaataagtttygggaggggttttaaaggaaggtttyggtgatttaggtgagygtttttttttttttggtagtygggygtaggtygggagygtygtttagtttygtgggtaggggygygggtgygggtygtttgtttttggttygaggtygatgggggagaaagygaggaaggggygaggttggttygatygggggttgtttggtygggttygttyggaggygatagggatttttagaygggtatttggagattagggaygagtagagaggtgttttgagggggatagagggtttgygttyggtttaagttgatygggatygatygtttgygygttgtgttggagttgtygyggaagtygggygyggygtttttgygaattttagagttagtgygyggggttyggygagygtattagttttyggtttttyggagtttaaggttttggaggaygttattttttttygttygggtaatttttttttygtttttttttgtttttattttttygygtyggtygtttagtttatttygagattttgtgtttttgttagygygygttagttgttgttgttattttttttttygttttygtyggagttggagygatttggggtttggtttttyggtttyggtagtttagttgtgggttggaygygagtggggttggttagttttttgygaggagggtaggagtgagygygggttttttttttagtgtttttttygaattygttttygtttttttgtagttygaatygttagtttagagagyggagttttagaagttagattttgttygttttggggaaaygygggggaggggggggtttttygggaaggtgygaatttygtagatgaggttagagttttygtttttattttagygttttagtttttgtttttttgtttttaagtggatagtggttttgattttygtatttyggtttgtggygtggggggygttagyggtagtgtgtgtgtgtgtgtgtgtgtgtgtgtgtgtgtggtgtgtaaggatgagygagtgygatttttygggaggtagaggygtaggagttagtttttttagttyggyggagtygtagggatygttttttttygtygttagttgygygtagttgtatttyggtaatttygygttgtyggttttttttttttagttttagttttyggtatttttaygattaaygyggaattttaggattaaaattatttggttaaagggtgygggtgggggatygaggygttttygaggygaatgaggttgttttttaaaattygggaggygtttttygttyggygttgtattttttygtggttyggttgtaaggatttgyggtggaggtttggyggaggygggttygygttttagagagagygttaygttattygagaaggygaygttgggggttgttgagttttttaattttttttggygygttttgtttagaagtyggggagtttttggtyggyggttggyggggaagygyggygygggaggtggggtggtttggttggtgttgygggagggygtttygggygygttaggggttgygtgtygyggttggagggygygtygggagttgyggygggttyggggtattygagtggygttggaagttgagtyggggttygtagggttyggtgatygttttggygtygtygttgyggattygggagtagtaattaygyggygygttyggtygttttttyggttygtyggtygygtttttygttttttttttgtagaagtgaagtygtygtttgggttygttygggttggygatttttgygttagaaaagtttgaggtgttggaggygaaattttttygggagygaagggyggygtttataagataaggaaagggaagaygtygggttttggygggtagygtagtagygggagggyggygttgagygttaaggatttyggaggygaggygaggttaggyggatttaatttagttaggaggtgttgttttygtttttggggtttttttataggtatttggtgttagttatagattttygttttygttagttygtaattttttygtaattttttttgaagtgygatggattaagattgggtygyga

SEQ ID NO: 6738 - DNA, 990 bp, Artificial Sequence
  Description of Artificial Sequence: Synthetic polynucleotide
ygtatattttgtgyggttygagtggttyggatggtatagtttaggtgttygggttaaagttggtatttttaaagtttagaaygtaatttgggygygttagtataaattyggttttyggtttttttgaagttagttaagttygtatagggtttttagygtttggaaatttgagaggygtggaagggtggggagtttygygaagtttttagtttttgggtgtttttyggtttygygggggagygggtttggagttaaatyggtyggtygtaggttggagtagygggygtyggagygygyggtggggatgttygaaaaggagttagaggtttagtyggagagttygagaataygagggatgtttattttgtaatatggttttaagtttttttttgtttaygyggaagygtttttygttttatttygggttgtgtagggtygtttyggygattaagtygttttyggagtygggtattggggagtyggtgttgygttygttgttggagtyggggttygattgygtygttaggtagtygggttttttttgggyggttatggtgggygygtagygttygggttttygttgtygtygtygttttgtttgygttgtygttttygttygtyggtygggtttaattggtttttagygtygyggygttagttygtttttttgtagtygtygaygttatygttaaygtygtygtygttattgagttttyggygtattttagtttygggygtygtttaygttattygttatttygggtygyggtttyggttygggtttagtggttgygtygtttttygttagtaaygttygygyggaatgagygygtygygttgttygygtttttattygtagggttyggygtttttttttygttygtygtttttatagtygygygtttattggttyggttagtttayggggagtygyggygggygggyggtttttggygtttatatattygygygygtatatatatattaygt

SEQ ID NO: 6739 - DNA, 2274 bp, Artificial Sequence
  Description of Artificial Sequence: Synthetic polynucleotide
ygtgtygggttygtttttaygtyggattttygatttygatttatagatttttttygtgaggggtttttttgggtttagaaygttttygygygygygtgtaggtatataygygtatatatttataygtttgttygtatatygttagtgttttttttttttatttgggattttygggtagtygggttggatgaataagttgtagttggtygyggygtttygttagggggaygagggtggggagggggagtttagyggggygtagggtygtggttagggtttggggatttgttygttttttttygyggtygttaagttttatygttgggatyggygaggaattttttttagttttttygtagaygttgtaygatygyggggatttttyggggtygttagtygygtygggtagggggygatagggagggtagggtatygggagatygtygtygtyggagyggtygttagttttyggygatygttgygggygtagtygaatattagyggtttgggttyggtygttgttyggggtyggyggggatygygtagygtttaygttaggyggttyggyggttgtaattgggaattttaagtaaagttttttgttgttttttttgtagtyggttagggatttaagagtgtaagtygtttaattttgagtattagtttaggtygyggaaggayggyggtygagttggtagtttyggttggggagttygttttyggggttygttygtttygttygttygaggattgggtgtttgttagttttayggtttttygtttagygttyggtttataggtagaagyggtgttyggttygtygygtttttygttyggtttygaygttagttttagggttttattattagggagttgtyggygtttygggygtttygygtyggttygygygtttygggggyggtagaggyggtttygtttatttgagaaygtttygttygtygtagttagtaaaagttyggttaaagtygttaggtaagttttaagtttttttatggtgttgagtgygggtygggtygtttttyggyggyggtgggtgggygygygagggyggagggggtygggagttttggtttygaggtagygaggagagaygggtaaatagtagagygttaagttaagtttttaaagtgttaatagttgtagaagttygaattttagyggttttaggggygygggtatagggttttgggttttttttttttgtttttggttttattyggygtttggygtygttggtagagggagyggagggygagttygyggagttaaaattttttttyggtttyggttgttgagttygtygttttttttttttttttgttygggattygggattygagttgttggtygtggtygtggyggtggtygtggtygtggtygygygygtttygttygtygtttttttataggtagttttaagtttagtttygggyggyggygygtygatgatygagttygygtyggttgygygyggggtttttgtttttygattgattggyggtgtttygtaggtyggttgaagggagygtttaygttayggtygttyggygtygtygyggttygttagagggygtgagygttygtgtttygtyggttygygttygagygttttygggagttyggttgggggyggtttygyggttatagttattatygtygtygaagygggygttagtygygyggggaggagyggttatygggtttttttygtttattttttygtttyggtygygttttttattttggtagttggttttggggagggtgattgtggaagaggttgygtygtygttagaagtttgtttygggttaygagtygygagtagtttgtgagygyggtygggygggattagyggtttgygatttygygggygyggttaggyggtttygagtttggygtyggayggygatgttatygtatagggttagttgtattyggagtygtygggtttgygttgttyggyggttgygggaaaagygagttaggagatygttgaggtttyggagggttgygagtttttttaygtygygggyggagygaagttggygggygtygggagatggygygggagtygggagygtygagtttygygatygttagttygttttyggtygggttygtygggtataygtygttggtttygagtattggygttygggaagtagggygygtttttgttgttttgygtttttattatgtttyggtgtttygtgtgggttygaagygagtygtaggtagtatayggaaggygg

SEQ ID NO: 6740 - DNA, 882 bp, Artificial Sequence
  Description of Artificial Sequence: Synthetic polynucleotide
ygaaggttgtggtygygttttygtyggttagtttttagtagtagtttatygtttttgtttygygttttygttttaggttygtayggttttagtttygyggggattagtattgagtyggtttygtygtygttttagtgaygggttgttgttgygggaagttaatygtttagygtttggaggagggygaygaggtttttygygygagygagtattagaaagtagtygggttttttygttttatgttggttyggttggygtagttygatygyggtyggtgtttgaggttgggggaygttttgattygygtyggtygtttttyggtggttttgggygygtttygtgtagtygggaggttggaggygttgyggtyggaggagttgggggagttggygggyggtttggtgtgtttyggtttgygygaayggttattgttggygaggaagtygggyggygagtttaaggttagggagggtyggttttggygttyggygygtttygygatttgtttggttgttyggggttgttgtataagtyggtgatattgttttgygggtttayggtttgtgagygttgygtggagttggggttygygyggttaygggygygggygygggygygggygygtgaaygtagtgttgagtygtttgttggagaggtttttttyggtygagtgttygttgygtaggttggagggttaggygyggagtttgtagygttagtagtagttygaggtygygttgtttaggtgygattaggttttggagttgtgatttggttgtggggtyggttygtttttttgatttttgttaagtttagyggttggagttaattygygggtttgggttttygagygttttgtttaggygtagggggttatttygt

SEQ ID NO: 6741 - DNA, 4359 bp, Artificial Sequence
  Description of Artificial Sequence: Synthetic polynucleotide
yggagygtttaatttagtatatygttttyggtaaattgygagtaatttaaagtagttygtttagtagggaggggagttggtgggaggggggtggatttygtygttygtagaggtggggagatttggggggyggtttygtttttaggttgtagygtgggtttggttttttgttaagttaggagygtagttyggagttagygyggttttygggtttttgygtttatggygagggtygygggggaatagtttttggtaggtaatttgtygggtatttatttgagtttttygtatygyggttygaaaatttgggagygttttaggataaagggttagttttttggaattagtygtgtgtgattagtgtgtgttagttygtatgtgggggttttagtgtgtaattaatttagttgtttatygtagtttyggagaaaygagtaygtttttttgtaygtgtttagggygggtgyggygggtagtgtattgtgaataaagtyggttatttttygygtygtatttyggggaygattttyggayggtttttygyggagagtygggyggatgagagygtggtgtgtgtgtgtgtgtgtgtgtgtgtgtgtgtgtgtgtgtttgtgtgttttgtgtttttttaaggagtyggaggyggttygygaggtagggatttgttttaatttgttttatatttggygyggttttttygaagttygggtggygtttagggtygggtaggtaygyggaggattagtagygttygttgtagaaaaagatatygttaatttttatttagaagtttatattgttttgagatttggttttttatttttttttaaaaaaaaaaaatgtaaattgatggatgggttttaattgatgygtaaaatgttttttttgagagtaagataggagggttagggaagggggaaataggtagttgatataatttttatagtttaattgtygagaattyggatttggaggtaaattygaggaygtattygaggagtaggygaggttgttttttagtaggayggtttggtatyggggygtattgttggggatttgattttttygtgtttttttattttagggattygtagttggttygygygttagggtatataygggttgygggagaaggtgaaagttaggatgtagtaygagtttygagagtggtttgggttgtgttttttaagagaatagtygaggttttyggyggttttgggaagttgtttttgggtygggagagygggaggyggygaygtaaggaygygttyggagtttgggygygtygggggygggygtttggttggaagtggggtagtgttttttatgggaaagygagattyggygagttttttggttgtttttttagttttygaggtgttygttttygygygtttgaggtagygtagttyggagggygaaygaatggyggttggtaaattttgagtgagagtgygtttyggattygaattgtygaattgtggttgyggtagggtyggtygagatataagttygtttttttygtttgttygatgggttttagggagattttagttttagtttggtggagygtttygttygagggagttgtgttattttgtttaggggtagggagggyggygttttgggygggtggggaagggtttttgtggtttttggggttttaagygttttttttttygtttttttttttatyggttttttttagttttttttgtttygttttttttyggggttggttggatyggygyggatttgttttagatttayggggagygttttaggtttttaatgatagtttaaatgtggttgttggaaaagtygaaagggatgtggttgaygtggggygtgtttygtttttttgtaagagtyggaaagggagttgggagtygygyggttggttttaggttttygygtttygtygttagtaagtaggtgggggagtygtygtygtygttagttttatttygtttttaagtttygttygttgygttttggtygygggygtygagagggtgyggggtttygtygtgttttttttattttgtttattaatttgtttgtttygtttygtttygggyggttttagataygggtttttygyggtagtattygyggttygttyggygtagtygtygtttygatttttyggtttyggggggtaatgagggggtagtggaaggggtattgtttttygggtattatttagagaaaygagatygtttygttttttygtyggttttttttttttttygttygggttygygtaatttttygttagagggtaagttgggagtgtttygtttttatygatagtttttttttttttttttttttttttttttttaaagtttttttagaagtgggagtygggtgggggaggaagaaggtttggttagttttygttttttattttattttttyggtttaatttgtttttttttttttttttttttttattttttgygygtygttgttttttyggagttgygttygggaatgataattggagygyggtttttttaagagttyggttttgtttttyggtagttgaaggttattaaatataaaagtttttagygttgyggtttaatatagygtatgygttttgttygaggattggtagagagayggtaatatggygagaatgtttggtagyggggattgtaatattagygygggyggtagygttagygttgtygtygtygtygtygagaataatggggagyggggygagggygagygyggygyggggggtygyggtygtygttatagtygttygtattattgtagygygggtgaggaggaggaggaagaggaggaggaggaygagatttaggaggtgtagataaygggggaygaggaggaggaggaggayggaggtggggggttggaggaggaygaggaggaggaggaagaggaggagatggggttggattgggaygagtttttggagttygaggattyggtyggggaggagttggagttygagtyggtttatatgattaatatggattagagygtygygttggagttygaggygtygtygygattgttggygtttygggttygyggtgggtygttyggggayggtttygagttggatttygaygtgttgtagygtttygagygggttyggttgagygagaatattyggttggttattygttaygtygtgygtatttttygggagtatttgagygagaaggygtagagttyggatttygagattatggataagggggygttgtgtygygtgttgygttttttttatgtygaggttygttttaaaagyggttagttttatagtaagtygtygtttattagtattygtagtttttttaatygttattttaatgagttttygtattgtygtaygttygattttattaaggatttygagttgygtagygttaatttgaygttggtygyggttattygtaagttygaggagtagggygtygggtyggtggtgtagaagtaagttattaygygygtygatttgygtaagttgtatatttttagygtttttagtattaataygtttttygggttgtttaataaggtttggttygagaygtgtatgtatttttgtattygyggtygygagaattagygtgagttggaggaggatttttttgggttggttatggaygaggayggtygtaagttygtttattttaagtttttygggttttattataagtygygttygtygtygtggagtaagaagygygtygagagtagygaygaggagaatttgtttygtatgtatgagaygggtatygagttttgtttttaygttagtttygttaagtatttgtygaaaygtaattttttttgtaaggygtttttttagyggtttygggattattgtagygagggygatgtgatttggtaygagaataaagttatyggtaagaatttgttaggtattyggatgtagatgttttttaaggyggttaagttttttaagatttatattaattattgtatyggygtygtttttatygttaygtttaatagtatygygggtattggtattaagttgggttygttygtttygtagggttgttaygtygaggttttgaayggggyggtayggtattatttttattatttttttatttattttttttattattatygtttttagtygttttygttggggaatatttatattttttttaaagatagttaggtygggttygaygtgaaattygaggttgygtttaagygygttttgtaygagtttgtgttygggtygggggaaatttgyggttttattttttttaaaagattttgtattygtttttyggagtttgtggatgyggtggtggtggttttygtgaaatayga

SEQ ID NO: 6742 - DNA, 2762 bp, Artificial Sequence
  Description of Artificial Sequence: Synthetic polynucleotide
yggggyggtgttyggygtattttaggttttttttyggygatttttygygggttgtagtaaaatayggggygtttyggyggggygggggygggyggttgtygyggattyggtyggttatagtygtagtttggtggttttygattggttaygaygygggyggggaggtttggyggaggagggaggygggggygagggyggyggyggyggygggaggaataggagaggggagygggtygygtagttaggtagygygtggggygagygyggggagagyggyggyggttygtttaggtygygtagyggaggtygagyggggtgygyggtyggygayggagggyggygygygygagtgagyggygtagggygaggatyggygggygggtgtyggtgygygggtagtaggggyggttgyggtagtagttgygygggayggagtygyggygggagagatygygtyggtttttygttttatttttttgyggtygaggtyggagaatagtttttaattygtygggggatyggaaagaggagtygagaagygtttttyggtttttaygtagyggaggygyggagtggygggattgttgttttttgtgggtgtagtaygtaygattyggagygtttttttygyggygttgttttyggygttttygtygygtygagyggttttggagyggggattyggaggaagtaaaattaygagttygaaatttygygtggyggagtttttggggagygttattygttttatttttatttttatattttttatyggttaaggttttygtygttgtatttttygyggttttygttgygtttygggtyggagtygagtygtttgygttgttatagtagtygtttttatatattygtagaygtttataygttttttttttttgttttttygttttttttttagttttttgatttttgggtttgttttattatttttggtgygagtttygyggatttygyggttygttatttgttattagttygttttttattggyggggagyggagagtagygaagaagggggtggggaggggaggggaagggaagggggtggaaattgtttggagtygttttttygygtygttgttggtgttgtygttgtttttttttttttygtygtygtygtygtygtygtygtttttttyggtttttygttyggttttttttygtttttatgtgtyggatagygggagygttgyggattttgttgtygttgttggyggttttgttttaggtaygyggyggttttygygggtygggttaygggyggggtggggygggyggygtygggtttttttgtttttygygtygttgyggggtygggttgygtattygggaagggaggtgttaygtygygtygygtygygtygygtggtyggtagttgygtaggtatygggtttygttygggygtyggggtagggttgtyggggttagtaggtttttygygttttttttggyggggttttaggggttggattgygggttttttttgtttttttttyggggtygagtaagttygyggggggtgtttttaggtagtaggagggtgaggtaggataatttttaggttttgtagttttttgtgtttttygtttttygtatagtattttgttttaatttttttgtttatttttgtagggatgggtygygagtttatagtaggaatttttattttggtgttttagttaygggatttgtttttattttattttattttgtattygtgygtttttyggtgtttaagggttttattgttttattgtttttattttagtttggagttgttttttttttttttttttttgtttttataatattttgtgttygttttatttggaaagaaaatttggtttttttgttyggaggagtttttgtyggttagygtttgtttgtagaaygagtttggttttttaygtttagtatttttttygggygagaagtttygttaygyggttgtttttttttttgttyggttgtttgtgttttatatgygtttygggggygtttttgtttggagtttttygtattttttatattttygggagagagttagygagtttttttatttaatttttattaagaggttttttygyggtaggaagtatttgttttagttygggygtaggttttttygttattgtaygttgygggtttttagttygggggtagtttaatttttygtygtttttaattygaggatgtttttaggtttttttygattagttagtttaggtttggaggttattttatatagtttyggtygggattttttagttgggygggtgtagtgttttggttttaagtyggttttygtttgtygtggggtttttygaaggttgygggaaaggggygtgtttattttygtygyggggtaggaaaatttayggagggtttttttgtttgtygttttyggggtaaggggagaggtgttttattgttagttggtagtttygaaaagtgyggaygtagttyggaagtgtttgtttygggggtggagataggtggtgtggattatttygtttygtggtttttaygggttagggtttggygygtttyggttygtyggggggtgagtgttgttggggygggggtaggggttggayggggttggttttygtagtttttygygttttttttygtaatttttagayggtygtgggtygtygtygygyggagttttgtttatggtgygttatggtgyggtaygtttgtttttgttyggttttaygtttttttttygggtygt

SEQ ID NO: 6743 - DNA, 338 bp, Artificial Sequence
  Description of Artificial Sequence: Synthetic polynucleotide
yggagygggggyggtttggagygttgatygggygtygaaaygtygggagtygggggttaagggttygagttaggaggtttyggagtagtagtygttygttttttaygtygtygtygtygttttygyggttgtttggataygggataatygatttggggtttygatygtagtagagtyggaggggtgggtaggygygggttygggagaygygyggggaaaygygyggagtyggtgagtygggggygtttgtgtttyggygygggygtttgtgtttyggygyggggygttgtygggyggygtttattttttttggtygttygtttgygygattttygygg

SEQ ID NO: 6744 - DNA, 1435 bp, Artificial Sequence
  Description of Artificial Sequence: Synthetic polynucleotide
ygggattygtgtgtttttyggggtttaaaggygttgggygggyggttgttttygggagaggygtagtttttatttttggattayggggttagtggttggggaagtttttggggygygygyggggaggyggygttgygttttatttgtttagtttyggaygtagttygggggygaggygtttagggattattttaatttaatattgggatttttaataaattaaggaatgggattttaattattgaaaatttagtttttttgggttagaatggtgttgggatggttttggttataaaatattaaagagatygatygttaagggaataggaaaaaygttygagatagtygttgtaattaygaatggattagatttggtagtayggggtattgattgttggtgtttaatyggattttttttttttttttttatttttttttttatttaaagtaggttttygttgyggtygggatttygtatttttgtaaygtggtyggggttgtattttttatgagtttagggtgaataggtgygaagtgygttgggagtattyggttagyggtygagygyggggaatatggagagygagygygatatgtatygttagttttaggattggtgttttaggatttayggggatttaggtaagattaagayggtgattygtaaaaaataygaayggatygtttagttttttaatggtttygagtygagttttayggataaygttaaatttaaattttgggttaaatygaagggtttttagttgggttagtyggaygaggttygygggggaggyggyggygttaagtaagtgttttaygtgtttgttaagattayggtgagtgattygtttttttttgttatttgtttgtyggagtagttyggyggggagggaggaaggagagaggygggagagagggggagtygtgagtygtygttggttygtgtgttttttattttttttaattttttttttaagtygtttttattygtattagttaggygygttttttttattgtatagtttttgtggttttttattttaaagyggtagygtatttttagagttggttttttttttygtttygggttttyggatyggttgtaggagttttttttttygggtygggyggyggygtttggygttttygggttgggttattgttttatgtttttttttgggygtttggygygtgttttatygtygttatygygtttaaaggttaggttggaagttyggtygtaygttttgagagtagaygagtttgatygatagtttatagtgtttttttattggtataaagttygaatgtagygttagyggtggatgtggggttttttttaggatattgttaggttttatygttagatygttgttygggaggtayggggtagttygaatgtttygattatttttagagatygttgtygyga

SEQ ID NO: 6745 - DNA, 510 bp, Artificial Sequence
  Description of Artificial Sequence: Synthetic polynucleotide
ygagygtgagttagygttgaaggtttagagygygttgtaygagtagaagattttgttyggggtaagtggygttygtygtggygtaagyggtygaygygtygatagggggygatttygggaggtygggyggyggygyggygygyggggagaggayggtagggygttygtygtttygtttgagttygggagttygygygtttttttaaatttttgggttttyggtygttygggtttaaygggattygggataggggttttatttggtygtggtygtgaagtttttgygygggtagtttggggygggggagyggygygtttygggttttyggagygggagttgttttygtygggttygygggtygygtgygygatygagttygtttatygagtygaygygggtygttttagtgggggaggagggggtyggygtgggagggggygtygtaagtgagattatygyggtttatttaaggagttagttttygtttttgataaattatygygtttygg

SEQ ID NO: 6746 - DNA, 2722 bp, Artificial Sequence
  Description of Artificial Sequence: Synthetic polynucleotide
ygaaagtggttagtygagggtyggygggggttaggttagtygtttagtttygtygttttagttttttagtttygtagttygygggggagygggygygttattttaatttgttaggtttttgaagygaagaggttgttttgaaaaagtaaatatgagagaggayggggtgtaggtaaatattattaaygtgaaaatttgttattttagttaagtttattattagtatttatttttataggyggggtygttyggattttgttttyggtttygygtttgttattttttttttygygtagtygagatgttagttttagtgggtttggyggggagttyggyggggttyggatygggyggttygattttyggtttttayggtaggaaygatttagtttygtatttygggagttgtaggtgtygaaaaygaaattygygggggtagygtaygtygygygagtttyggttyggyggtaatttagatagygatttaggggttttatttttttgatggtgattaaaaaaatatattttatttgaattygtaaagtagaygagggtaaattaagttatttttygygttggtttatyggttatygygtttagygttttttttttttttyggygggygagygggtaggggygttygatttttatttttttttygttagttatygggggattagtygygtttttyggggygggggaggtygttygggayggggatttttatttttygttttyggaagygggttggggygggggtyggatttygagtttttatttttygtttttttgtttttyggygyggttygatagtttttagttttattttggtaggtggtttgggtggyggtagatgtygggygggaggaagatgtggggttgttttggtaggttgggggtgtgaggaggaaaaaaaaatagagaaagatatatatagagagatagggagagagygygygygagagagtttttgtttatagatttatttatataatatatatttatgtagttttttttttttygatattgatgaatgygygttyggattttygggyggattttttttaagtyggttygtttttttagtttaaataaataaataaagttagatggaagaaaaaagygtttattttattttygtygtygtttygttygttatttttgtttttgtttygttygtttggygttttaatagagtatagtttggtggataaagtttttttatatatttataygaaaataaaaattattatttttaaaatataaaaagttgtatttgttgttattataaaaagaatttttaaaaggtaaagagaggaggtyggttgttyggttttttayggatattygtttttygyggtygtygggttyggaattttagygtttttygaagagttatgygtttggygttatttatagtygggggtygtttyggattgtattatygttayggygyggggtygtygaygggggaggygyggtggtygtygttttaygtygttttgttttyggtygtygttygtygtggygygggtttttatagygygtttattttyggtttttygygttttttttygygygygtatattygttatttttatttttggtttggttgggaatttgaatyggtttagtttgtttaaayggaaaggatagagattttgtttgtttaatgtaaaaaaaaaaaaaaaaaaaaaaaaaagaaaaaaagaaaaaaaaaattagattagattgagagagagaggagagagggagagagagagggagagagagagggagagagagaggagagggagggagggagagagagaggggggagagtagagagagagygygagygygagygagygagagaagaggagaaagagagagagtagagagygagyggagagygaggtgtagagaaatygagggggagagaattygagtgtgtgtatgygtgtgygtgtgtgagygygagygagygagagagaggagygagagagtgtgagygagaaagaataaaaggaaagaagattttttttatgtatataaagatggttaygttagtaaayggataggttgataaygtaagttttagtattaaygggttyggtagtagttygggtagtgtygggtatatgaayggattaagttatagttyggggaattygtygattatttttatgaaggattaygatgttattaagttgtttattgggtagatttttygtaatttggatgagaaggattttaagttttttttygaggagtttggtaaaatttaygagtttayggttttgaaggataggtttataggtatgtataaaggtgagtatattttttttttttaattttgtyggggagtaggagygggttggygggtygatyggtyggtyggygattgaygagyggyggattaagygagaggaagtttygggygggygyggtggagggaggygttygggtagyggagattagagttggggtgygtggggagttgttygttggggtaagattgggttttgggygaggtgttgataggaaygatgttatggagagagtagygggygtygatgaagagaaagagagaggggatygaggagayggggtttggatttttgggtatagygatttgaaagatggggatggggaaggttgtatyggtygagtttaggaygttgagyggayggattygygggtttttggtyggtygaggatygagggtgttgtttatygtygt

SEQ ID NO: 6747 - DNA, 1133 bp, Artificial Sequence
  Description of Artificial Sequence: Synthetic polynucleotide
ygagggyggtygtttttattttygggggtttttttaaaatggggtggggggaagttatygttygttttgygttttygygggtgtgttttgagttttyggtygttygyggygttygttttygtttyggtgtttgyggygatttaygtttygaagtagatttygaaaggaaaaagygatatttttgtttygtatagagttaaatattggaagtaygagatagtygaygtggattaggattattttggtttttygtgyggyggyggyggyggyggttgygygygggttttttgtggygyggttttggggygygggygygggyggyggyggggttgygggagtygtyggggygggaggyggagygyggggygygggyggyggtggggyggyggttggyggggagatagatggtttatggaaaggtttttttttyggtttttttygatatttaaaggygttggggtygtagttgtygttatataaaggygygygtagttaatgggagyggagygtagygyggygyggtttygtyggaatygygggggatagyggggatygygggygygygggtggyggagggagggaggggtgayggttggaagggggtyggyggttaatygttgyggttygttgyggggygygagggaggggttagttttaygggaagygtggagtttagygygggtttttggtygttygygggtyggagagggygygygtgaagygtttttgtatagatatgggyggygtgaatayggaaygtgtatatatggagagggaygtgtatttagatatgtggaggtgygttttttagtgtagagagaygggtaygagygtttttagtgtataygattttgaggtttttgtatatygygtaygggttattyggggaygtgygttyggaggttggygtaygtgtagagtttgattgygggtataagggaagttggaatgygaataagtagtygtaaataggatttaggtattgttatatagatatgtatatattaaaygttttgttaaygtaggaygygtgttaagaaygtatttttagagatatatagagggaatataygatgtagatataggtaagataygtatattttttaggttttttgtttggygtatygygtygt

SEQ ID NO: 6748 - DNA, 2401 bp, Artificial Sequence
  Description of Artificial Sequence: Synthetic polynucleotide
yggtttgatyggggygtttygtygtttttttagtgtattttatygttttyggttgggggygtagtattttggagagaggygtttggtttygygtttgggttgggggygttttattttgygttttgggggttaggggygtttgtygggtygttgtygaggggttttgtttatttttgtttagttyggagtttaggygagttagygyggygagtttttttttttttygtttgggtygttttgagttygygttygttttagttgttgtagttgttgttgttggyggttgyggggagygyggggygygygtygaagaggtttgggyggygaggayggggaygaggaggagtyggaggyggtaaggaggaagagygagyggaggtygaggggtttagyggygtggygataggattagggggtttygagaatatgggttagtaggyggttaygggtyggyggtyggaygyggtgaatttgtygyggtygggygygtattggygyggygagtyggagtygagygtagtygggggaggagggttggygtaggggygttygggyggagggggtygattatttattattaaygagttattatttaataagyggagagyggttygttagtygygygggaggygttyggggaagggggttatyggtygagygtagygtatattygtggygtayggygggyggygyggygtygaggatattygggatygygygyggagtyggggygggttygggggyggygtagatttygggygygggyggttygyggygttttttggttttyggygttyggggttagygtagttyggggygagyggggygygggtyggggagggggagttgttygygtattttatttttttttttttygggygggyggyggyggttygttgtatatatttyggygtatttygttaggtygygtatagygtttygagtttaggygttttttygtttttttttygygttttgyggyggyggyggyggyggtagtagtagtagtaatatggttgttgatgggtgtttggggtggygttggyggygggaggagttttttygagtttttgygtyggttgttygttgttagttatggtaaatggtggyggyggyggyggyggtagtagyggyggyggyggyggyggyggaggtagtagttttagaatgagtagtaatatttaygygaattattttagtttagaygygttttttttttttttttttttttttttttttttttttttttttttttttttttttttttygtttttggtttaygagtttaagatggatgygtttattatttyggtgattatggaggtgtygtgygatagtyggggttaaygtatgtggtgggtttttttggttttttttatggtgatttttttygggggtttttttattattttgttttggyggaygtttaagtatttgtggatygtgtgttgttattgygggggtaagaygaaggtaaygygygtttygggygttygttttttgygttagttttatygtttttyggygttttttgtagtttattttttygtttygygtygygtygtgtttttttttattttygtttgtttttttttygtygtttttttttttttyggttttttyggtgttttyggatyggggtagygggyggygygtygggggtgaggagttgtttttagttagtgygtttygggaygyggaygtttaattttgtttttttgtttattgtagggttgttggyggttgyggttggggtyggggtyggggatttataggttygggtgtygtggtgyggggtggggatagttaatttagyggggayggaggaagttgggggtagttgggtgygtgttttgtatygtttatttgtyggggttyggtttttggyggtgggygagagggagtatattygtttatattttaggaatttgttggggagatgagttygtggggttagaaagaagggaaaaattttttgggtaagggagagaataattttgtataagggaatttygggggaggagtatggttygagataatagggggatttygaggggygagagaagttggggagatttattttattattgggggtagtttayggggttgttatttttggaatgtgtygaggtygtatatttgatgtaattttttatttygttttttaggtgttttagtggaatatattttaagtttttyggtttttgtttttttgtttttaggttatttattttgggttttyggaaatgttattagtagygyggagttggagygggagttygtttgaggtygyggttttaygyggagygttttttttggygttygaggtggttagatgtygtyggttttagttatttttggtgtagaygtttatyggtattgaggttggygatattttyga

SEQ ID NO: 6749 - DNA, 769 bp, Artificial Sequence
  Description of Artificial Sequence: Synthetic polynucleotide
ygttgagtygtagggaagttgyggggttagttgagtagtyggyggtttgttgggtttttagtgtygygygatagtaygattygagataaggtatttggggttggtgttaggtagaggtttygygttgygtggtyggyggtaatagygtttggyggtyggtttygggyggggttgtaggygtygggttttygyggtygygaggyggggttggagggygttgygggttgygyggaggttgygggaagygyggggagtaygyggagttygattagtagggagatygygtygygtygggtataggtaygggattygygttttaggagggygtagygagaggygtattgygtatttaggggttgyggtttyggtygtygtgyggtgataagttgatttttygtygtygtttagttaagttygygyggggtgttggyggagatgtygtatgggaggtttttttaaygaggtgtaaatttaagttatttygtttgagtgaatgaagggayggygyggggygygggtggggtttatygtgataaaagtttagtatttggtttaaattttttttttttttttgttygtaggattagaatattygatattaaaatgttttagtgtagtagaattttttagygatttyggtggygggagagtagtattttttaggtatagttgtgygtatttttygggttttatygatygtattatttgatygygggaaaygaaatttgagtttaggaatttgaattgttttaygtaygttygttttygg

SEQ ID NO: 6750 - DNA, 1169 bp, Artificial Sequence
  Description of Artificial Sequence: Synthetic polynucleotide
ygggagttaggygygygggygggggttttatyggttatttygaaatygtagaatgttttagggttttygggatttgtgggtttaggggaaygttygggaygyggagygggtttagtttatttgtyggaygtttttttygtttattygaattygggagtttygtaggagggatttttttygtttttagtgattatagttyggattygggttgygttyggygggtaaggttgggagtttttygggtyggaggayggggygtatgggtttygggtttgtagaattygyggttgygggagttgggtttttttttttttaattygggtygygtttyggttggtyggaggaggtagagtaggggtgyggtygtgtgttygagygggagtggggygtttattttyggggagaagggggatygggaaaggygtagygygtygagtattygtttatatttygttygtttttygygygagtygggtgygtttttaatygaatyggggygggygtygggagagtygggttttttygagattygygtttttttttygttttyggtttattygggttttygtaggattagygygaatagayggggygattygyggtygagatttttatttaygygygyggygyggttagatyggygagygttttyggttygaygtttttttygattttyggattttgggygttgagygggagggggaggtattagtttygttyggtttygagtygttttygtttttttggttygaatagggggattttaaggtttttttygattttttygygttygygygtatygygtattyggagaagaagttgygygyggaattattagataggagttygygtttttygttttatygtttattgyggtttyggttttttygtygyggattttttattttyggttttayggygygtttaattttatttgyggtttagatttygygagtttygggtttygtttattyggtyggyggttttttyggggyggagygyggygtttttggagtyggtatttyggatttyggygtygtttygygtatygttttygttttagtttttagtggygyggygttttttygygatattygygggtttttaggagygagtygattttyggttgggtttggagtyggggttaagtttattyggagggagtaygg

SEQ ID NO: 6751 - DNA, 6036 bp, Artificial Sequence
  Description of Artificial Sequence: Synthetic polynucleotide
yggtgyggttttgggtattgattaygtttatatgtgatggttttygtaaygtgtaggtttygttggggagaggttagygygggttttaggttttagggtttygggtttattgtygggattttttttagttttttttttattggtttygttygtygyggttgygtygggtygatattgattttagygatttttggggtygttttagttggtagttagtattttttttgggatggggtttaaatgttagtyggttyggygtttgtattagggttttatygtaygtagttygttgttttttygtttttygttaaggggtgygataggtagggggattygttggtttttgttttttttatttttatttttttgggtttygtyggagygtttgggtttygggttttttgaatatygtttgggyggggttttttgtyggggttyggttatatttttattygtatttttatagttggggttgagaatgaaaataatttttgtaaagtttttattagygaattatyggyggttgtagtgattataggtttygtttttgygygtygtaaaggtttttagttggtaggttygtygyggygtygtttttttttagtttygttttatttgyggygggygtygttatttttttagygttgtttttgygaagtagyggatttagatttagattyggattyggaggttatygtttttttygttyggggttaagtaayggttttygataggggaagggtygygygtttagggttgggttaggaygtttttgttagygttttayggtygggatttgaggtttagyggtygtttygtttttttttggattttygyggtatagaggtaaggtttttyggtgaggygygaggtygtygtgygttgggygggggttttgagagtggtggggttygggtgggtagaggttttggggygatttatgggggaygtttatagygtaggtttatggggtagttagatygygtygtagggtygggagagaaygttttagaaggtyggtttaggttattattttaggagggtggyggaggtagtggtyggggtttttttygyggtygagtyggtggtggttgygattattatggggttgggtatatagttgaaggggggtattygggtygagyggttgggggagtygtgtyggttggyggggaagttttttayggygatttttaggttttygtgtaygaagggtgyggagatgggagttttggygaggttgggatygtttaygtygttgtygaggagggagagttggtygtyggygggggtttyggggggttttttggtttttaggttyggggaygtgttggagttggttttgggggyggygattttttyggtttggattayggygtygttggttttgygyggygggggttyggtyggggygttttygggygtggagtttygtagtggtagggtygtggygggaagygtgttgygtaggatgtggggtaygtttttatttyggatgygtygttaggtygtgttyggygyggttattttggggagyggtyggggtttttygtygttgttgyggygygyggygtyggttgaggtaggggtygyggggayggygtygtygggtttgygggttaygttgatgtgyggtagygaygygtagygtttgatagttttyggtygggyggygggygygygtataggtaggygggaygggttttyggaggtggtgtgtygggtagggygttygttagggttgggtygggtygyggggggtygttgtygggtyggggtygggttttgtyggggtgtygttyggagtttttygtagygygaggagtagaggaagayggygggtagygygggtyggtygyggyggggygaggygttttggggggtagaggtygyggattyggtygaggatagttyggagyggyggygtygtaagttyggygattttttgatgaaggttagttgtygtyggaagttygagyggtyggaggattygttgtygttggagagggttgaggttataygtattaggtttaggyggttttygygygttttygggttygtttyggttttygttyggtttttggggttyggtttygggattgttygagttagyggtggyggtttaygtygggtyggtttttgtatgaaygggattygtaygggygatttttgygttttgtgttgtttygttagaagggtgygygtyggygttttgggtatyggggaggtttyggggtygggtagggttttagtagtttgggtgatyggggggygttttttgggtaggggttgggaggygggygaggtttgggaggagttggaggagggggttttggygaggygggygggyggtgtggygtttttggggggttggtttagygtygttagtttygaggttttggtaggtyggtgtaggtttygygatygttgttgttyggggttygggattttggttggagtygygggttgtgttaggtaagggggygttatttttygyggtgtggygygggggtygggggtttttttgggttgggtayggggtgtygggttggggaygtagattattgttygttttyggagtatagttggtatttygggygtggttttttgtgtgttaygtggtttttyggggtttgtaggggaaygggggttttygttggttttgattgaggttgygttttttttttttggtygtygggtattgtttattttttttttygtttgtygtttttttttgtgtttggggggttgtagggtggattttattgatagttyggataygaaggataggatggagtyggattyggaygaggtttttygygtggtagttgttgtttggtgtagttaygtgataattgaattggygtttttttggatggygygttattttaygttatttaggtyggaggttyggttygagttygttgttttttygtygygttttygggatttttttgygggtygtttatttagtygggtggttyggggtttgyggygtygtaggttagatayggggggtyggygtttgggtagggtygagttgatgtatygttgtagaagttttttygyggttygygggttgggygagttgtygygttygttttttgggttygggtttttggtgatygygggttttyggtttygtggatggayggtyggyggtttygagggttygggttygttgagggagttggyggaggagtttagggagtagtagggyggggtttygttagtaatgaggttgggttgggttygggygggyggyggggtagttggtgtagttttggayggggtaggggttttttttyggttttgyggaygttttygygtaaaagygygagggatggtygatgtgygtyggtgggttggygtgggygyggtygtygggggtttttygttygagtygttgtygtagaagtagtatayggtttttttagtgggygtygtgaggtatagygattggagygtttygttttygygggttyggtygggttttgagtygtttttgtttgygggggygttygggggtyggtttaggggtagttttagttttgttttgtttttgttygygtttygagattgtttygygttgyggtyggygtttttygttttgtgtyggtgttttatggtttgtttggtagaggtggggyggtyggtgggtttttgtttgttygttggtttttygggttggtttttggggggtttttgtagygtttygtygttgagygaggyggygttagagaagttgatyggygtgtttttygyggagttagtgtaggagtygtttttttgggtyggggtyggggygggtattaatatgtagaygggtayggggagtgygyggygatttggtattagygyggaggttattttgygtagtygggtaggtayggyggtttttaggtattttygtagtagttttagtttttggttygyggygtygygagggygagaattygtgggygtyggttttttttttygtygtyggtgttttgtaaagtggaggtyggygttttyggygttttygtygygttyggggtaggtygagggtagtagtygtagttttaygttttgttgtaygtagtgttygtgtaaggttagygygttgaggttggaggygtaygagaagttttygtttggtttttttayggtaaagygtaygttgtttgygtttagtttagatggtagtyggtagygttttyggtagtyggygatgtttaggaagygttttaygtagtttttttattgtaggttgaattgggtggtttyggggggattttgtggygygggygttagyggtggygttttgtttyggttgggaggtatggtttgttyggggttgtygggtagttygttagggttgatggtgtygttgttttgttygttgtaaggtttattggggatggagttggygatggaygggttttygaagttgtttagygagtttatagagttgtagyggtttagtataagyggtgttttttgtaygtagtttttygaygagttggayggygtggygttttttatttttaggtttyggtttyggttaygtyggggagtyggaatggttaygggtagygaggtggtttygggygttygttaygtgttgtttagtttagtttygttggggtyggttttttttagtttttttagggaggagttattgttatttaggttattattttygttggggtttgggyggtyggtygaggatagygaggaaagggagttgtatygggatagygagagtggttttttttgygtygttagtttttgtagtgttttgttggttatagatagyggggtagtygttagtttttygggaattttgtttaggtggtttgtyggtagttaggtttgttttygggtttttggagagattttaggtttygygaggggttttgtattygtttttgaggtatttttaagtagtggtaygtgttgataggtaggygatagtttgatggtgygtaygygggygtyggyggaggtggtttygygggtygggggttyggtttggtagtygggtaggttaaggttaagtyggttgggtygaggttgtttatatttggggttttygyggygygaagttagtgyggttagygggtagggtagtatatgttygygtgggtagtattygtygttggtattgtygttgttgaggttgtygttggagaggttggygtgggtygttttgagtygtagtagygggtgygttyggttttttgtttttygtygttygtttttygggtygyggtatggygagtaggattgggygyggttttttygtggygttttttgtttygggtttttagagttgaggttgaagttatygtyggaygaggtgtgtagggyggagatgttttttattagttggtygatgygygttattgtaagygttagtttggttttggttttggtygttayggttgtttttttattggtgtttttttttgtttttttgtygtttyggygggtgggyggggtgygagttagygtttgtttttgtaggaaggggttgtttaggaagagggatagygyggtagggttggttggtttttyggtggtygyggtygtagttagggatgayggtgtatygtygtygttaaagtagttygaatyggaagtatagttttgggttaggtygtttaggtgtygtaggggyggtagyggttttttagtggyggtttyggttgtyggygggttttgtttttttaggtgttttagygtttgygygaggtgtygtgygtttagttyggtttttagygttygttgtttgygtaygtataggttgggtaygtagttgtttggggatayggyggtggyggtygtttggtgtttggygggtygatgggttagtaggttgygtagggyggyggygttgtttatggygattattttgtgtttggagtgtattagattaygtagtatgtttayggygtttaggttttatagtagtttttggttaygggygttgygggtygataggttttagagygtgtygtaygygttgtttaygatggttaggttgtgyga

SEQ ID NO: 6752 - DNA, 3400 bp, Artificial Sequence
  Description of Artificial Sequence: Synthetic polynucleotide
ygtgtagttgyggggtattyggggttgggtttatttgygttyggggtygtataggtaggtagagagagtygggtttagggtataggtttgttttttgttttttgygttyggggaagggggyggtatagagttagtgattatagygtagygygtatttgttttygtaggttttyggagygttttygygygtaagaaggygtagatygygtygtttttgtagtygtygtygtygttttyggttttgagygaggagttgttttggggagatttgtygtttaataagtgtttggtgttygtttygttggtggygttgttgggttyggttttttagttgtgtygyggtgagygtaggttttttagaggtggggygaggttggggtttatttgtgygtttatttttttaaggaaaggygttgtgtygttagggtggggtttgggagttttttttttagggttgggttttgtaygtttttaaagttggtttgtgtatttttttttaagtgaygggttttgygygttttttttattyggtgtggattttttgyggggtttatttttttygtygygagtaggttttggttttyggatgaattttgtgtaattttttttgtttygtagygttttgtygttttttttttgygttttttttggggatygtttagttygtgagygtttttygggggtatttttgygattttttttttgttaggggttttttatagttygtggtyggggggaagaatgattaattgaaagagygaggttyggagaaggggygtygyggtagyggagtttyggagtttttttttayggttygggggtatttttagttttagtygtatygggggagttttattttaattgtttagggaggggggttttaggggtgagggagggatggatagtgtggatygtgtttyggtttagttgattygggtttygattttgtygttgtagaygtygtttttggggaggtagtattttaagtaygtgtgttygagttttgggtttygttaagtttagtttygagggagttatygtygtttttggtaagagtttttttttattgatygygggtattgggatttttatttttaaggaaagaaggagttygggtyggggggaaggtgggygtttattttaggattttattttgttttgtagtttaagttygaggtttaggygtttttattagygtygtttgygtttygggtygaggtagaggttagatttaagattttygggagtygggaggttgtagagaaygaygaagaggagttyggygaggttatyggagaggtygttygggaggatygtgtgattttygtagatyggggatttaaggagaggtttyggagagaggggaagtygyggaaggagaagtygyggaaggaggagagatttaagaaagagaggtygyggaaagaggagaggttaygggtygttagggagtttygggaagttttattttagygttgggagttaygygaagggggttatyggtygtgggtaygggattttagggaygtygagtttaggaagaagtaggtttgggtgttttygaggygtttygaygaggagtagyggtttgggagtygttagaagtttygygtaggtaaggggygggattgagtyggtttygygtyggagtttaggggttttttttggaygtttygygattttggygaaataaagygagtgttgyggtygtagagttatttgtttttttaygtttggattyggtattaagttyggggtttgaaagayggtggtggggygttttaggtaggggagagatagygagygttatagggyggattygggtygtgygygaggagagayggtaagggaggttttaygggttttttaataygtayggatattttagtyggttgtttgttggtttttattggggygatgtttggggttygaataaatatgggaaggggygygagttggggygygttyggattttyggggtaggagttygygyggygtaggggttatyggtagttatattyggtggttattatgttgggtaygtggtgygygttgatgygttttttygataggttgatgagtagtttgttygygtaggyggtgggtaygtagtagggtgggygygttagggyggttttayggatttgtatttttagtagtagtattaygtggttgtygtagygygggttgyggtyggattgaggttagtygtataygttttggtaattgttggtttggtaggtttyggggatgagtayggagygttyggygyggaggtttaygttgagttygygtagygygtayggttygtyggyggyggtggttttygygttgygttgtgttygattyggttygygyggatttygttygygttattttaygygtaggttttgtagygtttttaggagtagtagygttygtaggggatygtygaggtygtyggggttatttgggtagagygygagtaggygygttagtagyggggttgtggtyggaggtagattygggaggtttygtagttyggtagtygtygtttgtagtttagtagttaygyggygygttagggtygtggtttayggygtygaygtggggtygtgtaggggygtaggattttyggtggtggtygtagtgggttttagtagtagtagtagyggtttttygtygtygagtaggygttttagygtygyggggttygataggttgattaggttttgygggaagtyggttagygygttyggatttagggttaggygyggygyggaggttygggtyggggggattygtagygttygtattaggygygtgagygtttttaggaaggggtttgygttgggtggygatttttygagtttygyggatggtttggaattygtaattggaggagttgagagyggttaygaggttaygtygttttygttygtttttgtttygtgtttyggtgtttgygygtatttgggyggygggaagggtayggtgtttagttggtygtgygtaggtagyggygygggttyggatygyggtagtaggagtagggtyggggttattygtgtgaagtagyggtggtygtygtygaatagtagtgtttgtagtygggyggtatttagtygggagtttgyggtgggtgggtaygyggttggtttaggggttgggggttygggggtagtygattyggtttttygtttttttttaygyggatttatttttttygyggggttgtagggttaaggttagttyggagtygygttaggttttygtagggyggtttatygttaatattaggtagygggtgtttygggaggggtagaggttttgyggagattagggtttagttyggttggatggaggtttatttagtttygttttatyggtttttttttttttatygttattggttttaygt

SEQ ID NO: 6753 - DNA, 1143 bp, Artificial Sequence
  Description of Artificial Sequence: Synthetic polynucleotide
ygggtttggygttttgtttattttttyggaygggtagtttatttttttttattttyggttttygtygygygtattggyggygttygttttaygttttaagaatttygttttttagggtgggtggggggtgtaygttygatagggttaggttagggttaggygtggagttygygtgygtttygggatttygttyggggygygygggaggygtygggggtygyggaggyggggyggggaggggtyggyggyggyggyggygygyggaggagatygtagtgyggtyggygttaggattygygggggttttttaggtygyggygtttttygtttttttttatttttygattttttttygtttttaaaatgaggaaayggagtaattygttttaagttgtgtagtygggatygtttyggggtgtgtagtyggttygyggaggtttttttgggggygggygyggggygyggttygggggygttttttgagtaggtgagtaygtyggyggggagaygtggagagatttygaggtyggggtggggggaaatttygagggttttaggygggggtgggttygggaygtgygtaggaagggtyggtgtgtgygygagtgtgygygtttygggygygtagygggtgygyggttggggyggagggtgtttagaggygatyggatttygygtggtggtggttggggttttttgggtgygggtgtgygyggttaygagtttygggygtgtgtattygygygtttaygtggagggttgtgygygtgtggtygaaaagygtgtgygyggttttgygtagygttttgygtgttygagtggttyggygttggygtttaggtgttttagtgtggggyggttgtgtgtgtgtygggggygggggataggtgygtaygtttttaggtgtggagygtttgtgygygyggatgygyggggaygtgtgygtatatttgtttttaygtggaygtggttttttgtttgtttgygygtagttgtgttygagttttgtgtgtttttgtgygtgtgtatgtattygtatgygtgtgagtataygtgggattggaggattttatgggaggygtattttggaggggtygagatttattttttagtatygtttattttttagttattagyggtygg

SEQ ID NO: 6754 - DNA, 220 bp, Artificial Sequence
  Description of Artificial Sequence: Synthetic polynucleotide
ygtggtaaattygggtttygaygatagaggtagygtagaagttygtttttaaatgagataattttattaaaattataattttttgtatttttatagygtttttttagtggyggagattttaggtgttttaygttagggtttattagagaatyggggygatygtaagtttagtygygggataggygaggttygttagttttaygaagygttatyggtaygt

SEQ ID NO: 6755 - DNA, 1860 bp, Artificial Sequence
  Description of Artificial Sequence: Synthetic polynucleotide
ygtayggaagtttttgtttagttgttagygygygtygttaggggttgtattgaagttgtggattygggatggggaggaggttggyggttttygaagtagggtttatagygggggagggttagygtygtttggyggtggttgygygtggttagtgyggatttaggttyggttyggtyggygttgtttgygtgtggttygggyggagygagggtttttggagttyggttygttttgggttttaggaagttyggygtgtagygttagaggtygygtgtgttgggggagggaggagtatagattgtgtttgggggtatttaggaygaatttatagaggggtggttttgttttatttagggggtgtygtgggtaaaggttttggggttatttgtttggtgttttggagggygtagggtaggagtygtygaggttygygggttattgtggggygyggaattttagattaggtattygyggtttaattttygggttaggggattygygggggttttaygaatttgtttggtttatttgtgtaatagaaattygttygygtttagtagygttyggggtygtttgygtyggattygtagtttagtatttttygygttttggatttygaggaggttaggtagagagyggttygygyggttttygtttgygtttttagtttygygttgggtagygggatatgtttggtttyggygtygttatttyggttttygtttgtttttgagtgyggagttyggagtttttttygyggtgygttgggttttagagggttagaggttattagggggtyggtatyggygggagtttagtygggygygttttyggtttttttttatttaygtttttygyggtygttygggtttaggggygtagyggggaggagatttyggttagggtyggggagygygagggyggggyggggttyggyggggaggggygygggygggyggggatyggggygggggtygggttygggggyggyggyggygygggygggaggaggaggagtttttygygyggggtaggggyggagygagyggtygygtygyggagttaagtgagttygtttyggagtygygtygtygtyggtttagtatttygggygttygtygttttygtygtygtygttagygyggggatgtaggatgtaggygggygttaggttttagyggyggyggyggtagttgtagtagtagtagtttyggyggyggtagttttttttttggtygatggaygtagagtygtygtygtygtygttttgggtttggatggtgtygggttyggtygggttgtttyggtttagygygggggtygtggttttttyggtgttgttygtttyggtttygtygttygyggtttygttgtttttyggttttttyggttggtyggtttygagygagtyggtgttttygttgttgtygttgttttttgygttagatttygtygtygtygtygtygygtatttttttttygygttttaygggtaggtaaygtgttttygtttygtttyggttygggtygtygttttttttgtttttgggygygttttgttyggttyggttttggttttyggttygygygttttttttttyggyggttttygtygttttaaatttttaggayggagttyggtagtygtgtttyggygagaaagttygtgtttggaygttyggtygtttattttygtagttttggtaggtgttttygggtgtttggayggagtygtggagggattygtygtttaggttygygtggggatygtagggaattygygttaygtygggggttattgtttatygygaggtgttgaagtggtttygtgatygtygygggtygtggttgatatygygg

SEQ ID NO: 6756 - DNA, 441 bp, Artificial Sequence
  Description of Artificial Sequence: Synthetic polynucleotide
ygtyggggtttyggttgttagygyggtygttatygtatggttgaaggggattgaggtygagttgggtaagaattttgggygtagattgtgaagttgattgyggggaggtttgggtttygttatagtygttttttatyggttttaattagtttygttttttttttygggatgtyggatyggtatttttattatttttaggtttttagggggttttggygttttagttgtggattttttaatattygtaggtygtagggttatataggttgggtttttaygtgtagaggatataaagtagatagaygaaaattggagtttyggyggtagygagaaataaaggtygygttaaatttyggaagtygttttgtttgttttagttgygggtttgattggayggtttttygtttagtgttttygattggataaygtttaaggtttygt

SEQ ID NO: 6757 - DNA, 5587 bp, Artificial Sequence
  Description of Artificial Sequence: Synthetic polynucleotide
ygygggaagaaggttttggggggggygttttygatttaattaggaaggagtatgtatatgtaaatgygtttagggggygggttttgggttyggagtttttyggggygtttyggygtagttttagttttgygttattttygygygtgygtttttttttygygattttttattygagtygtgtttttggygtagtaggatygtttgtttygatggyggygaygttgaygaggtagtagtagttgtygygattgtggtggtgggygtgtgggtygtygaggttgtygyggtttyggggattgygggatygatggyggygggagggttttygggyggygggtttttgtygtygyggtygggttyggaggtggtayggttygyggygttygygttgttggygttggyggygttggttgggtygtggygaygygggtygttgttttggatgtgggatayggtttyggyggtttgtatgttgggyggygygaagygygagagtaygygtagtatygtttgggttttgtgtttttgygtgtygtygtygttgtagttygataygyggtattygtataygttttygttttgtagtygtayggtagatagtygaagtyggtgtgagatgttattgttttggaygygtayggtttgtaagagagtagggttagaggtygggttgggtagtttttaaatttatttttttggttattttggtygtygygtttttttattygygtattttaatatttttyggattttggtttgtttattattaygattyggttttttttttattygygtttatttagtggtatagggtttttaattttgygtggaygttaggtagttagttttttggattgtgtttttaygtttttattaygttaattaaaygtttattttgtatttgtttygtttatataaattaatattgtttgttttttygtagttggygttttagaagggtagagtttatttttttttttttttttttgtatttttaggaaattttaggttggattttttgttttttaatttttttaygtttttttygtttygaygygttttaatygatagtttygttttagtyggttttttttatttttyggagtayggagggtttgttygaatygttttttaaggaaagttattttgttatyggatttygttttttatagttaatattgtgtttttttaagaaggtaagtaaygttgaggttgttgtttggttttttggttatttgttattaattygttttttygygggatttttagaagttttttagygaagtgttttttttttgygtttyggtggggatttygggaagtattgttttayggtttttaataaatatttagggagtttttatttttgaatygagtttaygaggaggtttygttatttttaggtttttttaygttttaggtgggaagtttgggygtatttttttttagagttagtaattttatgattygggtttttygtagtttggtataattattttttatttygttttttgtaagtttgtaatatttygtatttagattygtaatttaggyggaggataaagggttgtagyggagggygtagagtagatgtttagggyggggtagagggggygggaagttggygttayggtygyggygagggygagtagtygygygttttyggtgttaggaggaatgttygtagagyggaggttggtaggygygagaggttttaagygygtagttygattaaggggagttttataggttagygtygagtygaattaggggatttaagttttggatttttgatttatataaaagagaattygattttgtaatyggygatagatggygttyggataygtygagtagttatygatgtaaggttgygatygttgttttatttgygyggttttatatgygyggtygtygyggtttgttaagggagggagttgygggattygaggyggttagaaggggtttttygyggttygygttgggttttatatttaygttgattttagttgtatttttatttgttatttaaaatgtaaagagggagagagagaygtgaggttygyggttttttggttaggggaattyggattygtttttaggtaagggtattttttttyggtaggttaggatygaaatygttygggggatgggggttgagggtataaaggaygttyggttttttaagagttttttaggaggaagygggttttggagttagtatggtgtttgattaaygggtggttgttttggtgtatatttgtyggttgaattggggagattggatggatattagggtgggaaggaaagtttttttttttttttttgggtatttttaggttttgtygygtggtttaaaatttttttttagtttattgggagtygtgaagaattggagggagggtygttgtgtttggatagtatttagygggaggtttagtgggagtaattttgggtgggattttgggagaatgtaggtgtgtgtaggtgtaggtgtgtgtgtaggtgtgtgtgtaygygagtatattagagtgtgtaagagagtgtgggttttgaggtagataggtagygtgggtttgttttyggttatagagaagtggtttttttgtgtttttgagggttggaggttttgtyggtttttyggtattyggttttttggtggtttttggaaygtagtygtgggagttttggggtttttaaagtggtagagggyggggagagtttgatgggattaagggggttttttttattatttagtatttattagagggtygtagttagygagtaygagtaagygattaggttgaggtgtggttttttaggggttgggygtgaatggagttttgggaggtggtgggaatagygatgttgttaaaataattgataggtttgggggtaattattgttgattttgaagatgttttgggatgygaaggtggaagatgggttgygttatagggyggygttttgygygagtgaagttygttgtttttttttttgggttagttttygtygtttygggygygagtygggygygygtyggtatygygtgggyggygggttattttgtttygggygttyggtaygttgagygttagttygtgtagtagttttyggggtggttttttgaggtattattattgaatttttagygaataygaggtggtttygttggttyggaaygygtagggtatttygatgtygtttttttttygtattgttatatttttggggatttttgtgaatgtagttgggggtggggagagagagagaggygtgattagttgtaggtygggggtttggggtaatttaaagygaggtagtyggtttttggttggttggttttgtgttttttatttygtagttgttttttggygtayggtyggaggggttagtaaagttyggggaagyggttgtagggtygaggtagggatyggttatyggttgtttattgttttttttyggatggggyggggyggtaggggygattygtgtttttttttygtttttggtygtatygttagagtttggttggggygygtttattttygtttttygtaggtatttttttygtagtyggggtttyggygggattgggaaygattygggygyggygttgttgttgyggygatttttygtygttygtttttttttattttttygggtttaggttgtatagygggattgttggagatygygaagtttttyggttygtttttttttttttttttttyggtggyggttttagtaaagattttttygagtttatagyggtagtaaagttttygygtttatygtyggttaygaagagtagtagggtatgtagtagtagaggyggtaggtattygagggtatygagtyggtttygttgttttatttttygyggggggygyggtggyggygggggttygggagyggagaggyggyggtygygtgggttyggatyggtttyggttygggttaggaygttttygagtttgttatggtttygygyggygtttttttttttggtygtyggyggtygttaattagtttygttttttygtyggtttgttyggtgyggtttyggyggggggygttgygyggggtgtgtaggagaygyggttttatygggaggttgttggygatyggttagtgtttttttttgttyggtygtttataggayggtggggattygyggtttagtttttgttyggygggtygggtaggggttgggtygygtygggatttatttttggtygagggagtgygtgttayggagtygygagtttttgtttttttgtttttttttggttttgttttygattgttatttttttyggttttygtagtygttttygtyggttttttygyggtttttttygtagggygagtgggygtttagtygyggygygtagatttggygttygatttagygtagygyggggagagygggttyggygtggyggattyggagtyggagagaggyggggagagggggaggggaggggaagggagggggyggttagtggttgggygttaagtygtttttatygttgtatygttttygttttttttttttttgttatagttygtttygttttygttttagagygtttttttttttttttygggggtygttyggagggattatygtttttttggttggagtatagtttygtttygtattygtttgggttgggagtttttttatttaaattttttttggtttttttttagtttgtayggttygagayggtygtttatttttgtttttygtgtgtttttyggttttttttgtagtttttagtttttaattttttattttagtttgggtaattagttgtttygttgtttggtttaggtttgggttatgayggatgggtgggygttyggggtygygagaagggyggaaygttgtgtttagtyggagattaygttgggtggyggyggtagygtygggagtttgtagtgygygagggagaagtgagygtatagygtttagygagtaggtgtttgyggygyggagagygtataygttagttagttygtagyggtygtgagtgayggtaggggyggygggggtggggtggggtggggagygtygggtaygatttagggttygggaggttttygggagggggyggggtttttgtttttggatygygggtttttgtgtttttaygygtttttygtyggtygtggttttttttttgttyggtgtaaagygagatgtygaggyggtaggaagtyggaatttatttttygtttgttttggygtattyggtatttyggtattttttttagtttttattyggagtttgttttttttttagttatttgagggagygyggtttggttttygaaggtaaatgyggggtggatatgtggttyggaygtagygygtagttatagttataggggygagttttaaggttygttttgggttttttttatttttttttttygggagtttttagttagtgygtttyggtatttttgtttttatttyggtttttaygttttagttttgattttaggttggggtggggtagttyggtggatttaygtgtttgttttttyggttattagtttttyggaggtatygt

SEQ ID NO: 6758 - DNA, 3643 bp, Artificial Sequence
  Description of Artificial Sequence: Synthetic polynucleotide
yggygyggygygattagtagtyggtttygttygttygtagttttgtttttagyggyggttattgggatygattgttygttttygatttaggtaagatgtttaattgygatygygygttttttaagatygtttttygagtttygttataggtataygygtggtttaaatattttatttggttygaaaagttagtagaygggggaaaaaaaaaaagttgtgygagtagttagtygggtagtttyggagttygyggaggtygttttttygtygtttagtygtttagtygtttataygygaggtyggttyggggyggygygtagttygyggtatttygttttyggttttgygygtttatttyggggygygtygaggttatygtagggtatttatttggtatttgtttttgagtgtgtagatygtygyggtttttatttgggtttttaaataagttttagggagaaagaaggaggtaaaaaaaaaaaatttaattatgtaaatggatttyggattgggaggygygggatggatttgaygtygttattgtaygagttttyggagtagtttygggtygggtagatttatgggggygygttayggttaygttaggtttygtygtyggagtatttygaagttaattaaagyggtaatgtttatttttttggygatttttygtgygtgggtttattattttattattaaattygatttyggygggggygggggttttgtttttaygttttttttttttttttttggtygtttttttttttttttttttttygttttttattttttttttttttttttygtttttttaagtygtttgttttttatttagtgaataatgaataaagatgtgagtgatgggaaaagatygtttttttttttaattttagtagagagtaaagtyggttttaaagtaaaaatttagttgttagtattaaattgggaaagaaaatagygygtttttagttttattattttttttatatatatataygtaygtatatatataygtaygtaygtatattttattttaagtttatttaagttttggttggagattggggygttaaggttagggygygyggggttgtttaattygtyggggatattagggttggggaayggygygtgttttggttaggygtgtttttygygtttattttygtyggtttttttygtyggtttttttygygtttttatatyggtygattaggttyggyggttygttygggttgttyggtygtyggatgygtttagtaaaygyggtttttgtyggatttttgttaaattgtatagyggyggyggyggyggyggyggttgtygggagaaggygtaggaggaatyggagggtygtatygygygttygtttatttygtttttttygttygtttttygtttyggtttygtyggtygtyggtttttattygygtataygatttagtttttaggaygtatygggtgttygagtttygtaggtygggatatttygtagttgtygtattttttgttaaagtgaaaaygaaggyggttgataaattaygttttyggygaggtattygttagatataataatatttggtaaataaaattyggtygtygttgttattygtaygyggggttgagatttygttttgttttttttyggtttttagtttttggttattgygtttttaattttaaygtttttygttttttaatattttaattttttatttaattygggaayggtggatatgttttttaataggtatatagtaggaattatttataatatagaagtgaaaagggggggatttaattttttatttgtttttaaagaaagttttgtyggagtttatttygtagagtgaagagtgagtaatataggtttttttttgtttagttttttttttttttttttttttaattttttygygtttygatttttttttattttatatatattygtttatatggagatatttatattttaaattatttgtaaaattgtaatagatgggygygtygagatttggatatttttttatttattaaaggaaagtttttttttaattttaatttttttttttttgtttaaaatatatttygagtttygtttaygattgttttttttaatttattttygaaaaataatgttttgaagtaaatagaaaaaggtttattagtaaagattatttttattttagttatgtatttgygttggggggaygggaggygtttttttagattgtattttttttagaygtygygtaagttttgttttttttttgttttttagagtttttaygttygtattttttygttttgattggttttatttttttagtttgggattggtyggtttttttttttttataatttgttatttatttatttatttattttttttttggttttyggttgggtttttaggtygaggttyggttggggtaggtgttgygggygtygtttgygtttgtaggygttayggttttttttggggtygygggttyggattttggtattttagttttgaaattaatttttyggttttagtttggttaggttttyggggtataggaggtygatgtaattataaaatggtagattttagyggttttyggygttygtaagtttgatatattgtaagtattagttaattttaattgaaaaaaaaaaaaggttgtaaattattttttttttaygggyggaggggtyggaatttygtagtgagygyggattagagaaagagygtaaggygaattttygttttaggtagaggagaaaatggggaaagttatttgagtagaagttttygyggttttagtttatttttttttttttttattttttttattttttagatttttttgaaagtttttyggggtttgagagtggttygygggtygttygygggtggggggygtyggtygggttttyggagttggaygyggggtttygatygygygtygggygttaggtttygggatttttttttaaagtaayggtttygggatygygggyggggaggyggyggtttaggygtaggtttygttygtygtygaagttttttagygttataygatgttyggtygtagtygtyggttyggttttttttttttttttttttattttttattygttgatagtttttttygttaaygttatagttayggatatttaattagatygtattttttaatygygatggggygagaaggaatygggyggtaggtttygtygagatggggagggggaggggaygggggggtygygttaagagtttaaatttattttgttatttttyggaygtygaagttgtttttttattygtygtygttttttygygtygygtttttygtatygygtygygtttygtgattttttttttatttttgttttttttattttaaatattgaaaygygggygttaggagtaaattygggtaygtaaayggagygttgtaaaagattgtgtttaatgaataatgaaatatgtttataygattgatttgattatttttyggggttgaggggggaygggygttttgttygygygttttattygtttattyggtagagttttgygaattgtttttagtttagtyggggtagggygggttygatttttattagtttttttttagaatygtttygt

SEQ ID NO: 6759 - DNA, 808 bp, Artificial Sequence
  Description of Artificial Sequence: Synthetic polynucleotide
ygggattttttatatttygggtygtagygtattgtgygagtggagggggtgagttttttagtagaggygtaaggagggtgtagggtgygyggtgtggttgtgggttgyggataggggtygggggygygttygggtyggtgtygygtggtgggagtagtaggygygtaggtagyggggagttttygygtatttagttygygggtgattattatgyggyggtagttgttttyggygyggtgayggygtttttaattgattttattatttttttttygtaaggtgaagtgyggtygttygyggggttygggygygggtagggtyggttggtagtygygggtyggygggggtagygttyggtttyggggtggtattatygtygggygtygygttaaygaaygtaggyggygggaggttyggyggyggggttygygtttttgtatygygatygygttagaaaatatttyggggttgggyggygtttyggagaygtatttttttgttatttttatygtttttggtaaygattattaatgttattatgttttatttttttttattttttttygtttttagagtygygttygygygttygatttttaggygtttygttttttttggaattaataataatgatttttaattaattttttgttagggttgtttgttygtgaatggggygttttttyggttygygggyggtaggygttttagttygggyggggggttagttttygttttttyggtyggattygygggggttygtaattygttygggygtyggttgggggtggtttygtagttttttygg

SEQ ID NO: 6760 - DNA, 3415 bp, Artificial Sequence
  Description of Artificial Sequence: Synthetic polynucleotide
ygggggtttttttgygtgtttygatatggtagtatggttgttgygtgtatttygtatagttygtgttgtgygtggygggttgtygttgtaatgtgtagtttattgatattgatggatgygttaatggttggayggatagatgttagggyggatygtatagygttyggygtttgagygggggagggttaggtagygatttagyggyggyggtyggttaygyggagattygagtttaggtygyggttygtagtgggagggggtygaaggaatagaggtttgtaagaatagygaggggatggaaaggaggagaaaagygygattagggagaattataygttttygtgtgyggygtttygygttgtgtataygtygtatygggygygtttaagtgggagtttygaaggtgagttgggagtyggygggagttgatttygtgyggygtaattygtttttaggygataggagtttagygyggttattagaatggtgaggtygtyggyggtgtyggttaatttatygttttttygtttgtaagaagygttttaygttttayggtygygttttttyggtttggaggagtagyggttttggtttttgyggtygygggtatttaaygygtayggygttttagttttygagttygttagttygagagtttygtygtagttygtttyggattttttgtttygtttggggttygtattttataatttygagygtttttgygygyggaaaggygttggaggyggttttatagtyggggaggttagyggyggygtatttgtattttgggagaygtttggatttagtttaagttygtaggttgggygagyggagatttttgattttatygtgtgggtgagattattgtttttyggtttaaaagaaaagaaagtatgttgtgaatttttgaaataaatttgtaaaaatagtygtagagaaaaaataaaaaggatatagggtagaaaaagagggagaaagagattaaaaaaagaaaaagataaggggagggggaaggaaggaaggagagaaggaggaagaagtttggggtttgttgttttaggagygtttaggtagtyggtgttggagygyggggygttygttttygtygggattgtyggtttyggggtttgygagagygttagagttttagtyggygygttygggygtagggtygtttyggggatagtgggttyggaggtygttttygygttttagtagtygtygttyggtagygttyggagtyggtttyggygyggtygttttattttyggtttgagagttggtttagggagaygtaatygagttygtagygtatygatgygtygtygttygygtygttygggtttyggttttygtttagtygtygtygttygggggtygttygtatgagtttyggtttattygygtttttatygtygttygtaagtgagttygygtygtttygtygtttaygtygtttagttagtttttttttgtygyggttagtyggtygggtyggttyggagttttagygatttygattattaattaataattaatttttttagtttagtagtttyggtaggtygggygygggatayggygyggyggttttttaggttttyggggggagtttttggygggggatgggtaggggagttyggtttttttttttygttttygtttygttttaggatyggttygygtygtggatggggggygyggttyggttttygggggygaggggyggggtggagggattttgattattttaaagttaggagaggaaatttgaaggaatttttttttatatygattttygggaygggtttaggaaagtttgttyggggaaaaaaaattgggggaagtggttayggygggttttgggggaggagttgggtggygyggggtttgagggttgtttttattygtttyggttygygttygttttttttttggagggggtttgttygtgggttttggttttttygggggaygttagtttyggttyggggattaygttgggggtttyggagtyggygggtggagaggagtgygagtygggtggggtagttggggggtggttggggaygaaygttgggtgggaataggggtggggggtaaygagygtttygggaygggttyggyggggttggygtygygttttygygtgtgygtayggggyggaggyggaggggyggtatttttttygttggyggggygggggttttaygygggtttggggtygggggygggggygyggygttttygygggygggygattgataygattattttttttttttttaagtttgtttgttgtygaygtygtygttttagtygygttaygggtagaagattggatygtygagtttygggtygyggyggyggttgygygttttttyggatgtygtgattttyggtttaggggygggggtyggggtagtatyggttygggtygttttygygtttttttttttatygttttgttygtttttttttygttttttagtttygaatttygygtatttygtttggggayggggygggggggggtagggtygtygttttttttygttttttttttttttggtttttggagygatttgttaaattttttatttygtyggtagygyggttttttttttttttttttattttttttttttttgtttttttttttttttygtgttttttttttttygagtttttttygttygttttttttttttttttygtaygttyggggttygyggyggagygyggygygggggggaygyggagagtttgggygtagtagtattttgygggyggtygtttttygggggggaggttgagagtaggttygtttygttttttygygggttygtygttttttttttttttgtttttagttyggtagyggyggyggyggyggtagtggtagtygtyggagaagtattatgtygaggaggaagtagtaggygtttyggygygtagtaggtaygagtygtttttttttttttttgtttttttttttttttttttttgttygtttygygtttttagygggygygatttygtttttygtttygtttttttgttygtattgagtaatttygggygtygtttttttgtttgggtgygtgygttygtttygggtatygggygtttttyggaygtttygtygygttttgtttttttttttttygtatttatttggggagtygttygyggagygygttgagtygygttaggtttttatttttttagtttttyggttgtagagggaatgggaagtaatttyggtttggttttttttgtgggtggygggyggggttatttgagtttttygggatatttttygygtttttygagyggtygatygtygggggattgtttggtgttygtygagttagggagygygaaygagtgagygagtyggttttttygg

SEQ ID NO: 6761 - DNA, 3415 bp, Artificial Sequence; identical to SEQ ID NO: 6760
  Description of Artificial Sequence: Synthetic polynucleotide

SEQ ID NO: 6762 - DNA, 1592 bp, Artificial Sequence
  Description of Artificial Sequence: Synthetic polynucleotide
ygtgttttttttygttgattyggtygtttattygaggtagtttyggaatttyggattttagttatgygygtagggaattgtygggtygagygagtttatygaagtagtttygygtygtgygygtttygagygttygttttagttttygggtgagygtttttagtygtygttyggtygygtttgggtygttttttyggttagggggtagygggagtgtaggtagygggaagggagtyggtttygtaggtttyggggagygagygggygyggggtaggygtygggygggaggaagttagygtaggygtyggtygagtttygggagtygaggttggaaaygttggagygggygttgtttatygaaggyggttygggatygggaygygggttygagygatyggagygygggttgtygtggygttggtygtagtttaggttgatgtygttggatygggygttgtygttatygtygtygtygtyggatttygttaggttggttygtgggttgttygtaggttgygygttgagtttyggaatygtygygygtyggggatttygtttttygyggtttagttygttygtttyggtttyggggtygtygttgtttttttttttgyggtttagygygggygtygtttygtttttaggtttaggtygyggttttygtygttttygatygggagagtygtattygggttttagttttygtagggttagttyggttaggagtagggtygtttygttygygttygttttggagygttgtatggttyggttygtyggttttggygygttattttygttttygtttttygtygtygtttyggtygggtygtygtatygttygttygaagttyggagttygtttygggatttttgggygyggggyggggyggggtyggygtygggtyggggtygtttyggyggttaygygygggtygggggaygyggygttttgttyggyggygygygyggyggaggaatgtaagtttttaggygtygggtygygtttttttttygtygyggtttygygyggggyggagggatttttttgygggggtaggaatgygaggaaggagayggygttgyggtttttggaatgtggggggagtggyggyggtygygttgygtygggatttyggaggggygtggaggtygggttaggaygtaggggygggyggyggaggtatygyggggagagtttagggtttgyggggygttygggtygtygggtygttgggaagagttyggattttygtaggttgagttggaggtagttggygttattygggtyggagagatttaagtagtygatagttttttttatatttygttttattttttttttttgygtygttttgtttttyggygttgtagggtygatttagtttagtttggaatttayggygtttygttygtttygygtttaggaatattgtgygtttagygtagatgygtttttaygattttttgtttggttyggggttatgtggtygygtatyggtttttgaagtttttatttgattgttggggaaggygtttagaattaggagygggttggttggggattggttttygygttgggtygtttygt

SEQ ID NO: 6763 - DNA, 903 bp, Artificial Sequence
  Description of Artificial Sequence: Synthetic polynucleotide
ygggttyggttggtttttagtaggtttgtyggggtttttgtattttgtgttygggatttttaatttgygaatagtttggggaggttgagygygagttaggagyggattygggggtgggggtaagygttaygtgygygttaggtttttggtgtgttyggtaggyggygttgygtggttgyggttggtttygagggtgyggggggyggygattygggagggaaaatttttgttttttttyggggtttgttttgttygttttttaaattygttttatatttttttygattttygtttttgtaagygttatttgtagttttatyggttttygtaayggtggtggtggttggtggggggtttygaagtttgtttttggttagtyggatttyggtgggagatggaggtagaaatttyggttttttaggagaagggygtttgtttatttttttatttttyggggtttggggagggggttgggtaggggyggaagygagttggagtygtgtttgtygyggygttgyggagtggaatagatggttggggaggggagagggtgygtggyggggaggaggaggggtgygggggtyggaggatagggaaygaggaatttygaagtttggagttttttaggagaagttttttttttygtttttttttagaaaggggggtatatatgygtttgtttttttttyggagagttttggtttttgttttgtggtagattttgtygygtaattttttgttttagggygygttttttatttttaaattttygtygygggayggggtggyggggttaggatygttaggagyggttygggtygygagggttaatggggtygtttttttaggggygaggaggyggygggaaaygggttyggggtggggaaygagttttgggatygt

SEQ ID NO: 6764 - DNA, 1592 bp, Artificial Sequence; identical to SEQ ID NO: 6762
  Description of Artificial Sequence: Synthetic polynucleotide

SEQ ID NO: 6765 - DNA, 382 bp, Artificial Sequence
  Description of Artificial Sequence: Synthetic polynucleotide
ygttttttatttttaatygygagataataygggttagaggttaggaaattatgttagtattaatgygggygtttaygagtgyggtggatygatgtggaagggtygggaygtagttygagttttagttttygtygtagygatggtygattttttagtygyggaygttgaaagygaggattttaygtygatgatttttyggygtattatgttyggygggygtttggttaaatagtttaagattgyggaattatattygttattgtgtatttggaygttatttgtagatttagygtttgyggggatttyggaaaygggagagygggttttyggaaayggtgattaatgggaaaygtgattagatgttattaggygaatagttygt

SEQ ID NO: 6766 - DNA, 665 bp, Artificial Sequence
  Description of Artificial Sequence: Synthetic polynucleotide
yggggaagtagggtygygaaggtttttgggaaatgtagttyggygtaggaagtagyggaaygattygattttttttagtattaagttgygtttttaattttttagagttgggttygygggaggtygttygtgtaaaatttaggttgagtttttttgygyggagttgtgagttttggaatatygtggtttgttttttaggaygygtaaatagtgaagttagtttygttygggtgagtygygggggtttttgggaagygtygtttttggtgtaayggatygagatttgtggygtttttagttatygatagygtyggttttagtgtygtttttgttttagttygygtyggttttgttattttggtagygttaagtgtggaatyggggtttgtgttygygggtttggtggtgagttttygggaaatygttagttttgagygtyggattttttgtgttgggtgggagtgggggttygyggttttggtgttttaatttttggaggaggaygtygggyggggygatgtttgtgtttgtggttttttgaggtagtgggagtggygtgtgaaggattgtgagagtttggygtgaagtgattgttatttgttagatattygtttggttgagtgtggtttygggatygtgttygtaagyggatttygtggaggygt

SEQ ID NO: 6767 - DNA, 764 bp, Artificial Sequence
  Description of Artificial Sequence: Synthetic polynucleotide
ygygggtatyggtttaataaggtgtagygaatagtygttygttttygttttaatttatagttttatattttayggtgttattgattttttygtatttagttatataggaygtggataggtatayggggtgatagtttygtattgaayggtattaatttttattygtatyggagttatatagatggtttgygaygagttttyggagatttataygttattttttagtttattttygatttgtagaatagaattggtggaagattttttttttgtttygaaggttyggggaatttgtattygggttttatygttatttttagttggatggaatttagtttttaygggttyggaaagaagygttttagttgttttygttttyggaggatataaaggggtygtyggtttaattttygyggggttygttgggaaaygtagttyggagtagaaaaggtygyggygtygtagtgtttggtagtagyggtgtagtttygygtagggtttgtaatayggttttttttttattaggtttttttatattggttttttttyggttttttagagagttygaaagttyggattttttgtagtttygagtttggttyggttatagggayggggtttagygttatattataygggttggtgtggaagtgygtaggtataagygttttgygygttttttttagtaattagggyggggagttgagaatygtaggttggtygtagggaaaaggtttgtgygtgggaaygygttagtggygygt

SEQ ID NO: 6768 - DNA, 1394 bp, Artificial Sequence
  Description of Artificial Sequence: Synthetic polynucleotide
ygatgttaggtaygttataaaygtagatataaatygtaaagattttagagattygttatagttagygttagagttaggtattatygygtagttttttttgyggtattattttaatttttygttagagaayggtataygygtaygtagtagtttygtgtayggaaatattatttygttagyggttaggtattyggtttaggtaygygggggygyggyggtygttatttagtaaatattataggtagtaygygtygygttttggtttaggttygygatattggggttttttttatttaatttaygttagggttayggttataggtttagatttgaatattttatttttatygggattttgtagttaatttttatttttttttaaatttttygatttttyggtaggtgyggttttatattttttttttgttttttgaagggttttagygttygtttttygygygtttgygtattygaggtagaagtygatttttaaaggtttyggtgaggygtygttgggggyggggyggggttygtagttttygtttgttttygagtygagaattaaatgaaaaataaaaaggyggaatattgtttttttaaattttggatygtagtgtttataggggagtaggtttggattatttttaatggtattggttagttayggggyggttattataggtagaggtttgaggygagggatattgyggtttttttggtttygttttttyggttygattattttygtygagattyggttttaygygtttttttyggttyggagtagttgygggatttgttttygttttttygygygttagygtattygygayggagataggygttttttygtattttggygtygttgatttttagggttgggttattttttgagtygggtgaggttggggttgggagtygggygttattgtggtygttgtttttttgagggaaaagagygyggagtgggttaggttttgtaggtygggttaaggtggagaaaaggtttttgtggagttttaggtyggtgtgttttttttttygggattgagtttttgtagttttgaggtttggaggttygggyggtagtaattgtgtyggattaggttygtgggtgyggtttgtggtgtagttggagatygaggtttygygtattttygttygygttttagttatttaggttyggtygtagygaaaaggtttaagagggaagttagaggtgaaygttttaggatgaaggttttttgtaaaaygttgggatttagatttggggtgggtgtttggggtttaggaggataygttggatagtttygaaaagatatagtgggtggtttygggygtgggtaatygggtgyggaattatagygtattyggagttgygaatttagaygygg

SEQ ID NO: 6769 - DNA, 949 bp, Artificial Sequence
  Description of Artificial Sequence: Synthetic polynucleotide
ygttttagygttttygagttatatttgtgyggtttatttaaygygatgtttggaygtagtttttagagaggaggtygggattggaataygtagtyggggaatggttgtaggtggtttagttttygttttygtttygttttygtttgggtttygtgyggtttygggtgygtaggtgaaagttyggttttagyggtttyggttttgttatggatttygygttyggygttttagattttygygtygygtygttygygtttttgggtatttygtaagtygaggtgttggaggaygtgttgygggagtagttygggtygttgttttagttggtygttgtttgtyggtttaagyggttgttttygggyggttattygtttattgaaaatttttagttggtgttggagyggyggygtgtggttaaygttaaggagygtgagygggtgagggatttttagggtygaygttygttttttttttttttgttttattattaaatatttggttaatattygggggttygtttatygtttattttygttygaggygatttygagttttygaggttttttaygtttttagtttgttaggagaatggtagtggttttttttttttgtattttygtgtagttgttygttggyggtygttgyggtggtygtttygttygttaattttttaggatttgtgtaggattygggtttgggaggggatagaggaggggttttgataattttaaaaatgtttttttgggtaggtgttttaaaagtttygygtttagggggtgygtttttattttatatygtaggygttggtgggtgtttgggaygygtagggatttttttygttttttttttttgttttttgtatttyggtttygaagtatataygagggtgaggagaaaggggggtttgayggaagtgattttttttttttaaagtaaygaaataygaygt

SEQ ID NO: 6770 - DNA, 1365 bp, Artificial Sequence
  Description of Artificial Sequence: Synthetic polynucleotide
ygtttaatagtatygttyggagygtttatttttttttatttygtaaaaaaaaaaaatagggttattggttygggtygagagtygttttgggaagygtttttgttattaagygttatttyggggtgtgygagggagttaagggaygyggagatygggagtagggttgggtttttttgtagttttagygttggttttttgtttatygtatttaggygttgygtygtttttatatttatttttttttattttagtagygtgygggggaagtttygygtyggggttttttttagtaagattgtygyggttttyggttttaattgtaaggtaaayggtggtagagtttttttttattttagtygtgtgtgatttttatatttagtgtttttttttgtattggggygtyggtagtggygatttaggttttttagttttygtttagtttttygygtgygggygtygggatygtagtatttgtgaygtygaagtttagtaggtygtagaygggagttaygygyggttttggtatagggtaaaaatttaygtttaggtaggygggtagttaygatgtygggtaagtttagggtagattttyggtggygtatagggaagtagyggtttagaaggtygggtggaygtaggyggagttygayggttgggaggtygtyggygygtaggggtygggtttygttaggatggtttygatygagaaaggggattygaagygttygggagygyggggygtgttygggttagtaggggatttgggygtyggagagyggttagagygyggaggtyggattygagagttygagggagygggtggygggttgtttygyggtttggggttaggtatgaygyggtygttgttyggayggaygtaaggaagggagttygggagaagtgagaagattttgtaaaaggtagygagtaagatyggttgtttgggaattttttggygttyggygaaggtttttaaatttggyggggyggggtatggggyggtttttttttattgyggttygggyggggtttttaaagtttgtgagygttygttttgtgygaggtaaggtgggtatagtattaaagagtgtgtttttttttttttttygtttttaaaaatgtttattttggggyggtygtggggaggattttgagttygttggtgattttgggygaaatatttagttatygggtttygttttttttttttgtttattgaagaagggatgttygttttttyggggttttgtagaggyggagttgtgatttggagagyggtagggtagtgtttgyggttttggttttagttgattygygtygtttttgaygtagaagtttyggttagatttatttaggatygygygg

SEQ ID NO: 6771 - DNA, 2638 bp, Artificial Sequence
  Description of Artificial Sequence: Synthetic polynucleotide
ygtygatagygaagtggtaggtaatgggaatttgggygggaagtaaagaattattaygatttatatygygtttaagtagtagtaygygggaatttggtatatagtaggtaggygtttatttaatatttgttatyggatttagtatttgggtagggagtttaggggtggagtggyggtttgggggatataaaggtttygttagtttttagttgygtttttygtaaygyggggggygggagtttagagttagagagagggggygaaggaattygtttttatttgtaygtygtttggggttyggttaatttgtttaattatygttttaaatgttagygggtagtatataataygygtttattaataggtttaaagtgtygtagygttygttttaaatgagaaaagtaggygataaaagggggaaaaagttaagttttttaatttgaagaatgttttgggtygtttygaaattatttaygygagtttaaaattyggagttagtttygtagaaaagttgaggtttyggtgygagggttgggggtgggaaygggggttgtgaataattygttaygaaaattgggttttttaggaattagtttgtagtygtttagtgaattyggagtyggaggataaygtygttaatttagttttttaggttttttgttttattgttagagaaagttgatygatttttaagaaggaaagygagatttttttaaagygggtataaatttaagtttttttyggtgtaggygaagaattttggaggttaaggaagattttagaggtggattttaaaattttaattygtaagaggggaaaagttaaagtaattttatttttatttaggtattggttagygtagtttygygttyggtygttagagagtagtttaatttygtaaataagttttgtttgggatyggygtagaaggttttattttttattttatggttaagttygggggygtattttgygggtygyggttttttatttttttyggygygttygaygggtatttayggtgygygttttttygggagataggggttygttggagaggtaygggttgtttaggttygggattattaggaaggggtatttagggtaygggggttttttaaagaaygygttgttttgaggtttttttattgygaataagattaaggygaggtgaggtttaggttttygggattgatagygtygyggtagggggttygaggygggagttggggattttagygttttttaygygygttttaygggggttgtygttaataaaggyggagggtaagggtgygtttatttaagtaagggggayggtgggtygttygggttgagtagyggagygtagygggaatygagagtggggggttgttttagygggtatatattttyggygaaatagtttygyggtttttggaaagtgtttyggaygggttgygggygttttttygtttgyggaggagatataaaggtaagagygggtgagyggaygtagggtygggatttttygggggtggtygyggtgtttttttattttygagttygagttgttgttttggtttttygattygttgattagggaygatttgatttygtttaggtttygttgygtygaggygttatygttgttyggtttttgtttttygtttttttygttttggaaggggattagttygtygttygtttygaggtygtttttttygtyggtygtttyggygttggagtygtygtttttttygttgtygtygtygtygtygtygttttygtygtygagttggggtatggtggggtygygggtyggggtygtygttttyggagtttttagtygttygygttttgttyggttyggttyggygtttttttygttygtttgygggttygttgygttagtygtygtaataaagtttgatagggygtggtttygygggaagygggttyggygttgttyggtyggggygtaggyggttyggttygggttttttyggtagygtygagtttagggttttttaattygttatygtygtygtttgtttygtyggggygttttagtttttggttygtyggggaggggygagyggggagggagggaggagggatygtygggttgggtaggggggtyggagggaggagtttyggttgtaagttgatattygygygtttygyggaattyggagagttgyggtgygygygtatatatatatatatataygtatttatatttatatgtttatattygtattttttaggggttgygtttttttgtaaygtgtatygtttttaatttttttttgygttttatattgtattttyggyggttttttttayggtttttttggagttttggaagttttgygtttattttttygtattttttaatttttttttaaagaatttttagaatttygygtaggtttttatttttttttatygtatyggygygygggygggyggtattgttttttgygggaaagtttyggaygtatatattggtygyggggttttttttttgtttagagttttttygagtgygygagttgatgtayggattaggatattggggatatttatggaatttyggaaaatgttyggyggtttttygygttttttttttgtggggttttaaygygattttygg

SEQ ID NO: 6772 - DNA, 1531 bp, Artificial Sequence
  Description of Artificial Sequence: Synthetic polynucleotide
ygaaagttygtataaatygtatagaaaaygaataaatgtttttygaatgtgagygaatttatagtttggttagaaaaatttaatattgattttygtttttttaattatagaattttygaggagaaggggataygttaagygggtttgttaataatttttatygtatattttaaagygttgtaaattatatygattattttygattggaagtygatyggttgagattggaygtgaatttygygattygattataaaaggttaggaggaaagaggtagaaaagttaaaaggatgattaggtaggtggttygagyggttattttaagttaattttttagaaattattygtattgttygggttattttttttttaatattygtggttttatttattatgatgttaagaaaygtgggttaggaatggggtgttgttttttgttygaaatttggaggygtyggttttttagaygttttygggttygggtagaggggyggtaggggyggggygggygggtttygggtttgggygygygggtaggtggggygtggygggggygtggagagtttaggttygyggttatygtttygtttygggtyggtttaggaggagtygygtygggttyggttataagaggtyggttagtaggygtttygttagtattygttygatttyggttyggagtatygggygtttagygygggtgaaggyggagtygtagggttggtttttaaagggatgttttygttygagyggygagattagtttygttygtttttygtygyggtygygtygtagtygtttayggtygtygatatggttttttattgyggygataatttyggagtgtattygtagttyggtttgttttygttygtygttatygtygtygtttygggygttttttyggtagttagggygttttaygggttggtygattaygtygygtygtyggtygtygtygttaatttttatttgtggtttaaygggttyggygtgggaggttygtttttygtygtygtygtagtygtygtygygtatttgggygtttygtygtygtygtygtttttyggggtygyggtygggttttttttgtagttatygtttgtygtyggtatttyggttgtttttagyggtttttygygtagttygygttygtygygttygtttygttygtygygttygyggggttyggggagttgggttggttgtttatggttagtygygaggatttgatgaagatggtgyggtygttttattygtattyggygtttatygttatggttatttagagygygttygagygtaaatttatttttagttatatttattagttygtygtygatagtttttttttttattagygtagtaaggtyggttggtagaattttattygttataatttgtygtttaaygattgttttaagaaggtgtttygygaygaggaygatttaggtgagggtygttggtaggtgttttttagtyggggagggyggaygygggtygtaagggtyggygtaggggtyggtgtgygg

SEQ ID NO: 6773 - DNA, 2045 bp, Artificial Sequence
  Description of Artificial Sequence: Synthetic polynucleotide
yggygttttygttttgtttgtatttttttttattgtttttttaygtttggaatgttttygtttttgtagtttgtagatagyggaaatygygggtgtaaatgtgtaggggtygttgatatgatyggttgtagaagtttatttagggttattygaataggttagygttygggattgtataagaggttaggygatgttgtgggtttttaaatttgtatagttgygatattttgygaygtgttattttatttttagtggggtggggtgggggatttttttygtagttygttgaaagygaggtaggaattattgtaatttttttgtttaggttgaggtygttatygtttygyggatgtaygygttgtaggggygtttttygtygygggtayggygygggaagggatggggtttggtgggagtgggtaggtggygggagaggygygtgttygtgtattagaggttttygtgygtgatataggtygatgagtttttgygggttgtatttaygyggagttatagatygaaaaggttagtyggtggtyggtgtgttaatatatatagagagaygttygttaggygygttgtaggttgggaygaggttaggagggtttaggttggaggagggttgaggagggttgygggggygggtttyggygtagggygttyggagyggagggggygggttygaggyggggygggtygyggygttgaygggttgtygtygttgtattygtttttagttygyggtgtygagygtaggyggaggtatatggtttygaygggaggygygyggygagtattyggagttyggttttttgtttgagtayggtagtygygttttygttygygygttttygttttttyggtyggtagttygyggatatgatygtgtagtttttttttgggttgggatttgtttgaagattttttttatggaagygatgtttttttagtaggagattttagggggatagtyggggygttttttttttttgataggagtgtttyggttygygggaggtagttgtattaagaaggtgaggaygttgagygggggttygtgtttttygtygtygtagtttttattgtyggygygygtttttygygttygttatagtagygygttaggyggaygtygygggaatttgaygttygaggttygyggtttttaatgagagttttagaatatttttygtttttgayggttagyggtagygtygtygtttttygtagagygttygttttttygtttttagagttttagttttttttygagygatttygtagtttttttttygtttttattygtygtyggttttgtagttyggttttttttttagtttaggygygygggttgtagtgggygatygttttttttygatttttygtygtgtttttgggtttttygaagtggtttgggygagtattgattgttttttggyggtgttagttttaaagttagggtyggygatgtttgttygggagyggtagtyggygttgaagaaggtaggtagyggggttgyggygttggtgggttyggtttttttatttgttygtygaggygyggttgttttatagtagttttyggggggtagatatggggagtattgttttttatattagggttttggatgatttygggttttttaggtgggggttatagtttgaggggygattgtggatgataaygttygatattayggggatatgtaggttyggttgggtttagaatygagtagggtgggggygggtgggttgtggttgggggttttgagggttgaggtgggggattttttttttgtattggtttttggtttttgggattttggtygggttggatagggattygggtgtyggtgtgggygtgggggtagygygtgttttttgttaaagttgggagagggatgtaggtgataatttgtagygttttatttygataaatayggtygttgtgttgygggaggatttygattygggttaggtttygttggaayggttttttgagtaagtgtaygtgggtygygggttgtyggtttttgtygtttygt

SEQ ID NO: 6774 - DNA, 476 bp, Artificial Sequence
  Description of Artificial Sequence: Synthetic polynucleotide
ygggygataygttttgggagggygggttggyggtttttttagttyggagygygtggaggttgygygtaggggttygggaygygggatagggatttygygtagtttaggygtyggggaatyggggttggagtyggggatttgagtttagyggaygtttttttygtttggaggttyggtayggatygggatattagggygttygtggtygtggttyggtttttggttgttgygggtygyggtttttagtgggtttttaggatttttttttayggygggtatttatygaggttgagaggttaygtygtgttgttggggtttttygtygattatatttttgggygttagttygggtagagatygyggggattggttaggtygggttaggtygggtygggggagggtygygttttygggtttttgattttyggyggygagaggaagyggtatttgggttatatttttttygygygggtyga

SEQ ID NO: 6775 - DNA, 455 bp, Artificial Sequence
  Description of Artificial Sequence: Synthetic polynucleotide
ygtttttgtttagygaggatygtgtagaagygggaatygggtattggagggygygygyggtaygygtatttyggttggtattttttggtttygyggggtyggaaagaatttygaatattyggttttaaaaggtttttagttatttygttttttttattttttatagtatagatggggaaattgaggtttggagaataagygtggtatatttagggttatyggaagagtaatgagttgaattagagaggaggaaygggaagygagatttttaagtaatgyggggtggttttygggttatyggaggaggtatggtygggtaygtttttaagtttyggtattygtggtggttgtgttagtygatatgagtttttttttttttaggaaggygtaggattyggggaagttttygyggttaggtygtttgtttattygtagatttygggygtygttygygt

SEQ ID NO: 6776 - DNA, 749 bp, Artificial Sequence
  Description of Artificial Sequence: Synthetic polynucleotide
yggggattygagttttygggttgaggatygygggggattttaggtygggayggagttttttttggttygttgtgygygtaygtttggaaaggygggatttaaggtagygatgttgygggaggttttgtagtgttaaygagttttygaayggtttygttttattttttttttgtgtgtttygtaagtttttgtttagtaaatygttatagtttyggygygygagagtggygttggtaygtttaaatttyggggtttttggttaggttaggggggygggygtgyggyggggtygggtygggtygggtgygtttagygggtttygggtataygttttttatttgggygaggttyggtgygtaggygtttagygygggggtagyggtygggygtttaagttyggygygggtaagagttggatagtttaggggtygygtygggtygagttgtygttygygttatttttatygtygtygttgttatygttatygttatygtttgggttgtagtagatygygggagaaygtttgygygaagtttyggtgtagttttggygggatygtagtaattatyggagygtgagtaatagtttttyggttggaggagttattgttttaygygttygyggttygygygtygaggtaagttttgggygtttagtttagatyggygttttyggattgggygttttttgtttgttyggttttygttttttttygtagagygagtttgtatttgggygygtygttyga

SEQ ID NO: 6777 - DNA, 1134 bp, Artificial Sequence
  Description of Artificial Sequence: Synthetic polynucleotide
ygaggagggyggggygttyggtttttagtygygyggttatygtttgtttagtttggttggatttgagttyggttygtygatygttggtygaggygtagttgaagtagttttttagtygyggygtttttattttttaattttayggtttttgyggygygggygygatgtagttggttyggggtgaaggtaaggygyggggygyggggygyggggtattgggagygaggtattggygygggatgttyggygtaaggtgtagggygygggtygtttttttttygygtttttttatttygttaaagtttttttaygatggtttttatttyggttgggttagtttygtaattttygtttgttttttgttttttttttttttttygagtygyggggttttyggggygygyggattttygttaggggtygtgtaggygyggagttttagtyggtttgttttgggttygaagaaagttgtggtttggagttagttttttttttaygatttttgggggygtttttttttttttttgagttygygatgggaaggygtttttattttattttyggggtttttgagattttttggygaggtggggyggygyggtaggtgtagggttggggagggtttgatagttttggagagtgttygattttagttygtygtygttttttaggyggattttttagaggtaggttttagttttyggygyggggaggyggygygttttagaggggygtagggtgygygggggtygttggtttttygggtattttttttttgyggttttttygttttttttyggagttggtgtttgaggtygttgggattttagtttggygttttttttygtttygagygaggtaggtgtygtgggyggtttyggttatttttgtatttygagygtttattttgtatttagttttaagtyggagagttttggggatagtygagagtgttagtggttttatagggagattgagggttttgttttatttygggygtygtgtgggtttgggttgtttatagtatttttgygttttagtgataggagaagttaagygygaggttttttaatagttgygtgtattttattttttaggtatttggaatttyggygtttagaaygtgtttttygg

SEQ ID NO: 6778 - DNA, 1645 bp, Artificial Sequence
  Description of Artificial Sequence: Synthetic polynucleotide
yggygtttttttttyggaaaggaygttggatttagggygygttagtaygygtagtagyggttygygagtyggtaggtgggtagtttyggygygggaggaaggggaagttatttttttttyggaagagggygttggtttttttattttgtttttataataaggttatyggaggagaggaagtagttagttgtygtttgygttttgtaaagtatgtagttaggggagtagtttttggtgagtttagtgaatttgtttggygygtatttttattygttggagagtgygygaggyggtagyggygggagygttggttatttttttagygyggttttttttttttagaagttggatttagataaagygtttaagaagtttttyggtagttttttttgygaggyggtgagyggggagttygtagtygttagygtaggggttttygyggttatgtttagtgatatygaygtyggggaygtatttgttagygttgyggtagtggttaagtyggggttttyggayggtygtaagggttttttttgyggggaggaggagttgtttttygtygttgtagtygtygtygtygtygtygtygyggttgyggttattgtgygttattttatggatagtttgagtttygagyggtattatttttagtttttyggtttttaggggtyggagttggttgygttttgtttatttttttygtattaggyggyggttggggygttttayggatttgtgtattyggtttttaayggggygygttatttttayggttttatgttgtttttyggyggttttttygyggttgtgtgtttattygggagggygtagttyggtttaggagtyggtgygggtagtggygygggyggtagtagyggygggggyggyggttygggtatttattagtatagttagggggtttygttttaygggtygtattttggagtygtagyggygggattttgyggaggattggggggtttgggggttttaggttttggttttygtgtttaygtttatttgtgtaatyggtttttgtggtttaaattttatygttattaaattgagatgattattaygaaatagggtaggtgagygtagygtggaggggtttttgggttyggggataaagggtgaygtgtggttttggggaaggttygggatgagggagttgaatttagttgtttygygyggtgtttagagtgttttatygygygtaataaattttygtagatatygtatttttaatgyggtgtttttttgtgttagtgtttyggyggtttttgtagggtgttaatgttayggttgtatatygttttttttttttattatttttatttgaatagatttggaggaggyggaaatggaaattagggtatgtttataagttggattygttagatttttttgttyggyggtatgtttgtgtatgtttgtatgtyggtaaggagttayggatagggaaggtttaagagttggttatttgagygtagtagatgggttttygtagttttaggygttagggtttttayggggygttttygggaggtgggtatgaaggttagagygtyggtttyggaagttyggtyggagtaggtggttagatttgttttggagttagatttggttygggttyggtgygyga

SEQ ID NO: 6779 - DNA, 4698 bp, Artificial Sequence
  Description of Artificial Sequence: Synthetic polynucleotide
ygtayggattygygttygtattygaagattttataygtttttygtattgtttttatagtattttaygttygyggtgtaygtttatttgtyggtagaygagttataygtttyggyggtttagattttygtgtygattttygtgggygagtttaygygttgggtgttyggygygtttttaggagtggttgggatygygggttggygtygggtagggyggtgggaygtttggagtyggygggaggagtaygtttaggygggttygygtygagttygagygagygggygagtygggygggaggggttatttgtaatygagtagaygttattatygttttttattygyggggggygggggygggyggttaggtgayggyggtttatttttygtygtygagtygggtggtttttgttygggaggagttttttggygygttttgattggaattttygtygtagtggygggggaggggggataygtgatygttyggttaggyggttyggygygttttattygygatgggtattttattttttttttggaaaagtygggggatatagagaaggyggaggagtaygyggggtgtaggagagtttattagtttttttagtygtagtgttggtgatttyggtygttgaattyggagaggaaaggtttttaygyggttagtyggttttgattgttttttygttttgtttttggtygtagtatttttttttyggttgtagtaatygttttttatatttttaggtaagggtaygtttagtgtagattattgttattttatagatgttagtgttatttaagagtggtgttgggtttttttttttttttttttttttttttgtatattagtatattgtattygagagaaatttayggyggtgtattgtagatatygtttagttttagggttygaagatttttygattaggtttygggatgtttgaggttttttaggttattaygtggaggaatttaggtttgttttttgygtaggaggaggaggygtygygggagttgtagttttygattttttttaggaagtyggtygggtggaaggggagagggtygttatygtggtgygaatttaattygtagtttttgggagtaygttgttaataaaggttaaattaaaataattaagtggtgtyggtagggaygygtygtatggttaggagaagttyggttattaattatttataaggagtattgtttttttggtgtgggagaatggggttgtgygatagtttttyggagttgygttttgttttgaattttaagtttttttagagtaagtggattgygtagtttattattttatttttttayggtttttttttggggyggtattattttagatggtaggaattyggagaaaatgyggtgttaygttygtygttatgttygtataygygtttgygttaattttagtaataygtggggatygtgaatttgggygtttgttttttatttaggtggttatgtgggtatatttatatgattattgattaaaattaaattggayggagaagtttgtttttatattggatttttttaaatttttgtttaagggagttttgygttygatttgggyggggaygtagtttttagttaagatygtygtagygtttagtagagttyggggatyggtggtggtggtggygggatggggaggaatagaggtttttgattttttggtattttattttttttttttatttagattagtygggtaataygtttttygtttaagatggtttttttaattggaaygtgatttagataatgtggaagttaggggtttttgatttatygtatttgggtttygttgggtataggataagggttgggtaggtttatttggaaagggagtttattygtaaagtttygggtataaaygttagatagygaaattttgaggaagtttaaagtttatttattgtaaattggtggggggtgggggagtattttatgtaaaaaggaayggttttattaaattagtaagtattttattttygtagtggaygttttgttgtttttggttttttttttttttattttatttttttaaattattaaggttggagaaattttataaataaagtataagttygtggggggggggggggggggttatttggtgttttaaaaaaataataataataaaygatttttgtaataagaaaggtgggtaygtttttatttttaggttttaattttaaygttayggttaygttaaaattgaagttgattgagataagagaattttagagtatagtaygtagatagataattttataattaaaaaatatgtattttttttttttygttttygttattttttttttttttygttattatttattttygtttggattaggggttgggagaggaggaggatgtagttttttygagtgtataagggaggyggyggggttatttgttgttgtatygttagaagagttaatttygagyggatttggtagggagttaaaattttttttttggatgygaygttttagagatygaggtagayggygagaatagatttagygtttygagatgtgttttttaatttgaattttggattatttttgtttgaaatgttttgttttgtaygtttgggaattattttgtgygattaaaygygtgatatatataygtataygyggggtygtttygtaggggggagggtgygtggtataggagtttyggatttttaggggttttgtatttggggagtggtgygagggggatygtttyggtgtggttgttgaygtgagataggtaattyggaaaggttttttttyggttgttttggtaatgggaagttgtgggtaaaggtgtaggggyggtttyggagygtatayggygtagttygtagtgaagggtagtggtgtggtggggtagagagattagataagggtaggygggttttgtygatttygagtttattygtttayggggttaygttttgttgagaaaatgygygatattyggtagggagagagtgatattgattaagtgtttttggagggtygagtygtttgttttygggagggggtygygaggttygttagtattyggttttygyggaagttgtgttagygyggtagtttygtyggygtttggttttattagtttttgtttttagygtttttyggtggtatygttygagatttgyggagtagaagtygaggataygagtaattygttgtgggtttgaagtgattaygttttagggttgtgaaaagttgtttygtggtgatttgggtaygaggaggttaataaagtgtagaattagttttgatttttatttaaaatgaagttggtagtattgagygtttaaatgatttygttaggattttggaggttgtgggagyggggtgggagagggtaaatgttaggtttaggataatataggatatgtttaatttaaggaagttttttttttygggttaygttttttgtagttttatttaattggaatygtttttgtattyggggttattttyggtattatgatatttagygttgttttttaaattttaagttttygyggttatattttttygtgtttgttggtattagtaagagtttttgtttgtttttttttttttatatggatttttttttttttatttttagatygtagtgygattggtaggtattttttygtttttttygygtttygygtygayggtgggaatagtagygatagygygatygtagttttttagtgttttygttttttttttygyggttatattttatttattttattygttaaatttygtatttygtygtygttttttttttgygygttttyggygttaatttagttagaagygggtggaagttygggtttatgtgtaggtgtttttgtgygggagtaggggagtttataggttagygattygygattttattttgtttttagttyggggtttatttaygtggaattygtyggttttygygggtatttaatattagtttttygggttyggttgtygttttttygaagttttagggygtttttaygggttaatgattattttagtttttttttaagttagggtttggttagttgggaaattttttygttttttgtttatattttttggtattttyggataaagttattyggtttttygtttyggtatygggaaagatgygygtggagagygtttttaggygttgggttayggtttyggtttttggtygtgtttgttgtgtgyggagttggggyggygggtatygtttgygyggggtaggtattttattygtygtttttttagtaygggtattygatygtygyggygttgtaggaaggaggtttygtygygtyggtttttttatatttaygtgtttttygtgtgygygttttyggtttgtagatgttataaggttggygtygtttggattttygggyggttttatttttygyggtygttaygtttygttttttgtatttagtttttttggygttttygttgtagtatttaagattaggygtygtttttgttagtygtgttgtttagtaygtttgagggtygttgtyggtaggttttatttttygttygggttttttatttatttttttttttggayggtggggtttaagttttgtattggggttgttaagttatygtttaygattttttgtagggtgtagygggagggygttttygaggygt

SEQ ID NO: 6780 - DNA, 462 bp, Artificial Sequence
  Description of Artificial Sequence: Synthetic polynucleotide
yggttygtaaattgattatgaaatataygatgttaattyggagttgtattttttagttgggtattttygygygttggttttyggggtttygttttttattttttgtttttttttttygygttttgtttttattttttatttttygygttggttatttygtttttttggtagtttttggyggtagygygttttattygttttygtgtttttttygtttatggaattaattttggttttatttgttgttyggtttaggttggggagaggayggagggtggtygtagygggtttttgagtgaattatttaggagggattgagtatagtattaattagaggggggttagggggtgygggattygagygagtaggaaggaggtagygtttggtattagggttttgatttaatagaattgagataygtttgtaatygttggygtgtttygygtataggattttagyga

SEQ ID NO: 6781 - DNA, 300 bp, Artificial Sequence
  Description of Artificial Sequence: Synthetic polynucleotide
ygttgtaaaatagtygtygggtgtagtgggtygggygttyggttattttggttgygattatygtagttttttaaaggatgygggtagatgtagayggttttggtttatttgtttttaaaggtttgggattgtgtttgygtgtttygggagggtattygaaatttgggagtttttyggygtttttagtttygggtatttggggttttttgttttttaatagtattaattttgagaataaygygtatygaaggyggaggtttttgtgttttggataagttygttaygggtaagttagttyga

SEQ ID NO: 6782 - DNA, 554 bp, Artificial Sequence
  Description of Artificial Sequence: Synthetic polynucleotide
ygtyggggyggggattattttgtagtaggagttygtagatattgtagaagyggagaayggygttgygtttttaaattatggttttttttttaaagggttggggaaggaaygagggggtaagtagatgttggtgagyggggtaygagagtgtagggtttygttggtgtttttttttyggygttygtyggatttatygtttttatygttgyggtgttygaattygyggattyggatyggyggtagtagaagyggtagyggtaaagtattygtagaatggggtatygygaaatagttttttttttttttttttttgttggtggtgtagtygygatagttygttttttaggtaggggtttggagtttgtttttttttyggygygtatagtaagttttagagttygtyggggttgttygagtaggtggtgtagggatgtyggggtgttggagaaggtgygggygagggttgtaaggagtgggtaggttayggaggggaagggttgggggagaggaggagtaagtaagtagtattgtygttygygttyggggtgtttygg

SEQ ID NO: 6783 - DNA, 1153 bp, Artificial Sequence
  Description of Artificial Sequence: Synthetic polynucleotide
yggygtatataagttgaggattgtygaggygttttttgygaggtaaataygaagtygtttggttagtgagaagaaattygaggtggtttttggggtagatagagtaggatttgtttttgttttttgtttttttygtttttttttttttagyggyggygatygtagtaatagyggtagtggyggttgttgttattgttttgtygttgtygagtyggttatttgggtattygyggagtygygtygttgttatygtttyggyggtttttyggagtgygyggagggggyggyggaggagygagatatttatagtaatygaggatgygaggggygtttagtagtagygagtgtttgggagttaggaggaggttttygygygtyggtaatttttagtgttaggygttttgtagttttygygygtygygtttgggttygtatygttttygtagtgagggttygttygagyggtaagtttttttyggyggttaagtygatatttttttttygtttygtygtttatttygggtagtagtygyggaataatggagagygtagttagtagttttggagayggygttygggggaggaygygtygtygtygtygtygttgtygttagggtaggygygygtygygtggagtygggygggtgygagggygygyggyggggggtggggggtaygygtygygyggggggygggggtagtggggggygygygygygggttyggggagttygyggggagagttyggygttyggygtagygyggygyggttaagtttygygtttttttygttttttttyggygygttygttttygtttygtygttygtattygttgggggygtttagaaagatgtatagaggtaayggttaggggagyggaggtttaagttatatgtttgygttttygggggttagagttygttagttttygyggatttyggttygyggttagttygagyggttygggtgagtagyggtatagyggttttttygtttygyggttttygttygtygagaygtggttttaagaagtggtgtygtagtyggggtagaggyggaggaagtygagtygggtaagtygggaaggttgyggagaygttttgtyggggtaggtgttgtagttttagttagyggtttttayggagggggygg

SEQ ID NO: 6784 - DNA, 1603 bp, Artificial Sequence
  Description of Artificial Sequence: Synthetic polynucleotide
yggttygtagggggtgtttyggggygttttttgygygaggtttygggaatagggtaygagggtttaggttgtttagttgtaggtgtagttgtttyggaggaggaygttgtttgyggygtyggggagtttttygyggttggaggygaggggaattgtatttattatagtgtttygtttgygygaggattatttatttgggtyggagagagygygygygygtaagagygagttygggttgtggtttgggggaggggagygagggggyggggagygttttatygygaggaygggggyggggayggattgttaggtggggygggtagttggggyggttygaggatttttttygatttaagtgggtatttgyggagttaaaagtaggggaggygttgtagttgtgaagaggygtgggggtygygggaatttttttttggtyggtgygatgaaagtygggyggaygaggtggtttaayggggttgagagtggttyggtygaggygygggttgagtttttagtatttggtttgagyggygtgggtagtagtttgtatygyggatatttttaattttgtygygtttgygtygtattttggtygtggtagygatttttygggtatttttgaggtygtttttagttttataagtatttagtygtttattttagagtagyggygtygatygttttaagaggagttagttttygatatygttttttatttatttttttatatttttatygttggagggggtgagtgtygtggataggygttttygttyggggatagtttagyggyggtagttagttygattttttttygygygggtygtttaaatttgattagtagagygagyggtttagygtagtagtygttttygyggtttttagttgtagaaaagtaaagygtygggaggaagtagtagagggggggttatatgaggttggaaagtggygggtgtayggygttygggatygtygaggtttttgygtygttttgyggaggtgatttygyggtggaggttaygagtatygtygtagttttgaygttgggatttaggggttttygagygtttayggygtggtggygtygggtygygtttttttagtagtttaagggtygagtggygygtggttatatttatagtagygtaggggygtygtgggttgayggtttttttygygygagtygttttttygyggtatttatttttttttygygttygggtttttyggaagtygaggygygggttatttggtgggatttygyggttttygttttagggtyggggtaaygyggygtgttgattgggaggattttyggygttygyggtttttattatttygtttygyggyggaggygggygtttagggtagggayggagttyggagygttgtagagttyggttaagtttagttttttttyggtttggtagtygyggttyggatgtygttagttyggygttagagggggttagtygataataaaaatgtttgtatygttygtaggtggaggyggtttattaggttaggaatygaaaggagggagggatgttgttaggttaaatttaaygttttggttaagggygygttaaggaaatygtatygt

SEQ ID NO: 6785 - DNA, 1411 bp, Artificial Sequence
  Description of Artificial Sequence: Synthetic polynucleotide
yggttttygttattygggtggattttgtttatygygagyggggaggyggttgtttttygtgtaggattttygttgagggtttataataagyggttttaagygggggtatatttttygttattttygyggttttttaaataaataaagaagttaaagtyggttgttttaagattaatgtaagygtttaggaagttttgaggygtttgagggygaggtaggttgtygtgggtaggtgtgaatattttagttttygyggygggtttggagtygtttagygtaggaagagggtagaagtgggttygygtttatgygggtattygaaatgaaaaagagttgtaaayggtataaaagttygggggttaggygtaggaaaatagagtaagggagttgttttagtttttaaatattgtatatggatgggtgtttygyggaagattattttagattttgtgaaagaagtttttattgggygtyggttayggtattggggtgygygtttgttttgygagaagggttttttaggtygygygggggaaygtaggagaygtttgttttygggggaattagyggaggattgttttattttaaagtgaaaatttgtaggttttgggaaaygatatttaaaaaagtatataatttttatatgtygtttaatggaggatttttataatttatagyggtagataaggttagagggtgtaataaaaaatttgaagttttttttttttttttygtygttttttyggaattgtattttgggtagyggagtagaattyggaatgtgaatttttttygatatatgtttttygtagataagtaaataatttggaygtgaaatggaaatggtaattaatgtagtaatgttgttatatttygagtgtgtaaattttattgattygtygygttayggggggtgtygggygtayggggatyggtggygtgygtttaggttgtttattttttttttttttttttttttttttttaggttttygggyggggygtttagaaatttygtagggatgtggaygggttgygggaagtaaggagttgtttaagyggygttygggattttyggttttyggtttttggaggattgggygggtgttttgygtttgtttygatagtygtattttttatttatttttttyggttattatygtygygttagygttagtagggttttttyggggttygagtgtagttyggttttgaagtatttaggagagtttgagttygggygatagaggtttggaggtagagggaatttttaaatttagtgyggygggtggttttgagtgyggyggttaggttttttttttttttttgtttyggggttaagtgttgtygggttgtttggygagagtttttttgaagtttttttttattttygtatygaaagygttgatygt

SEQ ID NO: 6786 - DNA, 2629 bp, Artificial Sequence
  Description of Artificial Sequence: Synthetic polynucleotide
yggtagtaaayggtagagtaaaggagtygtttttttttatttgaaagtygygaggaggtttggagygttttttttygttggggttygagttttttgggttttggtygggtgygggtagattttatyggggttttygttattttttagtttagttygtagagygagtatyggtagattttaagggygygtgagtttggttgtyggttgggtttttgaggttygttgggygggggtaggtyggtttaggttgtgyggggygtttataaaaagtgatttggagatgaattygttygtgygyggttggtygtttygttataggggygaaggygtttgaygtaagyggaattyggtggagtttataygaattagaatagagygaggtttttggygtattagggattttaggaggtagtttygttagagaygygggtygtgtttygggaaatyggggggyggggggaggggaagagygtagaaaagaaaatttattaaggyggggattggtttgagyggggaggggyggygaggtyggagtttttttttgttgggyggattttttatggttagaggttgagttttattttygtyggtygttttttaggggaaggggaaggagaggggagagtagygataggtttttagtaagtaagygygggyggtattygtagtttttagaagtttgagatttggtygtaagyggattygtgygttttaattttttgtygygttagygtttggagyggagagtagaggyggttyggtygyggygygtyggttttgttatgatggttagttatttygagttygaggaygyggygggggttttgttggttttagagatyggtygtatagttaaggagttagaagggtygtygtygagtttaggtaagggyggtgggggtggyggygggatagtttyggagaagtyggattyggygtagaagttttygtattygtaygtggygtttatygttatggygattygygagagygyggagaagaggtttaygttgttyggtatttattagtatattatygygaagttttygttttaygagaagaataagaagggttggtaaaatagtattygttataattttagttttaaygagtgttttattaaggtgtygygygagggyggyggygagygtaagggtaattattggaygttggattyggtttgygaagatatgttygagaagggtaattatyggygtygtygtygtatgaagaggttttttyggtygtygttygygtatttttagttyggtaaggggtttttyggggtyggaggygtygtaggygggtgyggygtggygggygtyggggtygayggttayggttatttggygttttttaagtatttgtagtttggtttttttaataattygtggtygttatygtagttttttttatttatgttttatgttttttgttagatggyggtagtygtagyggttgtagtagttgyggttgtagtygygggtttyggtagttttggygyggtygttgtggttaaggggttggygggttyggtygtttygtaygggtygtatataygygtgtagagtatggygttgtttttyggygtagtgaattygtataatggtttgggaggttygtyggtygtattttygttttygtygtatttttattygtattygtaygtatattatttgtaygyggtygtygtatygtygtttgttttatygtattayggggtygtygygtygtygtygggttagtttagttttgttagtttagttatygtygygttttyggygttygygtttattagtgygtygggtttgtagttygtttgtgttyggtagttygagttygttatgatgtattgtttttattgggattaygatagtaagatyggygygttgtattygygtttygatttttgagagtttatygtatgtyggtgtagayggatgygaggatgtagggaygygygaygtyggtttyggtygtagtygaygaygtygtygttagtttgattttatattttttgggttygtttttggagttagygtttagggtttttttgtgttttttygtttttttaagtttttgtygtttttttttgtttttttagtttatgtttttttgtgtttatttttttgatttttgtgattttgtatttttttggtttgaagttgtttttttgygygttttttattgggttygttttttttyggagttttagygttttttgtttaaatttatygyggaaagggttyggggyggaggtgygatygggygtyggtagygtagattttttggtttttttttataggtyggtgygttygtttttygygtttttygttygattgtygtgtagtttatggttagaygygtyggataggattgatggygggatygygttgttygagaaagggayggattaataygtgtgtttgtttygygaatttttttgaagttgtttagaagtygtttgtygyggggtttattaggyggggygggggttgggatttagygggagtyggggtagtttggttttayggtttgtattyggtttatatygygggygggygyggagggaggttgygtttttttygttattagtttygtygtttygggtattttygggtttyggygg

SEQ ID NO: 6787 - DNA, 1686 bp, Artificial Sequence
  Description of Artificial Sequence: Synthetic polynucleotide
ygaygtttttaggtagttgttaaagttyggggttygtyggtttttaggttygtttgatagagttaggygttygtttggatttagttttttttygggygggaggygyggggaggttaagttttttaaaggaatagggtgggtaggggagtggtgttaggttaggtttttyggttttyggtagttagagyggagtaggaaaggtagyggggagttttatatttygygtttttttyggatttygtygtttattyggagggtataygtttttyggggagttagagaygttttgggggagtttgaggagtgttagyggggttttttttggagtttataagtttttattttattttygagttgggagataagttatagttyggttttttttttgaaagtatygtygttgattttttttttaggtaggagtagatatttgtttgtttttayggygygttagygttttgttttagtygtttttgggttagagttygaaatttatttattgygtttttatttyggtatagatagtttttaaagttgttygtattttttagatttygttttttgtttagttttyggatttygtttaggggttgagttgaygttygygggtggatttttttggttygttgygtagggaattgatttygggaatttagggygtatagaggttaaagaagttgyggtaagggagggtgggtaaatttagtttgagtttaggtttttgtygtttttatttttaagtttgttttgttttttttttgggagaagagtaaatttttttagtatttatttttagtygygaggaggyggygttgtyggttgttttygttatygtygttgtygttttttaygtttagygttagtaggagyggtatttagtatagtygtttaggtagtattttygtagtagtygttaaygagttgtagtygtygtttattgttygygtyggttttygtttttyggtgtttgtygtatygtgggtygtttygtygtgttygatgggtgygtttttagygttgtygtygyggygttyggtttygggttttygtygttgygtygttagttygtyggtagtagtygygtttattggygyggattyggagyggtttaggygtttatttygggayggttygtgaygttayggagggagggaggtggttygtgtatatttatgaaygygggtatyggygtygggtttygygtttttygttttaaggtttygatttttaattttttttagtygtttttaygtttyggggttttgtttaggtttttttgtttagtygggatygggtttttagaggattttggtgggyggtttyggagagttttttagtttygygtttttatttygattttyggaaaagttgtygtaagggatggagggtttttttagaaagtggttattygaggtttgagggttatttggggtggygygagggattttgatttgttatgttttttgaattgatatttgggyggagaggattgaygggygtygttaagggttttgtttttggttgggtttttgggygttttgygtygattggtttggggagggygttaggygtatattagagtagygtttagtggtgttaggggttgtygggtagagtagatagttttggatttggatggtaatggtagggtttygygttattttygagaagtaggggtagtygygg

SEQ ID NO: 6788 - DNA, 1686 bp, Artificial Sequence; identical to SEQ ID NO: 6787
  Description of Artificial Sequence: Synthetic polynucleotide

SEQ ID NO: 6789 - DNA, 2132 bp, Artificial Sequence
  Description of Artificial Sequence: Synthetic polynucleotide
yggttygaagagttggtgagygygattatagggtagtttgyggayggttttttyggataggataagggygagggaaayggtagaatggtgaygtatttgagtgygtttattagaygaaagaagattaattaagttttygtgtagtgygtagataggtygatatatatatatatatatatatatatatattaatatataygtaaagatagtgagggagygagaggygtatttttaggtagttgataatgatayggtttygattyggaygygggtttaaagtttttygattttyggagtgttttttttttyggygattttyggagattatygttggygtattttttygttttgttyggtttyggygttttttttttttttygtagtygtagtttttygtttttygygaaygyggttttttagtgttttttagaaygttygygtggttgtygggtttygaattttagggtygattttagtattyggygygygygtygtygygtygtygattagtttgyggttttygtattaattattaayggggyggttygggttgyggyggttygaggagggggatggtayggaattygagataggggataattttatttttygaagyggtygygaaattttagtttgggaggttttygttttttttyggtgygttygttttttttttygygtttyggttygtatatttttatttttygtttygggggyggyggyggyggaggtattygtatygygygatgtttagttatygttgtygygttgtygtygtagttagtygygtygtygtygttgtygtagygygggyggtygygygtyggtagtaggggtttggygaggaagtygttgagtttygygygtttygygtttttggyggtygtagygttgtttattaattgatttttttattgatttatttaatttttaggagyggttgttyggaggtaygggtttttttttaaatttgtagygaygttttyggygtgggtataaaggtttygayggyggtyggygggggttgtttagygttygggagtyggygttagaggtygtttgygygygttttagtygagtttygggtattatgtygyggygtttgtagtttyggggygygggtataaaaggtttttyggtttyggtttyggtagtttygggggtygttyggaatttttattttgtygtttttygggattttttagygtttgttaagtygttgttgygttgggaygaggtgttygaygatttygtggagtgttttattttgtygggttatyggygtttgtygtgtayggtttaggagtgtttagtttyggtgttgaagtttattaaygagaygtttaatttttggaygtattttatttygttgttgttgtttttgagtaagttttgtygtttgttttttttgagyggyggygaygtgtttttttattattygtggttgttatygttgtggtgttaygygtygggagtgttgttgattttygttatgagttgtayggygtaygtgtttagttgtttgtygttgygtttgygygtygtttttttttatttggattaygygtttattagttattayggtttyggtagtayggtggtttattattattatttgttgttaggttttagtttgttggatgttagagttatgattttatatttgtagtagygtttgggttggtaygtggattgtaygygttttatygtygtttatygygttttggtgttgtttgtggttttygtgttggyggtggtttgtattgtggtttgttgtaagagtygtatygattggtgtatttattygttygygttgygtattttygttttygttatgtygtttagtatggtttgttttattatgttygagagttggtttttygatttgygtggggagaattttatatttttygtgtatttttatygtygttatttttggttggtggtggtygttttttttaaygtgagtaagattttygagygtatttagtygggttttttygatattatyggttatagttattagtttttttatatttttattttttttagtatttaygattaggtgtattaygtagaagagggtttgygttagtttttttaggygtygtttgtygtatttattttttygg

SEQ ID NO: 6790 - DNA, 2954 bp, Artificial Sequence
  Description of Artificial Sequence: Synthetic polynucleotide
ygtttagagygtggtagtttgyggggtygtttaygtttttttttttggygttaagtttgtggttygyggtttttaagaagggtatgyggtgagttygygggtttyggttgygtattatttgtaggtttttayggatgaggtygtggygygagyggattygtgaattygttatygygyggggattaygtattaagtggatgattttgaggtttagggtygggtttygtagtagtggygttaagatygttaygtygaagaygygtatattttttatgattagtgtgyggtatttgyggtattttttttygaaaygygttaggygttgtggygggtattttttgtataygyggtygtttattaattttaygatttttttgyggtaggyggggtagagtggtgaygagtatattattttgttggtggttgygtygaagatgtttagygtggtgaggttgygtttttygttgttygyggggttatataattggaagatagagaggtygtagyggtaaagagygtttagtatgtttygygttgttttttgtagggaaayggygtttttyggatatagtttttgttatatatgttatattggttygtagagaaagaatatttygggattttggttgaatagttygtygaagaaygaygagttagagygttaygtggtgaataygtatattagttgtygtttgttttygaygttttyggtgtttygagtgttattgtttggaggggtygtaattttygttatttttgtygyggttgtaggagtygtttygayggyggtagygggagggyggtaaggagtgyggaggtttaaaygggtatgagtayggggyggttyggtyggaggyggttttgggygtttttagttgttttyggttgttttygttgyggtatttagyggtttatyggggttgtattgttgtagyggttttttgtgttatttgtagtttaggaggttgagtatagtgagtattagtagtagtgtatagttygygtataatattagygtttttttayggaatatttttatttygagaggggaygygggttagyggygttttgggygtyggggttattgygggagtagggtaygyggygyggttgtaggygtagtttggagtagtygagggagygygttygggggtagagttygttgygggttgyggtttattataggtataattygggtyggyggygyggyggaggtagttttgtagttygggaaggggaygtagygggttggttgttggygtygggattygggtygygatttygaggygggygyggyggttggtttttagygtttaaggttggtttttttatggtagyggtttygggtaggatttgygaggggaagyggagtgagyggatgygttttaattttttttttagttttttttttttaagtaaygtttattttyggttttgttyggttttttygtttatttggagtygagggygygttygggagyggtttyggattatygttyggyggattgttyggttgttattygtttttygatttygttttttttygttttygttgggggttttygtattttygaggggtttggggagtyggtygatttatttttgggtagttttygggtagygggygttttgyggttygggaagaaaaatttttaygyggtttagagtttygtttygygtttygtygaattyggygtttttyggttttagygaygtttttttygttttttygggatygtagttttttgtttygtttaggggaaygaagtyggttgggggygatggttgggggyggtttatatgggatttagttttyggtatagyggygtagtttttttygttttyggttttygtgyggygaatttttttatttttttggtagyggtggatggggtatagygygatttygtagyggyggyggyggttgtttttattatygggaggatgttygggyggatagygtaggtaattttygtygtttygtagttttygattggattaaaggatttygaatatatagttttaggtaaggaaatttaggtgtgtagtattgttygattygatttaattygttttyggtattagygtttttggttaaygaggtatttaagtaaagaaagatttygtygtagtygtygtygtygygygaaagyggygtttaggaggatgttgttattygattttttttaygtygggygttygtaaygygttyggattagtttttgygyggtttttgttagtyggygttyggttggtgygygtygtygtttgtygtygyggtttttttttttygtygygtagtttttttttttygtyggtttygttttygtttttaaygtygagtyggtttttatygtygttgygtttygggggttggagaygygattygttttatygygaygygygggggttgtagtttaygggttygaaggtttagttttgygygtaaagygtygggatgygaaygygggatttggagttygtyggtgtygagagttgttagagagttggattttgygtgtagttgtyggattyggttttatgtttttgtttttagaaagagttggtgatgaagtttgggtagaaattttttgtyggtygttygttttaygtttttttyggggtygatattgttaattttttygggtattgaggatatttttgygttttggagyggtgggaggaygyggagygtygttttttggttttygatattttgttygttttttttagtgggtttgtggttgygttttttygaaggaagtaataaatttttttgattttgggggttagaggagaygttttagtttttyggaggggtgtgygggygggatygttttttygttttattggatttttggtyggggttgtttttgttttattgtgttttatatgyggagtttygatgtttttygtattttygttygyggtgttgygtttattgtgattgaygt

SEQ ID NO: 6791 - DNA, 2954 bp, Artificial Sequence; identical to SEQ ID NO: 6790
  Description of Artificial Sequence: Synthetic polynucleotide

SEQ ID NO: 6792 - DNA, 885 bp, Artificial Sequence
  Description of Artificial Sequence: Synthetic polynucleotide
ygttygtygtttttttgaggttayggygtaggagagaaggagggygyggaaaygtyggtatyggttgggaagtttyggtgtttygggttttttttggygagggyggagaagtyggyggtttttgtttagaattttgtgattgtagggatygagatattaagggygggggtgtagaggattataagttttttagygygttttatttgtatataaatgtgttttgttttttaattttgtttttgttatttgtgtatttgttttttattaaattaattaattattygtggtttaggaagaaattagaattggggggattgtttttttaagggggatatagttgaaygtggtyggtagtttttggtttttygggtttgggtttagayggatttyggygttgtttttaagatygatatygggtatttggtygtyggygtatttaggagtaygattttatgygtgtgtaygttttttgttygggttaggagttttgttttagttttatttygggttataaatttttggtttygtttagygtagtttyggttyggagggtagtttgttagttaggttttgggttagggatggtttayggtgygygyggggatygttatattttttagygttaygttggggtygygygggtyggagtagggggagggggttygatgaygttatggaatagttggaggatttagttygggaattygtyggggagygggtttyggggtyggygttttatttaggtygatagygtttygggttyggttttatttttttagayggtayggttgttttttaygtttagagygggtttggggttttgaaggaaattagtgtaygatygygaggttaggaattttggagaatgggtaygtaggygtgygt

SEQ ID NO: 6793 - DNA, 2174 bp, Artificial Sequence
  Description of Artificial Sequence: Synthetic polynucleotide
ygygttgtgttttttagygttttaggggttyggtttttagttyggttttatttgggygttttttygttttttygtgggtyggygggtygtgygggaggaattttggttgtygygggttttgygttttatttgttatttyggtggttttygttygggtttygagttttttgyggagttagtattttagttgagttagtyggaggggyggyggyggtttygygygtttagagttttagtttatgaatgggattttattttgagygttttttttygggtttggggaggyggyggygyggyggyggggggygtttygtaagttygyggttttgagyggttattygygtagtaagttgggygagttggtagtygtttgtatttgttttttggtttyggtttttgatttygttttyggttttaagygttygggttgygttttyggttgtttygygaggtagttttaggaggtttaggggtttygtttgygtttttggygttagattatggtgggtagtttyggttaggagttttagtygtygygagttaatatygtttgtagttagttttygttttattygagyggaygygygggtattygtagygygygggttattttttttttyggtygggatgggyggygygggattgagtgatyggttttgygttyggygggtaatttttatttgatttgttgtttgtgagttgttgattgtyggggygygygagtttagggggtaygggtagtagygyggygatgatttgatttygagttygttagggygtttttttttttttttttttttttygttttttttgagtttgtgyggagattagttyggtgyggyggtttygggtggattatggyggggagttttagttaaaggygtgtgggygtygagttggagaggatattttyggtatygttgttttttgagggggtttatttaaattattgagttattttagatttaggattttttaaataattattaattgtgttygtttygtgtyggaaagtaagyggaaagagaaagagygtttatttttgggatttygtagatygtttttygttggttttttttygaggggtgtttggttttygaggatttttttttttttttygygtttttttttttttttygttttttgttttttttgtagtgttgttggtygggagttgtttttatygtagttggaaatagttgttttygtttygygtttttatttagatttygggtaatygtttttatttygygtttttyggaattttagaattygggtggtyggtttttggaaagtygtagtyggygygatgtattttgtagattttattttgttgggayggattttttaatttttagaatygygggtygtagggagttaaattgttgtttttttttttttttttygtgyggttggtggtttgttttttaaaggaaygttttatttattttttagtattttttatygggggygygttattygtttgggtttagattttgttttgtaaaygggttttttatgtatgtatgtgtaggtatattttggatattttataaygtttgygtttttttaatagaggtaygttttgttattttgggtatygtttttttttttttatttggtatttygaaygtagtgtgattaaattttttattgttttttggaygtygatygttttggggtgtaagtttggggtgtaaaygtttatttygtaagagggtttgggatygtttygtttygtttttyggtygttagaggttggggaagtttatatttggatttttatatattttgtygttattgtttagattttgattaattttgtgagygtygggttttygatattgtagtttttttaaattttagtattgttttttygygattgttttttttttggtygtttaggttttgttttygtttyggyggagygtaagtyggagggygtagtagaggttggggtttgaggttttygttgagtagttatggttgyggygatagttagttttttgattyggtagaagyggtaggygagggagtttaatagygatygagtgtyggtttttaagygtygttttagttttagtaaagaygggygttttttgtgygagaggtaygttttyggggtgtttagtaaagtgygtttttgtagyggtygtaagaggtyggtgaggygg

SEQ ID NO: 6794 - DNA, 873 bp, Artificial Sequence
  Description of Artificial Sequence: Synthetic polynucleotide
yggtygggtttagygatgyggttgagttgtttattygygtttgttgaatyggttaattagyggygttttyggatttagygggagygtttttatgtygatygyggtaggygtgygtttttyggggtygtatygttatggygatttgtttatttgattygtttygggtggattygtygygatttttgggygtttaggtttttgagggtttaaygggygayggttttttagttttagttgtgygttttygttygggygaggtggggttgatygyggtygtttgtataygttttttttggttygygttttyggtttgggagggyggattygtttattttaygatggtttyggttttggaagggattgttttygtgattygtttttttaatagtygttaataattttttttaaygttttttgygyggttygtttttgagaattttggttygggagagygaygyggggttttyggggttgygtaggttgyggygttttgtttaygttggttygagggygyggttygtttygggtyggtttatatatttaygttttttgtygggaggyggttgggaygyggyggggttgttttaagtgtagtygyggtagtgttgygtttttatygygggggtttttgygggtygygtttgtttygttyggttttyggtgtatgtggtttgygaggyggtagaggagatgtggggatttagggtygtaygtygtgttygaggtttttaygagaggttttttttygygggtttttgygtaattgygtgaagtyggttygggaaagttaagattgtggtttaggaagaggaaggaaygygggygatagagttggggtttgggaygttgagggggtyggtggtagtttttygg

SEQ ID NO: 6795 - DNA, 2174 bp, Artificial Sequence; identical to SEQ ID NO: 6793
  Description of Artificial Sequence: Synthetic polynucleotide

SEQ ID NO: 6796 - DNA, 510 bp, Artificial Sequence
  Description of Artificial Sequence: Synthetic polynucleotide
ygygtagtyggagaggagggggyggtattygggatttggygyggtttttgttttttgygttagygtgagttyggttagggtttttayggtygtgtttttattttttagggaggygtyggtgattyggttatagttttagttttygtygttttgtgatttgygggtattggatgattygtagttgagatttygttatatttttgaagtggggaaatggtgagtgtgggggtagggygttttaaggttggggaggttttattygaatyggygggaaatggyggyggygggayggagtttgygaayggagttttygttgtygtygtttagtttttagtttttggtttttttyggtgagggattygggtttatgtyggttttygtaaggyggttttggtttagtttgtagttttatttgtgtagttttgygttygtagtttygtattttttttgggttgtggggtgaggaggagtttatygggaaaaygtttgygtggygtgygaggtgttygt

SEQ ID NO: 6797 - DNA, 511 bp, Artificial Sequence
  Description of Artificial Sequence: Synthetic polynucleotide
ygttttgattyggtttgggygtaagtaaatttaggtttggtygtygggygtttgggtygygttaattygtttttttttttttaygttygttyggtattttttggttygttaagttttagatgygggtgtttgttttagaaaattttyggyggyggttygtattgagtatgttyggyggyggggygggtttggggttyggaagttttagygattyggyggtattygtygttttgaggtagygggtttygataggygatggatttttygggttttygggggygttttaygtgggtgttggtygggggttttttggtagtggttttggygttggggggtygaggttgtttyggygttagtttaygttttygttggygttttttyggygygtagttatttygggatttttaggtggtttttaggtttgggttyggtttgaggattttttyggggyggagyggggyggggttygagagtagtaygtaggtaaggagggttygattttaggtttygg

SEQ ID NO: 6798 - DNA, 417 bp, Artificial Sequence
  Description of Artificial Sequence: Synthetic polynucleotide
ygtygttattttttttttggagtagaaggggaattygaygtttaagyggttgygtgygaagtttttaattaggtttaaggagtygtagagtyggggtttygggttygtaggatttagaagttaygygtttygygtttttygtttygtygttgtttgttyggtygatttatttggtgtygygtgygttggyggttygygyggtagttaagttaaaggtygaggtygaggtygagygyggygtttagtagtayggygggggttagtagggygggygtyggtygtagygygtttygttttagtagtagtygygygtygtttttgtaggtygtttygtygygggttattyggggygtttaggttgtygtttygtygtatttygtygtttgttgtatygttttygttagggyggygaygygg

SEQ ID NO: 6799 - DNA, 1748 bp, Artificial Sequence
  Description of Artificial Sequence: Synthetic polynucleotide
ygygggtyggggagttgtattttttgtaggttyggttttyggtttygttttttagygtyggagttygggagtygyggttgtagtttatttttttaaatgatagttgaggttygggttttagttyggggtttgaygttagtgttttttttygtgttgttaggagtagttagygttatygtyggygtttyggtttygyggtaygtttgtaagttgtyggggyggygagttttttttgtttyggttttttttttygttttttttayggagagtygagtagtagttttagagtttttygtaagttttttttatattttttygttttygttttaaaggagtagtagtttttttttgtttttttattgtygtygtygtatyggyggagtttttttttygygygtttttttttygatggagttygggygtygtygaygtygtygttgtttygaattttgagyggggtygtttyggtyggaggaaygygtygtttagttygagggygtagagygttaggagtaygyggagggttggggygygggtttygggaaygagaaagtgtagttttttygggttattgggtyggyggyggggggattatggttttgaaggataygggtagyggyggtagtattattttgtttattagygagatggttttttygtttagttygttyggygygtyggtygtygtygtttyggggttttgygtattttygtttttttttgaagtagtggagttgaaygtaggyggttaggtttatgtgattaagtattygaygttgtttagygtttyggatagtattttggttagtatgttttygttttttagttttygtggyggygttyggygtyggggygagttgtttagggatagtygggygygtttttttatygatygggayggttttttttttaggtaygtgttggattatttgygggataagtaattygygttgtyggagtattttttygagaaggagyggttgttgygygaggtygagtatttttagtttatygatttggttaagttgttgtygtttaaggttattaagtagaatttttttaaygaygagggttgttagagygatttggaggataaygtttygtagggtagtagygaygygttgttgttgygyggggyggyggtygtygtgttttygggttygggagygtayggtggtggyggyggyggyggygygtaggataagygttygggtttttttaygttgggttatyggggtttttatattatygtgygygataattaggtygaygttaaatttyggygtgtggygygtattatggtgtgygggygtatygygttggttaaggaggttttyggggataygtttaaygagagtygygatttygatyggtagtyggagaagtataygtttygtttttattttaagtttatttatttggagtaggtttttgatygtttgttygaggtyggtttttatatggtggygtgtaatttttygggtatygtygttttygttaattagtatygygaygataagatttggagtagttatatygagtatattttttttygtaagttygtagtttyggygttttttagtatttttygttttttgttgagtygtygttagtttgagtttygttggaggtttygygggggtgttyggggtaggygttggttaattttttatagagagyggttttttttgtaygatttttttatgtagtagataygatttatattttatygattyggatattttygt

SEQ ID NO: 6800 - DNA, 1748 bp, Artificial Sequence; identical to SEQ ID NO: 6799
  Description of Artificial Sequence: Synthetic polynucleotide

SEQ ID NO: 6801 - DNA, 648 bp, Artificial Sequence
  Description of Artificial Sequence: Synthetic polynucleotide
yggttgtgtygggagtaaaggttygggttagtgtgygtgygggygygggtgattttatttttagggaagtyggygtttaattatttaggtagtagtttyggttgatttttttttttttttttttttttttttttttttttttttttgygtgttttttttgtatyggttttygtygyggagttaggyggtagtatygaygtygtygtagtttttgttygtatygygttaattygygttttyggtttataygtagtyggagygattgagtyggtagtttygggtttaygttgygtatygtgtgtayggyggggttggttgagttgatttgygttgggtttyggygtygtaggyggttggggagggyggygtgggagaggaygttgagaygtaggggyggtygygtygaggtgataagttgygtatttggaaagttattyggttgtttggtgaggttygtgggtygggggttttgggygtyggggtgtgagggygygyggggagggayggggtyggggtgygygygtgtgtatgttgtgaatgygttgygygatgtgygtttttattttatatttagtyggttttttgtttgtgttgttygagtgtggaygtgtgtaygygttgtattygttyggtgtggtagygtttygt

SEQ ID NO: 6802 - DNA, 863 bp, Artificial Sequence
  Description of Artificial Sequence: Synthetic polynucleotide
ygatttttaaygttgtaatttgtgatygtgattaaattttagygatgygagggtaaagygttttyggyggtgyggtgtgagttatttttyggygttgtttgttttttttagtagttttttaagggataggttttgtttttggtggtygatttttaggttttyggtttttttagggygattttgaygaggggtagggggtggttttygggaggatttagaggaaaggyggggataagaagggaggggaaggggaaagaggaagaggtattatttttagtttaatygttttygatttttataagagtgttygtgattttaaatttaaygtgaggygtaaaagygtttttattttttygttttgygyggttaggtaggyggttggagttgatggtttatttygygttttttgttttatttttattygagatagggaygaggagtaygttgtagggaaagtagygagygtygggagaggggygggtagaagygttgataaattagyggtgggggyggagagttgaggagaaggagaaggaggaggattaggaggaggaggayggygaygattagaaggggtttaagagagggggygagygatygagygtygygaygyggaagtgaggtgygtgygggttgtagygtagatttyggttyggttttttygagagygttttgggygtttttttaygttttgtttttaagttttttgtttttttattttygtgagyggagaattgggagtggttattygaygataggttagygggtttgttttttatttttttagtttygygtygtyggtttatagyggttttttttggggatagtttttttygggtgtygttttygttttttttgtgygt

SEQ ID NO: 6803 - DNA, 1288 bp, Artificial Sequence
  Description of Artificial Sequence: Synthetic polynucleotide
ygttttttgygtagtygatttygtttyggtttyggtttaggttagagaggtggttttyggagatgttgaagttatttygygtagggggaggggtygttaggtttttttttaattayggtggtygttttagttatttgtatatattatgttaataatagattttttgtttygtttttatttaagtttttygttttttttgggggtttttygggtyggttygygggttgggttaaggtgaatatattatgataataaggygggtttttgttttgttttyggaaggggggygygtagtagygggagyggtaggtyggaygtygggygtygggagggggtygggggagggaygtygtgttyggagygygygygtatttatatatttatatatatatttaygygagtatygygaagggtatttaaggatygygtaygyggggttgyggagatttttygggtagtygygatttyggtttygygagtagtattggttttttgggtttatttygttttttttttttttttttattttagtygtttttttygygttgygttgtagygtgtttttatagtttttttgttttgaattgaatgtaggtgggaaataggtyggygtgtygaaagatatygagtaggtagaaataaggtaaatttatagaggygtaataggttyggtttttygtggttagggygagtygyggtttygygtggygtttyggtygttgttttyggattttgagyggttattgttggggttttygaaagaggtgtyggttttttgggagtyggaagagttgtttgggtgggtttygttttgttttttattttatygttatttagttttyggayggagggtgttttttatttttagttgggaggagagaagaaagyggggatggtgtaygtttgygggtttggaygttgagtaaggtaggggttygtattygttygtgggtttgattttattaattagttgtgtagttatagggattgaattttggaggaatygatttttttttttttttttaggattatttgaggtgtagagggtgggaagygaagtygagayggtygatttygttaygatgttgttgaagaagtaygtagggaaaggagggggtygggagtttagattygaggattygatttttgtygaatagtattgtgttyggattatgttttygtgtgtygttttggyggtttttttgttagtggtggtygtggtgttttgtttgtatttgggtgtgaaaattaaygatttttaggygaggatygtygttttygaattygt

SEQ ID NO: 6804 - DNA, 1275 bp, Artificial Sequence
  Description of Artificial Sequence: Synthetic polynucleotide
ygtttatttygttttgtttgttygtttttattgtttttaagttygtttygttygyggtaagtgygtgtttaggygtagttatyggygagattaggagygtagygttygtagtttgagggaatyggygtagggtagtagyggttgtagttggattygygygttttagygtttagtggyggyggtygggatattttgggtagtatttygtatygtagtattttagattaygagtaatygtgttygttttygtyggggttggagggygtagggtygttattttgtaagttygtgggttttyggttatttttatgagagaaggygaagtygggygaaggagtaggaygttyggtagtaggattttttygtaagtttygygggttttttgttttygygtttttygggygtttaagaagtaaaatgtaattatygygttatagttgagaggggaaggggttagygttattygttygttyggaattyggttttygyggyggttgygygtttyggtygyggttttttyggttygggagtgagtagtagtaggaggagaggtagyggttyggggttggtyggggttggggaggagggaygggayggagggagggygygggggyggggagggggtttyggyggataaagatggtaatgttttttatttaagygtgttgtagtttggtttttttaatatggttgttttttttttgtttygtgtatttgttttgtttggattttatygtggtygagaaggaggaatggtatatygttttygtgaatattatttaygtygagttygygtyggatttyggggtyggggyggygggyggyggyggygyggagttgtatayggagaagayggagtgygggygttayggagagtattygtttaagtaggaygttygyggggaggtggttatggttagttyggtttaygatygtttggtttgygattttaatattaagttygtygtttygattygyggtaagaattggatagtttttatttttaagggtaattgtaygtatagggataagattyggaaygygtttttgtagaaygttttagtygtggttatttttaaygtgggttttaatattaaygagattattattatgttttaygygggtgagtggtttagygggygygggggaggggagtyggyggggayggaggtgtttagagggatttagygtttgtttttaggttttttttgggaagttygtgyggygyggaagaygtgtttgggttttttggatygattaagttttgtttygygt

SEQ ID NO: 6805 - DNA, 1071 bp, Artificial Sequence
  Description of Artificial Sequence: Synthetic polynucleotide
yggygttgagttttgtttagygygattyggatygayggaygygtagagattttgtygggattygttttttagtyggygttyggggagtygtyggtyggttttatttttygttygggagtygggtagggygagaaggtagygygagtggyggtggygattttygtyggggtttttgygaygagyggtgattagtagygttygtagtygyggtttygttttttattyggaygtggttaagyggyggyggttaygaygttyggtttttygggatygttyggttgygttttgggygtatttgygygtttggtttygygtttygyggagagggygatgggtttyggttaggattgagtttttttttttttttttttagtttygtttggtatttttttttttgtttygagggygagttayggtttgygtygtygttttttttttyggtgttttyggttygtygttttttygygtttttttttttyggattygttttyggggttattatggtygyggttatygttagyggtttgattygttagaagyggtaggygygggagtagtattgggatyggtygtttgttagtaggaggyggagtagttttagtaagaatygygggttttgtaayggtaatttggtggatattttttttaaagtgygtattttyggttttaagaagygtaggttgyggygttaaggtttgtgggggttatggtygggagatgygtttygggtygtttttttttygtttaaayggagtttttttaggttttttttttttttyggttttttyggtttatttyggtttyggttttttttttgagtattttgggtgtygtygyggggattttggagttygttgtygggtaatttgtagtygtygagaagtgtagtygttagagatggtaagttggttgtttttygtyggyggtttttgtttttygygtttttgtaggttgggttttgggaaatttgttttttttgagtttyggtttttygggaggatagggattggtattggttttggaaygyggggtatttttttttgttatattyggggtygagttatygttygt

SEQ ID NO: 6806 - DNA, 694 bp, Artificial Sequence
  Description of Artificial Sequence: Synthetic polynucleotide
ygttagggttgtyggatagttygatgattaggagttttyggttttygaagttgygttttatygtgtaaattttgttgatggyggtgtattgtagttatayggataygagygtttygygtagttyggggtagyggtggtattygaaggagatgtygtttttttgttgtagtygtyggygtygttttatgttygtygygggygtttygggtttttgggtttyggygtttaggagttattygtaggtagttagtgtttygtatagagttagtagygygttgttttttygttyggttatygttgygtttygtygtygtyggtygtgtttttttaygygggyggttttttttgtttgttyggttttgggtttagttygtyggygttgttgggggyggtaagtttygtattagtttttattygttttatttttttyggttgaatgagtgttagttygygtattggggttatttagaggagaygggtaaagtygyggttttaygggttgtattattggtygyggagtttaggggagttgtaggagaaattattgygaggagggggtyggyggagagaygggtyggygtggatttgggagggttgttggygttatttgttggttyggaattaygttaatagttaaatggygttygggaygaygtaggtgaaatgatagttaaggttyggggttygggaaygt

SEQ ID NO: 6807 - DNA, 694 bp, Artificial Sequence; identical to SEQ ID NO: 6806
  Description of Artificial Sequence: Synthetic polynucleotide

SEQ ID NO: 6808 - DNA, 1424 bp, Artificial Sequence
  Description of Artificial Sequence: Synthetic polynucleotide
ygagagttygaggygtygtttttgtygtttygggattggygtgaggagtttttgaygatatatattaattygagyggttttaaagatgtagttgtatatggagattttgttgggaaaattygtttgttttttttaygtygtttagtttaggagaattatygtygttatttyggagttttttyggttatygygtagagtttttygagagttygagtygyggttttygagttttaaggtttatttagggttttagatttttgtttygaaaggagaggatttgagaaaatggatgtattgagatttttttgaaaatttttygagagagygygagaggagygaggataygttattygtagttaaaattatatttaaggattaaaataataataattaaaaattttattaaaataataagygtttaagaatttagatygggttggtggggggaggggaagaggygggaaggggagggtygtayggaggtagttttgtagtgagtagtygatttygtygtttttyggtatagttggatyggtttttttagtygyggtttagattygtttttggatttygggttagtttyggtgttaggatygyggttygggtttggattttygagatttygygtattagtttygygggagtttyggtatttttgtatgagtaygagaggattttgttttygygtagtagttygggaagtaggagtygaagygygggtygtggagtaaggygggaatyggaggyggyggyggyggyggttaggggygtayggtgttaggattagttygtygygttttatggggagtyggyggtygtagygttgttgaggygggttyggttggttaggyggggggayggggttygggttgtagtagttttttttgyggttgtygggygggttygggygttygggggttggggggtggggggtgggggaggaygtygagygttgaggtaggggttygggtygagggygyggyggggttgygygtaygttggggygygtggaggggygyggagggygaaatgagtttggtaggtggttttttttattattyggtggtgtattaygagggttattygtttgtygtygtygtygtygtagttgtygtygtygtygttagtygttgtagttatgaggagaatttttatttttatggttggtttatyggttatttygagatgtygtttttygattatagtatggttttgttttatagtttygagtatgttagyggygtygtyggtttggattatttttattaygggggggtgtygtygggygtygggttttygggtttgggggggtygygttyggtgaagygtygaggtatygttaatygtaaggagyggygtaggatttagagtattaatagygttttygtygaattgygygagtgtatttttaaygtattygtyga

SEQ ID NO: 6809 - DNA, 1215 bp, Artificial Sequence
  Description of Artificial Sequence: Synthetic polynucleotide
ygtgygggagggaggataagaattygggagtggtygaggataaagygggggttttttttattttayggtgtttagttttttttygttgtaygtggtttagggtggtygtattatttttaaagtyggtttygttaatygttagtttygggattgaatttgttttttyggtygttygtttttygtaggggataggggyggggagggagagatttagaggggggtygggggaggtggggtygtyggggaggaggygagggaaayggggagttttagggagayggttttygagggagagtgagaggggagggtagttygggttyggtaygttttttttttyggtygtttttttttatataagygtaggtagagggygygttagttatgttttgtttttgygttygtygtygtygtygtygtygtttagttyggygygttttggaggattttgygtygyggygttttygggtttygtygtygttagtygtttygtygtttttttttygttttyggtatygtygttagygttttygtygtagygttygyggttyggttttttttatttyggggaaggggagggaggagggggaygagggttttggygggtttggaggggttgaatatygyggggtgttttggtgtttttygtttygtttttttaaaaagttatatygaygyggatygyggyggygttttttttygttttygttttatttygygggtttygaatgyggggagttyggatgttyggttttttgtgaggtttttatttgatattygtygttttttttyggtattggttgggagggygttttgtaaagttgggaaygyggagtttyggattygttttygtygttttyggttygtttagggggggtygtygggaggagttygggggagagggattaggaggggttygyggtttygtaggggygttygygtttttatttttgttttygttagyggatyggttttttattttyggtttttttattatgtatttgttgggttttttttttgtggygtgttttttgttygtygttgygttgttttygggttttygygaggygttygtygtygtygtygttttygagttyggattygatttttyggaygyggagttygaygygggygaggttayggtaggtttgygttagggtttgyggagaattygagagtttgygttagggtttgyggyggattygagaatttgygygg

SEQ ID NO: 6810 - DNA, 1184 bp, Artificial Sequence
  Description of Artificial Sequence: Synthetic polynucleotide
ygaatgttgttttygtatygatttaaattygygtygagtttttttttatttygatattataagggagaagagyggagtygtygtygtygtygtygttattatygttatygttatygtygtggttttyggagygagygagygattttgtygygyggggagttttatygggagtygygtttygttagttygttttaggtygtygtygtygtygtygtttatttattttgtygyggygygttttygttgtggtygtgaggaatygagtttagygttgttaagttgtttgggtttggagygtatygtgttatagygtttggtttygggttygggttgygygyggyggttagatatgataggttgaggtttttttgtttatattyggtygtygagggggyggtgygtygtttaattttttygygtygggtygttatygtygtttttygttagtttygygtttagygtttyggttyggtygtygttttattttttygttttattttttygtttygttttatataygygggtyggggtttgtgagtagtygtgtttttagygaagaygggggaattgtattgagaattygttttyggtatttttygaagatttygyggggyggtatttttttttttatataygtaygttygygagtygtttygggtagyggtygtgtttttyggyggggtttygtyggyggtttttgatttygttttagagttgtttttyggtagygttattttttygtgtttataaaagtattttttttttaatttatgaayggatttygatttttgttttgttattatttatgygtttygtattygaggtgtygtttttatttataygttttayggtttygygaaattyggttttttagttygygggaygygttgtttgttaggygggttyggyggtatttygggggygggaggggtyggtygtagggtttttagtttggygttygyggggygttygtagygaaggggtgggtgtygttygtgaaygtagtagggattagtttagttygygttygtttttgggtttyggttatygttttttygttattttttyggtttttgygtggatyggttygtggygggggttgttttgygttttygttttygtagtagtygyggatttttattaaygttgaygagttagtgtygygattyggggagagaagaygg

SEQ ID NO: 6811 - DNA, 5820 bp, Artificial Sequence
  Description of Artificial Sequence: Synthetic polynucleotide
yggagggaaatygggtygaygataagggtggttattttygggtttttygygttyggtttaagygtttttgggtggggtagtttaaayggggagaggggtttygtgggtygagggttygaggtygtagygagtttagygtttggttaaatttggttygygygtttttttattgttttgttagggttgtgtgatttttyggagttttaygttttygtttaaatagtttttagygtttttgttggtattyggggygtttttattttagtttttgtattyggygygtygygygtagatyggayggaggggaaagttggtaagagygyggygttygygggagaaagygttaatgggyggtygggtgggagtagygygttygttygtttaygttaygtyggtgygggttyggttgaygatygyggygtttggggaygtyggygygtttygttygttaggtgtttygtttggaaatgtttttattagttgtygtyggtttttygttggagygygygygtygagttttygygyggagttttygygggttgtygggagyggtttagygttatygtaggtaggtgaggtttttygttttygttttygtttyggggtttygagattttttttttttttygaggaggyggaggtttygygyggtygtygaggggagygggyggyggyggttgyggygatttttyggtgygtttygggttgygagttgtttttygyggtttyggtagttatayggygygggygggagtttttttagtttaggtagggagtgggtttygtygtataaattttgygaggattgtttttgygtttaaggggataaagtttgttattygtygttaggttttttagaggtygttgygtttgttgtaagttgygggaagtagggtgygygggtyggygyggggyggggggtggggggttyggagtggttaggtttgagttttggaygttyggayggygtttygtttagttttaggtygtatttagggagtaagyggygggggygtagygggagagaggagggagagggtygygggtttttatggagggyggttgggaatttagagatttatygtttgtttttgtggtttttttttttattattggtttygagggggtttyggggttgtgaggaaatgatttgttaatttygaggttygttagtgyggygttagygatygtgaggttttttaaatttatattttagtygggtgtttygagyggtgggygggtataggygtttttaaggtttttggttttaggttttagaaagaaaggtttttgtttggtgtttygggttttyggtttygtttttggttggagttaatttttttgggttggaaggagtttttttyggaygagtttttggtgyggggaattggtggtttttagggtaatttttgaagtattagggttaggttggtygaagaagggttagggttyggtttgttttttyggaggttttttatggtttygayggttaayggtaatttygttaaaataggygattygtttgygtttygygttaggggttgattattttttgttttttttgyggtttgtttyggttttggtttttygtttttyggagygttttaggttagygggagtattttattttttygaagttgagtyggtgttgtgtatttygggagtyggttgatttttggtttatttgtttaygggtgtatttagtatygggggtttttagagggaggaaggtttagtatttygagtttatgtagaygygtttagttgatatttgagatgttgagygttttatygttggtgaaagggatattgggtgttttygttttaggtttggttttttggtgaaggtatttggaaaatattttagtattatttatgggagaagggtggtttagtgagaattttyggtttgggtaggygggtttaggttaggttatagggttttagtgagatgtttyggtggtygttaatttataggttggattgattttgtgttttggaatgagtagtggggtttgggtgaggtygggygggttaggaggttttttgggtagttgygagtttttygaggtagggtgattgtgattgggttyggattttaggygttggggtttgttggygggtaggaagtggagygtgtgtgtgyggyggtttgggaaagtygatttagaggttaggtttttgggttayggagaaagggtygttygttggtggggattggagygtygatttatgtatataggttggaaaggtaaaagagaataggagaaggtggyggtggtggttaaaggaagttttygaaagggtttttaygtattggttgttttgggaagtggaggttgttttttttagattttgtttagaagatgaatggtygtttgttttggggtttyggttttagttaagtttygtygggtttggaaggaaggaaatgtattagttttaggtttgggtgggttgagttgttgtattagagtttagaggtgtagggtataggtggttgggtttttgggttttggtttttttttttagtyggyggagtgtttatagtygtygaggttaggttttygagtataggtgaggaaaggataagttatagttgaatgttttttttttgggggtttttattttttattttagtttttggttyggttgggtttatattttttttttagtygggttttattatttggagagagygagtagtttgtaaataataaataatgggaagtagaaggatgttygggaaaaattagaaaattgtaaggagtggggaggagggagggtgggagaggggaggaaggagggtgggggaggggaggagtaggaggagagggaaaggggttgagagatttatttttagygagaaatttyggtggttagttttttattatttataggaaggtgatattagygatttaggtgagaaagaaagaaaygyggtttgtygygaaattaatatagaatttagaaataattattaatgttatttgattygtgttttttatatatttttygyggttatygaygttaaattgtttgaataatttgtatggagyggttatttattattttygatggtttttttttgtaagtagttyggaygtggttygtttyggtttaaygygatyggagaattygtatttttatttgtaaattaaagtaattaygtagtagatattatatgatgtgtattgtggtttttagatagttattaattatttttaatygagttgttaaaagagtaggtagatttygtttttgggaggtaggtttgtagttggggagagggygaggaygttattattaattagagggtgattttggggygatttataggtttgaatttaggaatttttttgagtaagtttgtataaygttgttttgtayggttttttttttaatttattaygggaggtyggtttagggggygagggtaatyggggygagtttyggtttyggagggygatggygtagaaggyggggaaygggttygggatggttygggygtttttttgtygtttttttgtygtttgtttattggttttygttttgaatttgggtaaggttttagggagggtattggtygagggagttttggggtgggygttyggttttttttttygattgtttygtgygttttagatagaaagttgggtaaaatggataggggagggygttttygttaggtatttaaygttttttttttygtagttagttttgyggggygtygggagggaygagtttagygggaggggtyggggtttgggttgaggaatttgttttttygagygygtagggtygttyggtagttttyggtttagtygygaggggtagggggaagtyggyggagtayggtyggyggaaaggggatyggggaggaaagtyggggaggygaggtgggggyggtgggttgagygggaatttaaaagatygyggtggagaagatggggygtttttygygatattyggttgtttagaggtgtaaagtyggtgggygtaygttyggggyggttttatagttttygggtygttagttttagggtgtygggttttaattaaggtttygaagtttttaygtatttgagggtattttgattagtttttgygggttgttttgyggtygtagtgggttttgaaagtttatttyggygtagggtggaaatyggygggaggygttgttgattttygattaaataatagtgaygagaygygtgyggggygtttgygagtttttttttgttattyggagtagagygygttagygygaggtygggtyggtygtttgygtagygtygggttaattttaattgttgattatatttttagygtgtttttttataggttttatttgtaattgagaygaatgattatagtggggygggaaggagtagttgtttattaattaatttttaattaaaagtgtttttygttttygggtgattaaagagaaatatygttygttgggygatattgattyggatggaatttatttgttaaygttyggaggaatggttttttygtttatygygyggtygggattgttttggtttttttyggtttgagtygtyggygagtgatyggygagtttgyggttaggtygggttgygygaggtggggttgaygttagagtttttttygttttaagtygygtatatttgatttgaygggttygygygattygtttttttttttttttttttygtaaaatatgtatttttgtygtygttgygaggtygttyggttttagagttttttygagttttyggaatgygaagttaaaggaatygyggyggttatygttgtttattttgttattyggttagaaaagtttgyggagygyggggatggattaatyggtttttttgtttygtttttttagygtttagaagtttgtagtttyggagtagtggtygygttaygtyggttttagygygtagaattttgtaggtttygttygttygtttygggtygygttygttatgttttattygtagtttggatatttttatttttyggttttttaggtaagyggagtttygtttygtttaggttatygtaggtgtyggtagggyggatggggyggggayggggggtggggagtgttygatttaygattgtttgyggttttygagttagtaaggtttgggtygygygttttttaygtttaatttttgttttttaaattttyggggaaaggtygaggygttaagaaaattygaygggtygggttygggttttttgatgtttgaattataaggtttaggttgtgttttaggggagttttaggattttaaggaatttttggggaaggaggtttggygygtaaatggygttagaggttttggaaatttttyggggaagggtgtaggtgttyggttgggttttaygtggyggaggaggttagaygygtataagttagtggaaaggggygagtattttggtgtggayggygggaggttygggggtattyggggtaygttttygtgggyggygygygggattggtaaggtttagggttttagtttttagttyggtttttygttagttttygyggtttttttttgtagtttttgatggttattaattttttgagtaygtgttgygagttyggaggtygtaygttggyggatttygggttygtygtttyggtttaggygtyggtttattgttyggtttaygagagtyggttgttggttatygygygttaygagtttaattyggtygyggygttgggygtttatgggggtttttatggyggatygtagggttatggtaattaygtgatttayggttyggaggygttygttttttattygt

SEQ ID NO: 6812 - DNA, 1233 bp, Artificial Sequence
  Description of Artificial Sequence: Synthetic polynucleotide
ygtyggttgygtagtttagtataggttataggtyggggggtgggttygggttttgyggagtgggygggtttgagygggttggaaygtttygtyggttttatygtaggtyggtattttagttttaggttttatagygggtttttygtttttattttygygggttttgtagggttggggttgtttttgagtttttggtaaggttttygggagttttagttttgyggagattaaagtttttatattttyggtagagttygggygagtgtttygygggtggyggyggttgtggggtygtttgggatttttygtagtattgattttgtaattttttgtgtttgygtttygtggtgaggggyggygggatgygygygatttttttttgatttagttaaayggaaaagttygygygtttyggttggaaggtggaggttaggtaggattyggtaaaggtatattttaaaygaagtagattttattttttatttgtagagggaaggyggtgtggayggatagaaayggtttttatagttatagaattatygyggttatagtagygyggygttyggtagggagyggatygtggtggaggtttttgagtygagtaggttaygtagattygggaggygttgaagygggygtagttgygttttggagtaggtagattaggttayggyggagggagaggttyggggaygyggygtagtttttgyggagaggtaygggggyggyggggaygtttttttattggttgaaatgttagggatyggtttgggygtggagtagtyggggygagttygtttttaggtatygtyggttgttttaggtagggtttgtaggagtggttyggagtygggtatygaggtatygaggyggggatttggaggggtaggggtyggggtagggtttgttaattaagtttaygggggtygtygggtggtggaggtgggatgggggaaggaggttgagtattagtttygggygatttaagattttttyggtttaattttaggagggaggtagygttggygggtgaagtygttattttttttygggaggtygtttagtagttgtttttttaygtttyggggttattgygtygggttttggttattatttgggttttggtttaygtttagaygaggggtagygygattttttygtagttttattttagyggttgtygtygtagagtatgaagaggtttggtttttgtagaaaygtagtttagygyga

SEQ ID NO: 6813 - DNA, 2865 bp, Artificial Sequence
  Description of Artificial Sequence: Synthetic polynucleotide
ygttttttgttttattygggtggatgttygyggttttggggttttttttatgttttgattttggggagtttyggttggtattggttygygaaggtgatttgyggatagattagttagagattaygttggttggtygyggygygggttataaagtttagyggaggtggggtaggggattaagttgtttyggygagggaagaaattgttgtttttaaattattgyggttggaggagtygatttgygttttagygtgttaggataagggyggygygaggggtttaggggttaaatggggygttgggtaggaggggttgttttttgtaggggaggaggaatggttttttgttagggatttggggaaaggtaatagttaggaggggatygggtygtaagaagtttattttggattgtagtaygggtagttagygygaatttagttaggaggtttayggggatyggtaaaygagaaggggatgyggtgaggaygtyggattggygtttttgtygygttgatatttygattgtttttttttygtatygygttttttagtttgagayggggaagttatttagggtatygygtttttaaatagyggggaaaaggygttttgggyggyggttgagtgatygagggatyggttyggagttaggagttgggaggygyggggatgtggtggggaggaggggagtgggggtagtgagggggtttaaattttgyggggaygttygtttattttgtygttgyggttagttttttgygttttttygaygtttatttygygtygtattagygttygtagtagttttaygttgttggygtaggyggygygtaggagggtygtygttttygggaygtttttygggaygtttttygggaygtttttygygttttygaygtygtgttttttttygttttygaaagggtagaaagagtygttygaggygatgttgygggtgtttggtagattygagaagtttttaaatttttygtagttagyggggtttttttygatttgygygtttyggggtggggayggyggtggtggggttatgtagygygtttygtygtttttyggttyggtttyggttagtagtattatgtyggyggtyggggygygggtygggggtyggggygygggtaggaagagygggaygyggggygygygtygaggttttygtttttygtttttgygtttttagagaagtygtggttygygygttttagttyggyggaaatyggtattaggyggttgygtttaaagaaaaaagttttyggaggttgagygagtttttggggtgggygggatygygggggtttttygaggyggggyggggyggggygyggggataygttttttttyggggtttttttttygygtttttttttggttagagtttagagttaggtaggygttttttygagygyggggattgggtatttggtagygttgttttagagttggggatagttggygygggagaagtagaagtaattattaaagaagtygaattygagtygygggyggtaagyggtttygttttttttttygtyggttygygggatgggggyggaggtggyggyggggggaygtyggggyggagtyggtttttagtttygggaatttyggatttttggagtyggttttygtygagggygtygggttttyggatttgggtggggtyggtttttttygtygttttagaggagtagagygggtttttttttttygggggatttygggtttyggggttgattttattyggtygyggtygtttggaggtyggggaattttyggggygtttggygggtagaggagtygggygygggagyggagtygtttatttgggatttgtgttyggggagygttgygggtygggttattttgaattgggggyggtyggttgttgtgggggagttttagttyggaagggaggataatttttagagtttttygtttygyggaatyggggtyggtygtggtttgagggttggttagattttgggatggggggyggggtgtttyggaattttagggagtatttgagtgggaayggaygaygaggaatttttygtttttatgtttggtttgtgttaygtgyggggatttgyggatttattttyggaggttgygattgggygttgattttaygtttggttgtttaaaagagtagggtygygggygatagtygtagtttaggtttatagtttttttggttyggttttgtttttttttygttagttttggygtyggggatgggyggggaggaggagggygtgtgaggatttgttatagggagtttttgatttyggggtaggaggygtygtgagttaattttgggggaaggtttttgygtaaaggygyggaggtgygttygygttygtygtaggttaaagattgyggaggttattagttttgtgtttttttagttttttttttttttttttttttttygattttgatagygtgtttattagttgttagtyggtgggaggttttygyggttttaaggtgaatatagttaggttggygtagtygttggggattaggtttgaggtttaygtgtygttgggtaagttgaggggtaygagggtatygaattygaaatagtygtgggaggtgtaggatgaggataygtttaaattgygaagtygttygagttttygtgttatatygtattggttygattygttgttttggtygtttggttttttagtgtttttagtaggagttaaagggtttgttggyggttttygattyggtatttgtagggtttyggagggtggggygygygggagtatygatttttggtgaagaygttttygtatttgggyggttttgagygagtagygaattgagattygt

SEQ ID NO: 6814 - DNA, 1154 bp, Artificial Sequence
  Description of Artificial Sequence: Synthetic polynucleotide
ygtgygtttttaaggatgttyggtttttttttaattygyggtttttttttttttttttygyggttgtygttgttgtygygaaaattaggagaagtggaaygygygyggygaagygtygttttygyggyggtattgggtatgtttygtattyggggtyggtttyggyggyggggyggaygtttttttattagtygggygttygggtyggtygtygaggtttaggtggaggttgaggttgtygygygtygygggaggagtttygttttyggyggttgaggyggyggyggtataggtggygygggtygygygyggggygtagttygggagygttyggygtygggygtygyggyggttttaggttygygttygyggygatagtyggttgagyggagttgygggygyggyggttgtttttttagttyggtyggttggyggyggygttyggagtttygaggagttygtaggagttygtggagttygyggagttgggtagggggygttgygttygtygagttyggaggggtygtygggtygggygttgygtattygygtygggagtygtttttygttygyggygttygtttttgtygttygttagtattttttgtttygyggtygygtttagataataaaagyggaagatgttgtagttgggtaaggttaggattttgttttgaagtygggyggygtygygtaygttttttttyggattgaggagttgtygtyggyggagggtgtatgtttgygaggaagtygtygggygtygygtttttgggtgagttgyggggttgggyggtyggggtygggygtagttttttttyggygtygtttttttttttttgtygttggtgggggtggttttgggttttyggtyggtaggyggyggyggyggttgttgyggggtttttgtttgtttyggggaggatygygatygygttaggtttttttyggaagtygttgtgtttggaagggggttyggggttagtgttttttttggagyggttattaagtggttgttttgygtgttttttttttttgttatttattttttygggaggaagygtatttagggtaatatygataatgttgtttttygttattttgagaatatattyggtgtatttatgaygtttttaatataygggaggagaygg

SEQ ID NO: 6815 - DNA, 1154 bp, Artificial Sequence; identical to SEQ ID NO: 6814
  Description of Artificial Sequence: Synthetic polynucleotide

SEQ ID NO: 6816 - DNA, 396 bp, Artificial Sequence
  Description of Artificial Sequence: Synthetic polynucleotide
yggyggtttttygttttttttttatttttttygtttttatttttattttttggtygttygaattttygatygggagtttagagttttgttagygtygtattgtgygtygygtaagtygttygatttttttagyggtatyggttttaagtagtaaatatttgtgygtttttgagttagggaygygygtggggggtgggygtgtaygygggtgggttagygtagagtgggagtttgtgggtgtttttygtygggatttttaatttagttgttttygagagtttaagttgagygtygtaygtgttygtgttatttgttgtattggaygtagtttaatagygtagagaggtttttattyggtatttagttygatgtgggtygtttttttttttttagygg

SEQ ID NO: 6817 - DNA, 438 bp, Artificial Sequence
  Description of Artificial Sequence: Synthetic polynucleotide
ygaggagtaggggttgygggtygggtttttgttgttygyggttttygggggtygygtygygtygggttaygtgggggttttygtttttygagygggygtyggtgggaaatttgygyggygagagatagggggatggggygtttttgaygygattgtggggtgygggtagttttggaggaggatgttyggttaagtttattttgtttaggtgtyggatttttagtttaggttgyggtttgttttgggttygtgaggygaggtygtagygtttygaygtygggtgggygtgtgggtggagtggagatttgggtttttyggygtatgggagtttygtygtttgyggtagggaatygttttttatttttggttyggttygggtygggagtygtgtttygygttgattyggtgtaattttttagtttatttttttttaygyga

SEQ ID NO: 6818 - DNA, 438 bp, Artificial Sequence; identical to SEQ ID NO: 6817
  Description of Artificial Sequence: Synthetic polynucleotide

SEQ ID NO: 6819 - DNA, 411 bp, Artificial Sequence
  Description of Artificial Sequence: Synthetic polynucleotide
ygygtttyggttttyggggagtygttttttagatttgtttattygggagtttttttttygygtattttttagattttttttgagattygagagygttggtttttttttattygygatagttttgggatgatagtgygggtttttttattygtagtttttattatttggyggttaggggttygyggttygggygggyggygttagtgttttttggagttgggyggggagggyggggygggyggagygggtatggtggggtgtygggggtygtaggygtagygttttygttttggttatggagyggtyggygttyggygaggtggttatgagttaagttatttagtyggygtaygttattgygygyggygagttgagygyggggtagttgtttaagtggatygatattatygt

SEQ ID NO: 6820 - DNA, 1137 bp, Artificial Sequence
  Description of Artificial Sequence: Synthetic polynucleotide
ygygtttgttaggtttagatttataygtaygtygtttttgtttgtatatagtgygttttyggyggttygttygtttttttttagtttaygttttattgttttttaagttagaagtttygtagtygtygygyggagaatagygatagtygagygttyggttygtttgtttgtyggtgggtttgtttgttygygtagtagattyggggyggtygygggagttygygtttygttygtygygtttttgtygggatttattygtagyggagggttgagttygtyggyggtttttyggagtttatttattttygygygtyggagygtaggtaaaaggggaggaaaggtttttttttttagttattattttygttttttttaagaatttgtttaataaagygttgaggaaagagaaygtttttttgaattttttagtaggggyggagtttgttgttgttttgygttgttatttyggttatattgtttttygygaygatttttgattagtyggggttaygttygggagaygggattatgaagygttyggtagtygtttggtttttggtygggtttagtttyggtgttttttagttyggtaaaggtaaggygtygggattyggatagttgggtgagggatgggttgggagttttttgagaaaygtygygtagggggtyggaggyggttttttyggygtgttaagggtggygagygtygttggyggygyggaggaggygtygagttttgggtgtttygagaaagtgtttgtaaagtttgagtagagtgygyggggtygagyggggagaagggtgyggggtatyggggtgagatataggaaagaggaggayggtggggagyggtagaagatagygtttttaggattagygattttgtggtttattyggttattgggtttyggygtaaattttttttaggtagtgygggygatgttgattgtagaygtygggtagggttttygtgygggygggagygggggaagttagtgygttygggygttagttagttgatgygggaagaggttggggagttgtagggtygttygttttygggtgyggtgttttggygtagggtttgggttgagtygttygtaaatttagattyggygttgggygttttggtygygg

SEQ ID NO: 6821 - DNA, 2383 bp, Artificial Sequence
  Description of Artificial Sequence: Synthetic polynucleotide
yggattttttaggatygyggygtyggttggttgtttyggtttttygyggtygygtgagtttttttttggtggtggagggygtattttaatttggaaatttttagtttttaatttggtttygtagattgaygtygttttyggtggggyggtgggggtaggagggtaaaggggaggtttttttttttttggattgaggttgtaattaatagtttygtgagtttttatttttggttgattgygaatttttttattttaggttaggggtygggattttatagaaagattygtttttatttttaattttgyggtttttgttyggyggggaagtttagttgygggttagtttagttgygggttyggttaagtttggygygtttaggtattttagtttttggttygyggtygggygaggayggagggggaggggaaggggttgttgtttttttttttaaattyggtttttaatygttttatttttygtygtttattygttttgtataggtagttaaaatagagttagyggttaattgayggggaygggaagtaaagtygtttagygtttygttttttttagtyggtttttygggttttttttttyggygttyggattttggttttttttttttttttttatttttttttttgttttaatttygtttttatttttygtttattttttttygtattygggttygttaatttttttttttaagttttttttttagttyggtttttttttygggttygttttttttttttttaattttygttttttttttttttttygtttttttttttttttttttttttttttttatttaattttggtttttttygttttttagtttygattttttttttattttgttttygtttattttgygtyggttttttagttygggttgagttttaygtgtggayggtygygtttttattgatagtygtygttygtyggttygtttygygtttygtygggtttttaaaattttygygtygygttttttatygtygtattttttttagygtttagtttttygtttttttttttgttggtygtaygtttyggtttygygtattttygttyggtttygtagtygttattygygtttygttgttttgtgggatttygagygagttyggagggaatttttttttttttttgggggygatttttgtttgtttgtttgtttttttttggtgatttttgtagttttttaatattygttttyggagygtaygggaattygtygagttttgygtgtaggttttttttttttttgaggtttatattttttgaaattttaygttagggtttttgtaattttttttttygttygttgayggttttggagtygttyggggttttaggtyggttatgtaaygtgtatygttyggggttgtyggttgtattttygtygygtttygtygtttattgygttagattyggygtttygygtttygtttygtgggtagttagggggtyggygttttgtygaggtttttagttagagtagggagttygagttygagggagttttyggagtygaygaagggtttattagattttgatttttttttgaggygygtagattttgtttttgattatttttttttygygggtttayggtygygygttttyggygtyggygatggggagaagayggaggttgtgtttttagttttattttttgtggttgggttgtgtggtgttttgggygtagggtayggtyggttagttttagtttttttygtttaagtygtttyggttttagtygtygtygtaataggttyggttygttatagtaggttttgaaggygggtttttagygttygagtatygygaggagggtgtygtagtggttagtygygttygtyggygaggatagtaggaygtgtttygagggtaagtgggtaagyggtttygtatttagggtttyggtttgggggaggggggaatttttagtttggyggttttttggtttatttygttttagattttttagttggagtttagagttgtagttttttttgttagaatatttaaagatttttaggagygygtttttttttttttttttaatttygtagtttagygggyggaaagtttttttttygggggttgggyggygggtggttagggggtttaggggtgtygatygtagagygtgtgtagagttygygttgygggaataggttttgaatgttyggyggtaggygggtttgggttygtttgttgtaggggttagagaagtttgtttgttttttaygtyggggtygtygttygtgagttttttgtttgaggaygtgtgtagggtttatagtttatttttttatygttaattygagygttttattttgygaygygttttttttgataygtygg

SEQ ID NO: 6822 - DNA, 2367 bp, Artificial Sequence
  Description of Artificial Sequence: Synthetic polynucleotide
ygggtyggtttttygtttyggaggttggggagggggtygtgggtttttgygtttttaggttaagyggttttggaggtayggattagtaggaygtygaggtggygygggtygyggtttttttygtagtagttgtyggygagaattaggtagggaggygtygttgttgattgtattttatgaaagatttaggttyggttgtygygttgttatttttyggtattttgygtyggaaayggtygttttggagttygtggtygtyggygggtaggtttagtygttttagtttttgagaaaggtaggttatagttygatttgttttgtggttttattttataattttaatagtaagtaggtttaggttgggtatttyggggtattaggagtaggttyggttaattggtttttattatgaggtttygygtatagggttatttggttaygaggtaaygttggggagttttgtggtttgagggtgggtaaaggataggtttttagtttttttgygtttagttygttttttagyggtagttagttaggaayggtttgyggggttataggggtggaggygttatygttygtaggttygtagtaggatggtygttgggggatgtgtaggtataggggttggataaggggttttagaagtgtttgttttgaggggttggtgtgttttttttttattagtttagtttttgaggagagggaagaaggtaatttttttaattagggtaggtygggyggttgttttattttaatattttttatttttaaatatagaaaatttggggtttgtttttaaatttttttggttgttaygttttgggtagyggattttttttgttaataygtaagattagttttttttygtaggttgagtagaaagaagaaaggtttaattttaaaattttaaattygattattagttttygtttaaayggaagtagggttagttttttaygagttaggtgggaaattgggtttagggagagaaagtgttttagggttaggttgggattygttttggtttygttygtatgyggtagggtttttttayggaggttttagggygygtttttyggtttygaggttyggtygttagtygygyggattttagtttaygtttygagggaggttaggatttttagtyggygggattgygygtygttttttttttygtaggtttyggygaatatttagttttttttttttttatttttttygtttttyggttagtgttttygtttttttygygggygaygggyggyggyggygggaggagygggtygagtygaggaagtttyggtttygygygttgggatgtagygaattagtaggggtygaagaatygtgtagtgttagagttagagttggattyggggttttagtyggagtygaaatttgagttagagttygyggygggygagttyggagtttaygagtygtagaygtagygttgtttaggtggggtaagagaygttgggttaggggygtagggttttygyggtggaggggygtagggaggtggyggtygagttttgygtagtttgtttttggygtgtgtgggtttattyggyggygygggatagygtaaggygyggaaggttaggagttttygaggtagygygaggagttygtttttgygtttagggtatagttatagtygtygttatygggtgttattttatttaatyggygggattaattttttgttttggtttygggtattttaagagggtagtagtttygggggtaygggttayggtttygygaagggtataatttgagaagttygtggtagtttttygtagygtygggtgatatagggtttttttatttttaggagaagtgggtaggagagagggtygttygttgtttttygttgygtttagggatggagggttttattatttatggaattgttggtttttttgygtggttygggattttagtygtggtttygygttaagagggtattttttttaaaygaaatygtttygttygttygttygttygttygttygggtagtaatgtygtagaaaagtagtagaygtyggttygygttttggtttttttygtttyggatttygaygtttygtygtagygttyggaggtgtttttagtttaaggtagtttgttttygtyggtataggtygggttttttttttttaggagagaaattttaatttttttygtaaygtttaataaagatattttygyggttttttttaggtttggttgttgaygtagggtttyggagtaygtagtygttttttaagaatygggtttyggatttttgaaattgattagtttygtaaattggagtttattttttygyggtaaaggtagggttttaaagtygggatygt

SEQ ID NO: 6823 - DNA, 1235 bp, Artificial Sequence
  Description of Artificial Sequence: Synthetic polynucleotide
ygaagtttagtygatttttgattgttagtatttyggttataaggtttaaggygaatagttgtygtaygtyggygyggttgtggttgtygaaggagtaaataattttatygttggggtttttatttagattygttgtaaggatttgtattaygygygtgtyggagggtgtattttttaggaygygygttyggtataaggattggttgaagataggygtattgttattygygtttagtattttgatgtgaataggtaggttggyggagagagttggggttttttygtttaaygtygttagtattaattggagattaggttttygttttyggtttagggygygttttaatattagtttygygtatttggtgttgttttttygygtttgtaygygaagygtaaagtatttatttyggtttagtttataggtttgtaaagagttgttttttatatygggatygtgygygttttygagyggaaagygygttttyggagttayggtttygttaatttttaattttattttttgggtagggaaagtaggattgttgtygttgatgttttggattattatttttaygttgaatagttttagygggttttttattattaattttagagttatagtgtaagagggtagtgttttatatagtttttttygatttagayggtygtttataaatattttttyggtttttyggtttattttaaagaattttyggttagttttagatattattyggaatttgygggttgagaggttatygagatttaaattaaggttygygattaygttgtttatagygaaatttttttttttttttttygggattttatagtgaatgatygtggaagttttgtttaaggtattaagtagaagtaaaatttttattattttttyggtgtttattagttygtttttttaggtttttgggattattttatttaaaagtagttttttttagyggggtttagatygtttttgagatttygttgagaaatttttagygggttagygtttgggygttgggygtygagttygatatggttttttggatgtygttgatttgttygtyggttgtttagtttttgttttatttyggggygtagaaaggggaygggtaggggttygatttttagygtttttattggtygatagyggtatatagagttttagttaataattgtaygaagaatgagttagygtygggttttttgagtaggataygygttagygt

SEQ ID NO: 6824 - DNA, 3043 bp, Artificial Sequence
  Description of Artificial Sequence: Synthetic polynucleotide
ygatttaggagagttygataygtyggatagttgyggttagtygtggttattttggtttttygttttygttttttttattttygygtgtagtygggataygggaaaggaaagttttggaagttaagygtyggttaaaagatgatttgttygygtgttttttygtttttttttttagtygtgttatatggyggttttaattaggygggtagtgygtttygtygyggagatttagggtygygtygtttgggtagtgggtgatgaaattttttaggygtattatygtagagggygygggyggggygyggggygggggtgggggatygagagttggtatyggggtttatttgttttttaggaggagggtggggayggggggaggggygagtgygygttaaygtygggtgygtgttttggggygtttgggygyggygttygtgttttygtttttttttagttttgygagtttttygagttgygtygtggggtgaygggatygagagtagtttttgttttyggtttyggygygggggagaygtgagygtgtataygtatatatatagtaggggaagaggygttttaagyggygtttaattttttttttttttttaygggtygggtgagaaagtagtygggggttatttygattyggyggtttttggggagggggtygaataagaaaagggaggagatggagataattttttyggatttagtttttttgtttttgtttttgtttttattatttttatyggatgattggagagtaaaagggaattyggagyggggtggygagtagygttttgagaaaatgtaggagtgtgtttggagaygygtaaagttgttttttaagttttggttttygggtaygygatgtttygyggygggttgatttagggttgttttgggtttttttgttatttttttggaaatgatgtaagttttgattgttatttggatttttgtagtttagtttggaatgygtttggattaggggaaagaygagaaaygatattttaggtgttgtayggtttattaaagygggaagatagggtagttgtttagattaaatattgtatttagtgtttttgtttttatttttaatygtggggttttttttaatgtaaagtgttataaggttaggaatttttatgtgtgtttagttggtttatagtattattgtgtttaggaaattgttttaatttattaagttttttgggttgggaattttattgaattttaaayggyggaaagaggaaatttttttaattygatgtgggtgtgaygygagttaggggttttagggatattgttttagagtatatygtttttttttaatagtaattggagtttggattygtttttatattgtatagttttttygattattgttttggagtattygtataygygtaygtattttyggtygygtttatatatatttatatataygtaygtaaaygygtggtygtygttaggtyggtaattttgttyggygtttttagyggygttyggtttttttttgtagtagttgagygtaggtttygtttttyggtygtgttgttaaaagggtyggggtttyggattggtttagtygtygggataatatttgttygatttttttatttaagtgatattagagtttttagggatatttgaggtattatttttgttattgtygggtattygyggygttgttaayggtttggttatatgtttttyggagagttaygggagggygttgggtaatttttattygagtygyggtygygaggaggagggaaaaggygagtaaaaaggaagagtgggaggaggaggggaagyggygaaggaggaagaggaggaggaggaagaggggagtataaaggatttaggtttttygaygggaggttaatattaagaattatgtgtgtygagyggttgggttagtttatgattttggttttggtgttggttatttttgattyggygygggggatygaygttattaatttattygagggtttttaagataggagtttttagtagaaaggtygtttgtttttgtagaatataggtaagtgtatgtgttttygtagtygggagttattgggagaggatatygtgtatttaygyggygygttttaggygtttygtygggagttaggygtttatttagggttaygtaaatttttgggatggtaygggaygtgtaaagggaagygygaggtaaggygaggttygygtygggtttygagggttyggaatttgtaygtgttagtagggtgatgaaatggttggggtaggatttgttgttgttttttttagggtygaggggaaatgaagtagygtttgaygttgttagygttagttttygttttygaatttygggttyggtgtaaagygygttttatttyggtyggtaygygggaggtttagagggttttyggagttgggttgygttttgygttyggagaatttttttttttggtttgtyggttttagtaagggtgtygygttttttttttttttaaaagatgttygatattttagaattttgtyggygagataaatggtattgygaattttttttttgggggtattgttttyggaagggagygtgagggtagygtaaagygtattttygyggtgttgtygttatttttagtttttggttaggttagtaagttaagaaatggtgataygattygaatygtgygttttttttgttttatyggtttttggtttatyggtaagttgtaaagtagagttaggygtgtagggtayggggttggttttttttttagttyggaaagagaaagaaaatttgtttatagttttttygttttaygatttttttttygattttggggggtygtgtgaaygyggtagyggyggygtgygtgygtttatygtaygagttggaatgtaygagtgtttattagggaygttttaagtgagtgaatggyggttttgtgyggttttgtttyggyggygygtggggttttayggattttgtygtttttatatgttggggtyggtatttttattatttygagattttygt

SEQ ID NO: 6825 - DNA, 864 bp, Artificial Sequence
  Description of Artificial Sequence: Synthetic polynucleotide
ygygatttaatttttaattygygatttaatttttaattygtgatttaatttaaaattttygatttaaattttaattygygatattaagtttgygatttagtttagaattygygatttygtttggtttattttttagtagygatattggyggttttygattttttagatttagtgagtttygtaaagtygttyggttttyggaagtygtaggtgtaggygtygttgggttygygggtttttttggttggttygggttgttttaggattayggayggaaaatygtaggygygyggtttatttygttttaaggggagggttygtttggtygtgtagttygtttygttttttttttygaagagagatttggtgttggtatgggtatttygyggttatyggagtggtttttyggatgagtttggtttyggygttgaygttttggttttgggggttgtttggttggtgttaggtagyggaagaygtttggagagttattygtttttttttttattygtttttatygttgttygtgttaggaygygtagtttgtagttgtagtttaggtattggygygggatggyggagttttttttggatggygttagggttatygagtgtatagtttatttggtttgagggtttgttttttttggatattttttyggattttgatttttggygttgggtaatttataggatgagatttatyggttgttggygaagtygatygtttgattttgttgtttgggyggttggtttygggattygygttgttggggaygygggtttggtttgyggtgtttagttatttgttgygggygygttaygtttaggttggtggttgtagtygtagtttygygtttgygg

SEQ ID NO: 6826 - DNA, 2071 bp, Artificial Sequence
  Description of Artificial Sequence: Synthetic polynucleotide
ygttyggtyggygtygtttttyggaggttgtgtttttggggtggttggyggyggggttttttyggttyggttygyggygtttttttgtygtygtttyggggtgtttttgtttygttgygagttyggtatygyggygayggyggygygaagagggaagygggyggyggyggyggtygygttaagatgygtygggttatygtaggttgaggygttygtygttttygttttttttttygttygtttttttttttttygtttgtttttttygttygttygtttttttttttttttygttttttttttgygttttttygttygttttttygygtttygtttttttygtttygygttttgyggtgttgtagttgygggyggttttagttgtttttagatgtgggttgggyggttygyggggaattttygygtyggttgygagtgyggggtttyggttgtagttyggttgttatggattygtyggygggagtygttygtygtttgttttgtttygtgttgttgttgttgttgttgttgttgtygtygtygtttttgtygtygtygtygtygttygygaaygttaggttygtygtygtygtygattttttaggtaggtgyggttyggtttttatttttygggattttygtyggtttggttttgtttygygtgtttygtygttttttttttaggygtygtttagtttgatttgggtaaatttygygygtttygttyggggttaagttggttaatttyggggtygggttggtygygtagggggygtttygtatygttttygagygttttgggtygggggagtttyggagtattggyggtttttgagtygyggagggtggggayggagggtygggaaaagtttygyggttaagagygtagagttagttttagygggttygaggggggagttagggygaggyggygtyggggttygygttyggggaygtttyggaggagtyggttgtygagygygtagttttgggttttaaggattggttggggygtttygtagggaattttyggagatyggagggattttgttttattttttttagttttygggygttyggggagayggggtyggtagygggttgagygggagttggataggtaggataggtygttygtgttyggggaagtygagatttygtygtttyggaggttggyggtgagggtattygggyggtaggggttygtygaggggtygtggtataygggtaagggggttaattyggaatggttttygagtagttttaygttttgttaaggayggtaggtgtaagggtygggggattttttgayggggtygttttttygggtayggggaggtttttatygagttttaattttgaayggggtagggggtagagtttttggtaggtaaggttttyggaggagggaayggttggggagtggyggagtttyggagtggtggttttgttaaygttttttttyggttgtaggaaagtyggggaggtgtaggttggtttttggggtygtttggyggaatgtttttttttttygtagtggggyggggtttgggggggygtggtttgtyggygggtttttgaggtattggggtttygtggttttygtygatttaaygttttttttygttgtaggygggtttttggggtayggagyggagygtattttggyggtgttygtgygtattgaygtttagggtygtttggtgttttaygtggtgtyggtagttaygtttagagtaggggtaygagttygtagggtygtttyggttyggatttygagttttttyggaggtaaygaggaggagtttggtagttattttttttataatgttayggtttttggtygagatttgtatttgyggttgyggtttaaygttygtttygtggygttyggggttattatggagtggtagggygagaagggtattattygygtggagtttttgttygggagttgtttttaygtyggagaygtggtyggtttagtygaagttttttttgtggygtttagtaattgygatgggttggtgagtaygtatttttttagttttttttttttygttgttttygt

SEQ ID NO: 6827 - DNA, 1170 bp, Artificial Sequence
  Description of Artificial Sequence: Synthetic polynucleotide
ygagttygygttaagagttaygtygagaygygtygtyggtggggttaygygagatgtaatyggagagtttaaaattagtttaggattaattttttagggattygtttaatttttttygtagaagagtttaagtggggtagtggtygttataggttgaggatgattttyggaygygttttaggygygatygtattattygtttttagtttaaagtttgagtgatttggtattatttttttaattgttttttatttttttygtatttttgttgtgtttatygtttttaygtatttgagagtttaaattatgttaagaygatttggagaaaygttygatttgttttttaagttaygtaaggatttatttagaygtaygttygygyggagaygtaygttggtataygygtttatataygygagtatatataygygtatattattyggttygtgygygygggtygttgtttttgttgtattatgtaaaggtggttgggaaagygygttgatttatatttatatagtttattttttttttatagtatgtgattaataygtatttyggggaggagggagygyggttgggggtgttaatyggaagggaatagatagtgagtgttattttgttgggaggttttagaagtaaagygttaaygaygatagtagyggtggttttagttttattagtaattgtygttggtaggagtattataygttttaggagtttttygggtattaagtatgggtttagttygttttagttattttttttttttatggttttattttygttgttagtatttygattttagtttgtaattttgattttgggtttgattataaatgaygaaagatygyggtagtttttaaagtgygggagygagtttygtattggttagygyggyggagggatttttttaggaggttttaagtttttaagtttgtggagagatttggtaatagttggtaaggtttgttttagttattttygttggttttttgtttttgtatttagygtttgagggygttattygttttttttttgygttttaygtaagyggtttaaggaatttattygattyggatttygtttygtatgttttttaagttttygttattttygtaggygttttagaaaggygtgatggttttagtttagtgttygttagttyga

SEQ ID NO: 6828 - DNA, 2168 bp, Artificial Sequence
  Description of Artificial Sequence: Synthetic polynucleotide
ygygttataaayggggatttaatttattgttygatttttgttagaggygatttatttgygtttttgttatygtattttygttygygtttttgygttttaggtttttygttgttttttygttttttgtagygygggagygttgtttygtttggtttgttggttttttttagattttggttatttttttygtggtaggaagggttatatgtattgatagatttttygttggtggtggttgggtggtggygaggygtgttttygggygygtttaaaatttagtagttttttttaagtagtagttttttttatttygtttttaggattgaggatttagttttygatgtttttttattttttttygttttatttygttattattttttaatttttttagtatatttttaagttttataygggygtttgttttttttttgtattttttagttttygggygtttygttyggttgaagtttaygtattttgggatttaattgtttttaattattygygtagtttaagtttygygtttgtttggttttygtttygggagtttgaagttatygggtagtttattgggtgttttyggggaaaaggtttaagttgtagagatgagagaagtggggttgggggaggggagaggttttagaaggaagattaygaataygtgygaagaaataaaagttattaygtgtgtaygygygygggggtttaagggygygagygyggagtaygttttagggggttagggatagtggttttttgtagygggtatagtagggggygygggtatttataygaaagygtggtagatgaaygtttagtygyggggtttttttagtaygttgtataggtagttttgtattygtyggtatttgaygttgygtyggtagttttggttattygtgtaagagagyggtttttttagtaggtttattygggttttttgtttgtttyggyggtttttttttaggttatygtygtygttatygagygtggtygygygggtgtttagtagtagtaggtygtygtttttggyggttgtygagtttagtagtattttgtttyggtyggattttatattttttatgtygttgtttaagygtttttygttygtygtygtygtygttgygtygttttttatttagagttyggyggygtygttttttttttttttygygtggtggyggggtatggtattattaygggtatygygagggggtygttagygtttgyggygggggtagyggttttatgtgygtyggygggttttaaggaggaagtyggyggtygayggggygttygttagttagagatttttgagtygggggyggggaagtaggtagttagtaaatygttygggtttyggggygggaaaggaggggttgtagaggaggtygaggagttttaatttttaatagtttttagtttygaattttaaattyggatttgtttggggygttattttgagagggttttttttgtttttttattttygygattattatttttttttttttaaattgttttyggggatagagtgggggagtgyggggygtttygaggygygtttttaygygygtatatttagttttaggtttttttttttttttttttattttttaygttttgtagygaaayggttttagaagttttttttygaggygygagttyggtttggttttggtaggggttttgtagttgttyggaaggtgaagttagttttgtgttttgaggagaaattggagatgtaggtygttgtgttttttygttgttaygtygttgygtyggattttgttattttttygtaaggggtgagagygggaatagttttgttttgttttttaggtattatttagtttggaggttggagygtaaggtaaygtttygggaagtggtattygggttttygtataygggygagtttttagtagtttagtggatagattygtaggaygyggttgttaagttygygaggtaaggattaggtattttttygygttttattttagtttgyggattgtgattttttattttagtattagataagttygygagtaattgaatattttttttagtttatgggtggggtgtggaaagggygtaaaattttaaagtggttttttygyggtgagygagttgtttyggggttttgtttgattgtagygyga

SEQ ID NO: 6829 - DNA, 2053 bp, Artificial Sequence
  Description of Artificial Sequence: Synthetic polynucleotide
ygggaagatttggaggtyggtaaaayggagyggtgygggatgatgtttgggaatatyggtaaggtgttataaaatgaaygttaaggyggttataagaggayggtygggaatygaatttagygtttagtayggggtttttgtggtygaygtgaygtggtttygttaggtggaaatygtgygattttttttygatttaatttaygagagataaagatgtttaaataattaygatygtygtygtatattttgtagggtttygggggyggaggggaggggagygttttttyggtagaagyggyggtttaggtttgtttggaggttygtaatttattatgataaatgtaaagattaattaaggtttgattygtgtatataggaggtagayggyggttgatagtggaaataattaaygagtatgttttttaatttttgtygyggttgttgagtatatygyggttttttaggygttygtygttgtygttttygagttttagagtttttagttyggttttggagtggggygtttttttttagygaaaaggtgygaggagyggggtttygggtggtyggggagggggygygtygggtygggaggygyggagttagtygtttayggagtttaattgtttgtatyggggatyggygggyggggygygttygagtggtttygtygggaaagggyggygggygttggagaaggygtttggygygaagttgggyggygtttygagggyggaggataggtggtygygygatygtagttaggtagygaayggttygggggttgygtagygyggttttaaagtttagttyggtttygggtttagttygttgtygtttgttaygggagyggttttgygyggagggagggggygygagatygtattttygggttyggygygtttyggtttttgggttttygtttttttttttttttyggtttagttygttgttttagaygtgattttygyggaaggtgttggygatgygygttgttygggagygtgtgattaatggtttygaggtygtgggyggygtatgtattagtttttttttggtttggttagggtgtgagggtattygggagtatagygaggttatggtagygggggttttygggagygyggyggtggaggaggaggaggaagaggagaagtaggtgaygygggtygaagaggtttgttttttttggttttagggttggygtygyggygggtttttygttttaagtaaagtttggggttaygggygttgygtttaggttttttttygygtagttttttyggyggggtttgtgtygtygtygttgttagggtaggataaaggtttattaataygtgatgggatygygttttataaatgggattggagygagagggagttagagatagygygagyggagggagyggtagggattgygygagygggaygaggygaygggygttygggttggyggagaygggyggttttaygtygggttaggyggggttygygggaggatttagtgaagagtttgggaaggggygaggttygtyggyggtyggagtagyggggygttagtttyggtygttgtygygggygggygttggagatygggaygtyggygttyggayggattgatttgttgatygttygtyggaggtatattttattttattttatttygtttygttagtagttyggygtyggygtygtttttygtaygttattttttttgttattttttttttttttatttttttttygttttygtttttttttgtttttygyggygttagygtttttttttggttygggygggggtttyggttttttgtagagtttttygtagttagtgggggatatttygttttagyggataattagtttttgagttgggygagaggtgttaagggagtttttgtttygaggattaggggatgygaagggtaagatttggtagagttgygtttggaaatatttttttygtttttygttttttygggtaygattagtgtggtttttaagtgtttttygtggagtttttatttygtgtgagygaatygtgygtygg

SEQ ID NO: 6830 - DNA, 1679 bp, Artificial Sequence
  Description of Artificial Sequence: Synthetic polynucleotide
ygttttttttygggaagattygttataagtygygtttttygtygtttttaatttyggggtygttttggtygtttgtgaagtagaygtttaygttattgtygtygtttttgggatttttaggtttygggggatagtygggttyggtattygggtygtygttygttttggygagtagattttggttagggtggygggatttgatatgtygttttaggtttyggyggygtataagtattttgtygtagaattygtagyggtagggygtattgttttyggygtgtagtyggatgtgtttgttgagattgttggggtygtygaagggtygtagatagattttgtatttgagtggtttgtagttygtgtgygttygtatgtggattttgagtttatatttgygygagtatagtttgttatagtagaggtataggtggtyggttttgggtttatttgygtygttgttttygttgtygtygttttyggtgtttttygtygtygygayggtyggtggtaaygttttygagtttaggygttygygatttttttyggtagttatttyggatagttgttgattgtgtatggygatttttyggtygatgttggttagygattttagttyggyggggtttagggyggtygttgtaggttygttgaagtaggagatggatttyggatattttagtagttygtygaagtgtaatttgagygggtaataagyggtggtggtyggtgagtygtagagtagtttttygttgtagattgtaaaggtyggtatgayggygggtaggtggttgtatttattattyggataggttttgagatygttygggtygaggggyggtagygygtagygttygaggggtaatttyggygtagggggtagttgygtataaygygtttttggtagygyggyggttgygggyggggygygttttaygtgtttgaaggyggaygtttttttyggggggayggagagtagagggaagtygygtagggttttagagtagggtaggttaggyggyggyggyggyggygggtttttagygagtaggtatttgggatggtggtggtggtgygygtggtggtgatggtggtgattygygtygttygtygtygagtttttttygttttyggggygttygtaygttyggttttygtttagtagtttgtttaaagygaggtyggttttttgtttgttgttgtttttttttyggtaggggtygtygtgagyggtygtygtygttttygttaggtyggygggtttgaaagttgagygtaygtyggggtagaaagttaggttgtygattttygtygaggagtygtttaygatgtygaggaagtgtttttgttttygggyggtttygtttatgtttagggtayggtttagttgttttttgttttttttgggttgtttttatttgtttggggtyggygaggtggtygagggygyggaagaggtttygygtttgatgttttttygygtatygtaggtttgaattggtggygggtttagggggtggggtygtaaagtttttgtttgggaaggygyggygaaatygggygtygggggttttggggagagatygaggttattagtygttgggayggygttttggygagtygygtgttygtggtgtaggaaggygtygtttttatygtygttgaataygtagtggaaaygt

SEQ ID NO: 6831 - DNA, 1474 bp, Artificial Sequence
  Description of Artificial Sequence: Synthetic polynucleotide
ygygtgttagaagtttttttygygyggtttttttttttttttttttygtagtaggaggtttgattttygygttttgtattygtgtggattaaaygtttagtttttttygttataatyggaygggaattygygygtttttygggttattttttgtttgtgttgagttatgggygaattttttaaaaaggagatataygagtgggtygtttaattttgaggggaaaygaggatttttttttttatttttttttttgatttttttttttattyggatygtatttttygaattattttygtaaggaggaaygaygaatgtygtyggttttaygagattgtygttttttatttatgtttaaataaggatagaattttgtagygaggygataagaaaataaataagygggygttttaaatygagttttygggtgtgtagattygtagyggagtygygggagygaggtgggaaattttggtygyggygtygggtttygttygtyggggggygyggggyggygggygtatgygygtgygyggtgyggttttagttttggttgtygtygtttgtygtygtygtygygatgtttattttagttaaagyggttgygggtttggggattyggttygggtagyggagttttyggattygtygattygtygaggagygygygtygggttttygtygagtagttgagttygtgtgtttygygtttygygtttygaagttgtygtttygaattttggtyggygttgtttaggtttttygttagggattagtygggtaaggatgggaggygtagttgtagtyggtttttttttygygtygggttgtgtgyggtttygygtttttttggttaaatygggaagygaaagttggattttagtttttyggggagtaattttgtyggttttggyggtagttgtttgttttaygygttygggtagtygggggygtygttttttgttttttttygttggtygygttttygaggggttttyggtttttggaggtygttttttttttygggtttgggygttgyggttatagagatttttaayggttagyggtygtygtttaggttaggtagttttagygttttygggttttyggttttatygagtgtyggttttygygttttgyggyggtaagttttttggtgagtttygtttttgtttttttygtygagttttyggggttttttttygttttttgtagggtygtttygagtygygtagagtttgygtgtagtygggygygyggtgtygtttatttygttttygttyggagagtagggtgggttayggygtttattttttattttygygtttygagagygtttggtygaggaggatygttgttayggattttttttttttaaggagygaggttagagggtttygggagagygtygatggttggggattygaggttygygttatttattygtaattttttttttygagtttttgggaaygg

SEQ ID NO: 6832 - DNA, 675 bp, Artificial Sequence
  Description of Artificial Sequence: Synthetic polynucleotide
yggtttyggtaattttygtatttyggttgygtyggtygtggtyggaygttygagaygygyggaggtatagtagattttggygtataggttatgtygtygtaaayggggggygygtatttttttttaaagtttttagaggagataygtatttggtggtagggggtgtaggyggttgygaagtagggttgyggaggattatagatttggtatataatatttagatagtttatgatttttygtagyggagayggttaagtgtttttttattaatttttttttttyggagtttaggggtgttgtatgggyggygtttggattygygttttggagttattaggyggagtaaagttagygygtttygyggttyggaatttagttggttygttatttttttatttttgygattttattttygatygygttttagggtagaagygtttgagttttygttagtgggtatttaaagtttatgttyggygggygtgttgaygttattygggggttgyggagygggagggggyggtggggggyggggatyggggggttaatggggagygagggaygtttgttggaggggtagygagtgtgtttttyggggtttatttttgataagtatgyggttaagggtgtyggagattatgyggtttttagyggattygaggtttygtatygyga

SEQ ID NO: 6833 - DNA, 1133 bp, Artificial Sequence
  Description of Artificial Sequence: Synthetic polynucleotide
ygtyggttatygtygagtttttattttatttaattagatygyggggaaggataygtaaatttgtygagggttygggggtttygggttgttgttgttgttagygttttgggaagtgataggtattaggatttgttggtgyggyggyggyggyggyggtagttttagtygygttygttatatatatttttattygttyggtgtataygtygygtygygggtagtgtygtttgyggaggygygttyggggttygtaggggtagtagyggtagtttggtagygtygtygygttttygggtatttggttygygaagtttygtttttgtygtttttygygtygttygttttaygttttttagygyggtygtygttygaygygygttygttttgygttygtygygygtyggtttygggggyggtagaagygygygagggtygttgttygtttttttgygtagttygyggtttttaggtattttgygttgttgggttyggygggygggggtggggyggggagyggggygygggtygagygggggygtttyggtttygyggttttyggyggttgttgtagyggttgttgygygtaatgatgygggttygygtygygttttagtagyggygttgttttttttttygtttagatgtgtgaattttttttttataataaattttttattttgttttttgtygtttttttttagggggttaattttgaggatygtaggggttgtygtttaggyggtygtaggyggyggtgtttaggyggaaaggagyggygygaaagyggyggyggyggggatyggggtttyggggygaggagtttgggyggtatgatygyggtttgttgagttgaagtyggtygtgtttttagagttatttygygggagygaatygagtgtgtgtgtgygygygygttygggggagaagggattaagaggagggttagggaaggaagttggggttatggaataggggtgtaatygaggtatttagagyggtyggaaagttygagtggyggagaggttagaggtggygagaaggggygyggyggtatyggaygtatygtttagtatttggtttttttgggttttygaggatttgaagggtyggagygyggagagttayggagtyga

SEQ ID NO: 6834 - DNA, 1808 bp, Artificial Sequence
  Description of Artificial Sequence: Synthetic polynucleotide
ygggygggggaygttyggtagttttgtaaaygygtagataygygaattttatygtttygygygttttttggtttygttggtgygtgtyggggatgyggtygygtaggygttygttttttggttttttggtygggtagygggygttyggttatyggagtttagtttaagggtttagtygaggttttttygygygaggyggttgygttaggtgagygggtatygyggtygygttttttttgttatttatttagyggttagaggtattttgygtttgggagttttaagtgttttyggttgggtgtttttgttygatttttaaaaggaaagtataaatttygggtgygagtttaatttaggatygaattttttygygaatttgaagttattatggggygggagttattttagygtygygttygttygtttttygtatyggttaggatgttgyggaaggtaggggygtygagaggtaagggtgaaagaygtygtttatatttttaaagttygaatttgtattttttttgygaggygtagggygggaggatygttgtagttgggagtyggtttyggataggtaaagygattygataggtgaaygyggygggagggagtaaaygygtaaaaaattttgtatttattttttygttggygtttttttygggaggygttttggttgtygatgtattttataaagtttaaaatgataaaaagttaagaaattagtygtaagtgtatagtaatttagtaatgtttttttttttttttttttttttttttgattgttaattatatttaatgtttttaaaatatatgtaggtgttaggygtatatagatagtgttygagtagygggatttttttttttatattygataggygtgttgtgatggtaagygaagtggggygggtggatagggaaattaattattgtatttttaaattatttaagtattgaattgyggyggtttygttggggtggttggtatygtygygaatyggggttttaggagtygtyggggyggtygtaggtagtatgttgtgyggtaattgtygtaggygggattygggygggygagyggyggyggyggyggttgtagyggyggttttttgggtttagaagttgyggyggttgyggttgtagyggygggggtttttggagygtaggggagygggygtygtyggtatagyggttatggttaaggggyggyggagagatttygagttgtttttggygtgygygagtaggagaygttttagtgttgggttgggttttygggagtattatataggggaggaggaggaggagggtagggaggggggagggagaggagggtagggagggggagaggaggggggatggttgtggggggygggggggagttygggggyggggaaggaaattgttggagtaataattttgagygattttaataatttttaattttaagagggaaagagggagttggaaaagtataggygttgygttttggtagagggaygggaagaggygtttaaggggtttygggtttatagygtagtatttttggatattgtagtgayggtyggagaattttagttagaagaatggggaaagtagtgygtgygaagagtttttttagaagggtagttttggyggggagatttgggygtattggggttggtaggtagtgttgaggtygaagattttttatttattttagttyggttttttttygyggttttaagttaggygtattyggttgtyggtggtygtgygtttttgygtttttgtgttttagygtttttattttatttttagygtyggygygt

SEQ ID NO: 6835 - DNA, 1323 bp, Artificial Sequence
  Description of Artificial Sequence: Synthetic polynucleotide
yggtttyggttgyggtggtygtttatttatttttttattttygttagtattttttttttttttttatttgttttgagtatygggttttgggggtygggtygtttttttttgtttttagttttggttttattttaggagttgtygggaygtygggygtttttggaggyggaygaagaaggyggtagggtygggggygttagygggaatttyggtygtygygggtagtygyggtttttttttttattttagggttygggyggttatygygggyggatgagttaggygagggggygggtggtaaggggtgtaagyggayggagggtgggggygtttttatgttygygtygggggggtatyggaggtttyggggtaggggatgygtygttgtyggtgtttatagagggtygtygttattygggygtagagtttaggygygtttgttttyggagggtatygggygtagtaagtygggtaggggagagggagtygtygtttaggyggygtygttatygygtttaagaaagataaaagggatygggaaygggaggggaaaagttttttgttyggttttagatggattttagttttaaattttaygttataaagtttygaagaggygggttgggggygggggtyggggyggatttttaggggygtggttgygygtttgygatttyggatygtgttaatttygtygtygttttaaaatttgtgggaaattttagttttgttatttattttttttggaggaygtagataggatttgttttgtaggagtttaggtyggtygattygygtttyggttataaagttgtatttygagagtttaaattattygtagataaaatttatttttgggaataaagtattygtttgtaggygtttttttygggttggaaggttggygtgyggaaayggatatatttattygtggggttygtttttagttatygygggattatyggttatygagttagggattyggtttttttagtttttyggagyggttggggagttttagtygattygtagtattttyggagtaggtatygtaggattttggttttaygtttttyggaygttttttttttagatgtygttyggygggtyggggtttttttggygggttgygygggygttgygygagttaaattaaatttggtyggaaaagaygyggttaaggttygttyggtttaygtttttygtyggttyggtaaggggtttyggagaayggtttgggggggygagaattatgggygggggaaatggaagatagagggaattgaagtaygggggttttygatgagtagtgyggatgttyga

SEQ ID NO: 6836 - DNA, 1501 bp, Artificial Sequence
  Description of Artificial Sequence: Synthetic polynucleotide
ygttattygagttaatgaaygygattgttttgataaggygtttttaattttatygattttggtaaattgtaggagatatttagtttaygttatataaaaattattaaagtgggatygtygtagttgaaaagttygattagtgtttggagattagaaygygagtttttaaagtatataygtattyggtatygggaaagtttaggygtttgtgatttttygaaggattttgggttagtattttygygtttggattatttagggggttattagaaagtaatataygttataagaaagatgtgggggagatttygatgttygygtttttgttaggtggaggyggggtgtaggtagaagtygygygttggattgttggatgaatttygttaygygtaggtttygygtygatttyggaagggataggtaggttyggaagggatttttggggtttggggaygttttttagggtagagagtatygttgyggttygagyggttygggtttttaggygtggggtattyggtttttaagygtttttyggggaygtaggygtttaygtatygtttagttgygygtttttagtatttagygttyggygttttyggyggagtttygygtattttttyggaaagtttgggggtttttttaatttaggttttttygggagttttggggygggggttggaagaaggggttatttatttygtygttyggttygtttygggttttygaagtgtttgttttagtygyggtttagtgygttygtaattaagtatttattttygttttttttagtgtygaagtttttttttygygttgtgtttttggtgaaaataggatatttttttyggttattttataataaatagygtatataagygggggagaagyggggyggagggagaagtyggtttygagggggaggaggaaaggagaggagttaaaatttyggattgygataggggggaaaggagaagaaaagaaaatgagagagygygtttagtygtygtagtygttatttttyggtttttttygtagttttttttttttttttaaggtagygataattttaygtggataggatggaagttttgygyggaagtygggaayggtyggagygtgygtygygttgtyggtagtttygtatttgygtagggaggtggggygggggygaygtygttatyggttattgygggttygtgaggtygtygggggtttygggggaggtygttagggaygyggggggyggyggygygygggggatttatttygtttttatttgatttygggtgattgtttattgttatggtttgygatttygygtggggatygtttagggtttyggggttttggatgtttygggtggygtygtygtaattttygtgtttttygygtygtttttatttygtttttattygggtygattygagyggttgtagtttttaggttgaggggagggattygygatygygtttttttttttgggtyggagagttattgtyga

SEQ ID NO: 6837 - DNA, 1744 bp, Artificial Sequence
  Description of Artificial Sequence: Synthetic polynucleotide
ygttttygyggttgttttttttttagggtygtyggtggtttaggatttggttatyggggaggggygtggttttgtygaagtygatgagttataygtyggygygatggtagtgatygtgtataaagaggagygagttgtygattatttgygagtttygtatygttaggtygyggttttgtttagagaygtttttgtygggttttygttttagttttygyggttygggtattygggtagtygtygtttatttygtgttttttgaagaattyggatatttttagggtgtttyggatttgttgtaggyggtttagatatygtttttgtagagggtggggtgggagaggagggtaaattaattaaaygttaaatgagtttttgttaaygatgaggagtygggatttaygttgtgtttggtaaatgtygttaggaggaggatttagggtttygtttagygtggtttagaagggaaggagygtagagtagttgygagttagygyggtgagggttatggtggggatatagtygagggtattgggttagatgataggggtagttttyggttttaggttttttaatattttagggtttgggatttygtttttattagtatttttttatttttttgtataaattttttaaagaygygaagtatttgttttyggtttygygtagttttgaagtyggtgttgtaggagtygttygttttttggatgtgggataggagtgttaggggtttygggttygttagtggggaagaggatagygtagagtagyggtattttttagttgtaggggayggygaggyggtgggagagggyggaggggtaggyggggygggagygggggatygggaaagatagygygtagtggggttgyggyggtgttagygaagygygtttgttttattttgatgttttygatgyggaagtygagggtggtgttggagttgatgttttttygttattgtatgtagygyggtttggtgayggygygttgygygtgtttttttttygtgggagttttaggatttatygttagtatttttttgtatatgttttttygtagtttgggtygtttaygggttttggttagttttttttttaggtaagttttgtgggggygtaggtagyggttagggtatgagggggygtatayggagattttttygagtattygtttygggttttttttaagtagttgtttyggtttyggatttttatttgatttttttaatygatttggtagggtaygtatatttgaygtttattttgtagtygagtatataaggttygtygaagttatygagtaggttttgtagttgtaggtagttttygtygtygygttttattaygtygtggaaggtaggtaygtagtygygtagygygttagttattagtygygttaggtagtagygtttyggtttygagtagygttttaggattagttygttggtgttygtygttttaaaattttttgaggatyggtattygttagygtygtttagttttttttygtygygggtattygtttattygttttattgtttattagtgtgttttgttagttgtatttaggygtagygttttttgaaagggtttatgatyggtagattgattatggttyggattttttgttagtggtttttttgaaagygatagggttaaggtttgataatyggygtttyggtaatgtataagttttttttttattgaaatagggtttygttaygttttygatttatygg

SEQ ID NO: 6838 - DNA, 1801 bp, Artificial Sequence
  Description of Artificial Sequence: Synthetic polynucleotide
ygygtagtttaggatagtagygygygggttaygggygagtggagttgtaggggttygggyggagagtygttgttatttagggaagttttygggatttygggtttttygygaagtttyggaygggygttatygaagtygagagtttyggtygagttttttygtayggtgggygtygygtttaggygagygygygaggtygggyggggtygggggtygttyggggagggggyggggtygggattttygyggtygygygtaggggttgggaagttgttttttyggtygygtygggygaggggttgygtyggttygygaggygtatgygygttgtygagyggttttygtttttttttygtttatygttttttttttttttttttttttttttgtattttygtygtttttttttttttttygtttgttgggtgttgaagttgggyggatggtagtaaatyggtttygttagaggatygagtygtttagtttygttttttyggatttatyggygygttgtttatatttttaggygatygggtaagaygttgtttttaaaataagyggtgttaagtaaatgatattaaaatgtttgttttgtattaatggatggattttttttaaggtaggggggaggtgaaggaaggagggggyggagagygygatygtttatgtttyggygggggyggttgygyggygttggggttttagttgtggtygyggygttttgagygggagygggggtygygtygygggttygggaagttgaatttygygtygttgtttggaygyggttygttygtygtttttagttgttgtagggaatygggygagtgttttgttygtyggggaaygttyggttaggttttagagttttygyggagagyggggygtttgttgggggyggtygggagggtygggttaggggygygggagatttygyggggaygygaggtgttgygggttttgtgyggttggttgggaaygaggagaatgtgttattaatagtgtttaatygattgattattttgggtgttgtgtttttttttttatttttttttatttttgggaaaatgtattgtttaggtggggaaggtgttygaagaagaggttgygaaaatgaattttttgattagtagtaaaatatyggaggggtgtgtgtgtgtgtgtgtgtgtgtgtatgtgtatgtatgtatagggggtggggggttttttttgtttttttttttttttttagttaaaggaaagggagttttggygtgtgyggygyggggtggattttatagttatygagggggygaggaygaggaaygtttattaatygygagtygttgttygggtgggygtatyggagttttttttgttgtaggtgatggtggttttttygtgatygatggaattatagtttaatttttgttttttygttagtttttttgttgttttttatygagtgttgyggtagaggttgggtgtagatayggtygttttttttttttttttttgtttttttgtttttttgaataaatgtyggaggattaggggatggyggagggatagagttggattyggaagtygygggtgggagttgtttttygygagttygaggttgttggtattttgtygygggtagttygygttagtttygggagtttttgggtttygggagagygagtyggggtygtttggttataaagatgttygygygttygttttgygtaygggattygttttgygttttgagttttgygtttygttyggagttygggaygtyggtttaygtgggagaatttttgtygttyggggayga

SEQ ID NO: 6839 - DNA, 1801 bp, Artificial Sequence; identical to SEQ ID NO: 6838
  Description of Artificial Sequence: Synthetic polynucleotide

SEQ ID NO: 6840 - DNA, 1684 bp, Artificial Sequence
  Description of Artificial Sequence: Synthetic polynucleotide
ygtttttttygggygygygggttttttgtygtttggagtygagttggtattggagygttttttttttggagygtagaggtattygaygttttgyggtagttygtagttttttttttaygattttttagaatagttttgttttgttttttttyggtttttygagtgygttygttattttgtttygygagaggtgaaygyggagaaagtaggatgattatttaygttttygagaaattttgggtaaagaaaggtattattttagttygtaygttgaaagtygtttttttttttttttttttttygttgtgtttgaatttttygggatatttagayggttggagtttttygattttaaggygggygayggtaaagttaaaygttagygygttgyggttttygggtatygaggygttttygttttygttatttatatagggygttaagtgtttygattygygagtgaygaggaygtataggttagtgataygattygtagttagtattgagygggaygayggggttygagygtaggagggtgygyggggagttgaggagygtygggggttygggygyggygygtatttgaggtygtygtygaggaggygayggggagtagygyggttaagagtagtagygtygtttaggatagtyggygyggygygygtagggtygtttyggtttygggggttatygagagttyggggtgggtyggggttgggtgtttgyggttggtaggggggygttggtyggagtttggggagtgtygaggygtygtygtygggttttygtygtygttygtttgttttgygygttttgygyggtgttygtygygtttttgtttygyggygatygttttyggtygtatatyggtagtygygtttygttattgaggtygtygatttttygtygagttttttagttgygttygggygttttttgtyggtgtgyggggtyggggttagggtyggygggggygattygggygataggggygaygggggyggyggggttygggttggaggygggyggggygygggaygaaggggtyggagygtttyggattgatttagyggttttgaatttggggyggtygttgtgtygggttaagtggttgaggaagttttttttttygtttaatttttttattttttggttggggaagtygtttatygygtygaggagtgttttttgtttttttatagaaatatttttgygttttaagtggggattygggtygggattttttattyggttygtagygttgtagtttttgtggttagtttagtttttttaygtttttattygtattyggygygtttaygttaggggtttttagygtttttagattttgtttygtttggttgttatttttagggygygtaygatgygggtygaaaaggaatttagtttttagtgtgttttgttgtttaggttaaggatttagyggatttygttttttttttttttgtaattgtaatattgttttaggtttttttatttttttttttttttatttttttttttagtttggaagtttygyggttttttagatggattyggagygtttttggaggttatagtgatttaagttttaggaaggtygggttttggaygtygygtgttgttgttygtygtygatyggtgttttygtagagataatttggttgaatttatygtttagygt

SEQ ID NO: 6841 - DNA, 6657 bp, Artificial Sequence
  Description of Artificial Sequence: Synthetic polynucleotide
ygtgygtgattggayggttttygygyggagygaggaggttygtagygtyggggggagggyggtttagtagggagggygatgygagtttggggaggggttagygattyggttaggaggtgaggatagttttttaattttygggaagggaagggtagggggtygygtttggggggygtygggtagggtgyggayggygaagggggayggaagggagagaggygttggggaagggatttttyggaggtayggggtagygtgygggttgyggtagygatttygattygggttttygggttttgtygggttgagtttgygttygtttygtygtygttaagtttttttaattttgttygttgygttyggatygygygttaggtttgggggygtagtaggggttgggggygtaygttgygtattyggggaygttyggggttygaggtggyggggggtttggtygygtygtttttygggggtggttygggttttaagttttttaggtttagygttyggtygygttygtygtttatttgttygttyggtttyggtttyggggttgygttygtagtygtygtygttttttaagttttaatttygttttygggattgaaatttttttttagtttygtttatygatttgygygygyggtttygtttttygtygygyggtygggggggaatttaagttygttttgttttttttygttttttttttttttttttttttttttttttttttttttttygtttttttgttygtttgygygtttttttttatttttttttttttygtygygagttyggttyggagtttttggttttttttttttttttttggtttttygagttttttgtttttttyggtttttygyggtaattygttttttttttttttyggygaygygtaggggttggggaaggaggggaggttttagaaagygtagggggygttttygyggttygttttyggtttttttygtttatatttaaaaggtggagggggtgggtgggtgggtggggggagtgggggygatagttgttggttgaataagttattygygatttttattattttaagtaaagttaaggygtttttaggttttttygtyggttygttttttattygggagggtagggatttaggggyggagaaygtagggygtaggtygggttttttttgtttagttttggtttygttttttttttttatttattttaatttttgtgaggattttagggggttttggagtatttttyggtttagttttattttgataatttgtttgtgyggaagttttygttygtatgttataggaagggaaattgagttaagagaggtttagaatttggttttatatagygygtygaaggtagagttttaggggtagtttggattttyggtaggagtttygggattttaygtttgggtygggtaggtttyggyggtgtttggataagttygygttygtagaayggtyggygtttggggattttttttagttttygygtagttygygygttttygtyggygtttttttttygttttttgtttttygttygtttttggttttyggttttagtattttyggtaygtttttygttygtygttagtagttgggtaatttaaygagtatataaaagagttgatttaatttaaaggtagtaaattaagataaattttatagtgtgtggggatyggagagggaatgtgaatgaaygtttaygaygtygtttagttttgtatggatyggtttagttyggttgtagggtttgataygttygggttttagggttttttaggagttagaatyggagagtgggttttgagttgttttggtttttaggtttttagtattggttygaatttagtaatttagagtttgtggtttttttyggttggttgggtggggttttygtgataggggtgtagagttttgaaggggagtgttaggaygaaagttagtgygtttttaygattttatgtaaatattggggggtaggggttttggaaatttagtatagttttaggggtyggtaggaagggtatyggtggtttggaatatttaagttgtggtttttttttttttgtttygatttggattayggttagagttaggtygtaggttaagagtaggtttttgtttatttattagatagatattgtaagtttgggatgtgttaggtttgggtttgtggaaygaggtyggyggtgagyggggtatttttttttttttgtttgtttgtgaggtttttttagttgtagttttattagggagaagttggtyggtttttagagtttttttggttaygtttggaaggttttagtaagttattttttagtttttggtttggttagttttgtgtagaagatgattatygggtttygggttttagtttatttatttygtttgttaaatataaattttaagagaggtattggatttttatttttagtaggtttttttaggtttgtgttggttaagtgtagtygaagttttggaatgagttttttttgttttygtaggtgtttttygtgtgttttgygttgtgttgggygtttgttyggaggagtygygttaggaygttttgttattttttaggagtaggtatgatgagtttattttttyggggtgtaaattgaggtygagggtttttttagagygtttttgatyggtattgtttgattttagaggttagttttgyggttattyggggtttgagatttayggagaattttagaggttaatttgaggggygggtaggggtaygygygyggggtygtgggaggygagatttygtaatttgaggagttaggattttagtagagagygaaatttggagttgggggaggggayggtagaggattggaggtygggttgtayggtaggggtygagttttygyggtygttttttttttttatttygagyggaggttgygtygttyggttgygatygagttttyggagtttyggtygggtygtttttttttygtggtygygtygattggyggtttgttgttattyggaygtyggygtygtygtygygaggatatttgttyggggtttaaygtygygttttaygttttttgttttttttttagatttagaatyggggagaggaygyggyggtgaagttgggaggttggaatttggagggyggyggagtttyggagttaayggggyggggggyggggtyggygttggttttggggataaagatttttaygttgtttgagggttgggttttgtagatatygaggtaggaagaaggatttygtatttttygttttttagatttttaaatttatttaggtttagatttgagtgtttaggtggggtgggggagatygaatttttttgggttttygaggygygygaaggygaygttgaaggggggaygtygggaygttgttttttttttgtataygtygttygagttgtatttttaaaygttttaggagtttygygggttttttttgttttttataattttygaagttgtttttagygattttttttygtttttagatggggtygtaggggygggygaatgtgttgygttygtygtgggttgggaggaagggygyggattgtaggaagtttttgtttttttttgggtagtttggtttyggggattygygtttagttygyggyggaggattyggtygggaatggtgttgagattgygygggtayggtttagggtygtgatygggtggttatygtgtagtttgggaagagaaaaagttygggggggggtygatatttygagatygaagagggaaaatgggaggaaagtaggyggtagggagggaagagyggyggaagagggattaggagagttgggggttygttttgggtttyggggtttygttttattyggtagtttagtttagtttagtttygttgygttagtttttyggatygggagaggttagggttatygaygtttattaatagtygygagygggtttttttygggagtttygtagyggtyggtagagtttagttatyggttggggtgggggygggggtttygtaatatttttttyggaggtttaagyggygyggggyggggygttgygtttttttaygtyggttttgygaagtygaggtatttatagtttattttttttttattttygatttygagattaggttttagatgaagaggggttygtttgtggtttaatttggggygtygyggttattttagygtattygaaggygygtttagttttttttttttttttttgtttagtyggttttttgtttttagygygtttyggaaagtttyggggttttygyggygtttttttagttttaggggttyggagttttggtttttttagtygyggygtyggggagggaagtttgttyggtttaggttyggyggtygttaatttygggtgygttygttttygaatttgggtgggtggatggggaygttygggagtygygggtttygagygtygtatttagagtttygygggyggggagattyggttttggygyggaygtygaggttagggtattagggatggggtggttygggttgygagagtygttggggattttgygttgtttttygtygttttttttagagagtatttttttttttgttttttttaggggyggggatttttygatttygtagyggygatagaggggtttttyggtttyggatagttttttgttttttaggtttttttttatttgggtyggggtgygggtttygggttggaggtattgtygygggygagtagagygygygtatttyggtttttygagtgyggyggyggyggyggyggtttttttttttttttttttttttttttttttygggttygttggttttagatagtttttttttttttttygttttgtyggtttttttyggagttygttyggttggattyggtttgygattyggagtttagyggagtyggygggagttaggttgyggygtttattgygttaagygyggggygagygyggggyggyggyggyggggatygygygttyggagttyggggttggtygggtaggygggggagyggyggtttyggtttygattygggttygggygygggygtagtggtggyggtygyggtagygtygaggttgtagtatattttttttgagygtgatggaaggttttatgtgggagagygygyggggagggatggggagggggygggggtygyggygggggygatyggaggggyggggggyggggtygttgttygtaygtyggtgggttggggggtggtyggaggggggtttyggaggggaagttggagttagtygygggggyggygtgggaagtygagtggyggtttygttttttttttttggttygtttygttygttttttgttttygttttaggttatttagaggtttttaggtttyggtttggaagagaagygttygaaggtttgggggtygggattttggtggygttgggaggtgggtttttgggtggggatayggttgtgtttataggygttyggtaatttygtggaagttgattttaagttagattttttgtgagygygygygttygygagggttaaagtatagttygtaggaygygygtttgyggggyggggggagagyggggtatttgggggyggggaggtggagygagagggtygtygggtttttggyggtttygygtttttagagattygtttttttttaaggtygtygatttttttttttttttttttttygttgygygtygtttttygtttttyggtygggaggagggggaggygtgggagyggttyggygtttttygattttyggaaggttyggtttagyggatttttttttttttttatgtgttttyggaattttagyggattygaaatygygttttygggttttgagtygaggggtttttygtygttttttggtggtttygagttttygtygagyggttttayggttttttagggygtttttygtttttattygttttttttttagtttgyggttttygtgtgggttaaaaattttaaattaggtttaagagygttttygttyggttaagttttygygygtygttttataaatyggtygygtgyggagttgyggagttygggatttttagygygygttgggygygatattttggatttygttgttagygtygygttttttyggtyggggagttttatatygttaagagggtagggagaggggaggggaggggattattggaggggagggggttgtttttygggtgtttttttyggaggaggtttygggataggggtgggggtggygygggaggtygtagatagygygtttygaggatggtygggtyggggatgggygygyggggtttttgttyggaygtgggtttaayggttttttygtagtttagaaatttygtttagttygygggayggtygttygtttttygatttygagtttttattatatttgtttttgtaggayggggttggggggattgagatygtgattgaggtyggggtatggaggaagtgtygtygtttgttttygggattgttggataygaagggtggaggttaaggayggagtttttgtttgyggttgtttagtttttagtttttgygygggggygtttagatttttagggaatagggagatagagygggtygagttygg

SEQ ID NO: 6842 - DNA, 546 bp, Artificial Sequence
  Description of Artificial Sequence: Synthetic polynucleotide
yggaggyggyggggtygygggagggagggggtygggtttaggygattggtagygygagttygggagttttttygtgttttygttygtttygttttygttattatttgttygggatttggygtyggyggtttygggygtttttagtttyggttygggtttyggtttyggtttygggygtygattaggtttttttggttttygtygygygttttttaatttgttgttgtygtygtygygttttttaggttttgttagttattygygttttgagttyggggttagatttttatggaagygtygygatgttygtttttyggttgttggatttttagaagaygaaataygygaggtgagyggyggtygyggaggttygyggggagggagggaggggygygyggyggygggggtygyggaggttattttggttttygggtttygtygttyggagygttagaggggatyggyggatttttgattttygttygagaaaattaggatttaggtagtttygttttttygttgggatggagtaatyggggygttygc

SEQ ID NO: 6843 - DNA, 288 bp, Artificial Sequence
  Description of Artificial Sequence: Synthetic polynucleotide
ygygyggygtattgygggtygggaaygtgttgygygttgatatygggttagttttttgtgatgggattttttttttaaaaaygtaggygttttttygggtygtagtygtagtygggagattgagggttagggygyggtygyggggttttttgggtyggggygyggtttaygttttaggtttttgyggttttgattagaagtygttgygtttttggtygttttttattygtttygttttygtaattttaggtttagggttatagyggtttagttttttttttttygyga

SEQ ID NO: 6844 - DNA, 947 bp, Artificial Sequence
  Description of Artificial Sequence: Synthetic polynucleotide
ygtgaggtygyggtgttagtttatattttattgtgggtggygggttyggtttygygaggaggygtygtttttaaattttayggtttygygtagygaagaggygaggyggtygyggaaggtaggygtagtttatttttttygagaggtttygatatttttygggtgagtttygaaaagygygyggggatttyggttgagygttgggtygttagtaattyggtttttagagagttataygaaggaggggaagyggttttttttggggtttttgggaggtttggttygggtttttttygtagttttyggyggttagtttygyggttttggggygttyggatygagtaaaggtttyggygggygggtttttttttygttttttttaagygttygtttttygtyggtttagygtaggttttttygatttygttagygtagggggygyggttgtyggggatttagtagygggygygygggtaagtgygyggygggygygggttgygggattygtttygggttttatttyggattttttttggtttgtttgggtgtttygggtygggggtagtygaggtygygyggygttttttttttgggttatttttttttygtttttttttaggggagaygaatygattggttgttyggtygtyggaayggtaggtttygtygtttttttygtttttygtattttyggttyggtttttttttattatygygtttygttttaattygtagttagtattttttttttatttttttttygttttygttgttatttttttttttggatgttggaagygtagttggtattttygtttttttaattttttaaattttttttttttattygtttattttttgtgtttyggttttttttttgggtgttgyggaggttttttyggttygggggygtgtgtgtagggaggyggatygyggaatagataygg

SEQ ID NO: 6845 - DNA, 1313 bp, Artificial Sequence
  Description of Artificial Sequence: Synthetic polynucleotide
ygagaatttgtygtagggggagatttygtygttaggttttgggaattgtttgggygtygttaaagttygagtyggagttgttatttggggtagyggtygggaagaggtaaygatgttagtaagaaagtagyggaggtaggaggyggtyggaggagtggattggagyggayggagtttygtygttttttagttyggagygtttggagygaaagttaagygtttttygagggygatttttttttttygggygygygtttattygttgtagtyggtagttyggygggagaggtggtagttgtagtttygtatyggggagagygagttttttgygygygygtttattygttttttaggtgattyggygttttygtygygttygttggaagtttgtaaatttttttygggggtttygtygttaygttgggaagttggggaygyggggggaggtttttggttygtygttttygttgtygtttgatygtatttttggagggtttygtattttgttaggtttttggaggtaaatatatattttygatttataattggttttygygttaggggattygygygtttttatataygtaygtaygtygggyggattyggygtyggttttaygttagtatttttttaggygygyggygyggyggttatygagygtttyggtatttaygyggygyggggtttttagggtggttttaggatatagtygaattttatagtttattagtattyggggtyggatttttttttggttygttaaaatgtttataaatatagattattttttagaaaaaaatgtatygtattttttttattttttgttttgtgatttgtttattggattaagtaatttygyggttgttgtygagaattaatttttgtaaataagtatattttygagatggtttttgyggtaagtgtaataaaagtggttaaatgtaaaagttttagaagtggtygagtygtatttttaggaatttattaaataagtgtggagaaggtaagagyggagttygggtgaagggattaygttggattgagtaaagattataatatattttatttagagtgtattatattattttttyggtgaygttaygtgggatttttgaatttttaaattattgyggttygttggggagggayggagygaggggyggggtyggygygtygagggggtaggtttygtttyggtttygtttygatttygtttygtttgygyggattttggtgtattygttygggagyggtagyggygggggygattgygtaagtaatagtttgtagagtttagygtygtgtgataygg

SEQ ID NO: 6846 - DNA, 848 bp, Artificial Sequence
  Description of Artificial Sequence: Synthetic polynucleotide
ygygaagtttygyggtttttgygtgttttggtttygggaggataaggatttttttttttttttatttgygygyggagtygagtttttgttgaggtgagggtttyggaagtttaygtagtttygtaggtyggtggtggtygyggttgttttgygggggtgagtgtgttyggtyggggtyggagtttagygtgtgttyggtagayggyggtgttygygygttttttttttygygttygyggtgatagtttagatattagttygggygttgatagaygattttttttatttgttagttttttygtttgttagtagagttgttggtaagtgagagaaaatagaggggygygaaggtaggygyggttagggagtgagyggggygttgggygyggggyggagtygggtgygyggygttygggttaggttttatygttygygtyggttttygttttgtttagtygtygtttttttttttttttttatttttttttttttttatttagtttttttttttatttttaaattttttagttgygygttgatygtttttgtggttttgtttgggggtagggggagaataygaatagattygaggtgtttttttttggagttggagtttaattttaatttttatttttatttttatttttgtgtttatttttgggtattagttygggattatggttggttttygtagttgttttyggagygtatttggggttatggtttgtygygatyggagttygttttaagtyggagtttgggggygtagaagggggagygygtygagaaagtgtygggtaaaygygygtygygtttggttgggtatygygagttgggygaggagaygg

SEQ ID NO: 6847 - DNA, 2406 bp, Artificial Sequence
  Description of Artificial Sequence: Synthetic polynucleotide
ygggggaggggtataygtagttttygtgyggaaagatggtgttttttttttatagggttgygygggtatttattttygttgtaaagygttygggttaggygyggtttgtttygggtyggggygagttygttgttttttgyggtagatagygatgygygtttttygttttagttttyggttygttyggyggttygygygttttttyggtgtagtatgygggygttgtgaygttttyggataaatgtygtgtaattgtgtaggygaatgagagttaaaaataagaayggaaaatttattattaaggtattattgygttagygtagttatttgaaggtttttatggttttyggygtttgygtttgaagttygtttttaggttttggggggtatttgtagaaaatttttagtagyggttygttaattagattttagggtgtayggggggtggygtyggtaattatggtaatttttaaaataaaataatataaaataaagtaattaaygtttattaattattattttattttattttttgtattgtttttaggtagttggggaagtygtygggagtgtagtyggatgttggaatttaatgtgattyggttgattatgtaaagattaggattggaygtttttgtagttttatttygttatttatttttttttttttatttygtattagaaataaagtggggggggggggygagtttttggaggagaaaatgataattggtatttaattttaggtttatagtgygtygyggtggggygtaaagaygtaaattttygggatggygagttttyggggttttattgggttaaaygaaaattgatttgatttgttttttaatattygagggagagaaggggagatgaggggagggagggtagggtttgagtgtgtgygtgtgygtgtgygtgtgtgtgtgtttggggagggggaggaggtattaagttgtagtttgygygyggttttgygtttyggyggggttgygtgygtgtgtttttgttygygttgttgaaaygggtttttygagggatyggygttatatgatttygtttgtttttygttagygygtagatygttagttttttagtttgttyggtatyggaggagggtygggyggtatttttygggtattggggttttgyggagyggagaagaggttttagyggggaatggtatatttggatttaagaagtygyggttyggygttagattttggagtgtagatatttggggggaggggagagttagagggagygagygagygagygttagagagaggtagygygtagygygtayggayggggggttgttgygyggagaagatgtaagygygtggggtttygttggtttttgagtattatgtagaaggggattyggttgaatgatggttaygtygygtttttgggattgttggygygtaaggayggtaygygtaaaggttatttgagtaagyggagttyggataatataaaatggtaaattaagtggttygygttgttgtagaatttgtttttttatttygagagygattygagttygyggttttyggggttttatttgttggagggttgygtttgygatygygygtttttttttaagtyggygttgtyggttaaggagtygttggagaaataggtgaggygagygtygygttttgatttttttgygtttyggtygyggttttgggggtttagggttttyggttggttgatggygtttgaattttggtttttttatttttggygttttaggygttttttgtatttttagygagaggggaggtttgtttttagttaggygagtgattgyggygggtagagggggtagggattgagggyggggagtagatgtgggttgyggttgtttttygtyggaygagtttygtgggaggygggtatagaggggtygatatttggagatgtagaggaagatggggttttaaggattagagaygatgagtttggatataygtttagttaaaaatggtgtttttaatttttatttttatygtttagttttaatagtttygatygtttgttttatatygggaaygtgtaatttttygygtttaggtatgggaagggtaagayggaggygttygagygttgttagtttttgtttygtygtagttgagggyggagagyggtttgygttagtttttyggagttgggttggggttatggggttataygggtyggttyggtattatygagyggtggtgggtttttagttggyggtygtyggagtaataagtttaaagatttttaaggatygttttgatgygtyggggttagggttagggttgttgyggaggtagygggaygaagtgggygttttttttttttttygttttttgygtygtygtygtygtygtagtygyggttatagygttgygt

SEQ ID NO: 6848 - DNA, 1218 bp, Artificial Sequence
  Description of Artificial Sequence: Synthetic polynucleotide
yggatttaygtyggttttgttaygtgttgttygtagttttygttygtttttttygygttggtaaygggtattgattgttygatattttagygatygtagagatttttttaatgtygggygtattatyggygggttagyggtttygttggtttttttgatatattttttatagttattttttttagttgagatttttttttttaatatttygttaattaaygtgtaattttttggttaaaatgttagagttaagattaaatttgaagaaaagaatgaaattataggaagttttttagatttagtygttagtaaggttatggttygaagyggtgtaggggyggygygtygggaagttattggtagagttgtgygtattggggggtgttgtaagygttggggagagtgtggagaggttgygtggagttgygygttyggggtgggagttgtatttttaatgaagygygtgaagggtaagyggtgatgggttttgygttagtggggttgggagygtgttgggggttgtaygtggggttgygygtaaggtgagaattgygtatgtgggtttggggattgygygtatygaaggttgtaggygttggggagggtgttgggggttgtgygtggggttgtttttatyggaagttgtaygttyggggaagygtagaggyggggtgttgygygygttggggagtaygtggggggataygtagggggataygtagggattgttygygygaatggtttygaaygtatgygttttattttatattttatagtygttatgaygatygggaggttygttygttaayggttagttaayggttgyggggataagttygttgaggttgttaggygagttaggtttttttggatttygtttgattyggatgggttgtgtttgaaattgatttagttttattagggattatgaagaaataaggagtaaatttaaagtygttgtaattttttygttttagttygtttaagyggtygtayggggtttttttygttygggagttggaggtggaaaagtyggttttaggyggygggaaattgttagggggygttaggaggtttttttyggggaggattttaaatttgaaaaagygaaaaggtttggagttaaaggtggtggttaagatttttttygattttttttagttygttygtaattttttggygtagtttygggaagaggtgtaygaattgtaggygygg

SEQ ID NO: 6849 - DNA, 1848 bp, Artificial Sequence
  Description of Artificial Sequence: Synthetic polynucleotide
ygtagtaygagtgttagggygygtatttggggggtgttttggyggtgtggagagagaagagagagggygygggtgatattaygttygggttttttttttttygtygggtgggtggggtttyggygygtygggagggygyggggttaagtagggggaagaggaggagtaggtatgaatgtgtttgtgtgaagatyggggaggggtggaggaggaggaggaggaggagaaggaggaggaggaggaggaggyggyggyggyggyggyggyggyggyggagggyggggagggagygygygygtggttygyggygttygggtttttttttagttttygatttyggttygygaygygtygttttttagtygtygtygttygtttygtagttgggatttatttygggtttggggattyggygggygggagaagygggggttttyggygyggtttggaaggagygagaaagtaaaagtaaggygagtagtattttaagtttttttaatttygttttttgyggyggtaggygttttgttgtttagygygtttttttygagttygagagtggttgaaagaaaagggattgggygggggtyggggyggaggaagagagagtgygagggagygaggagagttyggtaatatttgttaaaatttgggggaggaggagygyggggaggaggaggaagaggaggagagaagggaaggagggagygygygggaggggagygyggagtygagggataatttttttatttygtgagtagtgtaggyggtgttaggtyggggyggggggtttttttatttagtayggggtattaggtygggatgggatttttttttagaaagtygattggatgttaggagaggygtayggttgggggttttttttttttttttttttttttttttygyggttgaattaaattagaattgttatttagggtttgtgagttagaagggatyggattataygattttygaaattgatgtyggagttgtaygagygggagggagygggtaggggtagygttatyggygygttygtatattygtattygygtatattygtygtttttatttattygygtygttttttygtttttttygygygtttygyggtygttygygtygtattatgttygyggygggygtatttygygtttagttyggtygttygtggtagtygtagtygttygyggtygygyggagyggggagtygttagtttgygtttygttygygggtttatgggaagttyggggatttgatagtygttgtygtygtaggtaygtttygttygaagttttttgtttygyggatttygtagttygtttttgyggtygygttygygttttyggggttagaggtggtttttagygtggggaygggatggagtgaaaatggttgttaaaaggygtttagatttagagagtygtyggtgaggygttygagtaaggtttgtattygttttttttttttggaaggtttttttygaagagttygattygyggatyggtyggagayggattggagaattttatttttyggaggggggaygaagtttgtygtagtggtggyggygtttttygttttygtttttatttaaagggtttagaagaatttygygagtttygtaygygtttggtttttttttttgygyggtggygttttayggttygggtttygggygygtayggygttygggatgggyggaaggaggygggaggtatggtgggtgygygyggggattttygtygygggggtygtygtygttggggtttttttagttygggttatgtttyggagggygggggtgtggtgtgagyggatggagagaggygygttttygtygt

SEQ ID NO: 6850 - DNA, 2119 bp, Artificial Sequence
  Description of Artificial Sequence: Synthetic polynucleotide
ygygggaggtagatagygttttygtttttgtaattatttygttygttygattgggaagatagtgataaagttygggygtagaaaaggtagggttagggtaatygtygagtggtagyggtagggattagattgtgtttgattttggtaaattttattttttttgggtyggaggtatgtttatagaagggtggttagtaaggttggaagagtygaagtttttttttattatttatatattattttygggttygtagggttgggaggygagtttagtaygygttttaggtgygtaggggaagagtttagygttgygygtagagtyggttttggagtttgttttgggggtttgtttttttygtttatttttagtttttttgtggggatgggtgyggtaaaagatyggyggatttttttggtygtygtttggtygtttattagttttttgattttggttaaatttttttttttttatatttgttttttttttttatattttaygttaggggygtttygtggattgtaattttgaagagagttttggtyggagggtgttagtttygattgygtttttaattygtaggagtgattttgaatatatttttattyggagttttagtgtttttattygtygtataggaaaaagygygttygatttygggtatttttagtatygttttagtaagtgtgttygagattagatgaggggtgygyggttgtatttatygttttttagagaygtgggygtttggyggggattaaggtggttgtgattagtaagtgygaygtagttattaygagtttaaagtttatggttagtaggttgygtaygggtagtaaggtataggataygaaggtgattaaaaggagttgttaaattttttgttyggyggtygttggttttttagyggtttyggyggaatttygggyggggtygtttagygygaaaggatagtagagtagygygaaggtgaggttgaagagtagygttagttggtygatttgttgtagttggggtatttgtagggatyggaygttggttattaygagtagygttaggaagaggaygtagtgtatygggtgtgagtttttggttaggtygggygygggtttyggygygtttagtagttyggttagygttagygygttygttagtaggttgagaayggttagygtttttagygtggtygtttgttttagtygtagygtgtagtygyggaatagygtttttagttttgggtaagygaatttttygtygtaygttyggagttygygtyggyggtttgtttyggtygttygttyggygttttygggttygttygygtygttttygtygtygttttygtygygyggygttttygttattttagygttatgtagyggtygyggtygygggygygtttttygtyggttyggggygtyggggygygggyggyggygtyggggygggygggyggygggyggygaggygtyggggygyggggygyggggygggyggagttggggygtyggttgtttygygygygygttyggagygygttttttttygttygtygygtttgygtattggagttygttygygtttygatygtggttttyggyggygatygygttgygatagtygagtttygggagtygygaatttgggygygtatagttygygttttaatttygygttttgygttttygttygtyggaggagtygygtgatttygagtattttttttgtttttttygagttttagtttttttatygtgtatagtggaatttatttttttggygttatttggggagtygaaaatattgaaattttgygaaattttttgttgyggggtagttaattttggaaaatatgtgtttttttttatttaataaaattaggttattagatttgagaggggttygygtttgattgygaatttagggttttygtttttaygagayggagaatygaygtttaagaattttyggggttaggaggaaggtggaggtttggggygtaygttttttttatgygtatgagggatttttygtttttyggtaatttttttttaagttttagggtygyggagattttgtgggygggtgygggttgygggagttgtgttggggaggyggygg

SEQ ID NO: 6851 - DNA, 562 bp, Artificial Sequence
  Description of Artificial Sequence: Synthetic polynucleotide
ygggtygttaggagggggagggggaygygygtygtygggttygttattttgtattyggggtygttggtyggtyggggtatttttaygttygtttygttggygagattggagggattygggatatygtaaagtattttttttagtgtttgggagygttygttgtaygtttagttttaygtttttggaattggggttttttggttttygggtttaggtttyggttttaggatgygagtgtttattygagggggtgggaaaagttgatttttygtaagggaggggaaggtgtaatttatttttttagataattaatggaatatttttygtttttttttttttttatttgtttayggtagaagttaggatggygttttttatgttggtttgggtgtatatataagtgygtgyggaagggtggttgtaggyggaggtgatagygaagtaatttygtagttygttygayggttttttgygttttagatttttttttggygtgtaagatatygtgtgttttygtaaaaygggaatgttatatttgatagygtattttttygttttaygg

SEQ ID NO: 6852 - DNA, 1404 bp, Artificial Sequence
  Description of Artificial Sequence: Synthetic polynucleotide
ygtttgttttagygyggttttygggggaggtagtagygttttttgtttttyggtttggtttttgyggtygtagtttttyggttttgttagggttgtyggyggtttygtttgtttagttagggttgyggtttagaggaaygygygtyggtgtttygggttgtygygtygttggattttagtttgtatttygtttttttttttttgaaaaggtattaggaaaagagagagggagagaagagtttatagtaggtaagtttggtttgggttatttgttattttagtgggagggtgtgttggagatygyggtgttaagyggggatagtygggatttgggggtggttgtgggttygaagtggaggaygagtatggtttgggagataaggaatygttttgagatagagaaggttttygggagyggatagagagtgggygaaatyggtgygtagtaatygyggygttagttttagygyggtttttggggygtagttttatttygttttagtagttgyggagttttttgaygagttttygtttggtagtattgtataaagttttttttttgagaygygtttaggaattttgttttttttttggttttttggtttttttattattttttttggtttgggtagtagagagygtttatgaatgtgttttyggttttygtaggttgtaggtttatttggagaygttttagtygggaatattyggggagtatttgattaaagggtatttgygttttygttygtttttttttttgttggtttgggagaagggaaaggggtaaggaagaaggaagggaagygtggtggtttttgttgtagygttttggaagaggaatgggygaygttttttttttygtyggggaatygygaygtttygtttgatggaagtgtgtatttttttagatttagagggaaagttggagttaaatagtagttataaagttggttgtttgaaatgtggttaaggtaaaatattygggggatttttttgtagtagtgggtttggttygttttggaaaggtyggatttgattygtgttgggtatttaattaggagtgyggtttttagggtgttttttttyggtttttgtttaaygagtttggagttaatgygttaatgggttattttggtagygtaygggtygttttyggtattgtttttttttttttgatgattygagtttaattttttgggttgagttgttttgttttygttatagtgtaaggagggaagttgataggaggaggagaygtygygttgtggtagggagttttgggatttaggggattggaagagagtygygygttagtagttggggtygttggtgttygggatttygagttatggggataggagttaaatagtygaatttttagygatttygtttygagygaagygg

SEQ ID NO: 6853 - DNA, 819 bp, Artificial Sequence
  Description of Artificial Sequence: Synthetic polynucleotide
ygygggggyggyggggtgatagttttygtgtatgaattagttattttttaggtttygtttyggygggggtyggtyggaygttygtttygtataaagygggtattygggtygtttggagtagaaagtygygtattttttttygttaggygttttttyggaygttttgtttagygggtygttygattttttgtattatggatttygttygttttttggggttgtygattttgttgttttttttgayggaggttgtattgggygatgttgtttaggagttaataggtatttggtygttttaggagtttttttttttaatyggyggagagggygtagygggttatggggtttygtgtaggygttttttaagtttygttttttttaggtttttgtygygygtttygttggtaggggggattygtttttaagtttgtattttttttgtagaggttttttygttyggaaggggatagaatttttygggatgttttttttttttaggagttaygtttgattatttttttttttttttgttttttttttgttttttttttaggaaataaygyggagatttgttttttgtttttagattayggattttgtygggttttattttttygttattattaygataggtataygtagagttgtygttagtttttgtaygggggttgygagggtaaygttaataatttttatatttgggaggtttgygaygatgtttgttggaggatagaaagtaagtgttttgygygtatttaggattttygygttttttgygtyggyggttggtagtagtttygttagttttttaygtttygt

SEQ ID NO: 6854 - DNA, 1128 bp, Artificial Sequence
  Description of Artificial Sequence: Synthetic polynucleotide
ygygagggtttttagyggttygyggtttygggyggatttttagaaygagtgygggtygttyggattggtagattgygagtttygaggggygygggaygtagtyggtttagataaagaaatyggygttagyggtygtttttgtygttttttttttttttttaygtatttttttaggaaaaatagggtatattgayggttaaaggggttggtttttttttttagatagttggaygggaggtgttttttgyggggttttgaygtttttygtagaagagtygygggtttagyggttttygatagygttttygtttygtttttyggygggygtttttttttgttttttygggtgygaatygggygttggtyggggatttyggggaygygtgygtttttygtygygygaggtgtygtygagttagttygagagggyggggggygggyggggyggygygygggggygggggagyggtygggataygtgtggyggyggygggggggaygyggygttyggggttttaagaaggtgtggagyggggygggygtttttttaggtttggtygaggggygtygygtagaggyggyggyggygtayggaggyggtagaygaygygttttyggygttygtagtttyggtttygygttttygyggtttaaagtaattttgggagtygtygtttttygyggaatttttyggygggggttygtttttaggttygttttygagttygtttygttttygttygtttttttttygtttttttttygygtggttttttygtttyggygtttttaaaattgaatgagygagyggygygtagggygygyggyggyggyggyggyggyggyggtatggagygtagtggttgggttyggtagattttttttttagygttgttgttgggggygaygttgagggygygygyggyggttggttattattttygtttttygttttttttttttttgtgtatttattayggggagttggaaggggatggggagtagggygaggtgtttatttttttgtatattgygggtaattttatttattaygtttygggataagaatattatggtaggtatygtagtattttygygttygtygtygtygggtgygttygttagygt

SEQ ID NO: 6855 - DNA, 1128 bp, Artificial Sequence; identical to SEQ ID NO: 6854
  Description of Artificial Sequence: Synthetic polynucleotide

SEQ ID NO: 6856 - DNA, 1128 bp, Artificial Sequence; identical to SEQ ID NO: 6854
  Description of Artificial Sequence: Synthetic polynucleotide

SEQ ID NO: 6857 - DNA, 1921 bp, Artificial Sequence
  Description of Artificial Sequence: Synthetic polynucleotide
ygggygttgttttttgyggtttttttygtygaggtttgtgygtggyggggtttttaggagyggtagttygtgyggtttgggggyggtttttttttygtatygtagyggggygtgtaaagygtttgyggttgtagtgtgggygtttattttaygtgttyggyggygtgygaggagtagtaatattttttgtgggygatgaaggtggataggttgttgaatttgatgttgtaaagayggtagtatyggtggttgtygttgggtagyggygtyggygtgtttttgttgggagtttggaygtttttgttygagtaggaggggggygtyggygggggyggtayggtttygggygyggyggtyggggaygggggygggtygggyggyggtttttggggtttygggtygaggtygtttygggggttaygggattygggttgyggggaggyggygggggygggagygggygaggggtygyggtyggtyggygttygggtttygattttygggtyggttaggggygygtygagtagtaggtygtgygttaggyggaaatgttttagtaggttttygygtatygggtygttyggggggtagtaggggtaggyggyggygggtaggtygagygygtygggyggtggygtagyggggtaygagtattttttgtgygttaggtaggtttygaggttgtggaagtttaygyggtaggtygtgtattygtggtagtyggttagygtyggtgtyggggtttyggggagygggygtygyggttttttgtttaggtygatggggtygtyggtygyggggtygggygagygygtaggggygaggtyggggtygttttygttttygttttygggtygyggygattygggygygggggygtggtygggyggyggggggggyggggygtyggtygygtgtagttygtagagtttgyggygtttgygygtgygtataggygyggygggagagggggtygggggygyggtyggtttagggggtttygggggygyggtyggtyggygyggyggygggtygtggygygaggygtagtagtatygtttgtgtayggtgtaggtttygtggyggttgaagyggatgttgtaggtttygtatagygtgyggttggggtygtttttygygtygtttayggagttattygggttttggttgttttygttgtttyggtygttygygtygttttygggygtggtygygtttttagtttttttttygygygtttyggggttyggggaygagygyggygygtygggttyggygggttggtyggggggygygygggtygggtyggggggygttttgggtttgygygyggtaggygygttttygggygtayggyggtttgaatagtagaggygtttgtgtaygtagtagttgttgaygttgttgaaggtgatttygtattygaagtaygtagygtttttgggggtttyggggaagagttyggtttgygygtygtyggygttygygttygygttttgttgtagtyggttgtgtattagttyggatattttggttaggattttygaggyggggggygtygygtygggttygaataygtattgyggaaggaatagggtttyggttaggtttagttygtygggtatygggttggagttyggygtggggttggatagttyggttttgattttggtyggggyggggttgygyggygayggygttygygayggggtttggggtttaggtttttyggggtttaggatgggggtygttttyggtttttttatygtttttattttgatgtttttgggggtygtygggggttygttgttgtttttattttgggttagaggtttygttttggttttttygttggtggtttyggttagggtttttttgtttagttttggygatggggtgggygttaggtttaggttygygg

SEQ ID NO: 6858 - DNA, 2872 bp, Artificial Sequence
  Description of Artificial Sequence: Synthetic polynucleotide
ygggtgttagggygygttgyggtttygygggtgggtagaggygygtagaaaaygygygggtggygygygyggttatttagtgggtttygttygygtygtyggygtygtygtygtygtygtaygtgygtygtygtgagygygaagggygttyggattygygttttgttygttygtttgttygtyggggttattgtggatttttaggtaatagttaagtgagaagttttttttattatygaaaggtgtttgygttttttttaygtttttttattaagtgtygygaggtgygattttattttaaatttatttataaatagttaggygatttttttaaagyggaataaaagtaaaattaggttagatatygggggaagtyggtygtgttaaygygtggatagggaaaggaaygygattaaggtagtagttatttttgtgtayggttatttygaagygttagtagggtttaggagttttttgattttagaaataggagtgttttttttttattttttttttttttggagaagtatttttgagatgaaygttgaagtgtttaatttagaygygagaagygtgtatttgtttaattgagtaaataaaggttagtagttggattaataaagtgtgtgtttttaatygttagatgtttttattgttgttttttttttygaggttgggggtgggggtgyggggaggaaggggaaaagataataaataattaaaaagaagagagtaaataaatatatatttggtgtttygatatatatttttttttagtygaggttttttyggaygaagtaatattttgtattatttaaattaaaaattattygtgagttaatagtaaattttttttttttattttttttttttttattataaagtaaaatgaaagagaataataagtggtgatgttgggttyggaatgygattttaaygtygagtttaaatttgatatatgttatattygtttyggtaagtagggygttgtttttggggygaaattttgtygttatygygggaggagygyggagtagagtaaagtygtagttyggtttagygtggaggtggttgggatagggtggggtgyggaggtgtagygygttagagtgagggttaagaaatttatygygatyggggaygtygtgggtagygtttygggaggtggtattygyggyggygaggtagaagtttttaaataatatatttaygygygagttygggtagttgttgtygygagtggggggygygttyggggagggggggggtygaggaagtygtagttagyggaygyggtygtygtataaataatyggggygggygttygygggygggttgygggtggygyggggttagagttagggygaagyggyggtygyggagttgtaygygtyggygtgtttygygttttttyggaggttygygttgtttygygtagtygttttttttattyggatttgtgtgtgtgtgtgtgtgtgtgtgtgtgtttgtgtgtttgtgtgtgtgaatgtgygttggtaggygygygtattyggtygygygygygtgttgttggtaatgygaattgtatatatattgttygyggggttgttttttttyggaggggyggggtgggggataggaygtygtagaggattttgaagtatygtyggattatttgtttgttttgttttattttgtgttgttattgtygttgttgttgttgataggtttggaattagttggttaggatgtttttttttttygtttatttattttttttygttttttaatttttttaaggagggggaaaygyggggaagaatattgttyggatttgtagyggagttttttggttgaygttaggtttatttgttatgtaaataattygttggagaatttgtttgtgttaygttagatttttttttatttttatttttttttttattttttgtttygttttttttagttygttttagayggygagttagggaagggggtggggagggaggygagaataaaatygtatgttgtattggtaaagtygagttgtgtttgttgttttttggtagtttttaaagtaygtttttttagtagayggagttgttggtaaatgaaataggggattttatttgaagtgtagaaagtttygaagggatttaaagttttyggtggtagggagttaaaagtatatggtagtyggaaagggagattygagygtgygttaaagygttgattggtttttttttttayggtgtgygtttttgyggtttggggtggagagaggtygagtgtttttttttttattgttgttttggtttttgttttatttgggttaaggagttttygggttttttygtggtygygtagtttaggttatyggggygyggtttggaaggaaggggtygttaagttgggatttagagagtttgaggttttygggaagggttttattagtgattgaggggagtaaaagtaatyggaaagaaaggaaagaagaaayggttagagtttgtttygygygtattttaaagtygaggygttygygtgggggatgtaygggtttagtygttagttttgggtttyggtttttatttatygggtgtgattyggttgggyggtttgtttgggatttagggyggtgataggggaaaggtygagggaggagagagygggtttyggaggggaygtaygatyggaattttggygaggggtttttttyggagttttagtttagaggggggttagygtttttttttygtygttttttttyggttttttttttgttygygggtygggygatttttygtyggtygtttttttygygygtygtagattgagttygttgttttgttygtaagttagtygtaaagygtggygtttygagaggygt

SEQ ID NO: 6859 - DNA, 2906 bp, Artificial Sequence
  Description of Artificial Sequence: Synthetic polynucleotide
ygygtttygttttttttggttygttygggtttagggygtygtttgtagttgygygyggtygtttttagatggaatttttttattaaygtaaggttyggtyggagtagttattygggagttgggyggygaggggttatttttttttatttyggygggtgtaggatyggggggtttgggtagtaattagtggggaggagygttggattgtgtaygtygagttyggtaggttttygtatgyggtatgygaagggaatttygaggtttttttgtagaattygagtayggttttttyggagttttttgtttygygtttgyggttttttgaattattttaataaaatgatygtttyggtagttatttatgtttttttttgygtagtgttygtagyggatygygttgtgtggtatttygagttttggggattttgttgtaygygttttttagattttygggggyggggagtggggagataatygttagagtygyggggygggataaatggyggaatygtygygyggygttaggtaaattttgtaagggaatygygyggtttgtyggttttattttaagtattttygaaaagaaagtatgtggygggatatttgttatttattatgtgttattttyggtgaygttttttggagttgtgtttatyggggattygggttygygggtgttgttygttgtgttygggygggygtygygttttttygygtyggtttygggttygttaggtagtyggagtygttgggtttttttataattatatttttttttttatygttttygtttttttttatttttttattttgtagttgggttttttttttttttttgggggyggggaaggggggatgatttttaaaaattagaattattgatatttttggttttttygtygttttaggttgaagagyggagggggattygygggtygagggtttttttttttgttygygttagggtygttgggtgatatygaaatttagaggttttygtttttygggggttttttttttygtttttygaggtgattggttggygygaagygattggygatttygggygygattttggtygyggtttttygygtygygtygggtgaatggtygygggyggaggatygggaggygtygggygtagattaatygyggtygtyggtgggagtatttgttatttatatggaagagatttggygtttgttaggttagtttagtttttttagtttagagattagttataagtgyggtygttgtgttygttttatgyggyggyggyggyggyggyggyggygttgatatggagttgygggttttyggygggtttttttatygygttttttgyggggagtagggtaagattygtygttyggtagtagaaagyggtttygaggaaagtaagtgtygaattaygggataaaaagtttttggtttttaaatttttttaaaaygttttgtttgttggaaaaggagaattttttygttttattttttttttygtttttttttttaaaattttttagyggatagttaggtgtattatttttttttatattattttagtgatttgttttttttgagtataagtagatggttttgtatgttygtagtttgtgagagaaatagygggyggaggtgaygggaatggggggagaaggagagtgggtattagggggygaggggttggtygggtattggagtttgattgggtgtttgttgattttaygttgtaaagaataaggtagttattttttttgtttgtttatgattatattatagtaaagaggtttagaaaagagggagattttattyggaatttttaaggtttggagatgtgattttttaaaagtttagtyggygaatgggagattgaagggtgaygggaagggggtaggygygttyggygttttgattgggygtgyggyggtaggattttaaagygttttgtttyggatygtttgttttgggtgatttttyggatttgttttggtggaattyggatttgtttygtygagatgaygaggtattttygtttygygaatttaataggagggatttttgaagttagyggttttygggatgagtyggggtaattttygttttttgagygtgggttggatggatgtttaattaggatttagggaggatgggggtygygggggaagtygggygtttyggggttttygatatttatattttygtayggygtaygttttgtttygagtttgygtttttygagttagtayggygagtttgggattttygtgttttttttttgtggttttygagaaaygtyggagtttygtgttttgttgggggttggggggatggagaaaaggtttyggggattttgtttaaaaagtaaaggtaaaygtattttaatagtttttyggtagttttygyggttggygyggttttagtttygggyggtttygygyggggygtgggygygggygttygggyggttaggtgyggygggggyggaggttgtatttttagygygtyggaatgtttyggggygygggaaaggtaaaagtagtttggygttttttttayggttttagtttttatttatttagaattyggttttaatagtttaaggaattgagaagaaaaaggaatttgygttgggaaataggggtttttggygggttgagtggtygttgttatggtagagatagaaayggagaggtagagatggatygtttagttatgttaagygygaagtttattygtttagttagaaagttyggatattttttgagtttygtatagttggtgaaaaaataatagaattattaaaaaagaaaaaaaaatttttttygtttgataygygtttttttggtgtaaatgaaatgyggagggataygygagttatttagttgygtaaaatygtattttygygg

SEQ ID NO: 6860 - DNA, 2906 bp, Artificial Sequence; identical to SEQ ID NO: 6859
  Description of Artificial Sequence: Synthetic polynucleotide

SEQ ID NO: 6861 - DNA, 1696 bp, Artificial Sequence
  Description of Artificial Sequence: Synthetic polynucleotide
ygaaggaggggttggyggtagtgtagtagygaagttygggttttyggttttgggagtttygtggtttyggtygtygtttttygagtttttattaygtagtttygaatttygaaygygagttygygtttygttagtagttagygggggtgaggatgaygygggtygggygagaggtaggttaaatgtagtagtttygtygygggtygtygggtttttgagtttygttttttagagttagggggtttygggtgygggtyggagggygggggtyggygygggttttttygtygtagtttygygtygttttagtttattagyggttatttaattgtttttttygatyggtttaaaatagttgygaaygtttgygatttgygygyggttttttatttgaygtttatttyggttygttygttygttygttttggtttygtttygttygtttagagggggyggggaggaagyggttyggggaggggggaggggggagggggagagaggaagagaggaggaaggaaggaggaaagaggaagaygggyggtyggaggygyggggttgygyggygtyggtyggygyggygttggaaggygtyggygttaatttygygaggtaggygayggagggggagyggygttaatatataagagtattgtattaygttaatttttttttagaatagtatgygttagtagtatatttaygttttgattgaaggataaaaggatgagagagtagtttgygtggttgtygtttgtaatatygygagttyggygygaggaggagayggtgggygtygygygtaggggtttygttgttgttgttgtygtygttagttagyggggattatgtttttgggtttyggagygtttttygtagtygygattttygttgtttaygtygttgtagtagttygttggyggygyggttattgagggygtygggagtygaagtygygaattygtttttttygtataaagtyggagtyggyggygygtygggggtygggtagyggygggyggygaygggyggttgygygtygtygggggttgyggtygtygtygtygtyggattygygttygttttyggattttttgaaggggtttgyggtgygggygygatygygggygtygygygttttttyggtyggyggatygggttygagygtagtygttaygtygttggttttygggggtyggayggagygtygtttygygtgtyggtagtyggyggattggagaattgatttttygtttttgttttttttatttttygagaagaggygaggagaaagggggtgtgtgtttggggagggygaaggygtygygaatatttttttttaattttygtygtttygygagtttaygatygtaattagttgtygtyggttyggagyggtygaygtygggagagggagygtagtatttagygagtgyggtttgggyggtttyggggygttttygtatttttttyggyggyggttygtagagygggtyggggtygtyggagygtattttggygatgaagygttttttttygyggttggagygagtyggtgttagggtttaaggataaagtygggaagygttggtggygtygttttttgggyggaggggggggtatgtatttgtatagttygtygggttttggtttttttaggygygttttaatttygyggtttygtyggtttyggtttygg

SEQ ID NO: 6862 - DNA, 2054 bp, Artificial Sequence
  Description of Artificial Sequence: Synthetic polynucleotide
ygayggttagygtttagagttgtaaatttygaggyggttgagygtttttttttgagygygygtygtgygtttyggttatttatgtatgttttttttttygttttatatygttatygttagggtagtttygtgygggtygaggggatttaggggggtgtyggtaaaygttggtgyggaggagagtyggtaagtygggyggyggygggtgggagtatgtagggaggygttttttgttttttttgtyggtygttttttttygttttagatgttagtygygagtttygagttagygagagygagttagagagggagyggyggygggyggygggyggtagggaggagaggaggygaggygagggagggaggaagggaagtagggagggygggagggaggagaggaggatttagagagygttaggtagttggagtttttgtagygtttggtygggttttaatgtatagtagtagygagtygyggyggtagtaggtagttygggagtttyggyggyggtygagttagyggyggtttygttttttgttttttgtaaattttgygagtagttygttyggggggtygggggygygttygggaggttyggttyggttygyggtygagtttttygtygtygtagygttagtygtygtagttattatygtygtagtttygtgttttttyggggagtagtyggyggttttygyggttttttagtttyggttttagggtattgttyggygagtgtttyggtaagggtgggggttgtygyggygyggtyggtygygggttgtyggggggyggtygtygttatttagagaggygygtagaggygtygagagygtttttyggygggtttttygygtattygtygygttygggtagyggttygatygggygagtatgggyggygyggagtgaygtygttgtgttygtttggtattaaggatatttagttygygggggtggggaygaaggggggtagttyggygtygttatygtagttttygagagtygtygtygttgttygggtttyggggttgggtggaggaaaggggtgttyggaatygatttttatttttygatttttttgttggatattaygtttattttggaygtygtaagagaagttgttaagtttygtaggttttgattyggygtttttygygtttttyggttgttttyggtttttttgtgtttyggtggagtatttgygttyggggttggggttggaggaggtagttataygygygtataygtataygtttagaggagggygagaggtagyggtataggttttatttgtagtgttaatgyggygttttygttgaaggagggaaaygyggygygtttaggtaaggagtyggttygtyggggagtggggtygggygggyggygagggtagtaaggtyggatagatttgggtygattygggagtttttagtgtttyggagttagttygyggtataygtataygtatataygtaggtatatatatagatttatatyggtatatayggygttygygtatttgtttaygttttatttggaygttygyggaggtgtagyggtyggagtagggatttttygggtgtgttttttttttaygtttttggatttagatttttttttttygggattttyggggtgggattttgtgtattttyggttttgttttttattyggggaggttgagggagtaattttttagtttttagtttttttygtttttagttgggttttaaaatgggagaagttttgagaggttttyggagatttatttagtgttatygyggtttygtggtttttggatattttgggattttaaygggagatagatttatagatattyggaygtatatttggagagagtggtggtttagygttyggggaggaggttagataggyggttggggttgtagttttgtagggyggygtatatgaaatagatattgygtttttttagtaagaggtagtataaaygtttttttgaagygtggtattgttttttygggaatgygtygagattttaggtagaaagyggtttaaagtatygtygygt

SEQ ID NO: 6863 - DNA, 1258 bp, Artificial Sequence
  Description of Artificial Sequence: Synthetic polynucleotide
ygaataaygtagyggygttaggygttagggtttttatttttgttttttggatttttttygtttttttgttttatygagggttttgtgattygattttatygaattaatygttgtttatygagggtttgttgygtttaaggaaggtatygggygaygagtaaggyggggaygtagtttggggaygtaggggttygggttttagtttagagataggaggtyggygtttygatttggtattygtygaygaatttattttaaggtttttattggyggagtttttgttatttttttttttttttaaatgtagttttygttattttttygygtttaggggttgttgtttgagtttagttttgtttattggagggyggyggtggagagggtgttggtttagygtyggtagttgggtttaggattaaggtgggygttygtyggttttggtttttttagttttayggtgtaggatttagggygyggttattygagtttttyggaygtttttttttttgatgttygttgtttttgttttggygtttttagttyggggtygtagtttgttttttttttttttttttttygtygtagttygtygttttygggtagagtttatgtttagtttgggttttygttygggatttaggaagaggttggyggggttggagggtgygggtyggygygggagggygygggaggyggggagyggyggtttttgattggtyggggygggggagtgagyggagttttttataatgtttyggtgyggtgtagtygyggatggatgttgygggaaggggttgttatttgttgtttttgttagyggygygyggatttgttygygtttttgtagtygtygtygtygtygtygttagttygttyggtttttgtagyggygtygtttgygtttttttygyggtygtyggagygggygttatgaattttagtttttyggygggagaggagaaaggggygaygggyggtagtagtagtagyggaagyggygtygggagttgttgtttgggygtygagggyggygyggattygyggggygtagggttagtygyggyggygggggtygttgttttggaygagttygyggtygtyggttagaaggagaaggaygaagygttggaggagaagttgaggaatttaatttttyggaagtaggtttygtataggtaggtgyggggagtyggtagtygagataggtgygtygyggygggagatttatttttttatttagtaaggggygttttygygg

SEQ ID NO: 6864 - DNA, 628 bp, Artificial Sequence
  Description of Artificial Sequence: Synthetic polynucleotide
ygyggtggttttyggtttttttttattttattttaygaatyggygtttggtygttttgaaatgaatgatttygtygygtttyggygtygygtttttagygttttttttygggatagyggttaaggtgattttgatygttttygggtygygggtygggtttgggtaggggtttttgggttaggagagggaggtygtttygygtttattttttaaggtygttttttagttggtgttgttttygtagttygattyggatygtygtagtagtttttyggggtygygggttttagtttttgygggygaaygyggtttgggggyggygggggygggygyggggygygyggygaggggyggyggyggtygggttygygaggggggttttygggtyggttttatgyggggygtttygtygygtygygttygygtttttgtatyggggtgyggggtttagttygaygygtattyggygtttygygygttttgygggttttttaggtyggtttygggtgggttaggatygyggygttggtaggtyggggttgagttyggtttttygygttggagtttttgygtygggtgtygtygyggtgygtttagygtttgtttygtygagtygtagtttttaygt

SEQ ID NO: 6865 - DNA, 1075 bp, Artificial Sequence
  Description of Artificial Sequence: Synthetic polynucleotide
yggaggttygttttygttaggggtttygggggtgygtgattatgaattttagagggttgggttttgatttgagtgtygattygttaatgaggaygggaggataaggttgtygaygtagyggaaggtaggggggaagygattygaggatttgaygattatttttaggtaggggttttttaagtaggtayggaaattaattttattaaatygyggagtggggattgggttygggyggtgtttagtagggtaggggtagggttagttggygygtaggtatttgtagggtggagtagaataatygtggggattygtttttttggaggggtattgtttattttttatatgagttttaggatattttygtggggyggagtttyggagaygttttaggttaygttttygtygttttatttttgtttgyggggggtygagtagggagggaggtttagygygygttgtgtgttygtagtgtttaygggtagyggggaygtttgygttygggttttygaygygtagtttggagagttgyggagggtgtttyggggttatatatttattattaattgtatttaggtaggtttttttgtttttttyggggtygtygttygtgggagggaaggtgtttygtttygatttatttaygygggtagyggtgtttttttygtttatygygttatyggtgaygttygtttttgygttygtaggtgtayggttaggtgttttatatygtttygtaygayggygttttgygtttttgggaygtgygygggtttygaggtgtttygyggtttttttygtttatgygtagtttttygyggttttttagtaataaggtgggttgygtygtygygtttttgtagtyggtttgatttygyggggtttttgtagaygttagtttagatatttagyggtttttagagygtttygttttgttattygyggtggtggygttygatggtyggygaggggygaggagygaggaagttygggygggaggagagttygtygtaggygtttggtttttttttggtggttaggaggygttgggagygggagtgttygttttggggatygt

SEQ ID NO: 6866 - DNA, 5566 bp, Artificial Sequence
  Description of Artificial Sequence: Synthetic polynucleotide
ygaattagttttgtygttggatttttggtygttgttygggtyggygttagttttatataatgtygygtgagtttttgtgygtgtgygygggggaggttygagatgtttttttttyggtaagttttygygttagtatygttttttagtttygygggttttttygyggygagtygggaygygtggttttygygggtttatttgaagaaggtyggttygagtagygygtatagtagatttaygtyggttagagtatgggttgygygtttaggttggygtyggtttgygagttgttygagttygagtttatygataggtygtygtygtttaagtygygggttttgagygattygtttagggggtygtyggggtygtygttttttttggygttatygtgtagygagagygttttggagtygtttttttygttattyggagagtygttgtyggyggttgggagyggttygttygygtygggygtatatggygggttttgtyggggttttygggagttygagtttaagagttgtttygagtygttygygtygtygttttttttygtatygttygygtygttttygtygtyggtttygtygttttttttttttttygygttygtatagtaggttttygygttttttygtyggtygaattygggtygtaggatgttgtygatgaagaagttggtgatgyggtgygggtgttggtggttgtygggygtttgtaggatygygggtagtattagagttygtyggygttyggtgttygtttygttygggttgttatygtygtygtygttygagtygtygtyggggttggatttyggttgtygttgtttttttatygtygtygttgtttygttaggtttggggttatttttttttatgttgtttatagtaaattttatattggtttttyggggaygtttttttaaattagttttyggttttttygyggygtatayggagattttygygtttttatttygtygagtttttygagggygtgygyggyggtygyggttagggttgaggttttataagtygtyggtygygttyggygyggagttatttttgaatttaygaattgggttagaaatattaygagtygtttygttygtttagaygatgagagatttaatagagttaagttttygatttygtygygtagtyggggtttagatagtygtagtggttyggyggggaygygggtygtttttygggtttttygttttttttygygttyggtygtttygggtttyggygtygtygtttgggtygttyggggygagagttgygygtatgtaggtagygygtttttyggygtttaygttygttygggtyggtttyggtygtygtygtygttyggtygttttygttygtaygttttagtyggttttygagggtgtygggygttygyggttagygygttygttatygttygtaygtatatggaggtttttttttygyggtygtygtttygttgygggtyggggygttttatyggygtgyggtygygttttygtygagtttygtagagtttygyggttygagtygtatgggtgagagaygygaggttagggttyggtygggtygggttgggtygttygygtttttyggtygttygtygttttygtygtttyggttttygygygggttyggaaatttttaggttattyggygtaatttgagatatttttattttggatttttgtttttatttttaatagagttttttygagtgaygtygtaggtyggttttttggataygtgtttygggttaatggtygyggygtygygygtttaygtgaygtttyggtygtygttgggtgataggagtagttygtygttttttttttttttaaagyggtygygtttttygtttygggtgygggagtttaggaattyggagagattttygatygygttttttgygttygttygygttttttttgtygtttygyggtttaggggtgtgagttattyggygatagtttygttaggttatttyggggygygtaggtggataygtataggaagatygttatttttaagatttttatattgtttatygtggggygaaattttataattttttgtataaaatgtataaataatattaaatgagttgtygagatataaagggatttttgtggttygttttttttgttgatggagaggaatagtgttatttttatttgattyggtaattyggtagttttttgttttaaaygtagagttggygygtaggatattttttttgtagatatttattgtaagtgtgygtgtgtgtgygtgtgtagggaggygygtgtatayggtygtattttattyggggatagygatttttatgaaatatgtttagygattygaaagagygggggaatgtagtatgyggttttatttgygaagggagaaatttaggagtttyggaggttttaaaggaattttttttgttaaggagaggaggggtgattgtttagttaagattttaaaattaagtygttygtttttttttaatttttttattttgattgaggagtttttagatyggttatttygttttttttgttttaaaattttttaaattaattttgtyggagagtagggtttatttgaaaygagaattaggaatttaayggtaagggtgggagttttagttggtttttttttttttttttttttattttttttagattttttttttagttgttgttagaatgtttaattggaagttttgtttttttttttttttttttttttttttygggtttttttttatttgtttttgtttatttattaaatattygttgttattttaggttygtttgtttattatttaaaatgtatttttatggaaatgtgtgaatttttggaaatattygatagggtagttttgggggtgygggagtatttgtaygttatgagtatttttagtgygggggaggyggggaggtygtagtttggtayggatattttagggttgattggttttgggtagttgtatygtgtttagtaatttagattttygtagaggtagttagtaggttgttgttaggttttgagtgaatttggggagtttggtaagtattttygaggtagygtggtttgttaggttatttggggtttgaaggttgtattttggttttgygaagttttttttttagtgtttattttaygtgttgttttttttttgtaggttttagagtgttggttgggttgggatgagaaaygatagtttttatagttgtttttaggaaaattatttttttatttaggaygggaatggtgggggaggaggtgttgggttggttttttggttattggaygtggttttggttagagtgtgttttttgttyggtgtgtttagggtagggtggggaagttttttttygttggggttggatttttttattttttttttattggaggagtttttattaaatgttttggttaggtatatatttgttaggggtttttttygagttttaaaaaattaaattttatagtttatttgtttttygggaaaatagggttggtgagagtttgtgggaagttttattgaygtttatttggttttttggggggagaattttttgtaattttggaaattttgatgattattagttaggaaagggagggtttaaygattttgggttttttgaatatgatattggggggaggaggggttttgagttttttggtttttgtaaaattattttaggttaatggttttatttgttttatgaaagttaattaggyggttttttgagaagtattttttgaatttttgggattttttgtttttgattgttttagtataaatggttttaagaygttgggttttagttttgtgtttttttgygatttagattttaattygtggttgtaatagagattttgggaagtagagygttatttttagggygtttggygggtyggtgggtagagatttgttttygtagggtttgygggttgggttttggggttggttggaggaagaggaattygtgggtygtttttttggaaaggaggaaggtgagaggtggagggaggaataggagaaagagaaataaatgaagagagagataattagagggtatygggttttttagagtggatttaaataygaaataattttgggaaagyggtaagaggggttatygtttaaagggtyggggaagttgggatggggttgtagaaagttgagttgtttaggggttgggyggtgttgagttttatatatayggaatttygtaaggtgttttaggaagtttygagaagygygtatgaggatyggtttyggtygtttgttttagttgggayggygtttygygttttttggggatgyggggtagtggygtgttttttttttgygatgttagtttyggttgtygygttttygygagtttagagttttygttttttttttygaaygatygtygtttttaaggtyggtttttttgtgyggattagaygagtttttttyggatattagtttttttygggatggaaagtggggtattgattygggaatttygttttttttttagttttatttaggaatyggagagygttygygattattygtttgyggaggayggttttttatattttttaggttygttgtataaagaggggtttyggagagggygagtaggaaagtagtttttagaygtygtgygttttaggatayggaygttagttttgtaaataaaattttagtgaagygtttyggagatatygggygttyggatgtygagttaggttttygtttttatttgaaaaygaggttagagaagggtgattttttyggtttttttgygttttttttattygtttygtttttttagtttgaygtggtgatatttggaaaaatggatttaatgaaagtygttygttygyggyggtttygttattygyggggtagagaygtttaataatttttgagagygagatttttattttagttaaagtaggtttggttagttttgygttttyggttgggagtygagtttygtagttaagttttaggygtygggyggggaattggggtygataggagagtaatatttttttyggggygagtagagagttatygtyggtttttggggttgaygtttygattyggtttgtagataaaggtygaaaygaaggggygyggggagtaggggtggggygggyggggttaaygggyggatattgygtgtttgygtttttttttgggygaaggaggatyggtttataggtttatygggygagttyggggayggggtttgggaggttgggtttagggtttgagatttttttagaataattttyggaaggagggggttaaatgyggtagyggygggtttgaaaagggttaggagygtygtaggaattggggtgtataggttttygygtgtttagygtttygttttttttygttttaggtttgttaggggygygygtggygygggtagagtttggtgggtgggttggygyggatagaagttttgtyggggagyggggaggggggggtagtygtattgtaygttttggttttgtttygatygttggagaagygt

SEQ ID NO: 6867 - DNA, 5566 bp, Artificial Sequence; identical to SEQ ID NO: 6866
  Description of Artificial Sequence: Synthetic polynucleotide

SEQ ID NO: 6868 - DNA, 1164 bp, Artificial Sequence
  Description of Artificial Sequence: Synthetic polynucleotide
ygaaygtttggattttagygagygggyggttttttggyggyggtgattatygttgtgttygttgtttttaygyggygttygttaattttaygtgttygtagtygygyggyggggtygggygttyggagttgattttagtttttaggatagaaagggtggttaaaygtagatttggtaatttttygagtyggygattatagattgttggtggttgygttayggtttygggagggttagtttttygttgggtttttagggtattaagaaaagaggggtatgygagtttggaagttggagagagttyggggttttttagagygggtgggaygtygygtttttaggatttygygttaygygtattttttttatttygatatttattgttatttttatagyggagygaggggtttygtygagggygagygtatttygtgyggttgagatgttyggaaygttttttygygtttyggtttttttagaaggggttatagtyggttygygagttttygggygggggttgagtygtagtgttaattaaggygaggttattttggttygygygttttttattttagggttttttyggtagagaggtgattgtaggttatygttagtygggtttttatttttygttttygtygtttyggtttttatatttyggaattttttyggyggagtttgygagttygggaaygyggttttagttagagtggaagggatagygygggaattyggtagagagaaaaagygggaattgggygtygtygttttaygatygggaggagattttttttyggttttttttggattttatttyggggatygtttyggggttagagtttaggttgggagagtttttgggygtatttatygttttttttaatttttttttttttatttttagttygggtggtagtggttattygtygggtttgtaggtggaggggagtttgygygtaaaatttayggtyggyggyggttattttttygygggaggyggttagattttggagttatayggttagagttagtaygagtagggttttgttttttatttyggggygygtttttttggaggagttgtaaggygyggatygattgatgagtyggttgagtyggaggttggagagggttggagtygyggtttggygttgagtaagtygt

SEQ ID NO: 6869 - DNA, 1495 bp, Artificial Sequence
  Description of Artificial Sequence: Synthetic polynucleotide
yggygygtattttatatygtttgttttgtgttttaaaaygtygaagttaattttttaygyggttttttgttygattatttatttttgygttgttaggtatatygaggggatyggttttttttttaggyggtttattttagygtttttygttagagggtatayggttttygtgtaaagygtttatggygyggggtaygygygtaygtagtttygatttttatagtttaggttttattttygggttgggtttagtygttaaggygttggggaggggtygtgttagggagygaagygttttygggattttgggagggtgyggtygggattgttgttttttgttttgagttttgggygtaggygttyggtaggattyggygtttaggtgagyggyggtttttaggaggggaagtatygygygatttaaygggygtttagagygtagggygaagaggatgggygagggagagggggagggagaggttayggtatttgaggaggaggaggagtaggaggagtaggaggaggatygtggggttygggtygygttgygtatttatttgggttttggttgttygtygyggatttyggttttttgtyggagtttygttttttttttttgtttttttttttgtttttgttttttttgygttyggatatttygtyggagayggagygttttaygyggayggttttyggygtaggygagtttggtttaagggttyggatygggtttgggaaaagtttgtttttygagggggagagygagyggtygygttgaggygttygygttgygygggggygtttttygttgtttgtagggagygyggygyggaygyggygggyggttyggttatttggaaygggygttygttttggttttyggggttgtttttgtygtttygggaagtygtygatgggttttatygttggyggttygygttttggtttttgttyggygttttygtaattygatyggggagaggttattatygttttgtttaygtttttatygttyggtagtygtygtygtttagtttttggttttygygygagttyggagttttaataagtttyggggaatttttygtyggtttttttttaattgtttygtagttatttatttttygttygtaggttggaggtaggygtttttttygtatttttttttggtttygtttttttttttttttttattatatttttattttgaggygyggataygttatygggaggagtttgggttyggygttttygggygtagtttttttttttttygygttggtygggyggggggtggyggygyggttgtygggaattttygataggggtygttggaygttgygyggagatygaggttagygtttyggagattygggaatttaggyggagattygaggttttygttgttygttttttttygtagttaggtagygtttgggagggttgtttygttttattttaygyggaaaaggayggygtagagaaaagtttgyga

SEQ ID NO: 6870 - DNA, 352 bp, Artificial Sequence
  Description of Artificial Sequence: Synthetic polynucleotide
ygtygtygttggtgggtggyggyggttygggtgttttttggattgygtagtaaagaggtattttgggagatggggttaaggttttagggggtgttattygygaayggtttattygttagattaggggggttttttggttgtgygtttggttagaattggttttgaygatggaagtttttggaattaaagygttgtttttttttttttgtgttatagttggagttgygggagygtttgttttgttyggagttygyggttttttttyggttgtttygyggtggygttaygygtttttttyggagtaagttyggtgygtagggtygggggygtgggyggttgttgttagaggygt

SEQ ID NO: 6871 - DNA, 1141 bp, Artificial Sequence
  Description of Artificial Sequence: Synthetic polynucleotide
yggggattaggyggtgtgtygttygggtagttagtgggtygggygagtttgyggggttggaggggaygyggggttgggaggttggggagttgggggttgatttygggygggyggggyggggtagggatttgtyggtttggggygggygtattagaygagtttttygttygtaggtttttagygtttagtygygtttyggttgygtttygtyggtttygtttygtttygtttygtagagtygtygttagtagtgggagaygtgygttgagaggygggggttgygttyggyggaatagtagttttygggyggagagyggggtyggggttygagagtaggtgatgttaagagttgagygggattygtgagygygyggtttagtatttattagggygtttygtaaaaaatttygttttygtttgtttttgggaattataggtaagttttgggttttygaggtgtagttttaggtagagtttygtgttgggaggtgggaagggggtttgattttggggatttaggtagtttggggatagttttattaggggtyggtgtttagaattggtgagggaggtattttaggggttgggggagaaggagygagygtttttygtttttttttggtatttagyggygygtttgttggtyggaaaggtagygagaagttygttttttttgttttgttttyggygatttgyggttygggtgggagttygtaggtttygggtttttagygtygttggttagggygygggtaaagtttgttttttygygtttagtyggttttttygttttygtagygtygtaggtgtygtttgttttygtttttttgttgtaatygttttattatggatttttygatttagatttttygyggggagtygggttttatttgygtttygagygtttgtttgttttttaatagtagygtttggtttttyggttgggtygagttygatagtaayggtagygtyggttyggaggaygygtagttggagttygygtatattttttyggttatttyggttattattayggyggtttatttygtagtgttygtygtgggtttggtgggtaattygttggttatgttygtgattattyggtgagygyggggatagygtagygttgggggttgggygg

SEQ ID NO: 6872 - DNA, 3297 bp, Artificial Sequence
  Description of Artificial Sequence: Synthetic polynucleotide
ygagayggataggaatygaggagatttttttgtagygttttttatttttyggatagaaattttgtagattaygtttatttttttatttygtgtatygttygtggttygtgggtagtagttgtttttttgggatttttttygtttgttygygagttttygtayggtygygtttttgttgttggggtygttygttggttttggttgttygttaggatttttttttgatgttgttaagttygggaagtttaygatgtattttagtgttygygygtygttttttttaaagttttttttttatttatttttttataagygtggagggagatggggtaggtygyggygtttatagattttttttyggygtttatttttttttttttatttttttagtagyggtagggtygtagygtaygtaaatttttttttaaaaygtttattttatttttagttagtygttttttttagggttttttygttygagttgggtgtggggatygtygygtatatagagaygggaaagttatttyggtttyggagygtygtttttttagaggtttttggttygttygtttttttagygttggaggatagtygygtatatagatttttttttttaaygtttatygyggtttttagttgtagtttgtatttttatttttygtttttagtttttygtttttygttttttgttttttagttttygtagttygggygtttagatttgtttygattttttagggtagtttygagggtgyggaagattaagtgttygggtttgttttaggaaaatttyggyggygtttgtaygttaattgttttggygtaggygaagggtggagggtatttttttgtttattyggtttttaagagygtgaatagaggtttygagtgaaygtttatatttagtyggttttttagggtttaygygtggggygtttatttttttattttgtttttyggtgtttttgttttggttgtattttttttaaaaggaggygttaygattttaggaggttttgtttttttattttttttagyggygtttaaattattagtttygggygtttaattttttttttgttttttttttatttygtgagaaagtygaygtttttattygtttggttttttygaaataygtttygggtggttaatgygatttttagggtttaaagattagattttygygttttttattaagatatygaygygaagtygtagaggtggaatygyggaygttttggtaggttygggatatattgattttggtggygygatgttttttttygtaygyggaygtattygtagttttatttttttaaattygtattgygggaaggaattttygattygtatyggttttygtttygtagtaayggygatattttgaggttyggaygagyggygygttttttttagtttyggttattttttagtaygaagttttagggygagttygagaygaagaaagagagttygaggaattgggatatttaygagtttatygtttattttgtyggtyggggaggaagtttyggtyggttygttttygttygtygtgygtatgygtttygygggtgtttttttaatattgtagygyggagggttgttttttttaygtyggygattgtttatygygtttttygttttttttyggttttyggtttttgttttagtttttttttttyggtttttttttttttttgttttgtttttttttygtttttttattttttttattyggtygggtaattttaygtttygtttttttttagyggyggygtattttatygtygygggtgttaggggtattttygaggttttaygyggggygygatttttatttyggtygtagttttattgttttagtttygtattagtaagttttaagagtgtggatgygaagttaggygygygtagagggygttygygaagttttttgtgttatygttttttttyggygygyggggtygagygagattagagtgtgttggattgygtgttyggatttygtgaatgaagggagygggaggaaggagygggggtgggyggtaggtatggagggggygtttggtttttagagtttygygtttgtggattgygygtttttggagggtagttttttatttttttttyggttyggggygtttttttgagttttgttttygttttatttyggygtagtttaggttttyggttttttygttttggaaagyggttttygtttttttttagttagttagagygyggaggttttatttagtaatygagygggggataagggggggaattaatttttgattttagatttygttgagattttyggtagtygtttttygygtttttttttttagggatttyggagttyggggaaaggagtagattagggggtagygggagggggaatttagtygtttagtttttyggattygtagtatygygtgttttygtagttygtagygttttttygggagtgggattyggtggggtygyggggttagttttttggagttyggagggttaagttgaagttggaaattgatttgatataaaaataatattaygttatttttttttttgtttgtygagagggtaggggagtgggagagygagygttgggagtaggyggaggygygtttgggggaggttyggagtaggyggaggagagygataygttgagagtttgaaaggtagtttyggggaagagygagggttttttttygtttttttggattatggaaaggaaatggtttaggaaaaagtagtttggagtgttttttygyggggaggggyggtgtttygggagtygttaatgtttygttttaggatttgtttagttaygtttyggttttttygattttgttattttttttattgttagttttagyggagygggttagttggggttaggaagaatygggagaggttggtgttttggggaggttgggtgtggggygtagtggagattayggtatttatyggtataggygagttttgtttagyggtggygtttttttttttgggtttggttatyggatgggggggttttagyggaygatttttygagggtyggtygggtagtgttagygtygtttygagtaggagygagaggyggttyggtagtttttygtgttttttygagagtygggyggtyggtagggygggaagtaggggggagaagtttaggygttttyggggagtttygggagggggtygtyggagaaggtgagagaagaattttgygaggttggaaagygggttagaaaggaggtygaatagtttyggggyggygggyga

SEQ ID NO: 6873 - DNA, 2213 bp, Artificial Sequence
  Description of Artificial Sequence: Synthetic polynucleotide
ygaaggygaygggtttaggatttgtagaaatygttgyggtttggggyggtyggggatttayggttttttggggyggttttgaataggttttggggygtagygttygttttttaaagaagtttgggatygggttttgtttygttgtaagttaygtttttygtgagtttataagtgtaaaattagaaaagaatgtttygtttaaataattaaagagyggtggttttygygggggtagyggaggyggttagtagggttttygttttyggggagaagtgtttaygatttaagggttgtttgttttaggaattttttaaagaattatagatattgagagtattyggggtttggtaggaagtgtagtgtattttttagttttagggtaattaggatagtatgaattttttattttgtggtagaataaayggttagygtttygatgtggygygttygatttttttttatagagtttaaaagttaygtttaattaaattgtagygttttygttttagttgggtatyggtttggaagyggtttggaattagattggattygaggaggtaagatttyggtagygygaggttaattataggttttattygyggtttttagttyggttttatygtagtyggyggtagatattttaaattttttataygtygtttttagygaggygtttyggggaaagtagygtgaggtagtgagtygaggggyggggttaggaggaygtttygttttygagttygtttygtyggagggtttgattaatgattttttaagtygttttagttttyggygtagttttttyggtgggttaggtttttygttygatttgttttagtyggtyggagtatataygtttggtygyggggygttygtataaaagttatagttagyggaggttggaaatagtygtygatttgggtatyggtyggaygaggatggagtgattagygyggttttggttatataggttttgttttaygtttttygttygtttttaygayggagyggagttttatttagtygttttaggaaaggtgaggggttygttagaygygtattgygtagttttygggttyggaayggtggygggtgtygtatttygaggtgaggttaagggtttttygtttttygggtagaaattttttttggygtgaaaggtygagggyggttggtgagtygtggtttttygyggygtyggygagaaggagtygygttatttttygtgygtgtygggttggataaagttatttaagygygaaygagtgttgattttgagttgtgttttygagattttttttttygggtagagtagattttttgtttaatttgtttttgaaaagtaaagtyggtattgygtttttttttatttttttaggaagtttaagaatttyggagtttygtaattttttttagaygttyggaagtaaatygygttttaggtaaaaygagttygtttgagagygtttttagtttygttgggttgttggtgggygtayggggagaattagggggttgygtttttygggttaagttygatygtttttyggttttatygtattttyggttttttgtagygygygyggygygggaagttgttatggatygyggtygtttagygggtagtttttttagygttagygtygagttygygtttttggtygtygttattygygattygygtttygggyggatygggtyggggtyggygggttttgggggyggttygygtttygggagygggyggtyggyggyggygaatgyggygygggagygtagtygggtgtagattttgyggtaygtttttttggagttgtagygtaygttgtygttygtgtygttygatattaagttgtttaagttggaygtgttgttgttggttattatttatatygygtattttattygtagtttgtaggaygaygtygaggygtyggyggaygtygggttgggygttttgygyggygatggttatttgtattyggttaaggtaagygggyggggygtatygyggggttggggtygagattaggatattttgatttgttttgttagttatygttttgggtagatgttttaattttttttygggtgaggygggaagtygatygggagaaygatttyggttygygagggtattggtggtaaggttttygtygygaaagtyggttttttygyggtttataggtggttggagaggygtttaaagtygg

SEQ ID NO: 6874 - DNA, 363 bp, Artificial Sequence
  Description of Artificial Sequence: Synthetic polynucleotide
ygygggggttatygygttygygaaygtagagtttataygtggattttygygtttgtgatgtttygattygtttygggttttygtatagataatgtygygygtttttttygtagttatttygggattygygtttygygtygttyggaygtttttttgygtttgtyggggatatttatygatattaggaattttagygtgtttatatagtttygttyggttttttggagttygttgagtaygtataygygtaggygaagttgtttttttaggtttttggygttttyggygyggttgttttygyggttgttttygtttatggtyggyggyggtgygtagygyggygttgttygtygtgttgagygt

SEQ ID NO: 6875 - DNA, 960 bp, Artificial Sequence
  Description of Artificial Sequence: Synthetic polynucleotide
ygtagaaaaygttgtaggggttaggygttygagatatttygyggggtagtgggtattaggtttaggtttyggttgtagagyggaggggygtygggtttaggaaaggggttgtgggtgggggtaygggggagattygaggggtgttgggaagagggtttttttttttagygttagttttggtgtygttgtgtattyggagtygygygaagggygtttttygattyggaggtataggagygtttagagaggaaagaaagaaaaagttatygttggttygaatttttggaagtyggagtygggttttttgttttaaatatygaggtagaattttttttagygttgtttyggtttttttgttatttattttyggtttgtttttggaagaatyggttttttagtttttygtygtygtagttgtgatataagtaagtgtagtygygttgttyggggttygttagggtttttygygttygttttttatygtggttygyggyggtygygttttygtttygtttygttyggtygtttygtyggtttttgtttttagttgggttgtygtgaygaggagaygttgttgtgaaattaaatttgattttgagtttttaggyggyggtygagagttygyggttgttgatgtttttgggttttatttyggggtaggagggyggygatyggygttygggaagyggttgaggggygtygygatttttagygagygtygttygagttttagttygttygggtagttttygaggtttagggygtygtygttaggtaygygaaagttatttggaagggagttgggtgygygtaataatggggttttgagtygtggtyggtaggggagaggtgtagtygtttaaggttygtggygtygggygttgtaygtggagggatgtgttaagggtyggtttgttttttttyggggaggtggtaattgattgggaygtygggggaygg

SEQ ID NO: 6876 - DNA, 1404 bp, Artificial Sequence
  Description of Artificial Sequence: Synthetic polynucleotide
ygttygttttttttaggttyggtgggattagattygaagttaattttygttaggygttaggtgtagattttaggttaggttagagtagtttttgggttttyggatygggatgttygttttgtttttttttttggtttygttyggtttgttatagggggaggtttyggtttygtatttygggtagygaatttygtyggtygaggttagtttygtgygggggtttttygygggatygatygttaagyggtattgttygtttygggygttygttyggttttagaygtaggttttgyggtygtttygtgataagtatattgaygggttattgttttttgaygagtgttaaaaagttygtttgttttgaaygttaatttttaagtgatttttaygaggttttttttttyggttttttygttgttgtttygttygtattyggtttttagtaggtgtttaagaaaygtttagtaaayggtagygtaggygagtttgttttgygygttggygygttttattgtttayggatggygggygattttaygggattttyggttygtaggattttygttttygaggttgtttttgggtygggaggggttattttagaggggygtttattttygayggygggggtyggggygtygygggtaggggagggygtagtttttaagtagttttagtttggtttagatttygygtttagygagtyggtyggttaggtttatattttttatttgtygttygttttaggggaagggttttttygaygaygttygagtttttttttttttyggagggtyggaggtyggygtttattggtyggttttgggygaygtttygttttttygaygttaygggttaatgagygygygttgttagtttattagtygggttggttgggyggttygggagttygagyggtggyggagyggygagtagygagtagygtttgygggagyggtyggtyggtygggttttygygtttygtaygttygtaygtttagyggggttygtattgagtatgggygyggyggtygtgygttggtatttgtgygtgttgttggttttgggtataygygggyggttggtygggggtagygggtttttaggtaagttttygatygaggtggggggyggygggygyggggggttygggyggtygaggygyggtttyggagggtttttttttygyggatttygagttygtttygygyggtttygygttttttgtttttttgtaaagtaatttttagggtyggttyggggygtttttttttygtagttygggyggtyggggtttttgagttyggyggggtygtattaggggtgggtgggtyggggtttygggaggggaagygygagygygggagygaggaagaaaggyggyggttttyggggatttygygt

SEQ ID NO: 6877 - DNA, 1247 bp, Artificial Sequence
  Description of Artificial Sequence: Synthetic polynucleotide
yggggggtaggtygygagagggagaggatttygggagtagaygaagaagtggagtagttaaagtttgygttagaagaggttggggattgygagaggagaggttggggtttgtaggggagygtagtagtttttagtatygatttaaattttaaagattygtggtttttgtttgatttygagggtygggaatagaygtttgtttttgtggagagygatatttaatygagaaaatggggttgtttygagttgggttttgygtttggtttagggygaggtttttttggtttygggttggtttttgaggggygtaaayggtaggtttggyggttggggtygaggagggagggtattatygtttygaggtagtaygtagtttgtagtagaggygtttgttttaagttgttttttgggggygtygtygtygtttttttttttyggggtygttygtttttaggaaagtggaggyggttggygaggatygagagtyggggtygygttgyggagggattatattttygggagttygagggggattttggygyggygggttagtttttgtttttyggttaygggtyggtagygttygttttttttyggttagygtttgyggttygygtygygygtatygttyggtaatttygygygygtttygygggggygttgygtttttttgttatatyggygtatygyggttttttttttttatattttyggttygtattattyggttttttttttattttttttattttttttttgttttttttttttatttttttttttttggygaggggygggagggggygtggyggggtyggggtttgtgtggttgggattyggtttttygtatttygagttygttygaggagtygggtttyggtygttgtttagtygtttygtgtttygygygttttgygtygtygttatygttttttggggagaygtagttatttgttygttatggatatttttagggttttgttttyggtygttttttttattagttttttgtgggatttgttyggtttttagtaggtttttattttatttttttygtygttygtygagttgggttttattaagggtatgygaagtygtaaggaaggtaagatgtagygggygtygygygatagtgaygygggtygggagggttaggaattatagtygyggttttaggaygaatttygggtttagtagtttygggygtaggagtygttaggtaggggttygygygtggtgttttayga

SEQ ID NO: 6878 - DNA, 1861 bp, Artificial Sequence
  Description of Artificial Sequence: Synthetic polynucleotide
ygtttattgggygaygtggggaaataagttttagttttygaagygygattaaaaggagaaattaagtttttatygttagggygggggagggaagttgggtgtyggtaggygtttygtyggagaygagatttttttyggttttagaagygtttygttagggttagagagggygagygtggygggagggaagtttttgttttttagyggttaggygattygaagtygagygtygtgttataygtatttygtttygttttgtttgyggtattttygtgtaatttttatgaaaatgttttttygtttttgaygtttygyggtgtaatttttattttttaaygaggagggggtygtygtaggattgggaatttagtggtyggygttttagtattttyggaygygtttygtgttttttttagtatttttttgagggatygtttattgygattttaygtagtgtyggttatttygttttagtygtagggagtattaaataaaagaatttttgtaaatttttttttttggatattygygggttttttaaatttggtttttatttttttagaatttgtatgtagttaaataggaaagttggygygggggggatggtgtgyggaggaagggatttygaagtttttaggttatttttggtttygaggagygygyggagtggagtygttttttygygggttygatttaggttttttttttttgttattttttttttttygttttttttagattaygtagtaagattygtygagggygaagaagttgggagtgattttaggggtttttgyggttagattaaatygtaattttyggtgtttttattttygyggatygyggggtaaygttagygagtagygtttttttgaggaagggaagagggggaaagggtgatyggaygagygtatttgttttagyggattttyggtgtatatttggggattgggggttttttaggtggygtttttttattttttgygggtttttttygtagttttaaatattttaaayggygygygtatttttygtttggtttatttatygatttygtygataygtaggttattaagtttaaggtgagtaggatttaygygygtygtatattttttagggatyggttgtttttagtygttgtttgtaattagggtaaaaygaagttttttgtttagygttyggygtagttygygtataygaattyggagtagagtatygtagygattgyggtttaggttyggggattygggttyggggttygggggygttygttttttttttttgygtttgttttygtygttygtagttgygtttygggaaygyggygtttttttatttgttggtttttgtattttygatayggagttggtgtttygggaaggttgttttttgaagttttttttgttttgttgtggttttgttttttygyggatttttttttygtgtygaggtttagtttttggttttaaggaataaattygttggtttgaaagggagttayggtagaagtttaggggtagagyggygggagygygygattygygyggttggagtttygggggtatttggagagtagygygtttaagyggggttattggtttygyggttgygtttttttttttttygygtygygttttttttttygggttttttttttttttttttttttttttttttttggtttttttttttttgagtttgtttttttgggtttttttgggygattggggagaggaggyggtagtgtgatttttagataaattygggagaaatttttataggattataygtygattggtagtttygaggattagtgggygtygyggtttygygttgtggttgygtyggttttgtttatygg

SEQ ID NO: 6879 - DNA, 3044 bp, Artificial Sequence
  Description of Artificial Sequence: Synthetic polynucleotide
ygtygagggggaggggttggaagatggyggyggaygtatatttattygatygygatagagtttaggtttttagttygygtygtygttygttgttygtagttattgtgggtagttttgttttgtttygygttgttggtagagtygtttygyggaggygtgggattagggtggygttygtattttttgttagygygttttygttygggttygtttagggagtatttgtgtayggttatattggattttgtgttttagttattgttttagygyggygggaaaggagagggtaygtatagagtttgggtttagttttagtttygttggggtttyggagttaagatgattagygaggaaattyggaaaggygttaaggaaaattatatygtttaaggttygttatttttattttagtyggttttggygtttttttttttygatatatatttttgtttttagatatttttaaaatagttygggyggtyggygttggtygtagttttygtggtttgggygtygttagygggagggagggyggygaattggggygygtaggyggtygtagggtagtgggygagggggyggagggtagggagagaggygggaatatggagttaggtttttatttgagtayggattgtttttttttttttttttttttttgtttatttatgayggttaggatgattttttttttttttttygtgaggtggttgaggttaggtatttygggttgtagaggyggttgagaggtygtygggatgggagttaggyggtttyggggttygataggagtygatatgtttggtggagtygaattattttagggaagyggggaggtaattttattggtagyggyggtatyggygyggyggttggggtagtttttagygttgggataaatatatataaattaatggtttttaatttaaggygatagttttttttttttaagaaaagtagggggaggggagggygagygygtggggaaggagggttgaggagtgygtttygggaaatgtttttttttttygggggygaagggttgtgaagtgagyggtttaagggaaaggggaattggaggtygggaygyggagtgygyggagaggygggggagggtggtggagtaaggtggyggggatagttaagggtggggtgattggagggagtaggygggagggygataggyggatyggggygygagtgtgttyggtygyggttagggtygggagygygygygtygtttyggaggggaaggggtgtttgygaataagttttyggggaattygtttygagygttyggaggyggagtattgtyggttygaggggtatttaggygggagtygagagggtygtgaggaagygaggayggtttttyggagaagtaatttattygtttygtyggttgaygtattatagggttttygygygttatagagggagaatttttttaggtatattygggagygggtygyggggtyggaaattttygyggagattttaattttatttattttattttyggttagagtggagaagygaaagyggagaagatatgaygggggttagyggyggagagtttyggggttagggtttttyggttgttaaygttyggatttaggygagtttygaygtgtagyggggtttggygtyggtttttttttattaygygttyggtttagggtygtttagtygtygttatygtygtygttttttgggtygatggagtyggygyggaaggttygygygttttgygtygtygtygtttagtgtygtygttagtatttttttygttttttygtttttygggtttatttygygggggyggygttattttttygttgtttaggttygggtatygygggygtttygygggyggtagtygtttttttygagygygatttttaggttgggttyggggtygggyggggagggaggagagattgagygtgaagggagagggygttygagttttyggggayggaagtgtggagaataggagygtgtgagggggygttygaggtgtygggggygggggaagagtatgagtaggggtgggggtaggggtgttaggtgtagtaggtagggaggtagaggyggygagtgggggygttygagggatyggggyggggyggggagygtaagggtggtaaggygttygagagttagggttggagttgaaggtgggtgatagggagggggygtttaggtgttaggatttgaggagaaagagtgygygtagygggagggtttygaagtgtyggggygggattttggaaggagggagaaygtgaggagggaggaagggtttttggggtgttagggatgggggttaggaaaggggtagagagttggaggtttataagtggggatagygggggagggaggttggagygagtggggaaygtaggtggtgtygagggyggggatagggygaggggagyggggygtgaggaagttgtgggaaatygygttggaygttgagaatgtgyggaaggattttgaggggaggaygygagatagygygaggagagaygaggagagttagggttggtygggagggtgygaagatgaagygattattggaggttgtgagggtgaaaggagtaagaatygtttagagaygggttgggtyggtgttggggttaaaggtttttgtttgttaggttttttttggygtttattttagaaagaagaggyggagaygygaagagatygggttagagttagattttygaagtayggagatgggtttaatgaaaggaygaggaaagaygagaaattagyggtyggagaayggaggtggtygtygtygttttttgttttgttyggggttgggygtygttyggagagttttttyggagggggyggggyggggtygggtgaatagagttgggygggttygttagtttttttaggygttttgggtaagtaatgtgggtgattgagttygggtgtgtgtgtttgtgtgtgtgtgtgtgtgtgtgtgtgtgtaygtatataagtgagygtgtgtgygtattttatttagttttttataygygygt

SEQ ID NO: 6880 - DNA, 1603 bp, Artificial Sequence
  Description of Artificial Sequence: Synthetic polynucleotide
ygatttgatttttgygagygtgtttgtttyggaaggtgttttttgattygtygtgttttttaagtattatygggattttygggtattygggggtttagggttatgtatttttttgygygtttatygttttgaatttatagttttygygttgggaagtgattggyggttttttttagggaggatttygygygttattagggttagatattattygaattttygttyggttgagygttttggyggygtgagtyggattygttygaagttttaggataygatttgttagttattagttygygttygtagggtagagaygtayggtygttygtygtagaggygygaatttttatatttattttttgtttygtttygggtttggtgtggttttggtatygtttaggatygggattttgaygttttgattttttatygygtggggaagttatttttttygtttygaggtttygatygtttagtttttttgagaagtttttattttggttattaaaagtggtttttaagagtagttttaygttaatygtataaagtaatgataataataataataagygtttaaaggagygggattgttttttyggttggaygatagygtyggggattygtagygtgygygggtyggaattaaaaaagtagttygggagygygagggttgagyggggtaagtatgggttgtttttygtagttttttttttgttygaggttygggttggtygtttgtttgtttatgattgtttagttgttttttygattgtttaggtaaagtttgagatatttaggggatygggagyggattttttttagtttygttatttatttatygttttttygtttygygtatttygtttttgggtaataattttattaattttyggtttygygygtaaatttaygtttgatttgtyggggtttgttttgttttygtygggatatttyggyggyggttgttgtygttggggttttygyggtgttygyggtygyggttgtygttttttyggttttygtygtygtygtygtygtygtygtygttggttaggttyggttygtygtyggtyggattttaggtgtttygggygttgggttttttygggagtygyggatttaygttyggagatgagtaagtaaatgagagaagagagaygggggtatagagagtgtgatagtgaggaggggagggggagaggagagygayggggggagaatgggaatgtataagygaayggttagggagagagaaaaggggaaagagaagagaaaaataatayggaaagaaggaagagaaggagggagggaygggagagygagtagygaggagagggggagygygggggygtagggygygggaggaggagygygttygttygtttttygtttyggygtgygggayggatatttyggygtygtygtygtygtttygggtygygtagtttttgttttgyggygggaggyggygaggygygygagggaggggygygtyggggttgtggggaggggagattattttattagttaaaggaggattggttgtatttaaatttagttyggatgtaaattayggtttyggttttggtygggygaagtgygg

SEQ ID NO: 6881 - DNA, 1365 bp, Artificial Sequence
  Description of Artificial Sequence: Synthetic polynucleotide
yggtttgtatttttatyggaaagtgygtttgttatattttttyggattatttygttttttygagagygttttgttttttatagttyggaaagaaagaaattttagttgtgaagtgatygtggagaaagygtaggaagygatataattggttagggaggtagagagtgtgagygggygtattttttgtttggggatygygttygygggyggggayggagtattttagtggttgtattygtygtttygygtttttgtttggygtygttaatttygyggyggtygttggaattttagagttgttaggygtttttagtyggtttyggtaaatttttttttagtttaygtgttaattaagyggttygtttttygagttygggatggagtatygygtttagggaggtygygtygttygagaygtgygtayggtaggtaatttatattaaggtagtygtagttgyggygtttgggtatatygtygtggattttaaatggtttaagagygtttttttagttttgygtttttagtgtttttagagttttttttttttttyggagygtyggtataaygtattatgtygttgggtyggagtttagggttyggtagaggttgttaatttattgattataattatttttttttttaattygttygtagttgttygttttggattaagtygtttygyggttygtgttaggtagtgggttygtttttttttttttttttttttttaaattgggaygtgygaaggygtagttgttttttyggggttttttttattttttatatattttgttttygttttttgttttttaggttygtggyggagagatgttgatygygttgaattgatyggtgyggttygggggtgagtggygagtttttttttgagttttttttagtagygyggtyggygtyggttttttgggygaattttttagtttttagattttgagaggygtttttttttygttygatygtttagatgtagtttygtttttttttttttgtttttattattttgaattgtatggattatagttattgttaaggtaatygatggagaygtagtaagygaggtgggtttttttttgttaaaggtgygtggtgggttttaggggtggygtgtggaggygtttatttaygttttggtttygggggtttagatggttagggttgtgttttttattttagtttttgygggtttttagtttttatttttaggattttggagttttataaaatattttgttttttgtattttggaggygyggggagtyggagygagaygygttgggagttyggygagtygggygttaatygggygtttagggttaagtygtgyggttygtatttatgttygtygt

SEQ ID NO: 6882 - DNA, 419 bp, Artificial Sequence
  Description of Artificial Sequence: Synthetic polynucleotide
ygtggygggygttgtttattyggyggagtygagyggygtgtagaggttataagtgtygtagttggtgattgggggatttttttygggaatygtgtygggagagygygyggtgttggagtygtatygggtggtygaagtagaaggtgagtggyggggagtgggatggggtggaggttttgaatgtaagggtgagagttttggagtttagtagagttggagygtatattttygttttttttttttygttttygagtattaggyggatatattygtatttygaatgttttagtgggygtagagtttattagaaatggatagtyggatttttyggygtttgttgggggtatygttgttaggtgtttggggttygttttttyggttttgttygtatagggygtatttagaggtygttttttyga

SEQ ID NO: 6883 - DNA, 3675 bp, Artificial Sequence
  Description of Artificial Sequence: Synthetic polynucleotide
ygtagygaggtyggttgygyggtygtygygtgggtyggagtttagtgttttttggtggygtygaggygggtaggyggttttyggatygygyggaggttygayggttgtgatttaggggtggygtygttgttagggyggygggaggtttgattggggtttygtygtgggttgagttayggygtaattaattattagttgttgggaatttttgtygttygttygyggtgatttattyggtagttaggtttatttgtygagygygggggttttggtttttaaaatgaatttggggagagtgtttgttyggggtagggtttttygttttttygttttagggygttygtagatttagygaggatttgayggtttagaygtagtttatagygygggttttttttttttggtgggtattygtgatttttgaaagtggggtgtagagygttttagttgggaggtttyggtgaattattggggttttagattttttgggttyggggtttttgaggttagggagttygagtatygttttagggggygatttatagaagggattggttttttggagttygygagttgttygagggttaggtttgattttttagttattttttggttagttgttagtttgtygttaggtaatttttttttatttttattttttttttggttggggttaggagaggaagaggagtttaggggtttttgaggtttgggtttgtttttttggagttttagggttttaggygggatttaggaagtygaaggttaaggaaaagtttttygatagtttaaagggagagggyggggagggggaggaggtaaaggaggttaaaatgggaaggagataaagtttggagagggtttatttggaagtagggaataggtgygttttagttygagtttygtgtttttattttaggtggtttygagggggttatygygtggtttagggttgtatttayggygtattttgygtttagttgtggggaattaaagagtgattatatatattaaagagtgattatatatatatatatatatatatatatgtgtgtgtgtgtgtgtgtgtgtgtgtgtgtgtgtgtgtgtgtgtatttttttttttttttttagtaaagtaatagagaggttattgggtygggggattgygatgttttttttygttgttttgattttaaaagtggyggtttatgttgtttttagygttttttagggaaaygattygggtttgtaggtgttggtttaagygggttgtgtygttgggaggygagggggtygaggtagttttygggattttattattttaygaggttatgtttttggttaatgataygttttygygtygggtggttaggtggggggtggggggtggggaagatttygtgaatygttgttgtygtttttttgtgtgtttatggttttttttttttttgttttttattttttgtttaatttgtttgaagttgttagtttgttatttttggttgaatttygttttttttttttaatttygagttttttaaattttttattygttagggttgtttgygtttttggggagyggggttagaaggatttaagaagtygygtttatttttttatttttygttaaaattygtyggyggtttygttttygttttttttttggyggtttaggtygtttttttygggtttttttygygtgygttttgygtygygttgggtttgtagygggagttgttatagtagtttygttagttggttggggattaggygggaggtggygygttttggaggttgtgggagggagggagggagggaggttyggtttyggygtagttyggttttygtttttygaggttttttygtyggagyggggttgttaagygtatatatatatatatatatataygtatatatataygygtatatatatattygggtttttaayggygygtaygtaygtagygttyggggtagattagygyggyggtygtttttygggaygttyggaygtyggagggtttygattttygygyggtttatgygttygygttygtttygttgtttygygaggttygygggatttttttygtygtygtygtygygttygtygttttyggaggagygggttggtygatygttatygygtygtttttyggtygttttygaagtygttttatygyggtttttgtygttttggggtygygtttygttttygygttttgggggttgagtygagtaaatttygygtatyggtygaygttyggyggggatttygttgygtattygygygttygggtgggygttgggygygyggatttttggggagygggttgtttttttygttgtatttgttyggtttttttttygtttgtaggggattttagagatatygttatttygtaaattttttttttttattatygagagggggygaggaggggtaaaaggggaagtaggtttygttgggygygyggatttgtaggttttttgttgggtatygttattygygagttggatttataggggtatygggtttygyggtygtttttyggtygttttttggtttyggttttygtttttgygtttttygygggagyggggggyggggtgyggagggtagtaaggttygygyggtatttagyggggtygttttgtatggttttgygtagtggggygggttgtttyggtygggtttggygtagggtgtyggggttttyggaygtttggtttyggygttygagtagttttttgtgtttgttygttttttyggttgagttygggttygygtygtttttgtttygttagtygtttygyggtggyggtggttgtggyggttttagyggagggggttttttttagttttttygtttttygtttttttgttgttgttgttgttgttgtygtygtygtttataatttggaggyggyggyggyggyggyggaggaggaggyggyggyggtygtygggygttgtagtgggaygygygyggttgtgagtttgygggatatgtttttygygtyggttttttgttggyggttatgaagaggtagaaygtgyggattttgttttttatygtttgtatttttatttatttgttggtgggygtygtygtgttygaygttttygagtyggattaygagatgygygaggaggagaaatttaaagtygaggagattyggattaaggggaagtataatattagtagygaggattatyggtagttggagttggtgattttgtagtyggaatygtatygygtyggygtttagtggaaattygtyggttttttttattttgygattayggttattattattataggtaagggttgggygygtygttgggttttygygtttygggaggagttyggggaggyggttgagygygtygygtygggttgggtgtagggygtygagggttaaaygtagttttttttgggggttttttygtagygtttttttttttttagggagtttttttttygyggygttttygagttttatttttyggggattttattyggtgttttttatygygttggtgtttgggtygggygtgygagtttygagygagtgtgtttgagtygggagggyggaggygttatttttgygaagagagtggagygttaagaataattttatagtagatatttatttatttatygtttyggygygggttgggttgygygg

SEQ ID NO: 6884 - DNA, 3675 bp, Artificial Sequence; identical to SEQ ID NO: 6883
  Description of Artificial Sequence: Synthetic polynucleotide

SEQ ID NO: 6885 - DNA, 3378 bp, Artificial Sequence
  Description of Artificial Sequence: Synthetic polynucleotide
ygggtygggtyggygaggggggtttyggtygagaygygaggygygttaygggattyggyggygggagyggatggygagygagygagygagygggygggygggygggygggagggaggtggyggtyggggttgtttaagatggggtyggagtygygggttaggygyggaggagayggaaggggygggtagggtygygygggygyggtgygggygttttttttyggtagttagyggtagygygtyggtttttygtttttygttattgyggtttygygtyggtygtttgggtttggagtttygyggygttttyggaggaygggtttygygttttaygatttattttyggaggyggggtygggtygatygggggyggaggaygtygtaggaggttgttyggatttygggygtttgttaggttttttttggggttttttatgttaggtttygyggttgtgttygtaagygtagatggtttygggattygggttattttgaygtygtagatttagtaygttgyggatygggtaygttggatttygggataagtgyggagggtygggggttggaagggattygagagtagagttygygtttttattttayggaygyggttatygaggttygagaggggtyggagtttgygggagagggaagggttttygagggttttataatttggttgygttttttttttagttygggattyggatgagtgttgtttgaggtygaggygaygaatygttttttattygtttttgygygggatttyggtaggaataagygttygtttttgggatyggaggyggtaaattttaggttygagttttttagygtagygtttattygyggagtygygygtttttttggygtatttttgggtttygyggttyggtttttagtygtygggtttttygggttagttttttgttttttagatygaggygtaataagtttgaaagtagygttaaggagtagttagygagtygaagggagggygtggggygtygggygtttygggattttygaaygygygtaaygttygttttyggggatygggygygggyggtaggygagygggattgattyggygggttgygtatatttttttttaaggtttygattgtgygyggaygggggygygtttaggaattttygttttttttttygtttgtttgattttgttgggtatttaaagtyggattyggyggtatttyggygtgygggygtagagtttygttgtygtttaygggagggagyggttygatttttttygttgttttttyggtagtyggggtygtagaygagtggaaggtatgagggttttaggagaygtgatagtygtttttttagattttatatatygtatattattttttttttagatagaaaagggatttagtttttttttttttygttttygttygygyggtttttgttgttttttygyggyggttttygtttygagggggygtgtgtttgtgtttgtggggagagtatygagggttttygtgggtttttaggatggagygggagagtagattttttagttttttttttaatataaaygataagyggtttttttggggygggagtgtaggttttttattygtttataygtttttttgttttttaattatttyggagttgtagtttaggaatttgygttttagattyggaggaagaayggggaggtygyggyggggaygggtgttgaaagagggttggtttagggtttttygggttttagtttaggygtttgygttttaagaaatttagaagtttaaaataaaagtggaaaggggtaaggtgtttagyggtttggggttggggtgttagattaggygttttttttaggttgtyggggagtggttaagtaggagtygtygyggttaggaggagggaygygggttyggagtygtagttttygttaagttttttyggtygtatygtttygyggtgatttttagtttygtygttttttttygaggtyggaggagttttttatttygtttagggggtygyggggatttagggagagggtttttggtygggtttagagtttttagtttttttaggagggggygggggtygtgttygtttttygaggtagtttygygyggttttaagttagygyggygayggtggagggtyggyggtttttgtttatyggygaygyggattygggagtgttyggygttygggagtgttyggygtttggagyggagayggtatagggtyggtttaaagttgagagyggtttattygygyggtttgttygatttagtggaaaggtagataaggagggaagagttaggygttygygtgggggtggggggygtaaaaatagtttttygttygaagtgggggagagtatttttagggagtttttattgttaatgttaggtttataggygagggtttttaygagygagggtttygagaaggagtttggggtttttttttgtttgtttygagttttgtgygtggggggaggaygtttygggtttttataatgtttgtagggggttttggaygtgattagtaggagggggataygttygggggtttttyggagtttgttgygtttatgtgtggttgttgggggttatggggggtttttttagattttygttagygtttgtgtgtgttgggggtatagygggaaygttttttttagtttgttttgtgtatgtgatgaagaggggtgttaggttgtggtgtgtggatggggaggaggyggyggygtygaggagttttttttgygtttagggtygttttttttttagtttgtttaatgygggttygyggggatttgttatattttatygttatygttggagaaggtagggggttgagggggtagggggtgggggtttaaatttttgagttttgagygtaaaatttyggagttgygaagttttaaayggygaagttaggaagtttgggygttygtttttttttygatttttttttattttygttgygtttttattygtygygtttttagtttttygttggagttttttttattttttttagtagtagyggtttygtyggygaggattygattyggygagttgtaaattttygygagygtttygygtygtyggyggttgagtygggygttygatyggaggtggggggggtttttttagtygtygtygttttyggttygttttgggtttygtygggaygttttttggagagtattygtyggygtaygtaggttttttttygttttttygygtttgttggagtttttygggygttyggagggttyggatgttygygttgyggaygatgttggygygygggttygggtygggttaggaygyggygyggtygtttgtgttttyggtttttyggtttygygttygt

SEQ ID NO: 6886 - DNA, 1108 bp, Artificial Sequence
  Description of Artificial Sequence: Synthetic polynucleotide
ygggggtttygattttttttaggttygtttttaattttatattgttattygttyggygtttatttattttttttagaggygtatggatttygtyggtygggttaggttayggyggttgygggttatagygattttttygggataggaygggtgygggttttttttattygtaggttygtyggtagttttygttygygtttttgttyggygtttttttygtyggttyggtyggggttttatygygtyggygttgagttgggttaagatggygaaggtggagagtyggttatagaggtagygygttyggagggygtygaggggtatygtgyggtagtygygttaygattagggttygagttgygggggggyggaggaggagggtttgggggygggygggataygggagggagataggyggagygttagyggyggyggggaygygggygtttyggttttygagyggyggtttygygtttyggtttyggtttyggttygtygtttygtatttgygttygtagtygygygttygttygttygtygtygttaggtttygyggttygggygtttatgtygygttttgygttygtygtygtygtygttgagagtygyggagygtagttygagggagygtygggygggggagtygagygatygggggyggggyggggggygagagttggttyggggttyggtagtygttygtttygygttttygtygtttttagttttttyggggttygygttttyggttygygygggaaggagggggaggttyggaggggygygtgggygtaygtggagyggggagggtgygagtygggtgtggtttgggggygyggggygggttyggagygyggygagggttygtttyggagtttttyggtttygyggtttagggygtyggttggagttgaygattttgggatygttttattttttatatttatttttttygggttttattatttttggtgtttgyggtttattttttgggatagatatagtttttttygyggggaggtttgtygttggaaatttttttttgyggtttgatttagtygttygttgtttaygggtygygattgtttygttttttatttgagtaygt

SEQ ID NO: 6887 - DNA, 1700 bp, Artificial Sequence
  Description of Artificial Sequence: Synthetic polynucleotide
ygaatatttataygtatatatatattygggagygtayggaygagttgttttttttaaggttatttaaaygttttaattattttygggygygtaagtttaagygygggagttaggatttatygttaagaygttttgggygaggaattttayggttattgtttttagtagtagttatttgtatgggaaagggaggaagagagaygtgaaygtgygggttyggtttgttagttttygagagttatatygaagggtttatgygygygtgatttayggggattaggtagaaagtygtttatygtygtagggtagggtyggttatygygygttggtttttttttatgttggyggttygtttattttgggtttyggttagttttatttagtttagaggygatagataaagygagtttagygtaggatgagggaggtagtttatttttatygtyggtttyggttygygagaygyggggatagygyggtgygyggttygtatgtaggggtgatyggagggtygttttttttaygattyggaaagaaggagagtttttygttaggtttttgtgggtgttttttggtygaggagttyggttttygtttttttattttttttttttttatttttaagtaggagagygtgtagttttagtttgtataaggygttttaagtyggtgttttygggttagggtttgggygtygttygggggtygtttttatttygggttyggttttaggggttgttgttygaaygtattggtttttttagaagtattygtyggyggtatatyggtagggyggtyggttttgttgggttttttgggygtyggtttygggggttygggyggtttttttyggttttyggtttggattygygaaygygygggygygaggggttgggaygygggagttttttgagtgyggagygyggagttttggtgtttyggygtattgtagttatattttygggtygygygttttygtygttttttattygygtygtagggtttttttttttgaggygtygttygygtatygtygggggggagggggtagygttaataaattggggagttyggttygtygygtttaggttttygtttggagtygtygtattygggayggtgygtagygttggaagttyggtttttygagagttagttgttygtygyggttttygtaygtygggtagtygtttttygtygtttygggygygttattatggggtttyggtttagygtttggttgttgttgttgttygtygtttttttgttttaygaggagtatagtygggtygttgygaaggtgagttttyggttagtttygttttyggygtttygtttygagtttgggygtttygagaggtttttttgttygygtttggattygttygtttgtttttygggggtygygygtggtayggttaggtgtattttttgggtyggggttygttgggggtttttgtaggttaygatygygtattggtggatygagttttttttgttatggtatgggtattggagagttaaggaattttttyggggaagggaggagaaatagttygygttgtggyggggtgagggtgtttgggagtyggygggatttgaattygygtygygggtatgttyggtagttgggygtttttattygtttygggtgygygagggagttgggggttggagggtygggagygtttatttygygt

SEQ ID NO: 6888 - DNA, 692 bp, Artificial Sequence
  Description of Artificial Sequence: Synthetic polynucleotide
ygattygygatygtatattttgtagagattyggtttygtttttgtatttttygtagatttygttttgtgattatatttttygttttttataggtattggttygyggtygtgtaygtttygtttttattggtttygtttygtgattaygttttygtaattttgatagattttattttygaggattttttttaggagtatagtgatttygtttttatagggttygtttygttatattgattttttygtgtygttygygggattttatttttgttygtttgtttyggtgtttatggggaagtttggtgttaggggttattagttagtttaatttatygttygattggtgggataaggataggttagygggttataggtyggaagtgagattygttyggtygttttgggaygygggaagatygaggtttyggtggtttttttttttttygtttggtttttttaggagaaggagyggttaaggtaggattygatatygyggtygtattygtttttttttttgttttagagtatagtttgggatttttaggggggagattgaatgagtgttgtygaggatyggygagagtttggaaygttygygttttygtaggagaaygaggaggtgayggatagggaayggggagyggtygttgggtgggaygtttgagattttygggaaatggtygggtygtyga

SEQ ID NO: 6889 - DNA, 1924 bp, Artificial Sequence
  Description of Artificial Sequence: Synthetic polynucleotide
yggyggagtaaattgaaygttatttttygattaaataggagtttygggtttatttgtttggaagtttttaggyggtttggaggggttyggttttygggygygattygtaggggttgttttgttyggttygyggaayggaygtttattygtygtagttaygaatttattaaygatattaagtattggtygggtagattaggygtygtggaggygttttagttttttagtttttygtaaygaygygttttaggggtgygtagtgtttggygyggtgatyggattyggtygttttttygatygygtagagygagaggttatattttggattttaggtygggtttttgyggttttgggagggaggtttyggaygttttttagatttygggtttttgtaatttygaggtygggttttaaaattayggttttttygagttatayggagagttygtggttaagggttaagggyggttttygattttygggatygtttttttgagaaatggttgagagttaagtttagagttgygtagggaagggagttaaagagttggygtygagygygaagggtygggaggygyggggaggttttttattygttttattgttttgttygttaatgaygtygatgatagygatagygtyggtygagtgttttttttgtttygggtygtttaggtatygggtttttttttagtattygtagtaygtattgaagaagaygttayggaagttttygttttttagattygggggaattaggaaaygygttyggygattttygggtagtagtatygggttaggtttgttttyggaatygttgaygttattygtygtttttttygtttgggtttttygygggtygtaggggtggaagttygatttgggttagggttyggatttttttttttyggtttttgygtygtygttttyggtgttaggaygygttttgttttygtygagatttagaygygtygaaagtttygygygggtagtttttygttttaygtttygggttgygygttttttygygaagtttttgtygagtgygygygayggygtygtyggattttttyggatygygttttygygtaygtttgatyggagtatttygttttaygggggygttttgygygtttttttttttyggtgygattttygtttttttttttttygyggtttttaggagtttaggtatttttygaygtygttgtyggyggaatygggaatttttttyggggttttttgygggttygaagtygttttttygaggyggyggagttgggtagtttygggtttygygtygtttygygtygtttygyggagtyggagttttttttyggagtttggatatagtttttygtttygtygtygygtattggatttyggtagygtggagtttgttygggaagttgggttgygtyggtttggggygaaggtttaaggggygygggggtygggaygyggggttgtggygaygatyggttttttgygaaygtttaggtyggygggttyggggttataggttgggagtggagttggyggttattggggagtagagaggaygtttaggaataggtgtattagggtttyggyggttgggtygagggtygtaagtagaggggatyggyggttgttagtaagttttaagtagatgttttyggyggggtagtygtattttatagygtttatttygygtatatygagtatttaaaaygagtaaaatyggtttataygttggaatgtagtttatgattttaaaattttatttttaggttgtttagattatayggtttygttttatttatttttattgaataayggtygttggataatttagagaagtagtagaaattaygagaaaaatagtggagttaaayggyggtaaggatygataaggttggyggggatattgagtaaayggygg

SEQ ID NO: 6890 - DNA, 1991 bp, Artificial Sequence
  Description of Artificial Sequence: Synthetic polynucleotide
ygtttagtttttatttayggagggygaagataaaaagygttttaggygygtagggaaatygygtaaygttgtgtttattgtagygatttttttagaaaaataaataaggtttttygataggttattygygtaagtagtagtyggtygagtttttttttttygttaatttagtagttagygttgtygttttttaagattttttttaatttaagtgtaatttagtaaggagggagagttagagattttggggaygttygaggaaatygaatttygaaattttttgtttttaaggygyggtyggagatttttgggattttaaagyggagagaattttttaattttttgttagaagagyggggttagagatttttgggatttttttggagtygaatttttttttttagttttatttyggagggygggagygaagattttgaagatttttttagygtaataaatttttttaattttgttggaaygygggttttgggatygyggggaagtttagaggggygaatttyggaattttttgttttgagagygggattagggattttagggattygggagtagagggaattttygtaatttygtygaaatatagggtgagagatygtggggaatttygagtygagygaagttygtaattttgttyggygggygggattagaygygttttyggygtttttagatyggygatgtagygtggtygggagtttaggattttaagygtygtygttgtyggtaagtatygtygtatttttttataatttaggattygtatggtaayggttatgttggggggattttatttaagaaattygggttttgtygggagyggtggtttaygtttgtaattttagtattttgggaggtygaggygggtggattatttgaggttaggagttygagatyggtttgattaatatggtgaaattttygtttttattaaaaatataaaaattagtygggtatggtggtgtgygtttgtagttttagttatttgggaggttgaggtaggagaattgtttgaattygggaagyggaggttgtagtgagttaagatygygttattatattgtagtttgggtaatygagygagattttatttaaaaaaaaaaaaaaaaaaaaaaattaaggttgaattygggttttygtaygttygtatttatttgygyggttattaygygttgtttttyggygattaggttgtattttttgtattggtagtygygttatatgtagaagygtttgtggtttttgagyggygaggygtagtygtggtttttgtagygtgygtatttgggtagtygyggggattttttgttttyggtatttaggttygaygtttyggagtyggagtygttttttttgttgttgttttyggygttygagtygttggtygtttttattagygttttagaygttttgttaaagttttyggttttgttttgyggyggtatttygggggygtgaggggttttygayggtgtagagggtttgttgaatgtttygtygttgggtatggtgtttttaggagaagtgygagtattttggttttttttttygtttggagattgttgygagggatgaattygayggatagygaygtttyggaggaggaggygtaggagaygtgtgygttgtagtyggaggygtagttggagtggygaggtttgggtaygttaygttyggagtggtggggggttgtgtttttttttttggygygygygygatttagaattttyggatattttttagaatattttygggattgtttgggagggagygtggttaygtttatygtttttygattttagttatygttttttagttgtttgtaaatttgtatyggttgtaagtatttagggttttgttgtagggtttttgtaagygtatygagagatatagagyggtttgggaatygygtggtatttttygtttygttttyggaggygttaagattyggttgttaaagtayggtgtatyga

SEQ ID NO: 6891 - DNA, 1667 bp, Artificial Sequence
  Description of Artificial Sequence: Synthetic polynucleotide
ygattttatygtagtgagtgtgygtaygtgggttttaattttgttttgttttaatttygttgtttttttgtttaatttgataygtttygaattttttaatttgggaaggtatttggygatattgaygtatagtttygtygtttggttgttyggaggygttttttttgygggygygagtgttattygygttgggtttagatttagtyggtttttttygggagaggaagtttyggtttggyggagagtaggaaggaaagtttygataggtttaygttttaaaattttgtttttagtttttttaagtggagttgtagttggtatttygaagttgttttygygttyggttaaattttygtattttagaygtttttatttggtttggygagttgygtttgtagagtttygggttgyggttyggtagtttaaygtagtgyggyggtygyggttaattyggtagtagggygyggyggttgyggttgygayggttgagaggttggyggyggttgyggggyggygayggygtttttyggyggygggggttttggtagagygygtagygagtyggggatgaggttttttaagttttygttggtttgttgtyggygtagygttatttgygtagttatgattygttgtygttygatgatgaggatgtatttttygtaggtgtagtttttgaagyggtagtaaygtttgtggtttttgagttaggataggaygttatggttgyggtagygygygtatttgggygtgygttgtaggggygttygtggyggttgygatatygggtygtttatgtataggtagggggagtygtagtygtttatgtttygggttttygaatgagttggtagtttggttgygggagagggttagggagygttggayggyggggttgygaggttygtttaggggyggttttygggygaygyggtttttggtttygtagtttyggtggtygtgtgtgtttyggggyggtyggaggtgtygtagtygtttttttagtttttttygygtttatagttyggttttttagtttaygtttagttaaygtygaygygggtttttgttttgggygygtagtygggtyggtaygttttttttygyggaggygttgyggyggttgtaaggagtyggygatagttttgattaaggtttgagttagtttttttgtagttttttygtgagtyggtyggatttaatattttygtygtttttttttaatttttttttttttttatygttattttygtttttggggtttttgtttttttgtatttttygttttaygtttttttttttttttgygtttttygggtgtttgtattttattttttttgttatttgtagttaggttattttygygggggygttygyggtttttttttttaagtttttttygttattttagttygyggttggagattgyggygttttagaaygyggyggtgttygyggggyggagaaggggaggattagygggagtgagggtgggggtgtttgtaagygagtgaggtggtygtttygtttttttttttttttttttttttagtttagatttggtygygttttttygagtttaaggtygtttttatttygatatttggtygtagaagtttagtttygggagaattygaatttaygggagtgttgyggttgtatttygg

SEQ ID NO: 6892 - DNA, 433 bp, Artificial Sequence
  Description of Artificial Sequence: Synthetic polynucleotide
yggttttttgtagtttygggygttttattttgttgaggtygttttyggttttttttgatttaggttgggygggaaaggtygggtygttttygtttggtttagatygttggtttattyggygggygygygtagttgtatttagygtagygttattggttttagtttgtagattgygtttttttttttagtattgttygtttaggtttyggagttttaygttttttgattggtyggttgttaggyggtgtgaatattgattggtygaggtaygttggtagggagtttttygtttttygyggtttatatttttttttttgaagygtttygttagagttygtttatygggttttyggtgtagtyggttygtttgtttagaatttaaattygaggtatgayggtgtttgtaagagagaagttattatttatttygygg

SEQ ID NO: 6893 - DNA, 896 bp, Artificial Sequence
  Description of Artificial Sequence: Synthetic polynucleotide
yggttttatattttggygggyggygtayggagygtttyggttttyggtattagttagygtyggagtgggtaggattggagatggtagttttyggtttaggggaagygggattttayggaagggttgggaagagggtaggaagagggggygggggygggaattgtttygttttttttttttttgtttatttttattggttaagggttttttggttttaatttatttttygtttttagggygtygtttaaagtgtgyggagtaggtgttttgggtggagttataattttgygygagtgttttggttgagygtagygtttatttattgttygygagygtttatttatttgttyggtygattgtttagygaaaggggttttaggtygggygtagtygttattygggggatygaggttaggagaggggttaagagygyggttgatttttgygggtyggggtaggggayggtggtygyggttatgtagttttgtgttagggygtgggggttgygtttgggtygyggggtygggggyggtygtygtttggttgggggatyggggtygtgttgggygtygyggagtygggatagtagtagtggyggyggggatagygtygyggttggggtttygygttttttggagygttttttgtttagataygaygatttygttyggaggtatatyggttttggggataaagattagagagagatgttgtagattttggggttggyggtaaggatttttattyggtttttygyggtttttttttygttttgttygggttttgtttgygyggtttttyggtttttattttgagttttgttgygtttygygtggttttygtattttgggtttygggtygtggygtggaagtaaattygtgtttttggttttygt

SEQ ID NO: 6894 - DNA, 1494 bp, Artificial Sequence
  Description of Artificial Sequence: Synthetic polynucleotide
ygagyggtttaggagygagtttaaaatttygtataggtttgttyggtygygttttttgattggttaaggygygttygtygtttygtyggtygtaggygttayggtagttttagtagtttgggtttygttatygttttygyggtagtttyggtyggygtaagtgyggygygygttgggggagggggygyggyggagygttaggttggygtygggttatygygggattaagttttttagttaygygtgagtgtttgtgygttttgattygaagtttttygtygggtygttattttagaagagaagatagtgagygtgggygaggygaggtatttagaggtttyggygatttttgttttttagtttttygttttttygygtygyggttttgggygggygtygygagtygggtaagyggygtttgagtttyggtttagaggtygaggygygttttygygttttgygygygygtyggyggggaaggtgygygggygttttgggttyggygtttgggggtgggggtgggggyggggatgggggtgggggtgggggtgggggtaggggtggyggygggtygtggggyggtggggyggtgygtttgttttatttygygyggttyggygtttygyggaagtygttgttgtggtttttttaaaaggatggggtttagaagttttttttgttattygtaagtttttattttttttagtttygyggtggataattttagattttttagtattttygttattttttttttttgttttygttgattaagaggtttaaaagtttttttttttttttgatttagaggggtatagttttggtgtyggggggttgggggtggggtgttagtttgggggttyggagygtagattaggtttttagggygygggagtttgttgtttttttttgtaggggtygttttyggaygttttattygtygttaygtggtttygggatgtgygggttgyggtagagagtgggtagtaatgtttttggttttgygttttygttttagtygyggggatttygaggygagtygttaattggtatyggtgtttygttttttatttttggtatyggygtttttttaatygtygttttygttggtgggagtaygttggttttgttttttttttagtttttttatttttygygttgatgggygtttttgtttgygatttggtagttttaggatgtyggatgttattagggaagygatgtttgggagaygttttgtgttttgyggagttgygygtttgttgggtggtgatggtgtatatttttgtttgygttttttgtagaggtataaaggttgggttatttttgtttgtagttatatggaaattaagyggagattgygggggaggagaagtggttaggygtyggygggaggtagaggtygtttygtagttattgggggygagtgggggtttttggagatttttattgygyggtgyggtttttgaggtgtttygtttgggaagatttygg

SEQ ID NO: 6895 - DNA, 828 bp, Artificial Sequence
  Description of Artificial Sequence: Synthetic polynucleotide
yggaggttaygagttattagttyggayggtgaaatttattttttttttgygttttaygttyggatgggagaattttagttttttayggygtatyggggaataattttagagtagtaygygagtagagtttttagygtttttaygtttaygtttaygattttttttttaatygygyggtataaggaggtatttaygyggagttaatttgatagttttygtyggggtggaaattygyggttttttygtatyggtatttyggatataggtttygygtaggygygtagtttyggatttygtttttgtttttgtttttgtttttattttttttgggtattatyggatagtgttttgattygtagtttaatygtyggggtgtygattygyggggatttatttttttgttttttttttygyggyggyggyggygttagttygttttygattygagygtggygttttygygttggtygttyggttygggaaattgttaaattggtygttattatttaygygtttgtyggggaagggttygtyggygtygygttttygaggtttttgyggygaatygygttaygygygatttttggtygggggygggaggyggyggyggyggtaggagaagtttaaggttygagyggttygtagtttttaygtttgtatttttttattttygttagttygatggttygtttygyggygtgtattggagtaagtaggtttygtttygagygygygygttttgggaagtgttgtaagtttggagatttggagtgagtttygggygttgttggttygattgttygyggtgttttttyggtgaggtygygg

SEQ ID NO: 6896 - DNA, 2705 bp, Artificial Sequence
  Description of Artificial Sequence: Synthetic polynucleotide
yggggttgttygtttatttaaatatttttygttttagtaaaggttgagattygttagttttgttyggtttgattagggygtttttttttygtygggtggtttgggyggtttygggttyggygttttttatttygttggtttttttaygttygtygggttttttaggagtgtattagtatygagtgtaaggagtygtttttgttttyggtygaggtaggggttgtgggttttagtagagaggtaaygggygaggtygyggtygyggagtatayggtggatggygtyggaggttgttgygaagtygyggggatagtgagtttyggttgtagygyggataygggyggtagygtaggygtgggtttgatgggtatyggtatggtaggtaggttttggtttgtygagtggtatagggatttgatygggatttygaaggttttatatttygggtttatagggatttyggttgyggttgyggyggtygyggyggyggttatygaatttatgaygttaaygtgyggttatayggagttgaygaygttgttaagttggtygggtayggggtagtttaggtggtgtatgayggaygttaagggtagttttttagtttgtagtaygtttttgtagtttyggttaataatgtttttaatggtaaaggggtgtttgaagtttgaygtggaygttgyggtygyggyggtagyggyggyggtygagtttagttygtagggtgggaattgagataggygttttaygttgtttatygyggttgtygyggtygtygtygtygtygtygttayggtygtygttttttgtattttgtyggggtgagayggttgttgaggttgygattgttggggyggttgttgygggggttgtgaygggaggtgyggaggyggttgyggagtagtaggyggttgttgatggaaatagtgtattatgtgyggyggyggygggggyggyggyggyggyggttggggtgggtggtggtgatggtggtggtgtgyggtagygtggtgatgatggtggtggtgggggtggtggtggtgatgggggtgaaggtgttttttyggatyggygttyggygygtttttggtgtttttygygtgtaagtgagtatggtyggygygtagtattttgaagygtttgygaygtygtaggaagttgtygttttygaatatgttttygtagtyggggtgtagygtttagaagttatttttgttaggttggtygggttttygyggaattttgatgaagtagtygttgaaggagaggttgtggygtaggttgttttgttagygttgtgtgtgttygyggtagtaggggaagygttttatgatgaatttgtagatgtygtttagyggtagtattttttyggtygagtgttggattgttatggyggttagygagatgtaagagtagggyggtttttggtygttgtaygagttttttttyggtygyggtatygttttyggtttttttatygtttttyggttygtattggattatagaattttttygtatttygtttttggggtttggttgtttttattaatttttattyggtttttttagtttygttattttgttttttygttttttaggttttttttgttttttttttttgtttttttygaattgtttggtgttttygattttggtttttygggtttatttagttttyggaagttggtaatttttggtttygayggttgtygattggygygtatagtygygggyggagtgtattaggtttatygtygttttttttgygttttttttygggtggttaaagattgagtgttggagttggttgtagaggagagtggtaaggggtygtgttttttttyggtttttttgttttttttaggttygagggaaatttagattaagatggttgggaggaaggtttgggtagtagagattttggttttttaaatttgagtttgygtttgttgttttggaggttagtgatagtaggatttttagtgttttggaygtaggtttttggttaggtatttagttagatygygttggagtttttttttttttggagtgaaaaattagggtaaggagagagaagattggtttttagggygtttttttttttttygaggttygtagygtygtyggggttagaagagaygygtagttttaggttgtygttgaggagaaaaaattttggtggtttttgaagyggtagygttygtaggttttgttgaggagtgtggggygtaggattttgggagygagyggygggttggagagggygtttgygaatgttgggtgagtgttggtyggggaggtttagtygttygygtygtagttgtygtttttttttygggtttgttttgaggaggagaggygayggtagtggtagygaygygtttttttggttgygttttgtaatggttttygagaygtygagattttygtagttagygtttygagattattatatgatygaggttgagggatttagtygtygtygtygygtttgtagttgaagaaggggtaagaaggygtygtgtttygttttygtttttttttttatttygtttygggygttttttatttatygygtttattattygttyggtagtttttagttatttttyggtgyggygggtggygtaggttgttygtygggagggggtatagtttygggtgtatttttygtagttgygttttattygggttattaagtaygg

SEQ ID NO: 6897 - DNA, 704 bp, Artificial Sequence
  Description of Artificial Sequence: Synthetic polynucleotide
yggtaggggtygtggaagggtagygttagttaggygttatgtagttygygtatgaagtttagtattttttgggagttgtygtyggttgataygaagattatttygaagggygygggtygtygygtttyggttattagygtygtatagaagtygtagagtagyggygtgaagtygyggttyggygygtatygggtygtygygaagtatagtgttattattttgttttgtagygtygtttyggtttttatygtygygtttttataggttattaggtgtygttygtttagaatgttaattatggygtagataygtagttatttgagattygaggatatttgtaggaggatgattatttgyggggaggyggyggygagygtygyggtgtttygtttttgttygtattatygggygttggattttttaagatttgttttagatgygtttatattttggttaggtttygtttgtggttggagtaattgtgttygygtygataatgagatatttagatattagagattttagatatttgggygatagygyggtattygtttttgggagyggggttagttaggtaattttaagtttttaggtttttgtatttttttttaattgygtttygtttatatttttgygtttttttattattgygtttygtttatatttttygtaagttttttaattgygtttygtttatatttygt

SEQ ID NO: 6898 - DNA, 950 bp, Artificial Sequence
  Description of Artificial Sequence: Synthetic polynucleotide
ygtgtaattttaagtagyggtttttygggtyggggttgygyggtygtygttgtgttggtttttaayggtgggagggtattatttttttgttttgttttygttttttagaaggttgtttyggggtttttatttttygtttygtttyggggatagtggttygtttgttatgygyggtagttygygtyggggtyggtattagtagygttygggyggatgtagygagtttayggaggggtatgtttttaygtattaagtataatygttttaggaatgattyggtgatatyggtygatgattttttttatagtttgtyggtgagyggyggyggaggtaaggtttyggyggygygygygatttyggyggyggttttttatttggtgttyggygaggygttgygtaaggygttygaygatgggttyggtagtttgggttatttgttttataaggtgttttatttgaaattttttagttygggttttygyggtttgtygtyggtygttygggagygggygggygygyggttttygggtagttgtagygygtttagtttggtygtttyggayggtagtgygttttyggygtttygygtttyggttatgagygtygttaggaagggtyggttyggygaygagtygttgtttaggttttttyggggggygtygtaygttagygattaggtgttggggttyggagttatttaygtggttaaggtgggtgygggygygggtygttttgggggttgggggttttggggttagttyggggtagatttttttattttttgaagttyggggtgyggggygttttygygattgttaygttagaggtaagtaaatgygtattttttagtaattagttygtttgatagyggtgaggagggaattataaatgygtttttttygtatttattgggaaaaggtttattattygggtggttygtttygtttygg

SEQ ID NO: 6899 - DNA, 4861 bp, Artificial Sequence
  Description of Artificial Sequence: Synthetic polynucleotide
ygyggtttttgtttttttttttttygattttttyggggttatttaaaagtygattaagtygtyggttttttagttgtttttatttttttatygttttttttttttgtttygtttgtttttgtgtttttygttaygttatagttygttggtttttaygttttttttggtttttttgygtatatttyggtggygtttttggtgtttttatattattgtttggaattttgtttggtttaygtygtttgtttttgtttttttttttatttgtgtygtttgattttttygattttygtttttgggggttttgtttttygaatttttyggttttttttttttagggygtgygtttygtttagtttttttyggtttyggtyggtyggttttttttaygtggtttttttttttttggtttttttttygttttttttttttttgggttttttttttyggtttagtttaggggttgggggtggyggygyggggyggggyggggyggggyggtgaygyggggttggtygggtaagaggygyggyggygtggggagggggygtagtttygggttygatyggtygagtttygygygtttygttygygttttgygttttygttyggtyggtyggygggggagggggtatgagtyggygttygygygtygtttygagttgygggtyggtttagagtttygygygggtttygygtyggagttaagtygtygtygtygtygtygttaaatygygggygtagtagtgggygtygygatgtagyggtygggggagtygggygtygygygtttyggttygttygagggttgygyggattatyggtygtatygttatygtagttttatgattgaggagatttttayggagttattygggtttaagggygtygygttygtagtygtygttgtygyggygggygagttgttgaagttyggygtgtaggygttgttggyggygyggtttttttatagttatttgggtaygtgtggyggtygyggggtygygggtygggtttggygggagatagygagttgaatygygggggygtttygagtttttttyggtatygaagtagtttygggaagttgttttgggagygtaggttttgggatygtttttyggagttttttaggygggaggyggagggtgtaagttttaggttttatagaaattaggtttygtgttygygggtygttyggggagggtgttygtttttttttttattgttttttttyggtttttagttyggggatttygagtgagtatttttagtgtaggygtattgttaggttayggattttygtgggtggaagygattttaggttaygggygtttgggtttygtygtagagggatggtygggagtggtygyggttgtttaatttagggaagtyggatttttggggaggaggtttgygttttygagggttgggtgttgaygygggtttaagtyggttyggagttttygggagttttagygggygaggaaygyggttttggtygtagtgyggatttgtttyggttttgttttggggttagaggtttgattgtgagtagttgtttggttgttttttttggttttaggtyggttgggtttttgtagggtttgaayggtttgygtagatttttttagtttttgtttttttttttaatttggyggggtttgttttgttttgatggtgttgtttttatygtattttattttygttttgtttttttttatttygttttttaatygtttgtyggtyggtttttttygttttttttattggggtyggtttgttttttattttttattttttttttaygggttttttgttttatatttatttgygttttgttttgtttttttygattttagttaggttaggattygtattttagtgataggtttgtyggggaagggaggtttttaygttgtagtygggattttagttttttaagtygttttttttgtatttttttattttttagtyggtgttttttagtttggagayggtagggttagygygttttttttaagtttagttgggattyggttattyggttatttttygtttttatttgttttgttgttattaattygtttgaagygggtatataattattttaggattgaagaaaatggaaatatttgtatggggaagygtttgaaaatagaaaaygtgaataataatttttaggtttttagggtattttggaattttygggaagtatttaatttyggtttagatgatttttggttatygtatggttgttgtgttaygtayggaagagtaaatgtgtaygtttygtgtatgttttttttttaaygtagtaaggttgatttggttggagtaaaygttatttttttaggattagttgtygttttttttttggtttttatttttttygaaagataagatatatttygagtttttygtagttgtaaatatgtttattaggaatttygagattttagaggtagttgaggtttggggaattttaggatagaatayggatagggtygaggagatatttttttttaaatttggggaayggtaaygttgaggagggtttttatttgygttatyggygtygatyggtagggygtggaggttttgygttgggaggtattggttaagygygagtattttygyggtaygtggtgyggtagtttttggggtagaggagygyggtygtagtttattygggtttttatttttttttttygtagtygtgttgaaggtygagtaggyggyggtgtttaagtttttattggygtygttgggttgtttagggttgagttttgygttgttggyggtagggttygggttgttyggygtygygggtgygttatatttgtygttygagttgtagtttygygggaagttggaggyggtaggttttggggagttaggtattaaagttaagaaggggygtyggagtygtattgtgtttatygagttgtagttgatgggtttggagaaaygtttygagaagtagaagtatttttttaygtyggataggtagggyggtataaggttggggttagygggttgtgggagtgtggttatttgttttgttgagggtgygttttgttttttttagaatagattttgttgagtttttgggtttgagttagttgtaggtgaagaygtggtattagaatyggaggatgaagtggaagaaaatagtgagtgtgtttggtggttttttattttttagttttttgggttatgtttyggtgtatgtagagttgtttttttttttttttttattgagattttgtttaatttttygattttttyggtgtttggtaygtatyggaatttttttagttttttttgttttttgggtaagttaatatttygttttttttygyggtatttttaggttttttggtagttttatgttttttaggtygggtygttttttaggyggtatttggataaatggtygttatttttygggatatttttttattatttttttatatggattttgtattttttagttttatttgggtttaagttttttygggggtttttagtttaygtgttggtttatttaggtgttggyggtttttygtgtaggtgttgtagggyggyggtttggagttttttattaagtttaaggggyggtttaagaagaatttaattttaaygagygagtagtttattgagtaggagygygttaaggatgtagagaaatyggyggaggtgtygggygagtttagygataggagtygygaggattgagggyggtatayggtgyggggtttgggatgttygygttattygtagtttttttattyggyggaaattygygagtyggttttttygygtttaagaagtttattttttaagtttttttattatgattttgaatgyggataattggggttaaaygaggaaggatatagatttaaaagttagatttaggttttagygygtttttgggttttaatttgggagattygtatttagttyggyggaagttatagtttttattttgagtttygtggygtagagygttttaygygtatttaygtttygtttttygtttgtatttttatttygtttggggtttgttttttyggtyggggagtttttaggtatatattygtttttggaygtyggggatttagyggttgggtttaggttataayggtttgagattgtttyggggtaattygtyggttyggtttggaggtygggttttygatgtygttggggtttttatttttttttgygaagayggtgattttttttttaataaaatattttatgatataatygggttyggtggagtagtttttgaattygtagggggtgagggtgggggtgggggtgggttyggtaagataagyggaaygygggtagttgttttttaaattttttttttttyggttttgtygaaggtagttgtgttttttattattaagttygggttaggtayggygggyggttyggtggttgtaggattttaggaatygtttttattttgggygtgaggggttagtttgaattttatttttttttttttgttagttagagagtygttggtaggagyggtttggtygtatygygggtgtttaaaggagygggagttagaggttygtygtagagttygtttyggaagtggttyggatagagagtygtttyggttgttgtttyggttttttgggatttgaaggattagttygtgyggtttttgagatggtttttattaattttttatgaggyggatgggaagtygaggaygtaaggtttggatagagtttttttattagygyggtagttygttygygggtttttgtagtagtaatggttttttagagtttttatatttttygtaggatatttagggyggyggygt

SEQ ID NO: 6900 - DNA, 999 bp, Artificial Sequence
  Description of Artificial Sequence: Synthetic polynucleotide
ygttgggagtyggggygygtttttgtttttygygttaggagaattattttygttttyggagggagttygttttygtgagggtygtttttagtttyggttygtygtttgaagatagtagtttygggaatygygaygatagtatygaattggagattaggaagttttggtggaaaaggttaaggagtggtgtgtaygyggagttygggattygggyggggatagagygggagygygggygtagttygttagygtyggyggtagagttttagttagaggttgygaggggtttaataggtygttaaaggtgtttttggttagagatgttatagygygtatttaggtaggaggtataggggattttttataggggttgygggagttggygttttttygttttaggtygggagttgagaggggttttagygtttaggtygattgygttttgatygggagttattgygtttagygtagttygagggygttgagttyggaggatgyggygyggggygggggtttygggagtaatagagattgggattygagggttyggttygygttgttgtttaygtagygtttttattttggaaagagtgtttttygygyggygggtyggtttttttagygygtatttggggttgtttttgtagggttattttygtttttagggaggtttaygttygtyggygaggaaggatggtgagttttggtttagygggaaggttggaggaaygtaggttyggaggaaaaagttttttagatttgggttattaaygaaggtttttatagggattattaggatygggaygtygtgggtagaggygttatgttttttgygttatttttttggggatygygygttagttygtggtgtagggtygagttttggggttgtgagygygygtttygttttygtgygttggtggaaagyggggtgttygtgygtgygtttgygagygtgtgtyggttgtaatygtagggagygtaaataggtygttaygt

SEQ ID NO: 6901 - DNA, 1750 bp, Artificial Sequence
  Description of Artificial Sequence: Synthetic polynucleotide
ygygtaygtattttagaggttatttagattatgtttygtygtttgggygtttaagttgtagtygttttttgtgtgtaggtagtagttgtttggtaattttygagttygttygygtttttagtatygtagaattagggttaggtgttttagtggttgtagttaagttaggtattttgtttagyggyggttgtataggagtagaatygagaattygtygtttaattttatayggggtgattgtygagtgtttatgttagyggttttaattttttttaggtggaggagtgggygggaggtaygatttgggggtttttaggttgggygygttggygatttygaggtygattaggttatgtatttttagttygtttgggtatttaagttgtagtygttttttgtgtgtaggtagtagtttttaggtaattttygagttygttygtattttttatattttagaattagggttagatgtttttgtggttgyggttaagttaggyggtttgttttgtagtagttgtataggggygggaatyggtttttagttttattttyggtggttgtagagggtttttggttagaggtttygagttttggtagaggaggagtygggtgggggtagggtttggygggtttttaggttaggggtattygygatttagaggtygtttaggttatgttttattatttgggygtttagttataggygttaggtaatttttaagttggttggygygtttagtttygtagaatyggggttagatgtygttgtggttgyggttaagttaggyggtttgttygyggyggttgtatyggggtaggaatygatttttagttttattttyggtggttgyggagagtttttgttagyggttttattttttttyggaggaggagaggagygggagttayggttaggygggtttttaggygggaagggatgygygtttgygatttygggatgttttgygygagtttaggagaattygtaagttagyggygtttgygttygagttgtagtygttttttgtygtttaygygagttygagagyggttttyggagttygggttagygtygagttgtaggygygygtttaatygttttgttgggtttaygyggtttgagaggtyggagygtttaattgttggtaygygagtaayggtttagttaagtttattyggtttgagaggtyggaggttgygagtgtygttgttgaaggttgtggtggatygggttggatygyggattttgagttatatygyggggttgggggtggattttgggtttgggggtggattgttggtttggtggtggattttggatttaggggtggatagyggggtggggagggggatygyggatttggaatttggtyggggtggaaaggttaygaggagtygyggyggtttagtagygggtggttggygtttgagaagtygttattatgaggaaattttttagtttygggagaygtttgggttaggygtttttgagttttatggattaagagtaygygggtygggggtattatatyggggattgggaattgyggaagatttatagggtggttattaagggygaygtygyggaggtggagygttgtttgattygtaggtttygggatttggatgttygygatagaaaggataggtagygggggtttagttygyggtgggagggggtttttaggttttgtttgttygtagygtttgaggygggggttttggaggtygtygggttttggagtygyga

SEQ ID NO: 6902 - DNA, 391 bp, Artificial Sequence
  Description of Artificial Sequence: Synthetic polynucleotide
yggtgttggagygaggatgygtagatygaggtagggaggygggggtgygggaggtttygyggttgygygggygygtgttggtggtttyggyggaggtttagtttyggttygygttygyggygttttygttgyggttygagyggtttggttgygggatttgtgygtayggatggygyggtygtttyggtagtattygggggtttgggygtygttgtttttgttgttattgayggggttygtygtttgygtagttagtttygyggaygayggtgygggttyggggggtyggggatttyggggaygygygyggggggataygggygtygaygaggyggtgtygygttaygattttttttayggtattttygygggggagttttaygatttgygt

SEQ ID NO: 6903 - DNA, 817 bp, Artificial Sequence
  Description of Artificial Sequence: Synthetic polynucleotide
ygygygtygtttttttyggagttttygagttgttgaggagtttggattgtgtttgtttttagtgttagatgaaagggygttgaggtttttggtygttgtttygygtttagtttygygtaygtttttttgygagttyggtygtttagygttttttttygttygagtygtygtttgygtttyggggtagtygttttgtttttagygygatgtggtttygtttggttttttgttgttggggtttggygttygtttygggttgggygattttttagtagatgttttygtygygtaattttagttttygtttttttttygagatygygttyggggttttygggagtattttygygtygttygtttttggygaygaagyggyggggagtagagtggagyggttgggttaggygtttyggygaygygtgyggttgttgygggagtttagygagygtttggagtttgtttttttggtggatgattygtttagygtgggygaagttaattttygtagygagtttatgttygttygtaagttgttgttygattttttygtggtgtttayggttaygygygtggttatygtgattttttygtttaagaattaygtggtgtygygygtygattatatttttattygtygygygygttagtataagtgygygttgtttttttaagagatttttgttattttttatygaggtggyggtatttatattaagggygttttttagtaagtygyggtaaggygttygtttttttygattygggttttagttttygggtttttygatttatygttgtttgttygtttttatttygg

SEQ ID NO: 6904 - DNA, 814 bp, Artificial Sequence
  Description of Artificial Sequence: Synthetic polynucleotide
yggagtaygggttaygtgttttaggtttygggaattagtttttattggtygagggttygyggggtygttaggagggttttttaggttttttttagggatggagtagttaygtttttygagtgtgtttattttatygatggagtaaagtgaggtttttagttygttyggatgtttttgygtygttygyggggtagttttygtatagataygttygtaagttttygattygttygttattygygtttagatattygygagtttttggggtygtagggayggtgtagygttygtygaggygtttttatttatttgtgattattgtyggagatttttggttttttttygttygtagttatatttgtagygtgaaygygtttyggggtagttygaggtyggttyggaggygtagttgttygtttygttygttgaaatagagygttyggttyggygggttyggtttttyggtggygtttttygtttttygttgttgtygtygtygggggaygygtayggttttttaggtatygttyggyggyggyggyggyggyggygaggygyggyggtygygggtygttygggtggygtaggtggtygggtyggyggyggggygygggggtyggtyggttygygggttttttygggttyggyggggaygttyggttagttygtagtttagygyggygtttagtagttttaggtgtagtatttaattttagagtygtatgttygayggtttttttygtttttttttygtttttgtatygttattyggagttgttagttttgggagtttyggygtttygatttttttygt

SEQ ID NO: 6905 - DNA, 1429 bp, Artificial Sequence
  Description of Artificial Sequence: Synthetic polynucleotide
ygygagggaaggattattaaatttaaagaygygygtgttygtgtgtttatatagaygtgtgtttyggygtttgtatayggtyggygygtaggtatgyggaygtttataygaatatataggtatgttttattgaygtatttggggtatttttttttaaagaaagtaaggaatgaaaatttaatttgagagttattagggtttatttggaggtygtttaaggggtagaaaaaatttgtaatgaygttagagtgtttgtttttggtgtaattttattttygggagggttggatataataygtttggaaagttygaggggttgttttaggatttgggggyggggggtggggtatttagtaatttttgtygygggttgtttaagaaaygtggaaatatattttgygattttttatttttttatatatataggtaygygatttygtygttatttttyggattagtagtttaygtttaaygttgggtygattttagatatataggtagtygggattttygttyggtgygtttgtttatttatttttttgygttaggttgggaygygtttygtttgtaaaaggtttaaaygtatttttygtygyggggygggatttaggggtttaggtttyggggtttagaggygggtaattttgttaattttttttagyggyggggaaygtygygtaatygttgagttttgttygtygagattaaataagtagaggaataggttgtaaatatatattttgataygtgagtgatatttaygyggtgygagaagttgtagttaagggaaaggtaaggggtggggggagygggtatygataggtayggaattttygtaggygtyggaaayggyggtttttygattttttttttttttagaaagtggtaaygaatgtttaagtttttygaatttgttttttgtgggaggtgataggtgaayggaatttaggtttggttattttygtygttgtttatttttttattatttgttttttygtagataagtagattyggygtataatgaggtagtagtttttagtyggttatygtgattaatttagaataaaagygttttttttaygttttttttaataaaggggttattagtttyggygtttttygaaggttgyggggttttyggttgtyggttgyggagttgtygygygtaaatttttyggggttttyggggttgtyggygttayggagtyggggtygyggagggaggaagygtaagtygttyggagaaagtgaggttagattyggygggggagaggggagggagtygggyggtygyggaaggagggtgattgattagtgygyggtgttyggygttttgtttygttattagaggyggttaaagtagggttaygtaataattttagaatygttaattaattgaygttgtaggtaattattttattgtgygygt

SEQ ID NO: 6906 - DNA, 7708 bp, Artificial Sequence
  Description of Artificial Sequence: Synthetic polynucleotide
yggaggggaaagygagtttyggaaataggygtagtttgtggygagggttyggtggtygagttgaatttyggggtttygggagattyggtttttgygggggaggtttttttygaagtygttattggygggggagtagagaaaaggggaaagaaggggagtggagaaaaagggaaaggagtyggttttaagtagygaggtygaggtyggttagaggtaagggtagggggyggyggygggggaggtagtygtggggtttaggtttggtyggygtttygaatttttttattttygtttttagtgttygggggygggtygagattttttaggatyggattyggggaggagygaggggtygaggggagggggaggattygggttttttttttttttttttttttttttttttttaattaggtygatttaatggagttaaagagttygtaaaattatgaataatttattygtgatttgttattaatttatygggtttygagtttttgtygttgggattgaatttgtaattaaatttgatttygttttattttattaaagaygagattgtaggtttaattgtttaaataatggattggaattaaattagtaattaygtygttaggtatatatatataaaaagttggggttgggggaggtygggygttyggtyggttygygygggattttygyggtygyggygygtaaatttaggygtaaagtgygyggttygggtttttygttygtttttgtygtygttttygtatttttagttygttggtagtttttttyggggtagggggaggttttygttttatyggggttygggttygaggggttgygggaagaggtygttgyggtttygtttyggaaggatttttygatttygyggttygyggttttgttgtaagtttagygttyggygtttygayggygttttttttttattyggtttttagttygtygttttttagtaaggtgtygtygygtttyggagggattgtttttagagtaagaggttttgtaaggggtygtygtggttgggttataggatgtgggatattgttataaataagttygtgttttygtggtyggaattttgtaygtataygtataygattygygttygtatatttygttygygatygtattttttagggttttygttttttagttttagttgtttygyggtttatattgyggttattttttttttgttagtgygggaggggagggaagggyggaygttagatttaggaagattgggttgggtttygagaggtyggggagatgttttttttttttaatttagtttygggagtttygaaagagttagtygtatagttatygtyggygtatygaaygtygttttttttaggattaggagtttyggttaaggtyggagaggagggtaygggaataaataygatatatatagagatagagatagagagaaaggayggagagaayggaaaggaaaaaaagagagagggaggttagagagaaagtgagatggttgaatggagggtgttttttgtagaggttaaataaggtttgaaatttagtttttagtttatttygttggggtaaayggyggttgaatagtaaaaagtagaaataaatttttgtattttttattttttttttgtataattttaaaatyggygtygaattttygtgtttaggaaaataatatagttttttagttattaggtgttttggagtygagtttygygaggtgttttygagtggaagttgatttatttgataaatagaagyggtttggtgttgggggagtyggtttgaattyggttttgtttttttttggggggtggtaggagaggagggatggaagttttagagagttatatttgtggtagtgtttttagtaaattttaaattygygttatygatyggtttatygttgttttattatttattaaattgggggttgygttttttttttagtttygtatatagggatataygttttatgattttttaagygatttygttggagygaatattygttttttatttttttttttatttaatttagattttttaagatgaaaataattgattttttttygtygtagtattttttgtatagttttgggtttgtttttgtttttgtttttttttgtttgtgtattagattaaagggaaaaggaagaagaatataaaatttttaaatttaattttgttgtaaaygaaagaaagaaaataattgtatataaattttagttyggaagttyggagagttataaattttttygggttttgtagatttygggtagatgttgayggtttatttgtyggaatttagaatttttgtagttgttttgagtagggaggggygygggagggggtagagttttttygggaatggtttggggtttaaagatgtyggaaattygaattaagttttttattttattttattttattttattttggygygaggttaggtttgtttyggtttygttttygttyggggggttygttttygagggttayggtttttattttagtaggygttaggaaattyggaggaaaaagttygggaaaattgagatttgtttttaaaggaggatygggtygagtaaaaggaatygtagtttttgtttttttgagttttttaagttygagttttttaagtttgtygtttttgggatattttaygaggttaggtygtattttaggtygagttyggygtttygggttatagttagtttttttttttgggattttygtygttttgtttygttttttygttgttttagttttyggtttttagtygygttaatttaaaatttgtttggygttagygtygttttgttttttttatttttgttattttttgtttagtaaagtggggtaaaggtttaaattaaaaagttatttttaaaaaaataatttattagagataaggttttgtattyggagtagtaagggattattgtatttttttttttygttttagtygaggaygtatagtttggaagtttagggggttaatgttttttttgygaggtygttyggtgtttaaggttygttatttgtttagtatatagagatttaatttagttttyggtygtygaggtygtatatttttttttaattttatgggggygtttygtgygtygygtatttattagygttgtaggtygttagattygtatyggggttygggtttttaygttttttyggtygttttttttgtatagtgtttaygttattgtagtagggaagatttagagggttggtttttgttgygtttagtttygygtttttggtygtygyggttgtagyggtygtygttgttaygtyggtatggttgaagtgtgyggggtattygttttgtagtagygtttygaagtgtaagyggtagtagattaggttgttttttatgtygaagtggtygttygtggttagtattttgttataygtggtgtaygtgaagtagttgaggtgataaattaagtttygagygygtattattattttygaggtygagatgtttaggtggtagygggygtagygttgtatagagaagygtttgtagggattatggagggaggggttgtgggaatatayggttgggtattttttttttttttttttaggtgtygttgttgttgyggggggtaattttttttttaagaygaataattyggtttttatttggaggatgggggggagagagaattagattttgatttaggtttggttttgttttaaaatagttttttttaatatatttatgtttatagagatttttattttatttagagttttygtaagttttaggaaagtttttatttgggagtggagggagatatttattatttattttttttttaatttttatttttttttttaaattagygtttgggaattttattgatttttataatttggaagaaatatagagatagggaaagagagagagatatagaygtagagatagagatagagagaatatatatagattttaattttaaaattggggagaaggagaaatagagaatttggagtttattagtgattttggttttttgattttggttattttttatttttatttttttaaaagatttggaaatgtatttatttttatagttttttttttagttgtgttttattttagtttgggttgtttaggtttgggggtgtttgtttttataatttyggattaatttaagaaattttaaagagagaggggagtaaggattttaatttaagtttttttgtggtttaagtttygagtaggagggtagtttttgttttttttttggtttttttatttygtagatttttttaagagttttttaaattgttgttttaaaaggttattatttaatttgtggtggtttggagaatttggggggggagygggggagttttgagtagtgaatttttttttgggattaaayggaaaggagagggttaaattgtaagattgtgtttgagattggggggaggggttttgaggggtagttgggtgggggggttatttgtagtagttttttttgtagtagatgttatygtttttgttgaaataggtgagtttygattttaggttgagtttgtattygtagtatttgaggtagygtatgtgttattgtttgtttatygttagtaggtagtagyggttygagattttgttttygtagtyggygtatagygyggygyggttattgttgatggayggtatggtttgygaagggagggaggyggaagatagtagygtttgygttagttagyggttttttygtygtygggaaatyggtatttataattttttttgtggttttggttattttgaaygyggagggggttgttaggatatgyggygygtttttttttattttaaaaggtttatttttatttttgggyggtttagaatttaggtttgtttgygtagttttygttagttaygggtttaggtygggtttttggtttaaatggttttggtgtttattttttttttttttagttttttttgtttttttttttaaaatgttygggttgtgtttagggattaggatagttattttagttaagttttttaagagttttttttaaattgttttttaaatgagttattygggggataaggtgattattaagttattttttatatagaattttttttggagagatagyggagtttttgggttttagttttagtgatttttggatttttagattagaggttaaggttaggataagttagttaatttttggtttttttgttataygggttggggtttttttgggttyggggatgaggtaagtggggtgtagggatatttttaaagttygtgggtgaaggataggtttaatttaaatatttttttatttaaattgattagtagagaaggtttaatygaagaagygtttagaggtygggaggatattggygtygttgtttttgttttyggagtagagaagtttttttygtgttttttattttygyggttttttaaaggttatttttgggttygttggtygggtagtgtttgttygtttggtttttagggaggtttgaggygaggaattggttatttggggttgggttygyggagttaggtgtagagatttaaatggagtttttttyggygagggttaggtyggagtttgaatttttagttttggtttggttaagtttgattagttaagggtttggggaygygattaaygataaatgttggtttygaagatttyggtttttgaaattgygttgggggttgaggaggattttygattgtyggaaagttgggagyggtttaagtyggttggagttttaatgtttttagttggttygtttttttttggygtygttygyggygtygttagtaatyggagtygagaggtggaggagagygyggggttgtygatttyggtatygggtaaggtgagaagggagtygtttygggtygyggatgggatttygtttttagttyggaagaaaygtttttttttatttttagggtygagatttyggttttaattttgttttttttttgygttttagtagtygggtttttttygaatygggagttatyggttttgtattttgatygaggatttttagtatttagtttygtgyggtaygaaggaygttttttaaatttyggggagtagaggygttgattggttyggttttattttagtttttagtttygattttatagtygygygtttatygtttyggtgtygtygyggtygatggyggagttgatggygggagtttygtttttggttttgyggtttatttygtygatgatttygtgtatttyggggttygatagattgtggaatagtatygyggygggatyggyggggtygggggygyggttttttygagggagggtttgtttttygttttagttgtttggygtttttggygttaaygggttyggtgtatygttatygyggtttyggtttygttygagttyggttgagtttttaggtygggtttygggtttygggygttygyggggtaggaygtttttygtygaggygtaggggtagttatattgyggggygtttgggygayggygttaaagttagggttataagggtaygggataagyggggyggggggagtaggagattaggatagaggtyggygttygtygygggygtttttaygtygygggtatygttygttyggttttagygttyggggygtaaagtaagggygtaaattttgttygaggyggygayggttgyggtyggggtttattttgaagtygttaggtgttygyggyggtttagttgtttggattttttttttttttggggtgygtttttagtttaaggygatttttttgggygttgagtyggygattggagtaggggttttttygaagtttgygagtygagtygagttatygggagaattgaagaggaggaggaagaggaggaggaggaggyggaggaggaggtggaggaggagaaaaaagaggaggagtagagtgggaggaggagtygtyggtygygggtttagtygygygtaatgttttttaagygygygtttagtttagtttyggttttgtagttygygttagygtaagttttygygttttttttatagtygygtttgatattaygttttgtygtygtgttattggtygttyggygttttaggttttggtagygygtgtttygggaaggygggagatttaagagggaggggagaggtaagaggagtagaggagagtygagatggtgggagttggtgggygaggttggagggygggggtgggggggaggtagggaggagggagagygyggggtttggagtttttaagataygaatagttttttgygatatttttagaaaggaaaattaaattttttattttaagaaggygtagtaaggggatgttygttttattgyggttttttttyggtttggagtygyggttttaggtattygtttgggaggttygggaaggtaggtttgtggtagagttgtaagagttttyggtyggtygttttttatygagtttygttttyggttygggttttgtatagygggttgtaggyggtygtgtaagttttttgggtattyggtagagtttgagtggygagatyggygagagttgtgattttyggggaggggggttagttagtatatttaygttttaagttygttagggtttaatttgtagtttagygtgtagtttttygtttttttygg

SEQ ID NO: 6907 - DNA, 3969 bp, Artificial Sequence
  Description of Artificial Sequence: Synthetic polynucleotide
ygttttttttgygagtygygygygtttgygatgygtaggttgttttggatttttyggggattggggggatttttttgggaagttaagggggatattttaagtgtgttttgtaaatygtattttttgatgtgaaaatyggtatgygyggtgyggtygtayggggagagygygtgtttgggggtggggggtatygtttaggaaagyggagttatttygggyggaaagygattttygtagaaagygtygygygggygtygttgygtgttygtygtttatagtygtagttaaagagaygtaggyggttttaygyggtttggtttatygtygtttgtagtgttygyggygyggggygtttygaggttgggtttatygtttttttygygtttttgaagatttttygggttttttygaaggagtattgtttttttttgtattttttttttagggagttyggtygtagtttttttaggaaygygttggygygtyggygtyggtgtaggaygtygtgggtttttttttgggttaygaagattgggaaatgygagtttygtgaagygtttatygygtgtttygtttagtgtttyggagatygttttayggtttaygyggygggggtatygtaggttttygttygttttggaggaggggagyggygttgttygygggtttggttgggtgttttttttgtygtgttttygggttagttattttygtygtttatttttttyggtttggtttttttgttttygggggttgatttygagggygygttygggggtaygygyggaagtygggtygaagggggttgygggygtygtygygtaaaygtgaggttgygggtygatgtyggygaggagaaggyggygyggtttygggtgtygggtaattttttggggtttaygtgaatygygygtggaaattygtatagtygttygyggaaatttaaatttttygtttttattygtatygygttttyggyggttagattygttttttttaggttttygttttggttygaggygyggtttttgttyggttttttygatagygagtttygggttttttygttagtttttggyggttttgggtttttgtygtttttttygttttygtttggggtttttttgtttttygygatttttgagagttttagatttygygyggatttttttggggtyggttttgagagtatagtttttygtygtagtttttggttttttygtaatttygayggttatttgtggataaataggatygtygttttgtttatgggaagayggggttggtgagggttagagaygtttagggygaggtaatttygtgygtttagtttygagtaggtygttttttaggaygttttatagtygaggggatygttattygggagygtygtgagttgtgggtattaygyggtggtggagagtgattttygtttyggggyggtygtgttgttygaatttgttttagttygygaggggagaygggtttgggggtaggygggagagggaggtttygggaggaggygagyggggttgagaggaygygygggaggggttttggagaggtygtaggaggygygtttyggagggaygatttttgttgggaggaygaggttttaggtggaygttgtgggtyggtgggtaggagttygagttttgtaggagyggtttaaattggttattgagygyggaagaagggayggaaggtgagygttattgggttaygtggggtygagagaaaggttattgtttgttttttttaaaattagttttataygtygaygtttttagagaattggtttggtttggaaggaggttgaggatgtaggyggggatattaaagaatygggtttaaggaggtgggaatttayggatttygagtttttataggaggtgttttgggyggtaggagtgggaggggaggtttatgtttttgtagttttygatatttaygttttygggatatttaygattttygggatatttatattttygggatatttaygtttttyggatatttaygtttttgggatatttatatttttgggatatttaygttttygggatatttatattttygggatatttaygttttygggatatttatattttygggatattttygttttyggaatatttatattttygggatattttygttttyggaatatttatattttygggatatttattttttygggatatttatattttygggatatttaygttttygggatatttatatttttgggatatttaygttttygggatatttaygttttygggatatttaygttttygggatattttygttttyggaatatttatattttygggatattttygttttyggaatatttatattttygggatatttattttttygggatatttatattttygggatatttaygttttygggatatttatatttttgggatatttatattttygggatattttygtttttggaatatttatattttygggatatttaygattttygggatatttatattttygggatatttatatttttgggatattttygtttttggaatatttatattttygggatatttaygttttygggatatttatatttttgggatattttygttttygggatatttatattttygggatatttattttttygggatatttatattttygggatatttaygttttygggatatttaygttttygggatattttygttttygggatatttaygtttttgggatattttygttttyggaatatttatattttygggatatttattttttygggatatttatattttygggatatttatattttygggatatttatattttygggatatttatattttygggatattttygttttyggaatatttatattttygggatattttygttttyggaatatttatattttygggatatttataattttygggatatttaygttttygggatatttatattttygggatattttygttttyggaatatttatattttygggatattttygttttyggaatatttatattttygggatatttaygtttttgggatatttatattttygggatattttygttttyggaatatttatattttygggatatttttattttyggaatatttatattttygggatatttaygttttygggatatttatattttygggatattttygttttyggaatatttatattttygggatatttttattttyggaatatttatattttygggatatttaygttttygggatatttatattttygggatatttaygtttttgggatatttatatttttgggatattttygttttyggaatatttaygttttygggatatttaygttttygggatatttaygttttygggataygtatattttygggatattttygttttyggaatatttatattttygggatatttatattttygggatatttaygttttygggatatttatattttygggatatttaygttttygggatatttatattttygggatatttaygttttygggatatttaygttttygggatatttaygttttygggatatttatattttygggatattttygttttygggatatttatattttygggatatttattttttygggatatttatattttygggatattttygttttygggatatttatattttygggatatttattttttygggatatttatattttygggatatttaygttttygggatatttatattttygggatattttygttttygggatatttatattttygggatatttattttttygggatatttatattttygggatattttygttttygggatatttatattttygggatatttaygttttygggatatttatattttygggatatttaygttttygggatatttatatttttgggatatttaygttttygggatatttatattttygg

SEQ ID NO: 6908 - DNA, 2490 bp, Artificial Sequence
  Description of Artificial Sequence: Synthetic polynucleotide
ygtgaattygagtttyggttayggtygttattygtttttatttatttttaygttgtagtgygattagttattygygtggtattygttaygatttagttgggtttatagataggagttgtttttttttattgtaggygggtgatttaaggtttttattgttttatatttgtttagatygyggggtattygggtttygtagttttttggtygygttyggggttyggggagtygggttgyggttggggggtttggaggatgagggygaagattygagttggattgyggagagggtgtyggygygggtygggtttggggggaggataygatygggttttygttttyggatatygtaygygtygatatagaggggtyggttttyggttttggygyggygggttggygtagggyggggtggyggttgaggggttygggttttaggtgygtttyggagyggtttyggyggyggtgygggggggaatagggaggtaggatggggggyggggaggygggaggggggagtygaggttttygygtygttagtttygygttttygttttttygttttyggttygagyggtygttatygygggygggyggygttgygttygggtgyggtttttygtyggyggyggyggygyggtygagaggtgygggtttygygygggygggaygyggggygttgttygtaggagygattaggtgggygtygggtygatygtagtygtygtygygttttttttygygtttygggttttggtttttygygtttttttttttyggatttygttttttygttygaggtygttttttygtttygggttyggtttttyggagttygtygattttygttygaggttttttygttygaygtttyggtggtagyggyggttygggttgygtttttygttgtygtygttgttgyggttttgtttttttyggggagggggtttyggyggttttgygttttygggttttyggtttyggygtygtygtttttygttttttgyggttygggttttygtttgggttygattttgyggggtttygttttggygtttgggtttttgttyggtaggttttygygygttttttgttttygattttygggttgggygttttygtttttaggtttttttttygtgtttttgtagtttttyggtttygttttttyggggtttttttygtttyggygtttttgtttgtygtttatygttgtgtttttggttttgygttagttttttttgggtttttttttygggttttygttgttttttygagtttttgatttaattttttatttttygtttttttttttttttttttttttygtttttttttttttttttttttttttttgtttttttgtttttttttatttttttttgtgtttygttttygtygggttttttttagttgggygttttagtgtttgtgtttttggtattttyggattggtttygtgtttgygttyggtggygtyggtygttgtttttygttagagtttttttttatttttggttttttyggattttgtttttgtttttttygtttttgtygggtttttagaatattygggtygggygttttagygtttttgggttttttggygtttttttygyggttgagtttattttttttttttagaatyggggttttgtttttagataaaygaattttaatygaagygtatygaattygagggttttagatygggygygayggggttygygygggaggagtttttyggayggggygggagygtggggtttggtaggggaaggtygggygyggggattgtatyggatttatttygggaygttgygyggggygttyggtgggtgtyggyggtagygtttgggtatagagaggggattaygygaygggtyggygatagyggttggggyggyggtygyggggattttaggttgtyggttttygtyggttttttttgattygttgttttttygtaggyggaygtygygggtatggattattygtaygaygaggatttggaygagttgtgtttygtgtgyggggataaggtgttyggttattattayggattgtttaygtgtgagagttgtaaggtgagyggygagygygyggtaggggtgyggtagaygggygttgyggggtttygttgatttttagttttygtagggtttttttaagygtayggtgtagaataataagtattataygtgtatygagagttagagttgtaagatygataagaygtagygtaagygttgttttttttgtygtttttagaaatgtttgayggtggggatgygtttggaaggtgygygtygygygggtttygatttttgattttttatagtttgagggggtagggggtgggggtgggagaggggttgaggggatagtattattggttttygygaaggtttttygtgygatattagggtttagtygttgtaagagaatygggygttggygttgggtgggtttygggyggggaagggaygt

SEQ ID NO: 6909 - DNA, 5370 bp, Artificial Sequence
  Description of Artificial Sequence: Synthetic polynucleotide
yggtyggtttagygtaggatttygggataayggatggtaattgggggtygttyggaggtttttaggattttattagtgttygttgggttgggttggttygttttagttttaagaygygtagttttyggaatttttggagttgttyggtttagtygygtatagagtyggyggtagagygggygygggtygggttyggtagggggttgatygggttygagtgtygggyggtggyggggaaggaggaygagaagygtttattgttggtagttttgtttgtagtatagttttygatttyggaagtagtagttggtggtgagggtttgttgataygtygygtattgtaaatatttttygtgttaggaygattygttgattygtattaggaagyggtyggagatgggtygttggtagttttygtagayggygggatgygggtagtyggagtttgtagygtatagggygaaagttyggtygttagygtygttyggtttagtttyggygtttyggtygtatygggtttatagttttyggtttygagggttygggtygttygggattatygtttgtygtttgygtttttyggatygtygygttaggggtygggyggtttyggttagttygttttagttttygggtttyggygtggagaggtygygggtttygagttttggttyggygttgtgtttttttttttttyggagaattygygtttygtgttaagataaatgataaygagtayggygtagggtggtyggttgggattaagataggygaggtgaggttggggygttygttggttgataygttttayggtggygttygtggttttttattttygatttttttaaaatttgtggtttgagtgattagggagaygttttttttttagaattttttttattttaggtgattttgygttttttttaagttygttaaggtgattgttaggttttttattatttttgttattygttatttattatatyggagtggtagttttagaatttaagtttggaaaggatggtgggtggygattggagttgttttgtttttttaggaygtttgtyggaggygtatttgyggttttttggygattattttaggagttttgtttttgttttttttttatgttttgtaaatttattttttttattygttggttttaaygttygtgtttatagtyggaygaygttttattttaygttygagattattygggygtttygatttygtatttatttagtagtatttttagagtggygggttyggggygtagggygtgtttttttattttgatgtygtttaatattttggygtagttygtttgttygygagggaagtatttttttagygattygggatttgttgttatatttatgggaygyggggygygttgyggatttygtyggtygggttgttygttygtyggttygtttattygtttttygttgtygyggttttggaatyggggaggygyggttttygtagggtaggggttgygtyggttttyggygatygtggagyggygaygygttggtttygggtttyggygtygtgygggygggtyggggyggttgtagttygygtygygttttttyggatatttgtagttaygygygtyggtttttttgttatttgtttgttagtttyggaattyggyggyggyggttgttgtagayggagtygyggggaggaggyggyggyggyggtggyggtggyggyggyggtaggygggggagggggtgggggtgtaggggyggtttygygggtygyggggggggygygyggygtagyggggtttygggyggggygtagygggtygyggggtttygggygygtttttygygttattttagtgttatggtgygttygttgagtygtygggtttagagttggggttggyggyggagggataygggtygttttatttttygaaattttttgatatttgaatttygyggtyggtatttttgygtygggatgygtygtyggttttaygttaaatagtgtygtttygttttttygygygtttyggggtttygygtttttggttygygtttygygtygygtttggtttygagtttaggtttyggtttttyggttyggtygtttygygggtttttygtagaagttttgatygttttygaaataaatttttttgttttatttttttgaaaaattgatttgggagttggggagygaaggttttttttttttttttttgttttttttattattaatattttgtaaagttttagygttaygaggagtggtttygagygaggttagattgygyggayggtagggagygyggyggtttygttaggggayggygtyggtygggagtggtygtttgggaattttygattgtyggtygaggtaggtygygggggttgagtyggagtttttygggyggyggygtttgttyggggtygtttggttygyggagagggtyggtttttaggaaygaaggaygggggygggtagaaggygaggayggttggttttggattygtgtaaggggggtttaggtttaggaayggggagtgagtttggagtgtgggtgaggggtttgggaaagtttygggtttggtagagattgggygggggattgagtygatgggaggttggggtttygggatygagaatgggggatattgggaygataaggaaggttaggtttgggtttaggygatygagagtttagaggataattaaggttggaaaaggggttttygggtaggggtaggagtagtgggtaagattygggttttttagggtttgtagtgaggggygttaggagggagtggtggttttagggtagyggttttgaagaaattaggttggttgttaagatyggggttttttggygggtygggtgttyggttaggggtygttgggaygygyggattaaggatagtgttttagttagtttgggtaaagtggatttyggtaaygggaygygaaagttggygagatggagttgtygattttygygttagtygggtttggtattygygttyggtgygagaggttatagygtyggatyggttgtttgyggttygtggtttttatygaygygyggtttatyggggagtaggggggyggttgyggttyggggtagyggygggttgatttttygygattygttgyggggyggtttyggtttttttyggagygaggtagyggygyggagtygggygggggyggagggtatggggggygggttttttgatttygttggaggygaaagggyggatyggatttggaatttgygggaggtttggttagaagtggttttttgygtygyggggtttygyggaggggttyggttttgtggaggattagaggttttygttttattttatttgygtgtgtgtyggtgggtatttgtgtgtgtttgtgygtgtygggttttygtttttgyggtttttgttttygtgtgttttttggttttgtatatayggtatgtgtgtttttgtaattttttagatttttaggggtgaatttgtggatttgtgtttgagttttttgtattygtgtgtatgtgaatgtgtgggtttttygtgtttgtgtttggggtgtgtgttygtattattttatgygggggtttaagtttttgtgygtgttttagtttttgtgttgtgtttgygatttttttttgtatgggtgtttttgttagttttgygtatttgtgtttattttyggggttttgaatgtttttgtgtgttygygtgttttttagtgtgtgtgtgtgtgtgtgtgtttgtgtgtggtggggggttttgtgttttygtgtatttttaggygtttttgtgtggttaggtyggggagagtggatagttaatgtggagttttttttttatatttyggttttttttttgtttgatttggaaattttaggtttggattygygaagttgggttgggtttgagtygtttttttygggtatttggggygggggygyggttgttgtagggagaagtygggygggtaaggtttyggygtatagagttagagtttygaggygyggagygyggttyggggtyggygggyggattaggtattttttgttttttgttggtygyggtttatttttgtaatyggggttgggygattgtttgtaggygagagttttygttttaggtttagatttttttttttttttttagggtgtatatggtaatattttttygttataggttttgtatttttaatttttggygtaaggttttattttttttttattttttttgtgtttggttttttttattttatagtttttttttttttttttttggttgaatgagggtttttgygatttagttttttaggtttttttaattygggttggygtttagtgtygatttggggtygttggttgtgtttagaggygtatttttyggattattygaaggtttggttttaaggtaggaggatttgtgggaagtatttttttygtgtygygtttggtttgttygggtgygtatgtatttttagygtttttttygygtttttgttagttatattttaygttattaaggyggatatagggtggtttgtygttatgyggttygygtttagataggggygttggttyggtggaygttagagtttggttgttttttttggtttggggtggggttgttgagtttatattttttgggtttttttgtatgtttttttygttgtttatttattttttttatatatatatatatatatatatatatatatatatatatatatatatatatatatatatatattttttttataggtttygttttttgttttttgtttttatttttygtgtttygtgtttttagttgagttggtyggtttygggtttttygtaygtagaygygtaggggttttagatttttttagtataatyggggttttygygtttttttatygttttttttgtygaagaagygaagaagyggtygattggayggtatagtaggggtygaggtttagagtyggtttttgttygtaggyggygaayggtattttgtttygttaggtttttgygggtgtgattygtgattygtagattttttygggygtttttggtttatgaygygggggttgttygttttaygtaggyggtttygggatgttttttygtttagattttagyggtagaaatagtttyggattttttttatttgggggaaagattgagtygggggttyggaattattggaagaagygagaatggaaagggaggttttggagygggggtttyggttttttttagtttgyggaygttttagttttattgagtttygttttagttttttygtttttttttttagggttttgtatttttttttttgygttattygtttttttygagtaygg

SEQ ID NO: 6910 - DNA, 3120 bp, Artificial Sequence
  Description of Artificial Sequence: Synthetic polynucleotide
yggayggatyggyggaygttgygggttyggtygggttgataggaattatttgygttgttttaggtygtttttyggtttattgtttttttgaattyggtyggttttygygggtygtttgatgtttgtagggttatagattttygtatataaattatygtygyggggttgggggtggggyggaggygttgaaatttaattygtagagtttgtttygtygtygtttttttgttttttttttygttygttygaygttttttatttatttttttttaaataaggtttattttttttgttaaaaaaataaagttggtattaagtgtttygagggagaaagttttttttttatttttgatttggaaggaagggtyggttgtygattgagtygggattgtagagggggttttaggagaggaygggygggaggtgagtttagggtttttggttttatyggttttttttttygttttygtttgttygttttatatttaatggtagygaattttatggttttyggttatgttttgtttttttattygttttgttyggaaagggttttttttatyggagttttyggtttttatgttgttagagatggaagtattattttttgttttttttttttttttataaaatagtttttgtttgtygtttttaygaggtgatattttgtttttagttygattttttttgygttyggagtttgggttyggygygtaggagattgygtgtattttggygttttygatttttgttagggygtayggggattttagagyggattttttaygagttttaataggaggttagggagtygggatattagagataaattttttygaagttttttttyggttttattgattggagtttttgggttgaaattttaygagttttttatttttatgtttatgaggggagtaaaayggagttttygggggtaygtaggtttygtttttgggtgttggttttgtttttggtttttttagtyggtgtagtgattyggaatagygyggtygttttttygaygttygyggttttttattgygtygaggygagygttayggttaaagtttaagtttyggygttygttgygtttgtyggagttttgtttgttygagtaggtagyggggtttaggtayggyggygaygtygaagggttagtyggtagatagggttgggtttttgyggttagagygtygtaggaaagttttgtaaayggtgggaygagggtggyggyggyggyggyggaggtggygagaaaggygttaygggtttggyggagaagagggttttygtgggggtggaataaaggaatttattttyggaagaaaggggtygagtatgtagtygggaatggttaattttggagatttgtaggagtgygagygttgygatattagttttagggatttaaygaaatttgtttygtygagggttttagtttggtatttttattyggttttttttttttggttaatttygttttaatgggggtggtgggtgtgtattyggagtgttattttttttgggaagaggggatagagtaggattygtgttttyggttagaggaggtaaatatattttattaattttttttttatttattttttagtygtggggttattgtttttattttttagaygttgttaattaaggtattygtaaaattattttttttttygtttttayggtaaygtttyggtttttgaggtttaagygygttyggaaaygaaaagygttagggggttatagggtyggagtttttttttttygtygttttyggaaggggtggaggggatayggttgtaaggtgttyggttttttttttgtgtttgatatgaataaggggattaggatggtaagttttygtygtttatttygtgggataaagggtttygyggtttgagyggtatagtttttgattaaaygatagagttttgttatttagtattattttaggtatttgtgttygtgatataattttattagaagataaaatyggygaaattttttttataatgaaaagttatatttaatggtyggattttttttttattttttttttyggagtttgttygttttttttygttgttgttggatatggttygtttataattggtatttaaagtattaagttygggagaaaaayggggtttagggtttttgtaatttttttaaattgtttttgttygaaatttttatagatataagtttgttaagagtaaatatttgtggattgatataattatattttttttttgtaaattaaatttaaaaaaaaaaaaataagataaaaaaaaatttgttattygtygttttygggttggggygtaggagggagggggttggggtyggttttagtattygygtygggaattyggttttygggtygtttggttgtttttaggagttgagggatttygtaygttttttaggygggaaaagggttttagattttttttygtaatttttaattttttgtttttttaataaataaatttttygaatttgttgtttttggttagttygagggggtyggtaggagggtttggggaggggygagggttgtgtttaataaggaatgaaaatgttagtttttttygttagttttattttttttagygggagtttgtagtggttttaaggagaattattggttttttttggatygygtaaggttttatttggyggggtatttygattttagtttaagagagttttygagttattaagggttttygaaaygttgagaagttygaaagttgttgtagggttttggatttygggttttagtttagygygttttaggatygaatttttttataaattagttgttgggtgaaagggttgygttttagaaagggtaggatygtgtgygygtattagagygygyggtttttaaattygggttaaatttttggtgatatygaaatttattaatygtygttggtgttygyggttyggttgyggagtttaggagtttatgtatggtgttattttatttttagtaaagaatatgttgtaygaatygtygagaggtgggtttggaggggtgygygggtggaggtygttgaaagtygttttattygygtgttyggaygtygaaggaagttttttygt

SEQ ID NO: 6911 - DNA, 3120 bp, Artificial Sequence; identical to SEQ ID NO: 6910
  Description of Artificial Sequence: Synthetic polynucleotide

SEQ ID NO: 6912 - DNA, 7861 bp, Artificial Sequence
  Description of Artificial Sequence: Synthetic polynucleotide
yggattttyggtaygggttgggaggagtttagaggyggggtgagttttaggttygggyggtttagagtttyggtttagggggygtttaggttaggagtgttygtygtttttagttygggtggaagyggygayggtyggaygttygagttttattygygattagygtttttygtyggtttttgygtttttttgttttagttygygygtattttttatatgaggttgttgtttttgtagatgtttaygtgtttyggggygattaygyggtyggtgaaggggtttatttyggttttygttttgatttaygttttggagaagatgtygaggttttygttagggatggagttttgagygatgattattttygtaggtagtattaggttggatagtttttgtatttttgyggyggyggggttaggaaaatyggttagagttygaggtagtygaggttyggttttttttttttygtygggatttyggtttyggttttgtttagattagttaaatttaagtyggttttaaatttagagaagttattygggtgtggaggaagtyggatgtgyggaggtttaaygattttttttttgtttgtaatttggagatttttygtgttttggaaagygagtggtgygttggggattatttttagaagtgggtttttagttttttygygaatttttaaagtattygtaattttttttattttttgtttyggataagtttaagaattaatgagttaayggtagygagyggttttatgtatagggaaattgaggttaggttttgtaaggaggtgaaggttaatyggagattttttygtttagtyggttttygggagtttattgtgtgtttaggttttgggtattggtagaggagtygggtygtgattagygttggggatagatttygggttggtaggtgttggaggtgttaaagaagtatyggtagtagttggttaggttttgygttygttgtgtgatttygggygygttygagtttttttttgtttttaggttttggggtgttagggagggyggygttygggtttagataaatttygatgttatttttttgggyggggaggagtygyggyggtttttagtttttygagggtttttttgtygggtatttgyggtagggttggaagyggygaggygtataagggyggtttttatgttttataaggtttttttttaagttatttgggaaaatattyggygagygggtyggttgaaaggggggggttaaayggtgtttattgyggygyggygggtaatttgttaygttgttaaagtgatygtatttattyggttttattygaaagaaattgttaattttaaatttattagttttggaagaatgttgtagtagtaaattgtagtttaatgyggaggggatttgtttaaaaggggtygaggaattttttttataaaaaagggggattagatggttgatatagygtgaatggaagtggaattagtttttayggtaaattaagagaggaatagaaatygtaaagggggaaaagagggygaygygtagagatgttagagttagggaaagatattgtttgygggttgatgaatgaggaataagaatttgagatattttaaagaaaagaaatttttttygttttttttttttttttttygtttttttygyggtttttttttttygttygttttttttttattttttttttagtttyggttgttttttaaagtttttggtttaagtgggaattttygtgggttaagtttaagttaattaaatgaatttaaaattttttttttttgagttaattgttattataygtttagtaaggttgtaaatgtygggaattygttagtttaagygtaggaggggaagggaggggtyggygggggygtyggggtygagygayggggtygtyggggtyggtttttgagtygggtgggttgyggagttgtttggtggttygygttttggtttggtttatggggaaattgaggtgtatygagygtygggagagtttaggttggygygagtagtagygaggtygggtattttagtygygtttygygtatygttaggaygggaatgggggtygtygggaggagggattgygtygggtttygayggttggatttatygtyggagaaggattgygttagtatttyggyggtgaaggttgttttggggttggygtggtggtttttgttttygaagagttgtttttygagtaygttgygttagyggtygtataggaagttgtgtaggatgtyggaggtgataatttyggttagygttagtttyggygtttttagttyggttttgagtattagggttttagtygggagtayggagtttattatgggyggttyggagtttttyggygtygggggayggtygggtygaygggggaggtgggygggygagaggggagtttaaggggygagaggagagygttgygatggagaaggaattagagtagggggaggayggagaggaggaggaygtaggagggagygggaggtgagggggygattgggaggaaagygaaygagggggagaggggaagagagatggtgaaatttgtagagatggtaaaggyggygyggagggtggagagaygygggtggaggyggaggygggtgyggggggtgtagggtgggtgagaggygggtggttgtagggaagyggtagtaaggggtttaggygygygttagtttttygtatattyggtyggggtygttttttttttggtaaaattttagygtttttataggagtygtagtgatttttttaattggttattaatgattttttgaygtyggaggatagatttgttgtattyggttgggttygaggagttttygtygygagagygygaggggygggggygygyggatygttttaaatagtatttttttattttttttttttttttttggttttttttttttttttttgttttttttttttttttygtgggaagygtagggtagggagggaggtttagtyggttttgaggagaggaggggayggagaaggggagggggtgyggygaggttttttaggattttagggattaggttagataagaggggaygtttggtttygggtttygygttttttttaggtttgatttatgtttatyggtttggtttagttyggygtttatttttattttgttgtttyggttggtyggtttagttttgtatygtttttttttttyggttagagttygygttttttttttttttyggttttgtatttttygggtygttatagtygtttygagttygygygtagttttagttgttaygyggattttttgtttagattgygttgttgaagtyggygtttygttttataygggtygygttaattyggtygttgtgtayggtygggtgygaaattttttygygggtttayggggttgtygaggyggggtygtagyggtygtyggggttggggttggtttyggtttgagatagttttatggaaggttaggttttyggtttttgyggggttaggtygggggtygagatgggyggataggaatygttttggtagtttgtttttgggaaaagaattttttaygggatatagggggattgaaaggggtttygagattttttttaggtgggagtaggygtgtttgagagygaagttttttagaaattgtaggtagtttygygagaggttttagtgygggttyggtttgyggttyggtttttyggttttttgttgagttgtaatttygggaagtyggtggygttgyggygtttttttttttttgttttttagtttttttttttttttttgtttttttttttttttttttttttttttttattttttttgtttattattttaggagtagatttgttttgyggyggtttygaggtatttyggagtttagygattttttttttygaagtaggtagttgttgagtttagyggaaggtttygttttttgtaggtttygyggttttttagtgttagttttaagtttyggattttaggttttgatatgttgggtgagggagtttattttatttgtygtatttttggtttttattattagtttataattttagatgtygttaatagaggtgtttggattttttyggygtgggttaggtttayggattagttttygttggattgtgtggattttttagattttttttttagygyggaggatttgggtggaagaatagygagttgattttttatgagygagattttgtttaaaygtttgttggtatagaygtttttttattattyggaygygttttggttaagagggttttatatttggygtttagattttagatttttggtttttagtttttgttagtagttttyggtatttttygttttygttgggaygtaaagggaggaaggyggyggtagttggtttttagattttgygttygggttygttygaggttggagtttaaggaagggtatatttggtagaaggtaggatygttgggtagggygttagtagagggtagygttgttgaggagggaggtgggttagggtygtygaattttttatttatttttygaygtagtttgtgggtygtatyggttttttggttagagttygagtttgagggggygtatggagttygatggtttttgtaggggagttttatyggggtttattttttggtttttgggaagatttaggtggagaggataaagtgttaggagygagggagaygaygtyggggagygttgttaggagttaagygttgyggtagtttttaagtttygaaagygattttagtttttttaggatattaaagggggataaggattgttgtgtgttttgtggattgttttttttttttttgggtttyggtgtttttgtttgtgtaatggtttgagttggattttgtgaattgaggtttttttgtttggtttttttttgggtaagattattttattttaygataatttygaggattttgttttttttagggttaygttttattgygggaagtttttaggtttgtgtatttttygtgttggggtgtagygtttgggttttgaatttyggtttagagttagaggtttggatttygttggygtagtgattaygggttyggattgyggttagggagttttatttttttttttyggattygtaagttyggagagtagtattgggagtygggtagaagyggagygtagaaygtttttttagttggtgygtttaaatttttatygygtttatattttgtgtttttagtttagyggtaaaatttatttggattttygttyggggaaaaaggagttygtaggtagygtttagttttaaggtgtattgaaatagggagtaagattttgtgtttatattttttygggaggagatttygaggggaaatatttygggtttttttagyggatgattygtgttattttgttatttttygyggggtttaggygyggaatgtgttygygtaaaagtttttttttttyggtygggtyggagtttttaggtttygtygtttttttygttygttggtygttatttggygatttttttaatatttatgggygttaatagagaggtttttagtatatyggtttattgtgggyggttygtaggatttgaataggtttyggtttttttttttyggygyggtttttygaggggtygggttaggagtgaatggtttygtttttygtttygygtttttttttttttttagggagaatatttttattttttttttygttgtygtygtygttygggtttttatttaygyggtttyggtttygggyggaaygaattaatttgtygyggtttttyggaggttattttygtygttygggtgttttttttttttgagtttaygggagtggagagagggtygtygyggtaggtygayggttttayggagggatattgaaggggaagtggaggagaagagtaggggygattyggaggggtggttgggtyggggygggtaagatagttttagggttyggtagtygttyggggttggttaatttttagttgttgtttygtttagggyggagygtygaggggaaggaggtygyggtttaagttyggaggttygttygttttttttttgaggtattagygygygttttttyggttyggttgaggtatttatgagaaygggggygtgtgggatagtttagggtttygtaygaygttttygttttygtyggtgygtyggggtttagtttygggagagttaggtttygatagtgygttttagggggaygttyggaagggyggtyggtttygyggtttttgygttttygttttggggttygggtttgggtgygggggaggggggtgygagtyggttaggyggggttaaagygtaygggttttygttttgttygtttygtyggtttttagaggygtagaaagaagtttattgttygtygagaaatatatttttgggggtygagtgaaagttygttttttttttgaattttagaagaaagttttttgttttygtttttyggagggagagatttgttttttttttygggagtttygygygtttttttttttygaaatatttgtygggggaaaatttattttggagggtagatygygttygttttaagtttggygaatttattaaaaagatattagyggygggggtaggtttygygtaggtatygatyggtyggaatgagttygaggaagaaaaggygaagaatgygttygygtygygtttagaygtttattygtttygtttagtttttgygttttagtttygtatagggagaggggttttygygtygtttygtattgtttgtgagtttygyggttygyggtttagtygtttttattygggtttttyggtatagtttttyggtaatttttttttgtyggtgttgygtttygttttggttttttttgygygtaggttttyggtygtttttttttttygttygttgtygtygygygtttagtattygygttttttttttttttttttttttttttttttttttttttagygtttttttttttygttggygtttygattttttttttagtttygtatatttttttygtttttttttygtaygtttttttttggttttttgagttttaatttttygtagtggtttaggaaatttttttttygygtggggttygygtygtttttttttttttattttygtttttygtaagayggtttagggttttagggygttttygtyggygygtataaaggygyggttggttgttaaggygggtgggggygaggtygaaaaaaayggttttaatagaygtgattyggggttaggtttgygyggggttgtyggyggagtggyggtttyggtttagtgaatggggatagyggtttttttttttattttatttttgtttttttttaatgtaattagtttttaaggttygggagagataaaggygygtttyggggygtttaygtggagtgygtaggygygaagtyggygtttygatyggtaggtgattggtaygygagtttttttaggygtttaggggyggaggaggggaagttttttttttgygtttttygaatttttttttatygtttatatttyggtttttaggttagygatgttagygttatagtttaggttgattaaggyggygggaaygaygggagagaygtyggggatattaggagatygggyggtgggagagatagaggygtaggtttttggaagtagagggggygagataggggtygggggagattgaggtaaggygatgtygaggtggagggagtagatgaaaggtygagtyggagaygtaggggtataaagattyggagatgaaggaagtagagggggagaggtayggttttygaaagagygg

SEQ ID NO: 6913 - DNA, 1434 bp, Artificial Sequence
  Description of Artificial Sequence: Synthetic polynucleotide
yggtttygyggygaggggtttagaygaaggaaaygtygttttaggggygygygggyggagatggagtggtttaggttgggggagyggggagtagggtygttatygttgygtyggttygygaygtttgtttttgttygttttgtttttygtygtttttttgggygattygggtttygygyggygttygtttagttyggggtttyggattgaggagggggaggaggaggaggaggaggagtygygttaaggyggtyggygggygtatttaygtyggtgttgyggtttagygtttygtygtyggtygtygagagtttggtggtgttgaggtttattagygagggtagygtttgggatatttagttagtgattatggttatggtgtttagtaygatttygattttgagtagyggtatygatatygygtttygagttgtttttagygttygtttygagttggtatyggttttygygtttaggyggtttttaggyggygggtatygyggygggtaggggygtttggttgtgttttygygttttttyggttygtygtygttygttygtygtygtygtygtttygygygtttyggttatygtygtgtttttttygggygttagggaaggtggttaggtggtttttgttygtygygttttgygtttygygtygttygttttgygttttgttttgttyggttgygttttttygggttttttygtygttatygggaagygtygttyggttttgagygttgygygggttgygygygggggtygyggtygggaggyggggttyggtygggygggatygaygtaattygtttaggaaatgggtggattttttttttygttyggtttttygtygttttttggttgttggtagygaggtttgtaaattttagttygtttaggagttgggattagggtgatatgaggagayggatatattattatttttagattataaaatattyggyggyggygyggggattttagttgggggtayggttygyggttttttygtttyggggttttttttatttttaygtyggggtattttttttygattttygtagagggttygttttggggtaaaggttgtyggtagagagayggygtygttttgtttattggagttttttttygyggtgattygagggttttagttagtttgggtygtygtttgaaatttagtaggtagggtaggtttygaaaagtagttagattygygagggtttttagygttaggggggygtyggggtatyggtggagagttaaaggygtttttgygattttagggtagtygyggtgttttaaggttttgtttgggaggaagggagttaatyggtatttttgatatttgtatagtaaggygggggttggggtggtttgtygtggttygyggtgygtagtgagggttttgggagggygtatattygg

SEQ ID NO: 6914 - DNA, 5053 bp, Artificial Sequence
  Description of Artificial Sequence: Synthetic polynucleotide
yggttyggtattttgyggtttyggtaygtagttttyggygttatatttattttttttgygtttygggttgagttttygtygattatttgttgttttygaggttaaattttagyggygggaggattttgttgttttttygatttttttttygggaattttagtttttttggygtgtgttttagtttaggtttttgtttttgggtygtttyggygtaggaagttgyggggtygggaygaaygttggygggaagttttgatttgggtttttttttatyggtgttygttttygggtygggtaygyggggyggtttttgggtatygtaggtttyggygtaaaggygtttagagttygtagtggttygggttggttttygygattttyggtttygtttygtttygyggtttygtttttyggtygtttygtttttygttyggttagaggtttygggttttagggyggttygygggygtagygtttagtagtattyggagtygtttggaygtyggttyggggttattgyggggtggygtygttgggttygggaaagttygggattggagagtggygaygtygggyggygggatttatggaggygygyggggagttgggttyggttygggagtyggygggaggygatttgttgttagtattgttggygyggagggyggatttgygtygaggtgggtgttygggtygagtggttgtatyggggagattaggagatttttaggttttttygggtttggtygyggaggttggtaggagttagaggatttgggygggagtgggygygaggatttyggaaygttygygtttgggygttttagtttgtatttgttgtagggtttttggtttgggttgttagggagtgagtgaggttgtggtattgygttgtttyggttagggagttttygggggtttagggtgggtttaggagatttttgtagttyggagttagttttttgggttggaggaggygtagggagtagtggyggggtagtgattaygggataggagggtttttaagaaggtygttttagtyggattttttttaygttttagyggaatagagttagatgtaggggttaaggtygagttgaatttygatygtyggttttttygaagttaggttttagygtttgygtttatagatattygttyggtttattttygtttagggttygtttgtaggaaaaagttttttttttttaggttttttagttttttggtggtattattttagtttttagtattttggtttttagggaatttgggtagtttttttygattttygggttagttggagtygtaggatggggaaggaggtttyggagttagtggggagtgagagggatyggtyggygggaagggggttatatttaggttgtgggggttygyggttttttatttatttatttatttttygayggtttttgggaggggttggtygygggggttggggggyggagagagggagggaggaaggaggattgygygttygygttygggagagttggtyggagygggygggttggygtttaggtttygtygatttygttatttttgatataggagttttygttagggttggagtygttatgtagygtaaggttggggtygygggygyggygyggggtgggttggggyggtttttgttygaygygggygtyggyggygagttgyggtygaggygttgttyggttygyggtgttgaattygygttgtgtyggtttgtygggtygtttygtttygagtygggttttygtttgygatygttgtttaygatggggatttygggygygtagygggttttygaygtttygtattyggagttgyggttttgtyggatgyggggygtatttatygtyggtttttygttattgygtggggaggygtagtttagtttttttygtyggaggtygagggagtttttttttggtgttttttatttattgggagatgggttggagtyggyggggtttatagttagggaggygggtgtaatatgttagtaaatttyggtttttttagygggtattttttttttttagagattttttttaagtgaagagggagtttttagtttttgatatttggaaaattygtttatagattygaggtttttatagggtatttttggatttttttagtgtggtttttttagggggtttgtagtatygaagtggggtgtggggggtagaagtagygggaagttagaygtttgagtaattttgayggtgttgggggtatttaygtttgatataaaggtagtggatyggtttgtttagtttatttataagtaattttgyggttgtttaatgatggggaaggtattgatatttatttyggaggtttgtagatagggttattaggtagggtagttatatttgygaggagtttttagaaagagtggttatgaygtttaatatgaaggagattygatggggtgttttagttttaggtgatggtgaagattygtttttttatgttttttgtygggttttagagagtagatttttttggggtggggtttttatttgagttttatatgtattttttttggtattggtaatattttgtaattgagtatttagtttygtgaaatggtttgggttgtttttttgtttatatatatttttagatygatgttagtttttttttagtttttgatataggatgyggtgtttgtatattttyggaatttgyggggttatttaagttggttggggaagagggtgtgtagggaaaggaggatttttyggtagttttgagttttgtgggtyggaggggagattggttygygttggggtgggaaggtggttttattgttttttggtttaygaggtgatttagaattttttygtgtttatagagatttygttgtgygttggttgtgattagtatattttggatygttttatttttaaggttttggatygttattggtatagtaagtgttttaagtgtagygattgttataygttattggtygagygttgttttagtygaggggagagygtttattgtaaggaygatttttttaagtgagtttygaaattttattttagtgtgggagyggagggtaygtttgttttagggatttttttttttataattattaaggttaggttttygaagtttgygtttttygtaattttagtttatttttgttatttaggtagggtattttgtggtttggttaaattaagggtggggtttttttatgggtgttttttgggtggttgggtttggttgggatattagtaagtattatttggaaaaaaaagtaatttattatttaaattatagaagtagttattagagaagatatatttttatttgtaggattttattggatttagttttttygaaattggtgatgttttagtttttaatgttggtatttagyggttttggtttagtggtttttatggttttagttgtggggtgtgagggattggttttagatgggtttttttttttyggatttatttttttagatttagtatgggttttgtaggtaatggyggttgggtttttygaggtttttttgagattgaggttttttttttagtgggagtgggtagttttgtttyggyggttaggttggygattattttgtagggtyggatagagttttttttyggggtygtttttttaggtagtygtttgtttttttttaattygttyggggygaaatgagtttygygttttygygttgagttyggttttgtgygtttygtaggygtttygggattaagtgygtygygtgttagttgggtatttygtttaygtaggtggtgygtygygtttaggatttygtgtattatttgtattgttttgtttgygtygtgtgtaagyggtagttggttaygggygaygagttttattttatggaggatagtyggttygtgtgtaaggyggattaygaaatygttaagtagygaggttagtygaggggaygaygtttttattttttttggtttgaaaaaaatggggttgaggttaygtttaggggggygttyggggaaattttttttttaagygtttattaagggggtttgggttagggyggtgtaggtagtaggaagtygaggtygggaayggyggagttayggatagattygygtttygaatygtttygttyggttygaagtgtgyggtttttygtttttggtyggaattatygttttaaatttttggtygygaaggttgggttatatttatatttttagaataaaggggagttygyggggaaattagggtgtttggagaagggagttaaggttgaaggygggggygtygtggaggtgygattttagggaaggygtygttttygttttygyggtagaattygtttttygtyggygttttttttattttagttygggtgttgttygtttttgttaatygtttttagygttygygtttttygagaagtttgtggggygggatgggggtgggtatttgaggtttygaygttttygygtyggtyggggtgggagggttgggggttyggtyggggtyggaggggttgtygygttttatygttygttygtygygtagaggtygaggttayggttaagyggtygygtaygattattatygttaagtagttggagaygttgaagagygtttataatatttygtttaagtyggygygttaygtgygygagtagttttygttygagaygggtttggatatgygygtggtgtaggttagygttygtttttgtttttttttygttygyggttttgggggttttygtagagtygggyggtygtttatttygtttygtttttaggtttggttttagaatygtygggttaaggagaagaggttgaagaaggaygtyggtyggtagygttgggggtagtattttygtaatatgaagygttttygyggyggttttaagtyggataaggatagygtttaggaggggtaggatagygaygttgaggttttttttttyggtaggyggagggatygyggagttyggggggggaygagygygygtyggyggggtygtaggggttttagggagttygygg

SEQ ID NO: 6915 - DNA, 6343 bp, Artificial Sequence
  Description of Artificial Sequence: Synthetic polynucleotide
yggtagggygggayggggttgyggtttattatggaatagtygtataygtgaatttttttgttttgattttggtgggagatgygttygtygtttagatatttatagtygtagttttgtttttgtatgtygttygatattttgtygtagatgttygttgggatgggagggyggttttaggaygtgttttggtygtttttggaggtygygggaggaatttttagtygaaggggtttgaaattttagttttgaatagttttttttttaggagagaygaagttttttgaggttgggatagggatgaatgagygaaggagggtggaatyggggagggygygggaattgggagattgttggggagggtgttaggtygtgttaygtttttttygtttaggattttagtttgggttaaatttagtaggggtaggattyggagtagagygtagttygttayggttygtagtttygttttygtttygttagtttygtttttgtttygttagtttygttttygtttygttagtttygttttygtttygttaggygtgtttttggtatgttygtaggtttygtttttattatggtatttagtttatttgtagtygygtaygatttttttgttttttgtagtyggagtttyggagyggggagtygagtggattyggattagtatatatttgaagaygtygtyggagtygatgtttatattaggaatgagagygaggttygttatygttatgttttttttttyggagttttttttttttattygattygggggtygtttgtattgygggaggygggttttgygagagygaygattaatttygtyggggaatgttttttaaggtttagygttttagttaattgtatygtygatygaggtaygtgttgattaatygtaatttagttttttgtygttttgyggtttygttagtttygtttaaaggaaaygtggaatygggaatgggtggtgatgaaatttagttaayggagaagtttttttttagyggggttyggtggtatttttggaayggggtagttaggyggttygygaggttggggtaaygagggaggtttgagggatttgttagttttgattttttgtttygtaygtagttygaagattatttttttygtggtttttatygtttaaaggttttttttttttttttttttatygttygaaggtttttttttttttygttttttatygttygaaggtttygttttttattttttttatygttygaaggattttttttttttttygtttatygttygaaggttttttttttttttttttttatygatygaaggttttygtttttaatttygttatyggtataaggaggtaayggtagtygttatatttaagttttattttatttggttygaaagtttttgttttttggaaattatttyggtttaggggygttttyggtyggtttttaggggtggggtygaatgtagaggttttggggtagggggygyggggygyggyggygggtgggtaagygggaygtttggtyggtgtagaygygyggggaygagatgggygtgtygggtgygaaagtaggagyggaggygggggtgtttaattttttttatttggtgtttttttttttggtttygaagtagggttggggattttaggagggtttttgygtttggtttttatttttttttygtatattttattttttagagagttttgggygyggattagggtgtatttgggggataggtggaggtygggtygtygggtttgygtttttaygttygtagtayggygtgyggttagagygggtgtgyggggatttttygggataggttaagttttttygggtgggtttttaygtttattaattagtttttttttttatttgttygtattaygttttgttttttaggtttttatttgggaaygtttygttttttggtttttttttttttagttaggtgttagttttggttaggtttaggtgttttgttttttttgtttaggttttttgttttttyggttgggagatttgtatatyggtttgaagatttttttgyggttttttttagtttttgtagggtttagattgtagyggttggaggygaagggayggtagggygygtggygtggttagtgtgttggtttygattagygggaaygtattgygtatygttygttttgtttatygtttyggygggaygygttygygtatayggaygtatagaggtygattagggtgttttttagygaggaggtaatatagtygygggaggyggggyggggygtgtttaaagtgatagattgggttttggttaygtygggtttttggaygaggggaaatyggagtyggggaggttttagygagagtttygyggatygayggggatyggatttttaygggtggggtttgtgtagtagtgattttttygagtgaaggtagagttyggyggtttttaggtttatttygttttttagyggggagtatygagggygaggatygattttttttggggattttygagggygagttgggagagggaggaggttyggaggagggagaggggttgttgggggtgggaaggygaagggtttgtgaggaatattayggggaygaagggtyggggggtgggggtttgggyggagttggaggtygaattgagyggagtttggaaggttggggaattagaggyggggtttagaagaagtyggggtggggttttggyggggttygggggyggttttgggtgggtygggyggggtttgagtgggtagggtagggttygggttagygtttgggttaggtttggtgggttyggygttttatatgatgtygtttagtaggttggygttggttatttagtygagygygygyggttyggaggyggttatgattatgtatatgaaggggyggtyggtgygtyggttygtggggtagatggtggtgggygtgaagygtttgttggtttygaygaattygtaaagttgttygtagaygygygggaattygtggygtaggaagaygtygygtagtygtagttygygttggatgtggatgaaggttatttygygygygygtyggttygtttygtygttttgatttaggttygtygtgttyggyggtggygttaggattagygtttttatgtygggttygyggtttygygtygggggyggtygygyggggttgtyggtygttagygttattttggygaatttgygtattgttggttygtggttgygtggygygggygygggtagggtyggtgttttyggtggygyggtgtygggttttayggttayggataygttgagtaggaagtattttgtyggttygtagaggygtttagyggtygttagttygygygygtagttgtttaggggygtygygtgtgtggttagtttaygtagygataggtaggtgggggatagtagtagtttttttaggttaaagygtaggaagttgtyggtygagtttggatttgggaagtttaggaagagtaygtygyggtygygygataggaagtygataygygygatgygygagaaagygyggtgtatygggtygttgtygyggtaaaattgtagtaygtggyggtataygttgtttaygyggtygtataygtagygygttttgtgggygttttagttttygyggyggtataggygygagtagtagtaggtgtagtagttgtggtaggatttgaagtagaggtaggygttgaatatggtttyggtgygtyggtagygygtattggagtaggttattaggtygttttygtyggygttgggttygggggaygygtyggtygtttttttyggggtygygggtttttyggygttgtyggtygaggyggggggygagygtggyggygttagygygggggtttyggagttygygggtygygagtttagtagtyggygtagttgggggtttaggtagtyggtygygggttttgaggtttggtyggyggtgggtygygagtygatgattaggttygtgatgagttygtttagttgttttaggtttygttggyggttagaggtggggtygtygggggtygygtggggaggtggtygygtgyggttttygggtaatttttaggttttggygttygggygttyggtggygygtaggttattgttagtgatggtgatttygggygttaygtattagttgyggtttaggttttygttygygyggttttttttygttagygaygtttyggatagggatagtgyggygtagygtttgggagaggtggataggtttaygaygaygggygggygtyggttttygggggataygtttygyggttttygtatttygygttttagtaggttttygtagttgyggtygyggtttaaygggttttttyggygyggtttyggggttagaatgttgttttaggagygygagtagtggyggttgtyggtggttagtyggggyggattggtgtyggtgtygtygtgttaggaggygagtaaygggtyggggttagagggyggtattatttgtagggtgyggtayggtygygggttttagttygtttaggtygggttgttgygygggtgygggtaygttygagttaggaygttaygttygyggtatttttygaagtttttygtgtaaaaggggygggyggtggagtgggttyggggtttttyggggatatagyggggttygtagggtaggtygtaggttygtggagtttttttatagtaggagygggagggyggtttttggattgggaaggtgygtattttttttgygtagtagtygtttatgygttttggattgggtttygagagtttttyggayggatagggtttggggtagtaggygtygaaggttgggtygggattggttgtaaagttgtttyggaagttttggggtttttttgtatagaagaattgggtggggttyggyggggtggtgaagggtagattgyggygttyggygtagtttyggggtttaggtaggggttygtygtagtagaaygttyggggattygtatagtatgagtygttgggygtyggggtgygygatagygttatgtggyggggttygggtatygtgaggtygtggaattgyggggyggggygggtttagtgygyggtttyggtgggttygtaggatygygagtttygggtggygtgttggagtattgygtygtttggtttgatgtttaggyggtagygtaygtggggggygggattygygggtggttygggyggtgygtagyggttygyggyggygtataggggygygaygyggtyggggtygtttygttgyggttgtaatttgatgggatgtagttygttggtaagggygyggagygtygggtaygygggttttyggygyggygatgtttyggttygygtygtaygttgggtttttygttttyggyggggtaatatyggyggygaggygggygygggygttaggttygggggygygyggggygtatttttggagygggygyggyggygtggttyggtttygygggttygggygygyggtatagyggatttyggyggyggtggtttyggtagggtttttatggtyggttygtttagygtttttaggaagtygaagttgyggtagtggygtttgttgaaaggygygggtttagtaggtygggttayggatygtttatatggygagtatttggaygygggtttyggggtygttattttgatgttttggtatayggtygatattagtaggttyggagggttygtaygggttattttaaaagaggtttttaggttggyggttttagtttatattgttttgyggggtttttgttttggggggagaygygggttagggyggtttttttygtagtttaggtttygttatttttttaygttggttyggtttatttggggygtagygggyggagtagttttggttgygggtttgggtygagaaygygggygttttttttatgtyggggttagaagtatttgygggaggaatttagttgtttaggygttygttttgttygttttttygttttttttttgygatggggygggygggttagaaaggtttagtygtggttgtggttttygyggygggagttttygygtgaagttttagggttttttttttttygattagtgayggyggggtyggttygggtggattttttttygggtggggtaggggagtgggggygtggttttggggttgygttttttggtgttygtagttggaaggaygggtygtatttgggttttatttataggtgttgttttaggagaygttagtgattgygttttygttatagygtttattgtagagygattttttygatygygtatagtggaaggyga

SEQ ID NO: 6916 - DNA, 1089 bp, Artificial Sequence
  Description of Artificial Sequence: Synthetic polynucleotide
ygttgaggggtygtatttattygygtaggtattagtaggtagttttggygttygygggaggyggtygggggygggggtttttyggtgtttatygtygtttttgyggttgggttygygtttygggtyggtygagtttaaygttaggatttygttygagttttttagggtttygttaggygtygygttygygttygygtttttttgtyggtttyggttygggttttatyggggygtagggttggggaatyggagtttygttygtygattyggagtatygtttaygtagattygtttygggygagggaggggtygggygygtattygyggggagggyggygagyggggattagtygaagtygggagaggggygtttttayggggygggaaattggygygygattttgggggaagtgtaggatggggggataggggygttttygygggggtggatgggggattatagyggggttggyggggtaggggtyggygtaygaggttggaggaggggagygygygtttttattygggttgggtygtygaggttygyggygtatygtggyggyggtgggyggaggggggyggggggtatttttttttttttgtggygtaggtgggygygttttggatyggtttgaygattttttttygtygttttatttttttggttaaaggtttttagtttttaattagggatatttttagtttatagtttygaagttatgggtttttttyggttttttgaagtygttatatttgtgttagtyggtygygtttttagattttttttygyggagtttttttagtatttggagaygtagygtagggtttygaggayggtttggttyggagaaaagatatygaagttttaattttttttaatttygttttttttttttttttatttttttttttygtttttaaagttygggggttttatttttttttyggttygyggagtttttygaattttgyggggattyggygttyggyggtgtttttttggggygtayggggttggggygggagygaggagattaggtggggaggggattttagattttagaygttaggggagayggygtttttygt

SEQ ID NO: 6917 - DNA, 1020 bp, Artificial Sequence
  Description of Artificial Sequence: Synthetic polynucleotide
ygtagagatygtagagattaaggaggygttygyggttgtagagttgtagagygggattttttygagttgtttgtgttygggtagtyggygygtaattgagttagaggatagygtattttttyggygygggtyggtagggtttttgyggtyggtaagttggtttttygggtggttatygggattttygagtttaatggygggggyggyggtaaaatygataatattgtagagattatttttatttttaayggagtaagtgttygagttttaggtggygaygttatttttttttagtattttygttttygyggagygtttggtattttttttttgygtatttttygtttttgattgtttttttagtttttttttttatttgttttttgtttttgttttgyggtttttttygttttattttttttttgttattttttgttttttaatagtaggtygggattttyggagatgyggtgtttayggagtagttgtagggtgagygggagygygagygggagggggagggagaygygggyggygayggattgggtagtagtttgtygttggtygtgtttttaggtttttttagttttgaggygttgttygtttaggtgggggygttgggyggyggttagtagttgtagttyggtttttgttgtttgtyggtgtttttygtggttttgggtatggtttyggattttatttttaygttggygttttygttgtattgttattayggggtttttttttttaatgtttttggttgggagtagttttttaatgttagyggygttagygtygttagygttgttttagtagttagygtygttagtygtgtygttattagtatygatttttygtgtagyggtttygtttygtyggattttaattattgttttaaggattgggattataatggtttttttgtgtttattattaaygttatyggttaggtgaggyggttaggygggtygygggtttgggggygggtagagagyggygagggyggggttttaygttygt

SEQ ID NO: 6918 - DNA, 6343 bp, Artificial Sequence; identical to SEQ ID NO: 6915
  Description of Artificial Sequence: Synthetic polynucleotide

SEQ ID NO: 6919 - DNA, 1109 bp, Artificial Sequence
  Description of Artificial Sequence: Synthetic polynucleotide
ygatatagggtggygtgtagggagygtgttttggtattaggygggygygagggggtagggygtaygttygggataygttttagggaaatygtttttgggtttggtagttgaatttagaygtygagtgtagttygttyggtgygygyggygttttattgttagatttyggaaattagttgttagggtggggtygygttttggygayggttattyggttatttttgtygttttygttttttttaagagatttttttagygggttaattttttgttygggtaaattttttggtgagtttttygttttttttttttygttttttttttttttatttttgttgtttyggttttttagttygttygygtygygttttatygttttygtaygttygggygtaygtttttttygttygggtygttttttggtttttygygttyggtagttagtgttttatygygtygtttygygttagggttygtttygagagtygtttttttttygtygyggtyggygygggtttttyggttatgygttttygagttttagtttgygtygtygyggygttygggttttgtagttttttgttgttgttygygttygggtaygygtgtttygygggttgygtttgtatygattygtatatygtggattgtygygatygygggttgtttagygtgttagattttttttttttggaygtgygtaagttgttggtggtyggtaatygtatttagyggattttygaggatttttttattttttayggygatttggtttatttggattttaggaataattygttgygttygttggaggagggtaygtttagyggttyggttaagttygtgtttttygattttagttataataatttgatttagttgggygtyggygtttttygttyggtygggaggttggtgaagtttagtttggttaataataatttggtgggygtgtaygaggaygttttygagattttggagtygttgtaggtgttggagtttaaygataataatttgygtagttttagygtggtygttttggtygygttgttygygttgygttttttgygtttggaygggaatttttggttgtgygattgtgatttygt

SEQ ID NO: 6920 - DNA, 1109 bp, Artificial Sequence; identical to SEQ ID NO: 6919
  Description of Artificial Sequence: Synthetic polynucleotide

SEQ ID NO: 6921 - DNA, 1384 bp, Artificial Sequence
  Description of Artificial Sequence: Synthetic polynucleotide
yggaagggattygtyggttgygtttygtttaggttggtyggggtyggtgtgatygtgtgatttygtgtatattgygttygggttttygtgaatgatagtagtttgtaatttttagtyggagagtagyggtggttatygtygggyggaaagggttataagttagaatgtaaagygatttygtttygggtgtgggggatttygggttttyggttattttygaggtygggygtgttttgttygttttttttygttttgggygtyggggygattttattttgygttttaagttgggggttttttatgttygtygtygtygagtttttygtygtygaggygttggtygyggttttygggttygggtyggggtygtygtygtygtttagtttygttagttttyggttggtggtygtgagttyggttygtaggttggttattttttggttggtygattggatygttttatygatgyggagygygagttgtttattgttttttattatgtttaggattttggtttgggggygagagaggtgataaagagttgtatgatgygyggggggygygyggtygggtattttyggttttatttgttgtgtttttygyggttyggtttygttygygtttygatttttaggtatyggtagygtyggttttttyggtataggaatgatagyggygtttttagttttagtygyggyggtggygaggyggyggggggaggaggyggaggagaaaaaagaggaggagaaggaggaggaggagtagygatygtygagatttyggygggygggygtygagagttgttttaagaaggatatygygygttattaggtattttttaaatggagtttattattygtygtyggttygggagggggtttyggtyggaggttgggggtatttttggtttttygygttttygtatttyggagatatatttttygggggggyggaggyggyggayggtagtygggagggggttaaggtggygtttttggygaggggtaggggtygtttggatygaggtyggttttttgtttttttttttgagyggtggggtagttttygttttggagaattggtgtttygagtygtgttaaggttggggaggtgttgggtgttyggaagagagggtgtttggaaagggggttttagaggggagtyggggtggatttttatggaagggagaygtttgygttagtttaggagtggagttygtgttttatyggttttttaaattgygagtaygaaatttttagaggggagttgagttggtgtttygygtgttttttattttttattttttattygtaggttagatttgygttgtttattttaggagggagygtttatttttttyggygtgggtygttggtgttttygt

SEQ ID NO: 6922 - DNA, 1384 bp, Artificial Sequence; identical to SEQ ID NO: 6921
  Description of Artificial Sequence: Synthetic polynucleotide

SEQ ID NO: 6923 - DNA, 835 bp, Artificial Sequence
  Description of Artificial Sequence: Synthetic polynucleotide
ygtgaagtyggygttatttagtttttttygttaattgtttatttttttyggttattgtttttygagtgtttatygagtgttygtgggttagygagyggggtygttggaggaaggggygggtgtgtttagggttggyggygggttyggggtttttgggaggaaagggtygttygtttagttttttttyggagtttagagayggtttyggyggygygggtatataggggtatatagygyggggyggagggagggggtggyggtatygttygtggagggygygggttygtttagtttttygtatyggygttttttygygyggtgtttttttygtatatttataygtatttatttttatagttatatattttagtatttgtaggtataaaygtttgtagggatatattaygatatagatatttaagtatatataggtatyggtttatagattygtttttgagttatatataggtatyggtttaaaggtataggtaggtttatagattggtttttgagttatatatagtttagatttagatgtatatatatagatgggaaygttygtttgtaygtgtatagatatayggatatattygtatattatygyggggtttygagtatataygygtttyggtagaygtttatagatataygtagggtygggagygtatatatatagatataggtttatatagatagattyggttttaaaaataygtattygtagaggtaaaggttagygtataagtaygtatagatatatygataggyggttttyggatatygygttttttgtygtatttayggtttaygtaagggtttatatayggttttaygg

SEQ ID NO: 6924 - DNA, 2248 bp, Artificial Sequence
  Description of Artificial Sequence: Synthetic polynucleotide
yggttttygggttagtttttygttgttatygtygtttagttagygttygtygygtgggagtygygaggttaggtttygtagayggygggttttyggtttygttgttttyggygggygygttttttttagttggttyggtygttgggttgtygtygttttttagttygyggtgttagttttygygttttaygtttggttttygggtttygtgttttygtagtagaagggattggggtyggyggggygggtggggaygtttgggaagygaggagagttttygtttttygggygtttttttataatggggttagggttttttttttygtttttygygtaggtgtgagygygygagtgtgygtttyggtaagtgtgagtgtgaagtgtgtgtgtgygggggagtgygyggagggagygygggyggygggyggygygggaggygggaggtagggygtaggggagggggttgggagggagagtgtgygygygtgtaattttatttyggggttttgtgygagttygggygatagtatyggyggyggttggaggaggagyggtyggagaygygtgtagttygttygttagagttyggtagtyggggtaggtgggagttygygygggagtygagtygaygygagtyggagtyggagtygagttygagyggagttygggyggagtttaggagtttygttygygggtagttygtgggyggtagttaggyggggygggygtyggyggggyggttttttagtaagatgtgygyggygtygyggggygttttttatttgtagyggygttygggagtygggyggttgggttaggyggygttttyggggttgttgygygttygygtttagagttgtygttttagggagttygttayggtygygtttygggtaygttyggyggygtttaaygatgatygttttttggyggygttttyggagtttggtttgggaatattgggtygggtttttygtgtgygttttttggatttyggattygygygggatgttttaygttattyggatyggtaagygttttttggagtygggggttttygtgygttygggagggggygggaatgagggggttttttaaygygtttyggagagatttttttaattttttttygagttgttgagtygatyggtgattattaggagtttttttttgtgaggataaagttttagagtyggggttaygggttttatttattggggaggaggtygtygggtygtagtgggygaggggtttttggygygtttttgggaggttagatttggtatagtgtggygaaggtttttagtgygatttygagtygagggygtatttygyggtgattgttagtatgaatygtagtygatygagttttgygatygggttttttygtagagtggggattttggggaaggygttaattttttttttttgtttattttatttttygygggtttttygtttttatttttggtatagttygagtagtygtagygaggtygtagggtatagattygtatgaygagggtagtyggtttttttttttggtggtygtttttggtttyggtggtatyggtttagtttygtgttatggggygggggttgggggagtaggatttygttgttygttgtagttggtttttyggggttaaggtttttttttygtttggggtagtgtaggtagagggaagggaygatggaggtygtttagtgyggttygggtaggyggtttagggaygttagyggtttttaaagttagttygaattttttygtagttggyggyggttggyggggttgygygyggtttttyggggtttyggttttttygygttttttttygtyggagatttttatttyggtttttaattttgttgtggtygtttaaggtattttgtaggtttgagygtygygtatgtttygggtygaygatyggtagggttgggtttggtygggttaagayggagtttttattatygtaggttttgygttygttattaggtyggatatttgggtygtttgggtttattyggygttagtattagygtttggtattaggygagtyggatttygtygagttagggttattttttttttttatagtttttttttagggyggattttgggttgttagyggygtgaaagaggtgtyggaatyggtgtygggtttggttttygtatttgagatttttttaggaggyggttagaaatttagygggtgggtttttttttgggyggtygttygggagtygg

SEQ ID NO: 6925 - DNA, 3541 bp, Artificial Sequence
  Description of Artificial Sequence: Synthetic polynucleotide
ygaggttggatagttttyggtttgtaygtyggatttttggagagttygagttttttttttgagtttattttttttttttttyggggygtgattttattaygattatagtygatgagtygtttaagttgggagaaggagygagaaggttgtagyggygtaggttagatatttttgggtttaaygtttatttttaattagygtttttgttagtagygtttttttyggagttatagtttttatttygagattttttttttttggaatttyggagygyggtygggtattaggggttygygtaggattgtagaatygttgtygttygtygttttagttttagttgttygygyggtatttatttgggttttagtgttygggagaaggtgtgttygygygaggygtgaagttagagttygttygatttygttygtatyggaygygtttttagggtagaggaggtyggyggagttgtgaygttgggattagaggaaggagaaggaaagtygagaygggtygggtagaygygtygaggagygtttagtgtaygttggtagtygygggaggygaggygggygyggtgagtagtygygtyggaatygagtygygaattygygtygtttygygttygtagtygttaggattygygggaattttggttygtyggtagyggtattgaggagggaggggygyggggttgagtygtttttyggagttygagygtttttyggagtyggtaatttttgttgttygggygggatgygggygggaatttagttygygtggaatgtgggatyggtygggttyggagtttttagygttgggggaaagyggggtttatatagttaggaygagagggggtgyggttttagggttattttygygttattttttaygtggyggtygygttttyggggygtgagtgtgtaygyggayggtaggggggtygtgaatgaagttttagyggttaattagtayggtyggygygygggatttygggagygaygtttaatggagagttttgggtggtygggtagggtggygggygggygygyggggygggggtygggtaggggaggygggaggtagtttygygggtagttaatgggyggygggyggggtggggtttyggagygtygagygggtyggggttttaagtyggyggagygaggyggyggggttygtagayggagyggagyggyggyggyggygyggygtagggygyggggyggtatggttattatygygtagtatttgtygyggggtttyggtggyggagtygggggtatygggtygtttatgtattyggaygttgyggyggyggyggyggyggyggyggtygyggagygattgtatgtaggggtygygtatygygaagtgtagaagttgatgtattaygagtggttgggygygggygygggttatttygtgggtttagygtatttttagtggttatttaygggaggaggyggyggyggygattgggtyggyggttygtatttagaatayggtaaggtaggyggyggyggtatyggtygagtygaygayggyggyggyggyggaggtttttaygygygtttggtgtattagggggyggtttaygygggygyggtatgggygtagggtagtatagygtattatttgggttyggttatgtygttttygttyggggttagygggggttattagttttagtygttygggttgtaygygtaggyggtttattyggggggyggyggyggyggtttggtygggatgttggyggygggyggtggyggygyggggtygggtttgtattaygygttgtaygaggatggttaygaggygtagttggagtygtygtygtygtygtatttgggygtttayggataygtatayggatatgtataygygggyggtttgtaygyggyggyggygtatttgtattygggygygggyggyggyggtttatyggtgggygagtattyggaygaggatgygtttagttyggaygatttggagtagttygttaagtagtttaagtagyggygtattaagttgggttttaygtaggtygaygtggggttggygttgggtaygttttayggtaaygtgttttygtagattattatttgtygtttygaggttttgtagttgagttttaagaatatgtgtaagtttaagtygttgtttaataagtggttggaggagatygattygtttagyggtagttttattaatttggataagatygyggygtagggtygtaagygtaagaagygtaygtttatygaggtgggggttaaaggygygttygagagttatttttttaagtgttttaagttttyggygtaygagattatyggtttggtagatagtttgtagttggagaaggaggtggtgygygtttggttttgtaatyggyggtagaaggagaagygtatgatttttgyggtyggygygggttattygtttatggaygatgtataygygtttggggagttagggtttggygggggyggygtatygttatttttygygtttttatygttttygtyggyggygttgtattattattattattatatattgttyggtttagtgtagtgatttygygggtygggttttygtyggygygttgtagggygygggygygtagttygttygygyggtttggattttttttgttyggttgttttggattttataaaaaaaaaaaaaagtttagaaattttygaataaaattaaatattyggaygatttttttyggtgagyggygaagatagttyggtaggttgygtygttygagtttygggagagaggagygaagattyggaattygttaatttatttygggtattttgttygtygtttgttttttgtttttattttttygaygattttygtttttgttttttygggttgttyggggtyggatttyggtagyggtttttttaaagygataggtaaygtagtgyggggttagggatttttygggagagaggaygaagygaggagagttttttatttttttttttygygtggatttttgagtttgygggtttagggtggggggttgttattttattygttataygtttttttttttttataaggatgygttttatttygttttttttttttttygggtttggttttttayggtttttatttattygtggagtttttyggtttttggggtttttttaatttygttygygtttttaatttaaatygtagtatattgtatttatyggggtttyggaggggaggtygygagagtygygtttgtgtataaaagtaggaaatagttaaagttttaatttagtttaatttatttttttttttatatttttttattttattttttttttaaaaaaaagtaaaaaaaaaaaaaaaaaattaataaaaaaaattygagtgtttatttttygtttygttttattygagtttyggtttggttttyggttaygtyggaggggtttgygtttttatatatttagaygggaaggggtttttgttttgttgtagatygatygtygtatagygyggtttttgtttttygygg

SEQ ID NO: 6926 - DNA, 1513 bp, Artificial Sequence
  Description of Artificial Sequence: Synthetic polynucleotide
ygtaagaayggtttagygaattttgtgtaggggaggygtygaggattggagaggttttgttaagggtttygttgggyggaaggygygygtttttttttatgggaaagatagatgtggggttaatgaaagggaggtygagaggygyggggayggtyggggagaygggggygtggyggggagaggaaagttttyggagaaagtygatyggattatygtaagygaggtatgtagyggagttyggaggaggaaggygtyggggattggggtagggttagggygggaygggggtggggggtgtggggggtattataggtagttggattygagggttttgagttgaaatttaatattygtttttggaaggatygtttttttttttttttygttttttttttttttttttttttttttttttttttttttttttaatttttaggayggagttttgygygggagaggagagggtttgaggggaggagaaaggaatagtattgagaggggttaggagtttaggaaggggagggaagggtagtygygggttaggggtgagtttgygggttaygygygattttyggagttttygtagtttttttagtgtttttatttttagtttaggygagtttataggattygggtttttgtttttttttygttttttttttgtttttttttttgttttgtggtttttttttttttttttagagatatttgggagttgtttttaagttttggggygtttygyggggttttgttaagggtgygtgtgagagagggyggyggagtyggygtygggtgttaggggtygagggtgggagygggagttygtggttttgygttttggagtygaggattggaagggggttgggttttttygtygtttgggygtaggtygygygtygggaaggtagtttygtttgttttaggggtgtttgygtgttggttgttgttgttyggggygaggygtygtagyggygattttagattttygggygygttgagtgagtgygygygtgaaaatygtygtatygtygggggtgygagtgtttgggtygaagyggttattttagygatttagttttayggttaygttttygggggtttttggttttaggtaatttggggtaagygttttagttttygtttttttttttttttagyggggtygtygtagattttagttttgggagtatygttttgtagygyggtyggygggtggagayggttggtttttaaattygttygtttagtttaatygtttyggyggttttttttagttttygaggtttttttgagyggtttggagaggygtygagygtagtttagygttygtttgtttattygtttyggttygggaagggaattttyggattttgygagttyggggygttttygyggtttagggygggtagttttyggggtttggtygagtyggtggygttygggaggtygyggggatagtaygtagygygygtttttggatgtygtttygtagygaygtttyggttygtttygt

SEQ ID NO: 6927 - DNA, 3541 bp, Artificial Sequence; identical to SEQ ID NO: 6925
  Description of Artificial Sequence: Synthetic polynucleotide

SEQ ID NO: 6928 - DNA, 558 bp, Artificial Sequence
  Description of Artificial Sequence: Synthetic polynucleotide
ygtgtttggttttyggaaagtgyggaygagayggtgtgggtgggttaggagttatttgtaagggtgtttgtaaatygtgaagtttagaggagaaygggagaaggatggaatygagyggagaggggaggtgtatggtaagaatttygttygtttygggttgaaggggagttgtgggtyggyggttaaygtttgaaggagaggggtttygggtggygggaggyggttggggattygygtaggttagygtgtyggttttttttagtttatygttgtygtygtyggggttgttttaagggagttaagyggagtgggagygggtttgygygtttttgttttgygygtaggggygggggggtttaggayggggygtttttttttatttatatgttgatttaggatttttaagyggttyggtttaggatatygtttggaaatttagtygygtgggagagggygattttatttttaatttttttgttgtgygtyggtttagtttttagaagttagyggayggyggaggaggtggttyggttttttttggtggttttgygttttygg

SEQ ID NO: 6929 - DNA, 7244 bp, Artificial Sequence
  Description of Artificial Sequence: Synthetic polynucleotide
ygtatttgttgggtygtttygggttttygagttttygtggttatatttttggtttttgygggattttyggttyggagtggggaaattttayggtgatttggttttaagygagaaggatatttgggttatygtttttttaaaagttaggtagatttgtatagtttatttygttttyggtttaatagaatttttygaaaattttgtttaaaggagttttgggagtaggygtttggyggtttttgygyggaattyggyggttgtyggygtttttttttygattttatggtttatttatttaggtgtagtyggggttagatatatttggtttyggaatttttaggtgttggaaggtggggtttgggttttgygtttttagaggatatattatttttgaagtatttttttatttttattttaygygggagattttygygggggttgatattttttttttttttaaatttatttatagattttagtaagtggtattttttgggagygagtaattagttttttatygttattatagattttgttygtgtyggagygttttygygtyggggtttggtgaattttttggaagtttttygttyggttttttagygaattatttttatttatttttttttttagttttagtttttyggtgggtattttttagggttttttyggggygttaggttttgyggttttygggtgggggttygttagtygtatygttttttttttatttttatttttgggtttagaagttgatagattgataagaygyggtttagtagtygtgttaggyggaatgggttgygttttgaggtygygaygattygggtygagtttgygygtttagattttygtyggtttggaggttygaaagagtaaygtagagaygtayggttaagagtggagggagaaygataggaaygtttattttttttattatttaaaygaattttttttattttgaaggagagagagaaaagtagagaataaaaaygagagtgatagaatattagaaattagagggaaaaatagaattagagggaaaaatagaattttagaaattagaggggaaaagatatagagataaaattagagttatagaaatygagggygattygttygagggtygyggtattaattttagatgtttgaaaggtaatagttttttaaaaaggaaataaaatttgaaatttgttattttttttgtagaaygagttgttttttagggtygtgatattaagataagaygagaataaggygaaagttaaaattgaaaattgttygagggggttttttagtagtgattttgttttttgtygggaaggtyggatagatygatgygygttttgagtttaagagaatttgyggagatatagaggttattttttattttygtttagaaaagaaaaaaaaaggggggggggttatttgtttatttgtaataaygataaaaagaattttattattayggaaaagaaatygagatgttgaaaagtgaggaaaagagagtttaaaaggggttgagggaygygaaaagaggggyggggagaggaaaggtttagggygygagggaygtggygggtatygataggaagtgtaattttattttttttygttgagtttttttttaaataygaaaatttttataaattatatttattttttaggatgattatygtattaggatttttaaaataaagtaattgagttttaaggagataggaggaaaaaattaaagtagtttttaattattttaaattygtyggatttgggagygygtygaaatatagtaggaagaaggtaggaaaaatygttttggtatttatgttttgaatatttttttttttttattttygtatttttgtttygtttttatttygatygtagtaattgaattgttatttgttttttatttygttttagggttttagagttatttgggaagttyggttttgttaagygttttaggttagtaagagyggtgtagtygagtyggygttttagaagtygagaggttatataagtttaygtagagaggygtatyggatayggtaattaggagtaatttataygttttygggygtayggaaattatttgttaggaaatttttaaygttttttttygtttatttttttttattttttttttggygygttttttttttttttagaggtaygtagtggagtttttggagtttygaatttttyggatattgtagaatgyggggtttttygggygygggttyggttaattagagygtygtttgttttttttggttaatggtaggygttatattgttgtttaattttgtttaatggagttttaaggattaataatagagygggygagyggtttattgagagtttggtagygtygggtaattgggtttyggttgygygtagygttyggygygtatygygaggggattyggtayggygagagttaggtygygggttttaattaygyggttygtagaygagttttygattyggatttttgaagggagggttggattgygttgygttttgaggggttyggaagttyggatatggtgattgaaggagggtgaygtggttagataaggggtygggggtaaagggaagyggttaagagttttagygtygttagtggagtygggaggygygtgtagygttagyggaggaggaggatttyggagtttaaggtaggtagttgagggtygtagggagagtagtgggtggagatttggtttgyggtttttgttgaggaggtttgggtttygtgggttttagggaygttygaagggtttgggagaggaggtaaygtttatagagaggaggtttgggattttyggayggagatataaggattttgtygygggttttggtagggayggggaaygygggaagtagaggagatygyggtagaagyggggagttgggtttgtttgggttttatggggttgyggygtgggagggattttggtgttygtttatggttagttgygaaggygatttttttggtttggtgyggtttgttgggttattygtgttttaggattttaattttgagattagaaygtaggagtttgygttygagaggggttttttgggattttaagayggggagggygtgtttgaygattttgtttttaaattyggaggggaggggagggtagtgtgaggtggttttygagaaagatttttttttygaaatgtttaatttttygtaggataygtttttygtttygattattattttagattgygaagttaaaaaattgtattataggttttatttaatttttttttttagtatttgtttgtggggtttttttttatatattttttttttttaggygyggtttttggatttyggatatttagattagttgttttttattgttttttttgtttatgaagtttatttttgggttgggtttgtttatatagaaagtttttttggtygaatttttttttttaatattttttagttttaagttaaattttatatatattttgttttttattttttggaggtttttatygtggaatttttggygtttatatttttaygggttttagagttattgggtttaattttgtttaagttgttttttygtttttattttgttttttaaagttattttttttgttgttgatttttttttttaaagtttttgttttaaattgtattaaaaataaataaataaaaagaaataaaatttyggtttaatyggtttttatatttgygtttttatattttttttttttttatttttttattaaattgatygttttgtttygggtttttttgttttgtttttggtattagtttaatttttgggttaaaattgtygttttaattttagtttygttaaaygagtattttttttattygttttattttaattaggttaagttttggggtattattttaatttttttaaatttttattatagttatttgaattagtgatttttatattttatatgtttttttattttttttagyggaattattaatttagataaaattttatttttagygtgtatattaggtttaagagtagttatggttagattggggtgaaggtgttagggtttataaggaggtttygattgtatttttttttagtaattttggtttttttagtttagttttygyggtttaaatttttttttttagtttgggttttttaaggyggygttttggtttagygygyggtgtgttttttattaggtttttttttttttttattttttttttygttaggttttgttatggagttgygttyggagttgtttagygtgttyggtgyggygayggyggyggyggtaatagygayggggtygtttgtggygtyggtggygtyggtggyggtagtygyggyggtygttgtatygttatyggtgagygtggtaggyggtttgttgygggggtygttattgttgttgygggtagtygagaagtattygyggatttttaagtgygygygttgtygtaattatggygtggtgtyggtttttaagggttataaaygttattgtygttggaaggattgtttgtgygttaagtgtaygtttatygyggagygttagygtgttatggyggygtaggtggygttgygtaggtagtaggygtaggaggagaaygaggygygygagttgtagttgttttayggtattgtygaggggttggygttggtygtygttaayggtattattttttygaggttygtttaygaggttttyggtttagtgtgygtygtygayggygggggatttggagygggagygttygyggggatyggaggyggagtagttggygtagggggtttaggtgagagygyggttaggtygtaggtaggggtagtaggatygtagttttggggtayggggtttaggggtttgtttyggtttagaaagagtagaattttygtgtttagtygtygygattgttagggtttatygttygtttagtttygggtatggagygtgggtatagaaatttttttttttttygtttttggagtatttgtattttattttttttttttgtatygggtygaaatgtataygttttaatttttttattygtttttatttaaaygtaggtaggtttttgtttttttgtttygttttttttttaggtggaaatttgygtattttygttygttttgygtttttttataggttttttttttttgtttttttttaatttttttaaggaatttttttttttttaattgatattttaggttttgagaygttttaggttttgagaygttttagttttttttttttttttygygtttttaaygttttttggataatygtttgttgygttttttttttttttagtttttttygtattttttttggttttttaggtttgtttttttatgttttttttttttygttttttattgtttgtttagtattattttttttttttggattttygtggttttttgtggggagggaagaaattaggttagagtygttgagggaaaggagggattygttttaaatttgggagggaagaattttttaggttttaattttggaaagggtggattagaaataggggttgtatttttgtttgtagagaagtttgggattttttagataattaaggygtttttttttataggttgtattgttagggtaggtattttttatatagtgggtttttttgtatagygtggttaggtagaagttatgttgttttttgtttgaattttggatttggttatttttttayggtagggtaggattggaagggtagttaagggtggaggtgttggggtatagaygtggggaaagtagtattgaatatygagtttatagggtataggtagttggggttttgaggagtatagaaagagagggagttttggggttagggttgtaggggtttagagyggaaggaatgttagagtaaaaagaaagaggggtattggagtttagtgaataagggttgtggggttgagggagaggaaattgagatttaaagggtygaggtgttgtgattgttgttttttagttaatygttttttaygataygttttttttttttttagaggttaagttgtagaagtttgatttgttttttaagaygttgttgtaggtaggtygttygggtagttygttgtygtygtyggtgaagtttttattattygayggygtagattyggggttygggaygtygtttttagaggtgyggttyggtttaggttyggagaayggygatggygagtttttttttggttygtttttagttygggtttttaaagaggtaggtggtagttgtttaggtagygttggttttggyggyggyggygaggaggatagttygggtttygttagttttttgggttttgaattyggtttagaggttgataaagaagagggtgaggtygygtyggygttagggttgggyggaggttygggtttayggtagyggaygtygttggatattttgataygygtgtttttaggttatyggygaggygttttggagttggtgttgtagggttgyggyggygaygtggtgtaggttatygagtaggtgttgaattattatygtgggggtttggyggtyggtttgggttttgyggygtttttagataaggtygtygtgggtgttgtagtagttgtagaygaygygtggtttagtygygtygaygtygtygtygtygtygtygtygtygtyggggggtttgggttgtttgygtygttgtaggyggggttygtygtattttygtattatagatttttgttggtyggygttatggygtttggggygttgggttygttgagtagtygttyggttttttygtygttgtagtttaaygttagttatttyggtgtygaygygggygtttattygttgggygygtygttyggttttagttttttgygtttggtttatttygyggyggyggygtatagtygyggtttggtttttatggygttttattttattgtyggtttggtgtttaygttyggttttygtttatttatggattaygtttttagygattttatgygtgatygttyggtygtygttgttgyggyggtgtataaggagtygatttayggyggyggtttgtaygggtttatggttaayggygtttyggagaagtagtagggygaggggtttggtagtyggtyggtttttaaataggaattttagttttgttttygygggttatygattttttttygtttagygttttttttgygttttggttgggygt

SEQ ID NO: 6930 - DNA, 824 bp, Artificial Sequence
  Description of Artificial Sequence: Synthetic polynucleotide
yggagtygttaggagtgagtatttttttttygggatatttagtttygyggygtttttygygygttttggttttatayggatttgttagttttagggaataaaagyggagttygttygttttttattgtagtyggaggatgagtygagagggttgagyggagagtgtggttttyggyggttggaggtaggagaatatgttgygttygttygtygyggygtgagaggttygaggtgggygygtyggggtaggggyggtygygggygtttgttygtttagtgggygttgttyggatttggygaggtggtggtttgtaatattgtgttygtattgtttattgtgggtygggygtygagttttygyggtygygagggagttttttgggtgggaattggaggtagtgggggaaaagtttggagttagaagttaggtagyggttgtygyggyggttgtggagggttgtttgyggtatttggyggygygygttttatygygaagagygggaaggyggyggttgtagtgtgygtaaagttttgggtggygygtaaaggygtaggygagggtygtygtatagagtygtttaagttgtggtyggagygttagggygatttttgggaattttttaagyggaatttttygagataagyggtttttgttttttgatattttagtygaggtygagttgaygygtagttatttaattttttttgtttyggggaaataattttattygygtygaygattggattttggttggttgggtagygtygagattttyggggggtttagttttgtggttttgagtattttttygtttagttygygt

SEQ ID NO: 6931 - DNA, 824 bp, Artificial Sequence; identical to SEQ ID NO: 6930
  Description of Artificial Sequence: Synthetic polynucleotide

SEQ ID NO: 6932 - DNA, 1415 bp, Artificial Sequence
  Description of Artificial Sequence: Synthetic polynucleotide
ygtttaaaatgatttygggygttttatttaaagagaygttttggtttaggtagttygttggggtygaaggttttattttttttygatttatygggtttygyggyggaagttttygtttaggtaggggatgttttaggagggaaggaggygayggtgtttaaggaygtyggaagtyggggattttygtttttttygggtttyggttaggttattagtgttggttygyggygygggtgtttagttgygtttgggatattgygggtayggttgtggyggtaayggtagyggtygtygygtygtygaygttyggtaggattgagygtayggagyggyggaatttttygtttttttaygtgtagagtagyggattgagygyggatagggygtagtataggagttagttggtygtttgtattttttagggtatyggtagygagaagtygttggttaggtttatttatattagtggttgygtggttagtaggaagaygtagtagagtagtagtatygataggtygttgagaygtygttgtgttygtygygggtgtagygygggyggtaggggttgggtttgygtygggtgygyggygttatyggggttyggygygtgttgggygttygggaaggyggyggyggyggyggygtagtygggtaattggtgtagtaggtggaagttgagtaygttgattygtttgaygttgataygtaygyggygtaygatgtttaggtagtagtgtagtagtagagttgtttgygttagtagygtygyggyggttagtagygtygggtagtggattygyggtggygyggygtygggtygyggtgtttagggygggagtagtagtaygaggtttagggygagygtttaggatagygttagtatgttygtygtgtggygtttttggtatagygtttggtaggtggygggygttygggtgatgagtaggtagyggtttagggttaygaggtagtgggagaggagggatatygtgagttygaggtttagtagtttatttygtagtaggyggtagttgtttttagygtygttttagtttgyggggggtttygtagagtyggtgggtaggagttygagtatygttttttgyggtatttagagggygtagaygttgaggtyggyggygtagtygtttaygatgaaggygttgttggtggtttgtagttttyggaaggaygataygagatagatgattatgtygttggttagygtgttttygatggttaggttygaatataggagtgatatygggatgygtyggttygtttaygatttttttttttygtagagtagtagtagygagttatyggtggtggaggaggtggatgtggaggaggagttggttattttggttaattttttatatttttttygttagygtyggtttttggtagygygg

SEQ ID NO: 6933 - DNA, 1415 bp, Artificial Sequence; identical to SEQ ID NO: 6932
  Description of Artificial Sequence: Synthetic polynucleotide

SEQ ID NO: 6934 - DNA, 3039 bp, Artificial Sequence
  Description of Artificial Sequence: Synthetic polynucleotide
ygggygtttataggyggygygggtagygygagtttyggagtttyggaggtttgtgygttttgagtyggtatggatttygagtattgygygttttttygygtggggtttgtattyggtttttatgtggtttygggggaygagttttygggttygtagggaattttygtygttgygttttatttgtatttygygtygtttygyggttygyggttgattygtttttyggtttgygggtttttggagttttattttttagagtyggttaagtygttygttaagtatttgtaggatttygggttyggttyggtttttaayggyggttatttttaygagggtttygyggaaggtaaygygyggygyggggygtagygygtagttygatttttttttttttttttttattygggtttattygggtttttttgtttatttttttygttygtttattttttaattttttgtttttttygtttttygttayggtttttayggaagtygggttggygttggttygggttaggtaaaggttagtgtggggygggagggtgaattatygtttttyggyggygggaatggaaggygggaggtygagggaaggtgtagtggygayggttyggagtttagtyggggttygaaagtagttggatttgggaaggagagagtatgttttgtygaagttggattggaattgttatttattttgaagtttagattyggtygagggttgtggagttatattgagatttgaygaagaagygyggtttttgtgtttggygttttttgagggttttgaggttgggttttaatttagagtggttaaatyggggtyggttggggattgyggtttggttttggttygtttttttttttygggtttagtttttataggaagggtgttgtttgtgyggtagattggtatagtttggtygygattggtygtgtaatgttagggttgtttttaagayggaataattgtatttttattttttatattaagttggtttttttgtygttatgtattatgatagtygtttttttggtagttttggttttttygygttggattattatygttgggtagttaggagtagttttgggtagtttaattttttggygtygygggtttaygggtyggtgttttgtgttaaggtyggttggatygygtyggtattygagaatgygtttgaaggtaggggtttggtaggttgatyggtagttttgyggtygttygtygtattttatgatttgtaaggygtttyggttttygtattgtatttattttatttgygttgttatatttygtagtttaggtttagaattggattttttaagattygttttaattttttgtygtygttyggttggygtttygygggtttttayggagtggtygggtattttyggttttygtttagtyggggyggtgggaatgtgtaggggagggyggggaggtgtgtgtgggttaayggaggaaatgaaygagttygyggagtttygtgtttgtgttttttgaaagaggtttttttgataaaaattatagttgggatttaatgagaagtagttggtttggtttttttgattttagttagayggtagaggtygygtagtgyggtgagtatygttagagataggtattyggtttggtttagygtttygygtygggtaggagttatttttttaggttygygtttttgttaggygygtygtattyggtatygatagttygggttttyggattatatyggtgtygygygaattgtagagagygttggtgyggaaygagyggtygggagaaatttagtatttygggattygayggtaagggtggttttgataaygaaatatygagaaagaaaattaaagaaagygagygataattaagaaaaggggaagggaaattgaataaaataayggagagygyggygagaaygagagggtaaatggtagtyggygagttgggatgaattaaaatgaataaatgaggaaygaaygaataaaaaaagtaggagtaagatygaaygaaayggataattagagaagggggaaaggataaagagggagggagtagattaaataaaagaaaayggagtatgtttaaagygtagaatatattaaaatgagaataagggggtaagaaaattaaygattttagttgaayggaggataggttaaaygaaagggaggtaggygggtgygagtagagtttggtagagattttggyggtygttagtttttggygtttttgtyggtgtttaaygggttgttagygtttttgyggtagagyggatttyggygtagygyggygygyggtggagtttggttgtttgaggatagttagtttttagggtygtatagtttatttggtgggaagtggygggygaagagggaattygttttatttttyggtttttaaaataatyggttyggagygtttttagtttataygagtgagygygtagttgygttttatttgyggygygattttttaygaggttgggtagttgygygttttagagtttggygtatttygtttttttttygtttgtagttygtygttygygtagttttaggtygttttttgttgagagygtttagttttgttttgaatttaggttgygtgttggygttgttagttattttygygtygttygygtttggttagtttgtttygagtttggttttgaygtygaaataygttttyggtaagagatttttattagagttttgttygttgtygttgaggttttgagtyggatgattyggtygatygttaaagtygaggagagttttaagtttttagattygggttgaggtttttgggttaaygttgagaatttttaagaagggtatygaggttttatyggggttttgtttayggygtttatgtttattttggttttgagttttyggygggagttgtaggagtttgggttttagygagttttgtaggtygtttagtgattttatagtggtyggaggaaatagtgyggygygggataaggttgtagygaaatgtgaaagttaaggttggtttygygg

SEQ ID NO: 6935 - DNA, 1277 bp, Artificial Sequence
  Description of Artificial Sequence: Synthetic polynucleotide
ygygtttttggggagyggtttatttatagtattgygagtatttagtatygttttagagtayggygtatataggtataaatgtagtagaggtttttygattygttaggayggygttttttttagatgggtattataygtaygttttttgttttagttatttygttttttagatgygttttttaygagggaggaagggttttttgttagtttygaatttagygaggattagttttaggattgagaattaaatatttatttygggygtgatagttttgtttygtttgttaatgttattgttaaggttataggtttgaggtygagyggttggggttggggtttttagttgygtaagaggtttttagtggaattgygttttgggygygtagttttaagtygyggatgggtyggataggtttttttyggtttttygygggygtttgttttygtagttaagtttaatttttttyggagtttttgggtttttttgagtattagaagttgaagttyggtgtttaattygtgygtaygtygttggggatttygatgygygaaggagagygggtttyggggtttygtygttaggtaayggyggttggagyggygagaggagttygggaygagygtagggtygggyggatgygggggtagygtygttttatattttggtttttagttttttttggttggggyggggttagaatagggaaagttgtagtggtyggttyggtaaagttaggyggggygyggttagygatttatttgttaygygtgggtagtygygtagattyggttygtgtatttyggtygagtagttgygattttygaygggtygyggaygtatagtttttttttygggttataggttttyggttggggttggggygattyggagttgygygtyggygtaygygatttygttygttttttattttttgttttattattagttttaatttggttttygttygtygygygttyggggtttaggggagyggygyggggatttaggttttayggyggagagagygygygggattgygaagattggggtygagtgtygttttttttgygttttggtagygtyggttttgyggagtagaayggagttgggyggagygttgygygtattgttttttygtttttygaaaggttattttggyggyggggygtygtgaygtaggtttgatttaygygygggtyggygttaatgygaggttttygggtagygagygaggttttgatggtygaygtaggyggagagggtgggygtggggygg

SEQ ID NO: 6936 - DNA, 2394 bp, Artificial Sequence
  Description of Artificial Sequence: Synthetic polynucleotide
ygttgtaaatgygttaatatttyggttgttagygtatggygagygttttttaygtttattygtaggagyggygtttyggtygttttttygtttttagtttgttttgttttygtttttttttttttttyggttatggttatttttggaygtttgagttttatygtgygtagttttttagatttattygagtaggaygygtaatatttgtygaggygggagttagaattaygygttttttagttygatttttgygtygtttggttggattyggagygyggttattatttttgtaagtgygtggtggattgyggtgyggggtgggaggtaggaggygtggggtagtagaattaagggtttagtttaygaggggtyggaaagtygaaattttagtttagagtttagatttttttagttttggaaaygggagttttgttttygaatttttaaygtatttatttyggtyggtatattttaagagtagatttttgtttggtattggtgtttygagatttggggtttttgtgtttgaygatttttagaggtyggaataattgaaatttaaaaygygtygttatttgtygtttttattttatttttygttttttttttatgtttgaaaatayggttaygatttttaggttttygtttgggatggttagtgttggygagtttatttttatttygtttttatttagggtttygtaaatttyggtatattgtagtgtagtygatttggaggaggtyggygttggtgatttagtttgtgataaattggtyggttagygtaattatyggtgyggatatgttaagagggtttyggggtgggttttttyggggtaygattttaggttygttgatgatygttgtggtatgaatgaggttatygtattyggagaggtggatgtttagatgtggatttaggaaatggttttatttygaaagtttygggttagtgggygtgttttttggttagtgtttttaygttygygttagaagggtagtaggttttygtagggttyggygttttatttattygtgttttttttgttgtttttagtttyggaygagagtagtttggagattagttygttagattygtygtagyggtygttygttaggttygygttttygggttyggaygtygagaaaaggaagaagyggygggtgttattttttaaggygtagaygttggagttggagyggygttttyggtagtagyggtatttgtttgygttygagygygagtagttggygagtttgtttygttttaygtttaygtaggttaagatttggttttagaattatygttataagttgaagygygttygygttttaggggyggyggagtygtttgatttggtagtattygtygagttgtaygtygygttyggtttgttgygtygygtggtggtgtyggtgtttgttygygaygggtagtygtgyggyggyggyggyggtggygaggtgggaatygtygyggtttaggagaagtgyggygtttttttagtygtygtttgttttttgtygggttattttgttttyggtttyggttyggygtttggtttttttttygtttattagtatttagtatttttygttttggttttttggaattggtgaggtygtagggyggtatttggggttattttygattttggagygygttttgygattggagtagggtyggagtygaaygtttggaaygtttttygttygtttttttgtagttttatttttttgggygttagggtttttggygygtttttattagtygtygygtaagtatataygagggaygtgtgttagagtttttttttttattttttttttatygttagttttagagttagattttatgtttgggttttatttgtatatttttaaatagygatttgtataggaagtaagttatttttttaaaaaatagagtattttttttygtagttygagaataaaatgtgtggggttgggttttttgygygtttgyggggaaygtaggygggagtygtgttttttagatyggtgttygtatygttggttygttttttgattggttaagtggggttyggttttagttggatygaagggygggttgtagtttygatayggttttaggaagatatttgggggatggaggggtggtgatgttagggttgggygygggaagaaaaggagaggaggaagttgaggtaattttgggatttttgttagygggaggygttattggttttagagtgatttygatttttygttgggtttttagagttgttggygtttygaatatygaaaagttaattttgtggattaygatagggtagaaggagttttttyggagatgagtyggygaggttaggtgyggggygygttgtatyggagtagtttaggtygggtygt

SEQ ID NO: 6937 - DNA, 1627 bp, Artificial Sequence
  Description of Artificial Sequence: Synthetic polynucleotide
ygtttygggtttggagggaggggaggtttttyggaaaggggtggygagagattttygttaygatttttaagttttttygygygygttggaggggatayggtgggygtttaattttyggygtagtagtaggttttataggttgtttgttggggtttggggaagtygaaattgygtatttygggattygggagtttttygtagygyggtttyggygtggtgattgggaagygtatattgtygttagttagttagtygtygtygtattggtttagtttygaaaatttttaggyggygtagaggtgtttaattttggttattayggygtygygtygtyggtaygtygygtgggttttagatagygttagtygttygggtaygaagaatatttggtttggggattatagygggttatygatygagggtagggtgggyggagaggggyggttgatatttaggaggyggagttggggtgygggatygtagaggtgttggatygagtttgggtaagaggagttgggggatygaggtaaaagtgtagggagggtttggagaggtgagttggagtttgggygggygggygggttgatgggggggyggtgttttggagggattyggagattttgttttgattttaagttgaggtttatttttygttttttatattttttagatttttttttaagattttgttttygtttygygttttattygttagygyggaggtgaagtagaaggygtygtagyggtygygtattyggtygyggggttygtagttgyggatttygggtyggtttyggtygtygtayggggygygtgyggtgagtatagggtagygtayggagttttygagtagttagttygygttatattagtttagattttyggtttaagttggygggagayggyggaggtyggggataagaggygttataggtaggagttagattgagttygtttggygttttttttygggtttttgagatagtttygyggggtttgggaagtgttgggttyggtygtttattttggtagagttgggagtaggtggttaggygttygttttgtttttygtaygtttgtttygtttygtagtaattgaattggtatyggtttyggttgggttggtayggaaatattatatttagggggtggyggggattttggggagggttagyggatgggagyggagggggaggaagggyggygyggtttgggagagggagttggggtttttaggggtgyggaggagatattgggaaggagttttgggagatttaggygaggyggattygttgttatataggaatggggygggagyggaagggttttattttttaagtttaaggttagygttaygttttygttttygatgtygttgatgagttygtagyggtatyggttttygttttttaggygtaygttygygatgattagggaggygtttagtygatgtttttttygtattttggygygtttttttaggggtttatattttygggygtgtagttygttggtgatgaggattagygtttttyggagttttttaggttttattttgttttagygtattttgtagttgggaggygtggtgtttaggaygtagggtagygtggtygtggttttayga

SEQ ID NO: 6938 - DNA, 271 bp, Artificial Sequence
  Description of Artificial Sequence: Synthetic polynucleotide
yggttygyggagttagygtttttttygygtygatttygggtttygggyggtygtyggggggygtygggygtatttttygttgttaatttttygttygtgttttygttygygtttgggtttygtygtattttagtagaagttattatagagaataaattatttttttgttttygagatgggttttyggggaggaaggtaaattgtttgtttygtgtataataagttaggygtggagagtagygyggaggaggtygyggtagttatygagygg

SEQ ID NO: 6939 - DNA, 884 bp, Artificial Sequence
  Description of Artificial Sequence: Synthetic polynucleotide
ygtagtattttggygaatttttttaygtttttggtgaagttgtttygataaattygaaatatatgttgtagygttttttattgttggtygttgaaygtgttttgggattaaggttttagagagyggayggtgttygagtygttgttttagttgtgygtttgtagtttttttagttaygttaagtygtyggtgygygtttagttgttattggygaaggaygagatttggaggtagyggagggggaaaagtttttgygggattgggagagaatgaagattggaggygtgtagtaagtggtygggagagtagttagtataaagagaaggaagaaagaaataagaggagatgagttttaggaggyggttgatgttagygaattttgtgtygygttgttttttttyggagttagggagtagygagttttttatttagatygygttagtgygtttygggttttattagtttttattaggygttgtttttttygtttttatttagtttttttttttygttttttygygagtgtatttaagygttttygttttatttatttttagygtttttttaagtttggaggagygtttagagtagtagaaatagtaggtattttatatygttyggygtggggatttygyggagygtygttgygygtygttttttgatttgygtatttttttttttygtygtttagtttaygttttttttygttgggtgttagttaatttttaagtttagatttyggtagtttttttygttgggtttgtyggyggtttgttgtttttgtygaagggygttttygtttttagttgtgygagttgtaaagaggtyggggttttaggaattttggygtygtygtttattttagtaggttttataatyggygt

SEQ ID NO: 6940 - DNA, 1007 bp, Artificial Sequence
  Description of Artificial Sequence: Synthetic polynucleotide
ygygggtttggttttaatttagtaygyggaggtttttttttttttagttttagygaaagggyggygggtgggaattattygttattttggtaatttttttttgtygtttgtttataatagtttgaattatatttttgttaggtagttattagttygattttttttttttttagttttygtttttttttttagygtttaggttgggggyggygtyggtgttagtttagtttagggygaagtttttagggtyggttygggtygggttgygggattygtygtggagygtaaagtgtttgaagttttygygygtattyggttttgtttttaaaggttttttagaaatgtaagaggttaggygtagaaatatatayggayggtagttttatgagaaaatgtagataaagagttyggyggtagggttatatgttttttataatttttaaagtygttattttaattagagttttttttgagttttaatgtttaattttgagtaaataagtygttttgaaagaagaattyggtttttaattaaaagtgtattaatattttttttttttttaattttygyggagtaaagtttygygygggyggaggygaggttaggtygyggygaggtygtttygggttygygtygtttygygtygtygygygtttttaggtgaygttaggygggttygggattagggtttattttgygtttttygygtygygtygtagagttaattaaaagtaatgttayggtaaatttaaaggtttttygttggyggagtygygttttygggttagtttgygagagagggtttttygaggtaggtgttggggatttatttgtgtgtgagtgtgagtgtgtgtgtgtgtgttygygygagygtaygtgtgagygtttgtgttgaaagggagagttttttggattttttggagatygagattgttttttttttttygtttatgtttttagtttttttygtatatgtattagtgaagaaaygtayggatatygtygt

SEQ ID NO: 6941 - DNA, 2191 bp, Artificial Sequence
  Description of Artificial Sequence: Synthetic polynucleotide
ygtygygttttgttyggttttatttattyggtggygtttgggttygttttagttttttatttttattttagggtattatttattagggtttygtttygttttagttttaygtgyggggttttatttyggygttagyggttttttaaatatttttatttttatatattattttttttttattyggayggtagtygaatagggataaaatttatggygtatagttagtttttttygyggagtaygttttgtgttgttttagtygttggggttttttatttygggttatagttttttggygtttttygggtygaggtagtygggtygaggagtgtyggtgtggttyggttayggggyggggtyggygggagtttyggtygtygtygtygtygttgttgttttygtttgttttttgggtygttygttygttygtygttgggtgygttgtaygyggggggtagtygtggtgtagaggtttatgtagyggyggyggyggyggyggttgttgttgttgtygtygyggaggtagatagatygggygttgttatygtygttttttttyggttttatgtygtygtygttgtygttttttttttttyggygaggggyggggggtttyggttyggggtgggtattatttttygtagygtygtttttttttttgtttttygttygggygttggagtyggygagggtattygtygttttttaggagtgtatttttygygygttttgtyggagygagggggygggygtgggyggaygtyggggtagyggggatttygygyggttgtaagaggagggggtttttttaaggatgttyggyggtttttygtttttaggtgygagttgagtttgatygggagygagyggygygtygttatgtyggygtgaygggygttttyggttgttygygygggttttygygttgttttaygtygygtygtgtyggtatygggttgtaggatgggttgtatttaaagtattatttgtaaggygyggattyggygygagaatatygtggtgtaygatgtgtgygttattatygattagtgttttaygygtatygaggagatttygtttatygttttgygttataagattttttattttaaagttttygttygygtggttatgttttttatttttygttaygagatttgggtggtgggttggatttaggygtgtaattagatggagttttttaatatttatagygatttgggtatgtaagygattygtygygyggtaygggagyggattttgggtttttagttttgtttgttattttgatttttttttttagtttttttttattgttgtttttatygtttttttaaatttttttttygtttttttttttattttttttttttttaygtttttgttttagtgatagggygggtgtagggaggttttttgygaaggtattttttygtggtttgtttttgattttttagaaaygygaggagaaaggtgyggggygggaagaaygygataaggagggttygagaggyggaggtggggatggttggygagtgtttggygagttttagggygtygtttgtgttttgtggggtttttygggaagagtttgggggaaattatagaggagtggagtggagtgtygggggygtatgggttgtgtygygygttttttggagaaatyggagygggtttggaagagtaggtttygggtattygagygggagttggtagttttgtttttgttttygygattgttgaagtttygaatttttgtttttygggttagggagttyggaggygttttygtttggaattataagtyggatatagttgtttttttgttttygygttttttggattagttttggtggggagttggaaggtatygagtgygtttyggttaagaagggyggatagttttgtgygagtagygttyggttggygyggygyggggtgttttttatgttaaaggaaaggatggattttttgtttgtttagggtttttattttttaaaatttttttaattgyggtattggaagggatttttttggygtttatygtygaattttatyggygagttgggagttttttaatttttagtagygtyggttggtgygygtygggtttggttgttgyggtgaagattaaggatygtygyggttttttaatygttaggggtygtaggttaygggyggtygygttygg

SEQ ID NO: 6942 - DNA, 859 bp, Artificial Sequence
  Description of Artificial Sequence: Synthetic polynucleotide
yggygygttaygtagggaggttgttyggggttggygygtatygagggggtgggggtygagttyggggyggatttttttttygatttttygattggaggatagggaggaaatggttttgtatygtaygatgaaaggtaggtaggagggttattaggyggggggtggtaggggayggaggatgtttagagttggaggatttygttygttttayggatatygttattttgttttttattttattttgttttttattttatygtagygtttggtttatttattttttggttttygttgttygtttaygttttaayggttygtagyggggtygttttattgtygtatttttatttygygttttgygygtttatttgtttaygaagttttygagtatygagtttttgtyggygttttggtygtttattayggygatttgyggtagttttagtaggtagttttgttttagygtygaaaaygygttttgtagayggtttattagygggattagtttttttatttttyggttttttattttgttygaggggtyggygattagttggtttttgttygtttttaygatttgatagggagtaggggtygygttgttttggttgttgttgttgygtygggtttagttagttaggttttggygtagaygtyggagttygtygttagttygtygtttggttttgatagttaaygattygtagygygtttgygygggygggtaggggygtggtttattttygygaygtttygttttygtttygyggttgtttygtttygggttttttatyggattattaggttaggygygtaygtattgtagtttagttgyggttagatgttayggtttttgygt

SEQ ID NO: 6943 - DNA, 791 bp, Artificial Sequence
  Description of Artificial Sequence: Synthetic polynucleotide
ygygygattgtagttttggggggygygttyggaatygaaatggtttaagagatttgaggatyggygygtttttttttttyggttttagtttttaattttygttatagygtagagggggtagtgyggtgggagggggggagttgtggggttggggtttyggtttggtyggtgaagttttaggattygttygtttggggttaaggtaaggggtgyggtaygaggagygtagggagtttygagttttaggygtagatttagttgyggattygtygtatagttttggtgttgtaagygtggatygtgggygtaaggtttyggygggaggtattyggttyggtygyggtygggtttgtagggttttggygtagyggatttyggygygttttggttygyggttygtagggtttagayggggtygagatagttaagttyggttygttygygttaggygttggagttaaggttgaygggyggttttgaattatgtttggaggagyggygyggtttttagggtttygttgagaygygttgtagggttgttygggttttttttyggygaygyggttagtagttygygtygygtttttagyggyggtaaaaattaggagtttyggggttttgtygggygtyggtattggagggtaagagatgttggtttttttyggggtttattatttyggggttttatagtatttaygtgggatggggatttyggagtagattayggayggaaaggaayggtggttttattttttgtaaaagaaattttygygygtataygggtgtttygg

SEQ ID NO: 6944 - DNA, 586 bp, Artificial Sequence
  Description of Artificial Sequence: Synthetic polynucleotide
ygggttgygygtttygagttgtaygggtaggtatttttttyggttttgttttataaggtggggagagyggggttggaygygggagggggygggggggggagygtgagaagaaaygaaatygygggaaggaggggatatyggygggttgggtagagggygaggyggaggttaagttgggtttgggygtygtygttttygygygygtttgttgtygggttygggttattyggagagygygggygattygggtttygygtttgttygtygtygtygtygtygtygtygtygttaygygtttagtttygggttgttygttggttyggtttyggtayggygyggygygggggyggtgggtgtagttttagttgtygtgygtttyggygtttttgtgygygagtttygtttagttttttttygtatgtttttgtgtgttttttttygtaatgtttttygtgtttygyggggggtgtgtggtayggttygggygttygtagttttgtagtttttygttgtttttttttttyggttygtttttgtygttttttgtyggttygttttttttttttyggaattttttttttttygt

SEQ ID NO: 6945 - DNA, 1678 bp, Artificial Sequence
  Description of Artificial Sequence: Synthetic polynucleotide
ygggatygayggyggygtttttttttygtttttygtyggtaggagaggayggggygggagaggaaggggttagttgtggttgtagtygttatttttyggygttygggattygggaygtttagtygggttttgtagagggtgttttatttgggtattagyggtttttygtttttagttagggtatygaaggygygttyggygggatgtagygaattgttttttgtttygggatagtggagyggtagaaggtttaatttttyggttygtttaygttygtaaggtggaaaaagtggggtgaaatyggggaaatttagygaaattggggygaaagaagagagattaaagygtgttatttaygtgttagatggygaagaagatgagygtagygtatagtattagagatagtatgtagtagaaygtagygaaagtgaaggttatggtyggyggattttaattttattatataygttaagaagtttttaggagttygatgtttttttagaggatygtattttttttaaggagtygygtttgtaygtttttttttaggttagtgtttaggagggygtatagttagygaagygattygagggttagygaataagygttggattttygtaggtttyggygattttagattyggtttttyggygaagataggaaaaygtgtgtygagagtygttggagggaatygttygtaaatygaagaagaaattaaattagtagygaatatttgtaaattagtgttaagttgtgagtttttygagattaataygataagygatgygaygattttayggaggatygagggaggaggttttattygttttaggaagagttttttgtttttttttattaaatygttgaggagagaygagygtttygtttyggattttttygygttatyggggygtaaayggatagtgtttagygaggtgttygagyggttttygagttttttttaaattttagagtygggtagygttttttttygagagaaggagtttttaggtagtygggaggaggtaggtttygttggttttgygttttagaygyggtttttagygtagtygtgygtttygaggygygttygtttttaatygtgatttyggttagtyggttttygtaatttaagtgtttyggaaatygggggtyggatyggggygagtattggttttatttaaygggttaattttagttygggtggttgtagtagtgggttttaggttaaaygttgtagttygttttatttgttgttgtygttgtygtygtygtygtygtygtttttgttattgygagaattgtagyggtgygattygggatttttttttttyggygttttattttygatttttgtttygttgagygygtttttttyggygggyggagattgtagygtygggggttgaggaaaggtgggtggygaagygtygtygggygtttggtggtygttgtygtygttattgtagttgtgtaygttygtttttyggaggaaatttgaagttagtagtataagtagggttggaggtygagyggaggtggggygggatyggttggagtagggattttttaaataygtgygtttggaggaggtgggaagttgyggaagggtatggtgtgtgtttygygtttaaaygtygtagtygtttttttyggtttttgtagtttygtttatygg

SEQ ID NO: 6946 - DNA, 1600 bp, Artificial Sequence
  Description of Artificial Sequence: Synthetic polynucleotide
ygagayggagttagtatttgattagygattaatagtggatyggygaggygggtttttaattagagygagatttttagaagttggatagtttttgtatttatgggagtatgyggygtagttggtagtgatttttaggaaatttyggtagtagtygtygtygygggtgtggtgatttygggttygtygtttatttggagygtttyggyggygtttggtttagaattatyggggyggatagttttttggagttgtaygyggattgyggaaggggatagtgagygggatyggttygtatttygttygygggttyggatygttggaagtattygggtttttttttttttttgtttttyggtttygttttttttttttygygttgygygtggyggtttygggttgygygtttttgtaggaggagatyggtattgtygtyggyggttttttttttaatygttagtttyggtygygygtttygtttygtttygyggaggagggtgggggygtttttygygtygggttygtttagttttttygyggttgttygggtygggttttttattggtyggygggygggaggtgaggggyggtagggttygtttttggyggttygygttygggaaggtyggtagtygagygtyggaggtygtggagagggygggtagggaggyggygggygtygaggagatgtagyggyggyggtggtggyggtggtggyggyggtggyggyggyggygtttggtttyggtygtagtttttgygtttygttygttttgggtygtttttgttagtttygygygyggttygtttttygtygyggttygtagtttgyggygttygagtttygagggygttttttygggygttgggttygaggyggttaagayggygggtyggtygggtayggggyggygggygttgtgttgygggttgygttggtggggggyggygggtygyggygygggtttagggttyggygtgtgyggttgggaggtattgtgggggygggygygygggyggyggtyggggttatggtygagggyggygggggygygyggaggagggygtyggygttgttygaggttgttygygygygttaygagagtttgtatatttyggaygaygtgttyggygagttyggttyggatagyggygggaattttttttatagtatttyggtygtttygygttttttttyggtygttttttyggaygaygagygygagttttygggatttttaggggtygtttygttatygtttygygtttyggaygtataggagtyggaggaggaygaggtyggygygggttggagygtagygttgygggatygttygttttygygtttygaggatatyggyggtaaggggttgttygygggtggatgtygggggyggygttggaatygggygygggggaggygtgggtgttggggygggygagtttagatttttygtgggttggtttgtgggtgttttttyggaaataaatgaggttgtaggagyggtgatyggtttgattgtttttgggggtttygaattygtgggtggagagggtaaggyggaggtygtggttagtatttttttagtgataatgtygtygg

SEQ ID NO: 6947 - DNA, 2394 bp, Artificial Sequence; identical to SEQ ID NO: 6936
  Description of Artificial Sequence: Synthetic polynucleotide

SEQ ID NO: 6948 - DNA, 1160 bp, Artificial Sequence
  Description of Artificial Sequence: Synthetic polynucleotide
ygtaggattygtttttygatggaygtgagttttatyggttygttggtgagattttttayggagygygattattttagattttttttaatygtttygtttattattaagtatttgagttgtyggagttgggggttgatgtyggatagttttygggggttgaygttyggtgatttttttatgttattgyggtygtaggygttaygggtaggtgggtgggtagggggagtatggatagagaggaggggattygtgaggagtagattttagggygagagtaagagygyggtyggggtttttygggggygagygtygyggtagagttygygttttttttttttygtygttatttatttattttttygggtagttgtttttagtgttttattttgggygtttyggggtagtgygggttggggygagtggygagggaaagaatgattgaaatttttygagtagttttatygygygygtygttttttttygagttttagattgtttagtgttttagttgtaaagggttatttyggygtttyggtttttygttygtyggttygtttatttaygttyggggygttatttatayggtaatgtttttgtttttgggtgygtygttgggaaattttygaatttttataggtaaagatagagtgggatyggtagtttttagatttgaggyggaggggtygygggtyggagttttttgtagtygttagtttgggaagattggagtgygttgtttatygagggtttgygtygygtyggtygtttygggtygttttgtgygygttygygyggtttgtattygagygttttygyggygtgyggtaygatgtaggygyggyggtttagttyggtgattttaggtyggttygygygttygtygtaaygattyggtagtygaggtagygtygygttttaygttygttatygtygtygtygttttagtatatygtaggygtgagtttygtygygatygggagagtttttttagttgtgygttttygaggtatttggtygggyggggaggygtygggtyggggygtataggggttaggygggggygttgttgtttatttttygtttttygggygtgygtttygtttyggagttygtatttygygttygygtttygtttggaagttttggggtatyggaygygt

SEQ ID NO: 6949 - DNA, 588 bp, Artificial Sequence
  Description of Artificial Sequence: Synthetic polynucleotide
ygtaggyggyggygttttgtattgyggagtygygttttgggggagtagtatttttagtttyggygtttygtagttagatagttttttttagggtggtagtatttttyggttagggtgtagggattttyggggygaggyggtygygtattattttttattttggtaagggttaggatyggattgttgtaggygttgagyggggttattygggtygagtgtttttttatgatgagtyggtygtttgtaggagygttgtygtygatygtttatattttggggtyggttggagygygtttttttygggttygtggtygaygyggttttttgtygtyggggagtattagyggttygttttttttagtttyggttttttyggttgttygtygggtttyggttgtygygttgtttattgyggyggtygttttgtagygtatatttttttyggtygygtagttattttatatataygygygtatagttttttatttggaggttgttgtaaattttaaygttaygtataagtgtattttttgtttttatttygtagtttatttgtttygttttttttttygggaygtttagtttygt

SEQ ID NO: 6950 - DNA, 878 bp, Artificial Sequence
  Description of Artificial Sequence: Synthetic polynucleotide
ygggaggygaaaaygaaatttatttttttgygtttatttttgttagaggtttgtaggaygtgttttaatttggtatttygagtttagaataaaagttaygggggttgyggtatgggtagggggaaggygygyggtggttgaygyggggtaggggttttggygagygygggaggggyggttagtagtygttygyggggttggattgggagtttygtgygatttygggtttggygtttgggtygggggtggttttygggtttttttygggggtygtygaggttyggtttygatagttttgyggttgttgygagygtttttygagttttygtttygyggtgttygttttaggagygggygyggygttgtgtttttttatttgygygtagagggtygttyggtgaagttatggyggygggttaggggtaaaygagygttygagyggggttggtaggttttyggggygygggaggatygtgggattayggggatgaaaagttttgyggtttygaygygtttggagtaaatygtggttttgygygtttttgttttttttygtttttttttttttttttttttttttttttygttttttttaygagtttattttttgttttggtaattagtaaagttttttygttgygygtttttyggtatttttttttagaggygyggggygggagtyggggtgtygygattyggggttgggaygtaaggyggggtttygagtgtttygggygtttttagygtttagagygygygttttgttyggtatttaygtttttttgggygggttttagyggggggttgataygattgtygttygggatagattgygagygaaggattggttttaagaaayggttgtagtygygggtygt

SEQ ID NO: 6951 - DNA, 561 bp, Artificial Sequence
  Description of Artificial Sequence: Synthetic polynucleotide
ygagtgggygygaatttttatagtagygttaagtagtaggattatagygttagygtttggtttyggaggaaagataagttggagtaygtaagggygattygttttygggggtttyggttaggtatttgtygtatgtatttttttygtggtggtggtatgagygygygyggggygyggggggtaggygaggggattttggtaggygtygaygttttaggtyggattygggggtttttttgtttgtagttttttgttttaatgatygggttgyggggaggggagggtaggtttttttttaggtttttggtttttgtygattygatttgtttatttgygtttttyggtagggtttatttgtayggggttttggaggtgtttgtgtagagtgagtaygaaggggaagtgttattagygtggtttygagtaatttggygttgtatggtagtgggttttagagyggygtttgttygygtttttgggggttgttttatttagtttaaaaattagtaaattaaygaatgagtaaagttggygtygttagygattagygtggattygygt

SEQ ID NO: 6952 - DNA, 1235 bp, Artificial Sequence
  Description of Artificial Sequence: Synthetic polynucleotide
ygagttgagttgttygygaggttgyggtaggaggtttygttttttygggtagggttttttttggaggttttttyggttttttttagaygtattygygtygygtttttgtttttygggagtagtttttttttagtygtyggttttgggagttttatygtttaaaygggagttgagtttgtaagyggttaggyggyggtgyggttggtgttgttgttgatgttagagttagaaagtagttgtgattggatttaattagaygttgttgtagtaaatagataagttttttgygtgattggttttaaagtggttggtgttaaataattagtagaggygtaaaagtagtttttttgygttgggagtttagagtaggaggtagagttygygggaagttyggagtatttaggaygtygygygttttttttygttttttttgattagggagtagttygttttaggygtttagtygaggtttttagtttagtgggagtaagttatagagaataattygagagatagagagayggagygygtttttttgtttagttttgaaaagtgagtygttttygggtttgtaattttaagtttygtagtagyggyggyggyggttgtygggaaggaggtaggtgtaggtgtaggagggaggyggttttgggtttygygtttgggtttyggttatggtttyggttttggggagyggtagagggtttggagggttgagtagttaatttaaatgtaagtttaagaggaggaggaggyggaggtttaagyggaaaggtaaggatygygtggygygtyggtttttgtttttttttattttyggtttttttatttyggttttttatggggttttygggtttgttygttgtgagtagttttattttggggtgttggygggatggttgtttygtgtagggygttygggagtttagatttygtggaaatgtttggggtttttttttgtttagaggggatagtgagtagttaygttgygatatgtttgagggattyggaygaagtggggygagggyggygaggagtttttyggggatttygygygttttygggtttygtagtttttagtggtyggtygggttggtattgttttttatttttyggaggttatttygttttttagtgttaaaggaattatttaaaaaygggggaaygagttttygygttagttatttttatttaaattgtttyggaggaagggataggygaagttttgygatygt

SEQ ID NO: 6953 - DNA, 5964 bp, Artificial Sequence
  Description of Artificial Sequence: Synthetic polynucleotide
ygyggtggttggttgtagtttaygtttttaygatttttgtagaaggaaattaygttttttttttttttttygtatttttatttttattttaagttttygggaagttttgygttggtattagggtaagygtttgtyggttttygggagttaagygaggtygygyggtttgggaygtaaatgggagggagtagtygttgtygttttgyggggttagggttattgggtaggygtagygygggttaagagtgggaggtttagggtaggggattygtattyggggttatttttgtygyggygygttttgygttttagtagtgtatagggtggggatttttygaggatagtggtgygtygaygggtttttyggtttttttttttttataggtttygttgtgtggtgaaggagttagaagaggygatttgggtgttgagattyggggttaaatygtggagagtgtttggagtttatattttagatttttggaygtygtagttagtttagtaggttttatttggagtygtttyggggtttaatygggaggtagyggggtgtaggygagagggttaatgygttyggttyggttggtttgaggagtttttgtttttagygatttatagggtagagagtttagggtttyggtttgatgtttttaatagttggggattggagagttggaggggtygtagatttaggttagagtttaaagtgygtygygyggygagtygttggatttttttgggttttaygtggtttttgtgttatatggagtgataggtyggyggaaggygttttagtygtygtttagygttttttaaggtgtaaggaggtaggatttttttatattggyggygtagggggttttayggttgyggaygttygttttggattttttagttyggtagattttttgggtggagaggygttttttagggtygyggygaaggagagyggtttttyggtaygttttttygtattttttttagattagtttyggttttatygtttaggagagggttygtttgaggatttttgtttgtgtygygygtggttagtttyggtttttttattttatggttggtttttagttttttagagyggatatttttttttagggatgtagggygaggaagggygggtggagttgygaatttayggggatttggaggattttttggttttttggagaggggtattatgagagggatttatgggatatagatttgggggattgggtaattttattttttttggtaattataaaaattttgagtaaaygtgtttattygttatttygtagaaatatataatgtaggtttatataggtatttttgygaggttttttagttaagggygtagygtttttyggaagtttttggttttgttattagggygttatyggttttttygtattggggatatttygtttgggttttgygtagtygttgtatttaaggttttgggagtttygygtttttttttaggygttygggataaagtgttygagggtttygtagaygtttagttttgttyggggtttayggtygtyggggttttttaayggatygtygagggttaygttttgttggggtgtgagygaygatttttttttygttttatgaggttygttattagttaggtgttttatgagaygtygtggygagtayggttatttggtagttygttygggtagttttaatttaattttttgtttttyggggtatttttttttygaatagtttttttyggtttttttagttttgtttaaggggtttggaaatgttygtagttttaagaaaggttttatttaagtataggatggggtggggygggyggggttaagattgttttggggattgaatttattttygtttttagygattttyggyggataaagygtaagtttgtgtatayggtygattgagttattggaaatttagtttaygaatygtagttagggaaaygggagtttgtttagttgtttttgyggaggggtgtgyggaaaygttygygatgggaattttttgtagattatgtatggagggagtttataaaaaggaggaaggggagygyggtggggaggaggtygygtgggygtggaaggttttagggttttgggggtgttygtttgtttaggygtagggaatggygyggagttggttggggaaggagtygattaygtttygtaggttaattggtttaagaaattttgtaagygttggaaaaggtygttgaaggagttygttgtaygygtaygtatatatatatatatatatataaaattttaaaaaaaaaaaaaaaaaaaaaaaaaaaagagygtygagtatgygtatagagaggatgttatattggaatgagttgtagtgggagtyggaggatyggagygggygygygagggaggyggygggyggggagygagygggtaagggygggygagygagtaagygagygaggtyggtgttttttygggyggygatyggggtttgggtttaygtygagggtaggaygaattttattaggtaggaygtygygtyggttgttgttttyggygtttaggttggtyggagagtagtttttyggttygtaggttgagtgygttggttaggggttttttttagtttaggaaaaaaaaggaaaaaaaaaaaaaggaaggaagtttgagggagttggggttggaggtggygggtgggggaaggttggggagggtgtaggggagygaaagagaagggtaggagaagaaagygattgtatttgagygaagttttaaatttttttgtgygttttaggttgttatttttgtttttygggtttttttygtttgygttttygggttyggaaaagtygagtygtgygggagttygttyggagttgtaaagtgtttttttttttygggygtagtttgttttttttygtygtttatttttttygtttttgtatttattttagygaygtagtygtygttgttatttatttygygttttygygtttttttygygttggggtttttttttttttttggtttgggtgggagaaaaagatggtgaggayggggaatyggagatyggtatgggggtaaaaatygtgtagatattyggaatygtttttttggaaatatttgtttgagtaattgaaataaaattggtagtagtagttttggagygtgttttagygaggatggtttttttgtttattattttttttttaaagtaatattttgttatttaggggtttttyggttgtttttttttattygatttttttttaaaattgttgatttgagttggttttggagtttattttttaatatgygtgygtgggtatgtgtatgtgtgtgtatgttttgtagaaattygttaaaatgtaattgtaggaattgygagatgtatttattgattttgattaggggyggtgggaaggggttggagggagttgggggattttggagggtgggaagtggttgattttyggtggtyggatatttatttagagtttgattygtattygtgtttttttggaagygttataattgyggggaaggagtttttagaaatygtgttagttttaatatggygggttaaggtggtttttaaaaattgaaaataaaggttttgaggtgggaaaaaatttagttgaagtttttattttttagtttygattttttttggttattttaggaagygttttagygaattaagtggggaaaaaaagaaggaatgggttgttyggtttttttttttygtggttagagtttgtgtgttaagtttattgttaggggggaaagggatggagaagtgtttttggttyggattagggtatygaaaygtaattgtygtgtgtgtttgtggattagtgtgtaggtttgygtgtgygtagtttttttgggtgtgtgtgttaaagagaattatttygaatgtgtgtgtgygttttggaattagattttgttatgatttgaygtgataaattgyggataygtggtgtaaagtatatgagggtagagggagtgatttattttgtttttttaggagaygagttagttttygttttgtgtgtgttggattttgygygggtagattttygagtaggtggggygaggaggtgtttattaaaaggattaattgtttygggtattgggtgtaatygggttgtagaygttagtyggatttygtgtgtgtagggggygygttgtatttaatagtgggtttttgtttttttttaygtygttttggggtgggaggtgggggatygggatygaagtttggagaagattaaagtggtggtggtggtggtggggtggggtagaagggygggagygygyggttttgggagataagtaygtagggtygaggygaggggttgttttttttatttttgggtttygygttttagggaaggtgggggatggggatagygtttggggaagaaattgttttttgttyggtttaggaattttttyggygtatyggagaggggtatttttttgttttggygggtatggaggtygggtagtygtygggggatgtgagtgggyggygaagtgygggggaaaggtyggygttttagggyggggaggatttgggagtggagttyggagataaaatyggggttaggtagaggagttagagggaaagttagtaaaygygagttygggtgagagttatyggaatgygggaaygtagtttagtygggaatagggttttygataggggtygttygtggttaggaygyggtygttgaatagaggtygygyggyggtttttgttygagggatttygtgggygggggttatayggaggtygygtayggttttyggggttggygggggtaggtgggaggatttttttygggttygygaatttgatttggtagyggttaggtgtttggaagygtttttaaatgatagggttataaagatatgttggttaggtttgtagttagygtagtaaygtggtttgtaggagygtagaaygaggttagatagggttattyggaygtygtgttgttagtgggtgggggtygggagtaagyggtattggtttggagatttygyggtaggtgattttttttatttgggtagygaggttgaaygatggygataygtyggttaggaygygttygtggtttttttagtttgygtttgggygygttttttyggggtyggtttttttatgggtttygygaggtggggagtagtttaaaatggttttgtgttgygaagttgtagttttagtygygaatttttttttttgtttttttgaygtygtygttgataagygtaatttgttttaaggtttygaaattygygattttgtaygaggtygtgtygtggaagyggatgtatagttgattataaagaatattttatagggttttygaagggtttaagtttttttttttggtggggaggagggaggagtygagattgggtaggagttyggtygattatygttttggtatttaggggttyggggygtattagtagttggggttggggatttggatgygygaaaagtygagggagttttyggggaygyggatggggattattyggggtaatagttayggatatyggtgttygtggttgatggygtttgtggtgttygagaatttygggaygaygttggaaagtttgggagatygtttttaaatttttggagattagttygtagtttygttttyggaatttttaggatttttgggtttttaaagttgggtgggattttaagaaggtaaggygaggttygtggttttgaygatyggtygttygatttttygtttattttagttttttttattttgtttttttgaattttgtygaatygagtygggtttggggtttyggggtttygygtattaattttagtygygttttgagggttttygtagtatagtygyggttgattygaggttattggtgggaaattaatttagaygaggtygattttttttggatttggttyggttgtygt

SEQ ID NO: 6954 - DNA, 5964 bp, Artificial Sequence; identical to SEQ ID NO: 6953
  Description of Artificial Sequence: Synthetic polynucleotide

SEQ ID NO: 6955 - DNA, 5964 bp, Artificial Sequence; identical to SEQ ID NO: 6953
  Description of Artificial Sequence: Synthetic polynucleotide

SEQ ID NO: 6956 - DNA, 703 bp, Artificial Sequence
  Description of Artificial Sequence: Synthetic polynucleotide
ygtttggggattttygtgttgggtatttygtaygttttggaygygygtagttttatygggagygaattttgtttygtttgygggtgttayggagaggggttgggaagtygagttagttttggyggygattgggggygtttttggttttttgggggggygggggygygtattgttgtttaggatygggyggygggyggtggyggyggyggtggygygyggtggtygtttagtattygatttagtagygygtyggggattggttyggggygygttgggygtattatgyggygggtygggygygggygaggggygggtyggyggyggggtttattggygtygggttaggttyggygygagaggygygagygggttatgggttgaygtygagggtttgyggygggggyggyggyggggayggggygggggttygttagttgygggygttaaggtygtttagtaggttaagggttttygttygggygaatgggaygttygtttyggggtattagtygtttgtagttagaagtttttyggattttttggaagygtaaaaaataaaaggtaatgtgtttttgtttttyggtygyggtggtagggaggygattgayggtagtttttygtttttygtgtttttaygttgggtyggggaaaagggaygygtygttgtttttttattgggggtttggagtygtttatttygygt

SEQ ID NO: 6957 - DNA, 1315 bp, Artificial Sequence
  Description of Artificial Sequence: Synthetic polynucleotide
ygtgggygttygggggattygygggtattygggaygaggygagggygtagaaaatttggagtttaattagtayggagttgagttttygygttttaatttttaggtgatttygtgyggyggyggyggtagtagtagtggtagyggygatyggagttygtagtagtttygagygttttygggaggataggyggygagttyggygaatygttatttgttagtygatygyggygtttygygggtyggggtygggagttyggggygagttygaaygyggtttttttttygttygtygyggagattttgtygggtgggttgygggygtttttygttgtygtttgtgaaygttgtgggtgygyggggttgyggttayggyggyggtggyggyggyggygggagtygygagtyggggtygttygggttgtgtttygtttyggtagtagyggtggyggyggygtttgtggtttaggatgyggtyggggggygtattgttygttttgttygttagtttgttgttgttgttgttgttgtgtttgttttggtgttyggtagaygygttyggtygygttaggtaatttatttattygtyggtygygtttygygtygygygtttygtttggygttttyggatttttaagtygtttatygttttttttygggygyggagatttttggtygyggyggggagtagtttaygggyggygayggtttgagagtggagtgggggagggggtygtagggaggygatttttygatyggtggayggyggttggggagtagagggatyggttagggttgygggggttttagygygtatygttgtgggygaggtagttgtggagygggatttgtygtygggtttygtattaggattttatgttttttattttggtttttgttgttttttttttttygttttaaggtttttttaattttggggttggggatttggtttgggagtyggggagtgygagatttttttgttaggtaaggagygygatttttagttttttagttaatagttttyggyggggtgtagtaatttaagtttttttttyggttgtgtaggattttggtggaggaaagtagggaggttatttayggtattttygtagygttgaggaygtttyggagttyggygatygyggtatygygygttattaataggtatagyggygtttagygygggyggattggggttygggagttgygagtygggtatggggygyggttgtatyggtttggattygttgggagtaggtaggttgggayggygygagtgagtgtaagagtgtgygtgtgtttgaagagggygygg

SEQ ID NO: 6958 - DNA, 1316 bp, Artificial Sequence
  Description of Artificial Sequence: Synthetic polynucleotide
yggggtttttygaggtygtttygtygtttaggatggagtaggtttggtttttggaagggygygygggttgtttggggaygggggygttttttttygygtttygyggtttttttttttttattgtaggtagygygygtttgtagygttttgggatygaattgatgtttttgggaaaygaaattaaatttttttgaagtttttagttygggttttttttgtttttygttattyggygtggtttagttygggygyggaaygagggyggggtygtggttatygyggyggaaaygattygggtygggggygggyggygaggataagggggttttgtgyggtattygtttagtttgygttttggggattgyggtygggyggyggggttggaygggagtggayggggttgggygygggttgggygygttgggtyggttaggyggygygttgatygyggttttygtgygtttygtaggyggggagttygtatygtygygttygggtygygagtgatgataatttaagaggtyggygygggygggygtgagyggyggaggagtygggygyggygataygyggttatggagygggagtyggyggggatygaggagttygggttttygggayggyggaggygtygagagggtaggaygygtayggtgygttttaatttgttgtygttttygggygtygaggattttgyggttggygyggttaagggygagyggygayggyggygygggtgtgtttagtatttggtygataatyggtttaagattattaagtataygttgttgttttttttgtttaagaatttgttygagtagttttatygttyggttaaygtgtattttgtttttatygygttgtttaatttygtgtyggyggtgaaygttttttagttyggtttggtattggygtyggtgttttttattttggttattayggtttttagggatttgtgggaggattatagtygttatygtttygattataagattaattatttgggttgtttggtttttagtaggtgagttgggygggygggygagygagygygyggtggygtagggtagggygtttygggaatttggtgttgggtatagtgattggtaggggttgggtgtttagaaggtagttttatttagggtggagggttyggttgygygggattyggtgtygatygaagttatagygtygttaaggtttttttgtgttttygtygtagttaaaggggygttttggatgyggggaygygtggggattttttgttatttygtgtyggggttagaatgattttaaggttagaaatygayggtygt

SEQ ID NO: 6959 - DNA, 1110 bp, Artificial Sequence
  Description of Artificial Sequence: Synthetic polynucleotide
ygtttatttyggttyggagygtggttaggagagtyggtatygtagaaagygttgygggaagygggttttttttygtttattyggatttaygatttttagtaggtttagtttatttttttgatttatgtttttttatgtgtttttttygggaaggggygaggagggttagttggagtaattygggagaagtttgggaggattggtaggtttttttygtttttttttattggtttttyggaagtagagaaaaatggaagtygaggtagagttaggaaaaggygtaaaggggtagggttttyggygttaggagaggagtagagggtgggtaggygaygaggggaggaggtgygaggttagagatttttgtagtggaggygtygggagaattygaggtyggtgttttgttyggyggtttataaaggaaggagaaggygtygygttttygttatttgtgyggyggtttygagygttttygygggagttaygttttttagtagttttatttggattttttgygttatygtygtygtygttgtgggaggygatttggatatgtttttttggattattggygaaaagtyggttyggagygaagtagttagttttyggyggygggttttttttttttygttttygttttttygygttttgatyggttttgggggtygtttagggtttaggttyggtygttttyggygtagygtttygtagygtttygggattyggygttttgttgttaggygtttagtgygygggayggggtyggggtatygggygaagygagtygttygggaggygggaygygggggygyggttgyggtgtttgggagaggggagtttttagyggggtagtyggggtygggagagygggygtagygyggyggggatyggagtygygggygtygggaaaggttttygttaggaggggagggaatttygggagygygagttagggggaggygygtyggaaagygagagtgataagtagtttataagtygaaaagtttttygygggaggygygygtygygtgggtttygatttagtygttgygygtygtygtggtatataggttgaaaagtttgygaagttatagaagttaggttyggygt

SEQ ID NO: 6960 - DNA, 1655 bp, Artificial Sequence
  Description of Artificial Sequence: Synthetic polynucleotide
ygggttttttatyggygaattgaaattggttygtgaagaagtggtaaagtaatataatttttgtagyggttaggtyggttttygggaatttygttatgtygtygtygttatttttttattttattygttagtttttygtyggtgttygggggttttygatgtaataggtaygatygggttaaaygttgyggatyggtttyggtaggattyggaggtttttgtaaatgtygttgygattttatagtagggaatygagaagaggaagaagygaaygygagtaggagygtagygtttttyggatttttgaggttttttttgtaatttgttatattygtagtttttattygatattgaataataatygyggggaggagaggttatttgtagtygaggttygtaaattgtyggttttattygggtagygttaattyggtgttygyggayggtgattttygagttttagygatgygttttattgggtttaaaatagatttaattttatagttagygtygttgtttgttttagatttattagggttggtyggttttgtaggaatttttttttgtttagggatggtttyggtaggaggtttaggtttgygggaaggaggttgatgaygaaattttttygataagttttgtttttttttttygttygaygtagggygygygttttttttygtagtyggaggaatgggtagttttaaagagttgagttttgggaaggttagggttgtagtagtttgaggttygaagttaggaaaaaaatgtgtttaaaaaaaaaaaaaaaaaagaggaagaagaaaggaaaagggtggagtgggagggagttaygttggaatttatygggagagggttttttygggtttaggaggaggtggttttaagttttygyggagttttaggagtttggtggyggaggaggygttgtygtygttaygttttttygygttttttttttatattttgaggagggaaggtagttygtaatttgttagatttgtygtygtatttttttttttttttttttygttttttttttygtttttttaggttttttttatttttttttttgaaatyggtagttygtatagatttgtttaatggttgtatttttttyggggttggttgaggagtygyggttaatagattaagtygggggagtttagygaaggggagggagagggttattttagtttygtgygttttaggtagtyggttgttttagagygyggggagaggggataggtyggggagttatygggggagygyggggyggtattttygygtygtyggggygttattttygtagtttgttygtaygttttgggtagtttygttaattgygttttatatttatttggttttygggtygttttygygttygattgyggggggygatygygtttygtttygattttggyggggtttttttgggtaygaaagggttaattatagttygttttttygyggaggttggttttggtagtggttagggagtggagaaagtaaattagagtyggttyggttatygattttgygaagttttttygattttagtttagygygggagggtggyggaaggtggtgtatygtagygtggttttygtygttgtygtygyggttttgtaaagtgttagygggggygaaagyga

SEQ ID NO: 6961 - DNA, 1655 bp, Artificial Sequence; identical to SEQ ID NO: 6960
  Description of Artificial Sequence: Synthetic polynucleotide

SEQ ID NO: 6962 - DNA, 304 bp, Artificial Sequence
  Description of Artificial Sequence: Synthetic polynucleotide
ygyggtgggtagggttttaggaggtagttttygttyggygatagttttyggggygtaatttttygtaggaygygtatttgttaggatagttattaagaggatgyggaggttgggggttttttyggggataaaattagggtattttaaggaattttttgygygtttaggtttgtttgtgaagttggtaggyggaggataatgggagtaggggtaggtttttagaggygagttygtttttattttttttatttgttttttatttttgygtyggtygtatttatttygttttttttttagygttygt

SEQ ID NO: 6963 - DNA, 1666 bp, Artificial Sequence
  Description of Artificial Sequence: Synthetic polynucleotide
ygaaatygygygagtggtaggagtaggttaggtyggaggttttttttyggtttttaattyggyggtttgttttttttttttyggggygtttgtatagtagatatttgtagtaygggyggtygttygggttttygatataaggygttggtatttgagtttttgattggtaatgtattataaatygttttttttaggtttttttagagtaggagtayggaggttatygtgtttataaatttttttgtgttygttaygttttttgggttttgggygttygggtttttagtygtagagtaygtttgttygtgggaattttaatatttgtgtttygygaggtyggyggggygggggygggggattgggattattttgtttttttttagttyggtttttttygttttgttygtygttggtttatagagygtagygagtggaaygaattgggtgygtygtttttagaygttggyggaaattaaatgatgaggygaggtgggatattygtttttygtttygyggtygaygtttagtttayggtaaaggtattatayggtgtttygtttygyggygaygygagyggygggatgattyggtttgggttttggygtagttaaaggttyggttygttggggygygattttagttyggygygtatagtttttygagttttaggttggattgggtgyggttgtatttgtggagtgggtggttyggtgattgttattygggttagtgttgttagtagatgtgtatattttgggygggggttggyggtygagtgttattagtaggggyggyggttaggtagttattygtygttttttaagttyggygttgygygtagggtttggagtattyggtgttgagaygygaatgygtataaagagaaaagtgtttttagtgtttttttaaaatggggaatagggaagaaggataagtattatgtaagattgttattgttatttgttttttgyggattatgttgttttttttttygttggtttggttttgagtattgaaagtyggggagagggygtyggttttagagttagtygtattyggggatygtaggyggygttggttygggttatttaagttyggtagatgagtttttggtttgygggggatygggtyggaggttagggggayggtagtgtygtyggagggagygygtagtttaaggtyggtgtttyggtttygygygttttttttygggttygtagggaattygggttatttggggagtygggttttgtyggttaygttggtttttygyggttttagaattaattaaaygttttttttggttaagggaagttttgygtyggaygggggtgggggygtgtgggggyggtatgtgggtatyggaataattagttttatttttgygtttttatagaattygyggygtagygagaagtgaatagyggtygtttgaatggyggttttaaaaggygatatttgtaagygyggtyggttgtgaattgaattgagttaaatgyggygttygttygtatttgagtygygagttattagtgttaggygygttyggtygttygggyggggaagygygyggttaggtygttygygttgaatgyggtaagttgyggygyggtygttttatgggaatgtygttatttgtgttgttagyggtygggagggggtgygt

SEQ ID NO: 6964 - DNA, 5030 bp, Artificial Sequence
  Description of Artificial Sequence: Synthetic polynucleotide
ygygttatagtggtttttttygtttagttaygygtagtgaaattttyggtaatygggttagttaagataygggatttgtatygtagttttttagtttttggagtyggagtygagygttttyggtagtttttttaattttttttttaaagtgygaagggaaaagtttygtttgttttaygattgtaaggtyggyggatttgggagtygygttyggtttyggaggattyggygggttyggggtttttyggtagyggtttttttgttaggggttaatagtagttttygyggtygggygggygyggaygttttttttttattygttygggaaygtggatatygygttygtaggatgttygtyggttgggatyggtagttaggaaatatgagaaggtttygttatttttgttttygggyggygygygtygggttgggtaaataaagtygagaygayggyggtggyggtggtgagygygttggagttygygtggagaatatgyggyggggatgggagtgygtttagtttygaggygggagagttagtygttttgtagtyggtygtyggtttygtagttataggtatagttttygygtygtygagttttagtyggttgyggyggaaygttaggttygttttggtttttgygttttgggygtyggtgttttttygttttttttttaatttttttttaaggtttggtggagaggygttygggtagyggttaaggttggtttaagggtttgygyggagtttgggagtttatttggtygygttttttttgttttaaaattattygtyggygttgggggagggggatatttttgtagggagtgattttttyggttatagtttggagtgaatyggggtaagtgatttgagaagaggygygggtggtygygygygggagttttgggagggttagtaagtgtggtttataygttttyggattttttgygataggatagygttyggatttttgttatygtttgtttttgagtttgttgtttgtagatttatagygygtygggtgtttgtgtttgygatttttgygtgggtttggggttgtyggggaagtgttygaggtggttaatttygtgatgatttygttaggaaaaataygtygtygtatttaggaggaygygttggggtggttyggagaaggtygggtyggggaagggtgttttgtataaataaagtagtatgaatatatatttttaagggtatgattttaaaagaaaatattaaygygagttttgattgtagaataggggttgtaagtaygaaaattttttttgatatttattatygaggttatgtgtatattttaggtaygtatttgtttgygygggaggaygtagttttaggggatataygatatttagtagaggtttgattttatttttttaygaatatagatygtagtygtygtttgatygyggtggttaygygtggttttaaatgttaygygtggtttttgttgyggtggtygaagggyggggygggggygttggygagtgtgggygtttggygaggtaaagggtgtgtgtgtgtgtgtgtgtgtgtgtgtgtgtgtatgygygygygygtgtgttagtggagtagtagtttatgtygyggttggaygggtaaagggggygttggtagygaagttgaggtygttyggaggaaaygggagttgtttygaggygygaggygaggagatggggygggygaagttygtygygygttttggggttgtaattttgyggtttygyggtygygyggatttgtttttgaygtyggtgygyggtaggtagaggtttagggttttygygattttagaggtgagttgttggtttttttygatagtggtagtagtggttygggaggtgygtygattaagttgttttttgttttgggtttttgatatttttatagtttttgaaagggttttyggagattttagagagaggygggtgtygaggggttaygagttygyggttgatattygygttgyggaagagaatggtattgattgagggttttggggatttgggttttggygttttggattttaggattatgtatttttyggggygygttgggggatgataggaagattttgggagagaagggggagaagtggtgttttygttttgaygttatttaatttttttttgtttttgaatttaattttatttygggggattttggyggatagaagatgygggggttttaattaaattatttaygatttagaaaataygaaaattttttaaatttyggtatggtttgggatttatgagttggggggttttgtggatayggttggtatattattttaaatttttttttttatttaattttttttgaygtttygagttggggtttttagaggttttagttttttgttgtgattgaagaattaygygyggttttaygtyggtygygtttygtagttyggagtatgttttttttagatttaaattgaaatttagaggttygtttgggaattygttttttttgtttttgygggtgaatgattttyggttgtagttttggggagtgaagggattggggggatygatygtttaggtaaggaagagggtaggtatttgttyggggaatttgtaggggygggggygtgtagttaattggggagagtygtagggtttttgttagttgyggyggygtygttttttttttyggtttygtagttyggygattyggttaagtttaaggttttgaatttgtaggggtttgagtatttttagttagtaagtaaygagatgtattttttttttttagaagtygagtttygttgyggagttttyggyggtttagtttygaggttttgyggtygygtygygygtttttattaatygatattatgaatattatygtttttaataagtttagyggtgyggtgttgtttgaggayggaggygtttyggagygggagyggggtggtyggttttatagyggtgttttggatagtttttaygttygtttygaggtgggtattttygayggttygttttttaaggataatttyggtttgagatatyggaggatygggtatgygtatttttttgggggttttgttygtttgyggttyggaggggtgggggtggtgagttgtgayggggtttygtggtaaygygggygggtggaygggaaagggttyggagttttttgggagtgtaggtttgtttttttagggttygygtatttttatgttaaggggtttttattttaaaatatgagggattaattygtyggggtagttttaaagagtttggtggagattaagggygttaggagttgtttttyggtttttygttgtttggatttyggagttgggggttatttgttttttttyggattgtgggtgtyggtgygyggttgagggygaggaaaaaggattgagttyggtgtagagaaataggygaagtygagtagtyggggagtttaggtttaggtttygyggattttttttyggttattygagtttttygttagagtttygyggttygtttggtttaaggagtygggaaggtygtttttygttagggagtttygggygtgagygyggttyggttgggttygyggygaattyggagggggaggtttygggtttgyggggtygggtttgagtttagyggggtgaggggtatgttggggggggyggtagtttgygggtgggttagttgtttagattgtyggtgagtggagggtaggttttgtttggttygattyggyggtttttygggygtttygtyggggaggggyggtygttttagtygtttttatttgaaygattgtattagttgtttgttttgyggygtygttgtttagtaaaatagagattyggtttygttaaaatgttattattagtygtttygggtggaattgtattttaaagtgtttaaagaggtagaaatttaggaggtttyggygtaggygygtaagtttyggggagyggttgggttygttggyggtygygygygatatttttyggattygtgagggagygtagygttttaggttaygttttaggtttttggttgtttttgttttttttttttttgaatgtgttttttttgaggtttttttattttatatgatgggatagagtttgtygtatttttaatttttttttagtygggaaayggttygayggtgtttttgggttttgtagtttttttttataaattattaatttttttagaaagtttttttttttttttaaaagattaaaggaaatagtttaaagagagtyggggyggtaatgtttttttgttttattttttatgtttagtyggygattttttttttgattataagygayggaaagtttttgggagtagataagagattttygagggaagtttygagagttagtygtatattttgttaggtttgttaggttagggttattygagggtgyggygttagygggtgagggaagggtagtagttagtttygttgtttagataygygattggaatagtagtattttttaaattatttgattttygttttttaaatttttaattttggggtattgggtttaaggtatttttttatttaagataaatttatygaaatgatttttttatttagaaattgtgtggtttttattttttgttttttttaaatattttgggygygygtaaagtaggggygtaaggtaggaatgygtagtttggatgyggggttygggtttggtyggggygtggagygttygggygggtaaaygygtygtttattagggtygttttttttttttatgttttagygttyggtagaatggygggaaggtgaggtataagyggtaggttttgtaagatatggygygattttttaagtagtggttttataagtatygtgataattygtattttattaagatygagaagatatttttggttttyggttygtagatgaygttagtgtaggtaattaggatttattaatattttgattygttttttygygaggggttgaagagygggaaygtttagagttygtgtggttttttaygtggygt

SEQ ID NO: 6965 - DNA, 2868 bp, Artificial Sequence
  Description of Artificial Sequence: Synthetic polynucleotide
ygygtttygtattttagaggggagggagaaagggagtttaggygyggggggtggggttgggggagtaygagagagtttttttttaaataygtattttttygttttttygaygttgtagyggttttattatagaygtatttattgttttttttttaaaagtygttttaaaaataaygtaggaattaaagygagtttttyggttygaaatgtaygtgtaattttttatatagtttgggttgyggtyggyggtagggtygttgtygtttattattatataaataggtatyggggyggygtaggygggggttgttttttttgygttttygtygttttygggyggataagtttygtttttttygttataggaattgtttagataataataattagtagatatttygttgttgtaygagagggagagaaagtatagtatygtttygagataattagaaatataattaatttataaygtttttttaaattggaaaaggygattgtgtaattattattatatgtttaggtttygatttttygggttgtttttttttttttttaatttttaygttaggtagaggggtgtgtgttttttttggtatagtagtataaattaataaatattgtagttgyggtgtaagtagtagtttygygygttygtyggttygttygtttttttttttattttttttttattygagatttagagygttatttaagttttattattyggttttagygtttygtgygttyggtttaggtaataatttttttaaaaatygaaagagaaaagygygaggygtaygtatatyggtttatttyggygtagagatttygtttgtttygggagggggatttgtttgtggtgtttttyggtttttaagtttaggtaataatttygtaaatatattygtygtttagttygtttttattygygyggttttyggyggygttaagtgggtattttttttgttttgtttttygygtygtttygtygygtttygttaaaygtggattttattygyggggttygtygyggagtttttaggtyggggttttgggtygggtagygggaggygttagggaggaggggygtttagggattygygttttygygtttttaattttygttaygygagygygttyggttygygggttttaattttatygtygtyggtygaattttgttygttygyggygygtatagtyggygttygygtataygygygtataaattttaygtaattygyggtygtttygtttygtygtygtygtagttygtttgtygygygtttatagttyggttygagtygyggggttygagygatagygayggygtyggtyggggtygyggygygyggaagttattttgtayggttagygtygggtataagtttgtttygyggttttygggggtttgggygttgagggagaatygygttgagggggttaggaggagggggagagggaggygtygaagggtataagagtggggaaaagtgyggaaagaagtaatagtygttttattygggattagaaaagtggttagtgygtttyggtygttygttttgygtyggggatgyggyggygtyggygtyggttaayggtttagggaggyggtaggggyggygggagtygttaggyggagagagattaggtaagagatataayggtttagggagagygagyggtygyggygyggtttyggtagyggyggtagyggaggggggtagagagtattattttttatttttttattttattttgtygtttttgtttyggttgtttttagttyggttygttttttttattttygggggygtttyggttgtttagttttttttgatttygtygtttttyggtttttttygttatttatygttattgygtygygggttygtttgttttttgygtttatatttggggttattygttatgattttttygtttgtgtttaaatgttygagttattttttttttttttttttttttttttttttattttttygtttttattttttttttttttttatygtatttggtttaygatattttyggttttaygatattattttttttatatttagaggttttygttttayggtyggaattttgttgttagggatygggyggtttgyggtaatygtgggtattgttgaatttgaattgaggggygagggaaaagttttttttaggtgtggtggggagagggaggyggatgtygggaaatygtagggaygyggttagaaaggygaygggttgtyggagttggaaaggtaaagttggaggttyggyggygttttgttttygygttggttatattygtygyggttgttyggggtagggagggatttggttgattttttttgtattttgtgttttyggagttgttttttygagygtttagaggttttygtttgtttgttttttggaggtagggttattattagttttaygtttygygtgttygtttttygtatttyggggttaaggaaagggatygyggtttggatttttyggggagtttttttgatgaggggaagggtaggtttggggayggygaggataygyggygatyggagagaggttatttgattygygtagttyggatttttttttttttttttttagggaygtttggtttttttttaagygaatygggatgggaagtgattttaatgagattgaattttagttggattgaaagagaggttagaagtttygtttgttagtagtttttttagtagagyggaatgagtaatatttatayggtgtttgttttatttttttattygtattyggtttttatttgttgttatttyggttttttatattyggttygygtttttygttttttttttygygtagaatygt

SEQ ID NO: 6966 - DNA, 2678 bp, Artificial Sequence
  Description of Artificial Sequence: Synthetic polynucleotide
ygagaggygatggygtttgttttggttagatttaagggtaagygaggttgygygyggttttygtagggtyggattttygagttttagggygtttttttattygggtgtagatttttygyggattttttygttttttygggttttattagttgygtaggaatggagttggttagagttttgggagyggggagggaggygtygttattagagggygtyggagttttagygttgyggtyggtgagyggttaggtttttyggtttagtttagtaaaggtttggggaygttygayggttgttttttttattggattttattgtttttagttttttaagagtagggttaagttagtggggttttyggttttaagtttagtgtttagggtgggtgggtgggtgggtgggtgggtggatggatggatggatggatggatggagtgtyggtttatagttatttaayggttaaagtggttttggaaaaaaaatgtatagaagatatttatttttattagyggagtttyggagttttygtagttttttgttgatygttttygtttaatgtagtygttgatygtttatttttygayggttaggattttttagggatagggaygtgtttttagggtaggtttttggatggaygyggygattgattttatttygttggaygttgtgttgggaaggatatagagaggtggttggggtagtttgyggttataaagygaggtttaaaggggygttttttttatttttaygttttttgggtgtygatttgtatttttttttygttatyggattggggttatttgggatgtttygggggtattyggagggttaagtatygtygagggayggtttygtgggaagagttttttggatttagaaggtagaygttagtagtattgttttaggagtyggaggtyggggtgggggagtttttagttttttgggtygtayggagttttttttgggtaaggtagtaagtatttaggtttaaaggatttatttatagttattatttattgagtattgtttgtttgttagataygatgtagagaatttygyggygtggggygggttttattgaatttttygttttatttygyggggtgggtttgtgattagtttattttattattgagaggtyggaagtataaaggttatattygtttttattgagagtygtyggygttttttgttttgtttgtataggygaggaaattgaggttyggttggtggygtygtgggtttggagttygagttaygttgattgtaaagaygggttttattttygtagatygagttttgtyggyggttgygtygtaagtygggtaggtggygagtttgagtttttaygtatagaaagtaggattttttyggttgttttgggtygttatygttagtaggtttttygttygggattaatttgtttgttttttattggtttttatttagttttygttatygaaaggtttygtttygtagttttttaygygygttttattttaygtttaaggtttttagtttttttagtggggttttgttatagggataataagyggttttttagtyggygtygtttaggttgyggattttattgtagatygggttagyggtgyggggtttagyggagtttgagaaggttaaaggtyggagygtattgygtttygggagtatagagggagyggaggaggggygaaggggatgggtggggggtgtygtygagggagtygygygttagagatttyggttayggttagtattyggtttygggttygttttttatygygygtttygtttygtttygtttggtttttttttttaaagygttyggygygygttttttatygtygtatttttatttttygttagtygtattgttygttyggygttyggttttygattygygttygttygttygttygttygttygttygtgttatgaaygttaaggtygtggtygtgttggttttygtgttgatygygttttgttttagygayggtaagtgygttyggyggggaggttttggygaggttttgggtttyggttttygttyggygtagagtygyggtttttttgtttgygttygtagtttgygtygttygatatagtgggggtggaggtagttygtttagttgggygttttggtgyggtgtygygtttaaagttttatttttgygtygagggtttgtgatttgtagagagygatygtttgattttaagttggttgtagagygaggttagtygggataattgggtaggaaygttttaagagagygttygggattggygygggaaggygygagggtggggagtygyggattttagatttttgtttgtttattttttatttattgttttttygttgygggttyggtttttataggygaatgggtttygaggttttgttgygtatagtgttggaggtygggyggtgtatggygagagygygttttgtaaagttygttttatgtygygatttgaggttgtgaggttygatgtagtygygtagttttygttttttgygaagtygattttttttttatattttygyggggtttttggttaggygygggygggttgygyggygtagttgtygggtttgtgttattygttaggtygygtttttgtatagtttygyggttygtagygaygyggatttgggygygygtttagtygt

SEQ ID NO: 6967 - DNA, 2756 bp, Artificial Sequence
  Description of Artificial Sequence: Synthetic polynucleotide
ygttttygtaygtattaaaagggttaggygggttgygaggttygtygttttggttagatataggaygtttaygtaggygtatygtatygtatagattttgyggtggtttattaagtagtatatygygttyggaaygggagygygttaggaggtttaygttgyggagtagtagtaagaygggagtatagagtaggttggttagttttatgttaaggttgagttgtttaaagtttagygagtgtataatgtggtttgttattatgggttygagygygtaggttatygaataggagatgtyggygatggygtagaygttgttatagattgagatatggygtaygtttattaggaaggygagygtgggtagtagtgttgtgtygattagggttatgttaaaatagaggtygtatagtgagattattagyggygygaaggagyggtaggygggtaygatgtaygagttggygtygattatagttagtttaagygygtygtatagttattgtaggtgtgggtagygygtygttaggygtayggtgaggtagaygtttagtatatgaggtaygaaggtyggtagttaggttatgtttattttttattyggaagtygttatygtatgttttatttaygtggtaatggtgggttygaggaaggygaggggaatgttataggtggtgagygygtyggttattayggtaatgtaggggtttagtatgaggyggtggatgggagtgtttattggtaggttggttygagttygtgtagtygtygagaagggtttggttattgttagtagtaatagygygttaaagagygatayggtagttagtattaagaagggtaygygtttgtyggygaatttatagaggatgttttygaagggyggggttattaggttttygaagttaatgaaggttagygttaygtttagtgtaygattgygtttyggttttttygggtatttatyggygattatggttatgttagaygtgtyggygaaggttgagtttaggttttgtaggttgygygtygygaatagygtggygtagttttyggygaaggygaataggattgtagaggygaatatgaygtttaggtygattagtagyggtaygtygtagtttatgyggtygatgaagggttygtttaaggggtttattagtagttgtaggatagttttggaagtaaatagtatttygatttttaygttttygtttttygtagggtagyggggtygaagggttgagttygttggttaygtagttgtyggggaygtygaggtgttggtygtgtaggygttggtattggtyggagtgggtagyggtagggtgggtttttatatttygggagttygggtggggttttygtygttttygygtatgtgggygatgtagtygggtattatgggtaygatgattatgtatagtatgttgtttagtaatagygttaygtataygataataagtattaggygtttttgtygtyggggtttttgtagygtygygtttatagttttygatagtttggtggtygtygttygggtttggttygtaggtttygyggattttatgtttttatttygatgttttttygaggaygttttygttagggtygagygttggygtttygtagtgtagaggygagggtaygggatttyggggaggttgttttggtygagtagatttttttgtgttttaggtggtygyggagtttatggtttagygtttygggaaaggaaaggatttygttyggygaggygttgtagttatttttagtygatttygggattygyggttgttgggtttaggggyggtygggaagtygggygygtygaggggtyggggtyggagattgggygtatttygttyggggygygtttagagtagttttygtygygttaagaggtygttygygttggtygagggatatgttgttgtygttygttygtttgttygttygttagtttygtygttgygttttttttttttygygtyggtttttgtttttttygtygtttttttttttttttttttttttattyggggttgtgaygyggygagttttagttttygagtggtgttygggttatttaygtygtttatgttaatgygaygtyggyggggygggggtygggggyggggygtggtygggtaggggttygttttttagatgttttagggttggaggtttaggaagggttttyggtgtggaagttttgaattagtttttgggatgggygtttygygtyggtagttggttttttgtttttygttttttgtttgtttttygttygyggttttaggattygyggggttagygttygtttttttttttttggggaagggggygyggtagtyggtttttygaggttttttgggagaggygggagttagaggtttgygattttygttttagtttggatttyggygtatagygagtaggaagttttygaggtgagtygtygttgygtttatttgttttygtagttggattgtggagtygygttyggaggagygttggatayggatatttttaatttttttttygatttygttttttggttttttgtatatatattttygttaggaggggaggggaaggtttagtaattgtttggtttggttttgatttatyggttttttygtagaatttttyggtygygaatygyggtygggagtttgtggggattgagggtagaagttgtygygttttagtyggggtygygaatattagtttggtygttgtygttttttygt

SEQ ID NO: 6968 - DNA, 990 bp, Artificial Sequence; identical to SEQ ID NO: 6738
  Description of Artificial Sequence: Synthetic polynucleotide

SEQ ID NO: 6969 - DNA, 829 bp, Artificial Sequence
  Description of Artificial Sequence: Synthetic polynucleotide
ygtagygatttygygtaggtgagggtattggggagttygtggtttttttygttygtyggtttttttttattagtygttagttagggttttyggygtyggggaagttttttatagggttttaggttatttaagygyggttaaaygtyggyggttyggtttygtttatttgaygtagtygygygttygtttygatttattaggygygtagggttygttttygaaattygygygggttttygtagtyggtygygyggtttttagtygygaagagagygtygygtayggtggygtygttatagtygtgggtygtygygtttaggtagygttttagttgttygtaaagtttttgtagygtygtttygtyggggtttaygygygtyggttagagtagygtttatygttygagttttagattttaggtttygtygtygtttaygtttagtttyggyggtagtygtgggaagtagtgttttagaggyggttatagygtygttggttgtyggygygygtygyggaatttygyggtygagagtyggtyggtttagttgggyggggatayggyggtttygggtttgtgttttagttttagtygggttttttygygtygttgyggttgttgygyggtgyggtygtgataagttatagtaaatttgtttttygygtygttttaagttattaggaagygtaatyggtgtttttggggatyggygaagaggttttttyggagyggygtttagttttttaggttgtygggttgttygttttttatggtygtyggyggtagyggttttagggtttggygggygygggtttgatttygtygtatygt

SEQ ID NO: 6970 - DNA, 4119 bp, Artificial Sequence
  Description of Artificial Sequence: Synthetic polynucleotide
ygggaaaggtggtagtygaagatttygyggttttttttygtttaggtatttygtttygtttttagtttyggttttgtttttygygttttgttggtygggtattygggygtttaggagttttttttyggggtggygygyggygatygtyggygggtttggtagtagygttagtygyggggyggttygggtaattygttygtttgtyggttygtttaygtgygtagagaggagygaagygygagtagtygtttygttygygtttgttgtyggtgggtgttttatttaaggggtyggygggggtygtaattygagttttatygtagggattygtatttgtataattyggttttttttygttttttyggatttagggttygagatgygagtyggattttttttygaggygtygttttgtttatggttagygygggggtygygggattygttagagygtaggyggagtgggttggygtaygtggtaagaaygtagttatttttttttgtttttttttttttttttttttttttgagaaataggattttgtatatttttgttggggtggggtatttattagggtgttaattttgttgygatttttttttatgttttttttatttttaattggaaaaaagygtatagygygagygagaaatttttttaaatgtgttttgggtgatttaagttagagagatggtyggtygttggatatyggttgttttggagggagggggagaagtagygttttagtggaagagtagagggagagatygttttyggtagttttagggttttgatygyggtgygttgggttyggygagagttggygtayggttgtagyggtygaggtaggtgagyggttgaagattygtttgtagygtygygttttttttayggygtggygtygtggttttygttygtttyggtttatattaagttagggtygtttygggttyggggtgaaaaagggataggataggtttgygaggttgattttgygygttatttttggttttygyggttttggagygggaaagggttttggggtagttygtaatttgtataaaygattatgaatgagttatgtaggyggyggtgygttggatttgggtattygggattagttttttgtggggtttyggataggttyggttatttattgygggttggggygtattgggaggtagaagttttgygtttagtaagttagaatttgttgttatttggattttggaaaagtttttaaaaattgttttgggaaygaaatagaagggtttttatyggggtttygtaaagtaaaaygagtgggttgggggatggggatggygttttgaaagtgattagagatgttttyggtygttattgaggatygygttgggtttatygaggtgttttttggggagggagagaaaatatttattttagtaygtgtattttggttygggtgygggtagggygyggttttggattttgggttatgggggttagggggattttgtggttgtagggatyggtagtgaaggttaggttagtgtttttatagaattttttgtttagygagttyggagttygttttgtygtygggatattgttggtaaygayggygygyggaygtagttaatagggaggtgtgtagtgtaaggtgtgtgagygggtgtgtgaagagggtagygggggygggagtgtgtagyggaagtggagygagtgtgagtgtgtgtgtatgtgtgtttggaggggtagggtgagtgtttaagtttttatttggaygtttttaygtagtygatygtttagaygygtygggaagggygttygtttygygtagtagttgaaggggggyggggagygygygggtagaggaaggagggtgttttyggttgaggatttttttygaagttttttatagtaattttgttttttttagggtttatttttttagttttaaggtgtttaaaatatttaaataaataaataatttaaatttgtttygttttygtttttgtataaatagaatagattttttaaaaaagtaataygtatttatttttattattagttatttttttttattaagtaatttagaaaaaagtagttagttttygtgaatgtatgtagtttttttttttttygttgtttttttttgtttgyggttttgagttgttaagaaagtgagtaggggtttgattgtagtgtttyggtttygttyggttttttttygaagtttaatttttyggaatggtttttaaataagggttagggaggyggagtygtyggtatyggattttygttttttttggaaagttttagagaatyggaattttttttygtttygggaggttgagtygtagtttggagtagttygtttttttgttgtggttgtgattgggtttatggygygttttttttttygygatttttgygtttyggatttaggttgtagttagggtygygygttygggattttagygattttygtygtttgygagttggaagtygygagttyggyggagttygygyggtygagttygtgtatgtaaattagttatgtgayggtaaaagtygtttggtttagttttgttttttagtttatatatgggtagygaygttaygggtattgaagatttgtttataaatatttagagtaatatttttygtttaattgagygaggagtaattgattaatagttyggygaggggatttattgattgttataataatattatattagtaatttttggttttttagtagtyggaatatagataggagagagttagtggtaaatagatattttttttattttttaaaaaatagtaatttgtttgttatttttatttttgttgattttttttttttggtgtgtgtggtggttgtttttaagtgtggagggtaaaaggagatattattttaggtttagtttaatttttttttaaaayggtttttttgatattttaggtagygagggagttgggtttttaggttgtgygaggagtaaatgatgatygttaaggtygtagataaaattttagtaatttttagtggttttgtgtattagttgtttgataatatttattyggtggaggatttygtygttaygtyggtgattattttttttaatgtygaattgggaggtttttttgattagatgaayggagtggtyggaggtaagtygygtgttttygtaggttyggatttgygyggttyggaggtggtggatggggtgtagtgggtgtgygggaatygtaggagaggattggggttttaggtggayggtgttgattgtattggttttgaagattggaagtgggtgtaggaggaatttgygatagttgagattagggygygygggtagatgygttaggtygttagtaaatyggygtgygtgygtttyggygygtttagtttygggygagygtagggatgggggtggaagaggygttttttygggtttygaggtttgygtaggttttttggtyggtagtatttygattttttttttttyggggtaggggtaaagtgayggtaaagttyggggttttyggggagagttgygygtttggagagtygagyggyggagaagygttaggggaaagygtyggtagtttttttttgggtagagtygatttygggaaaatttyggagygttttttttttgyggtttggaggygygtttttatttgttygtygttygygaagttgagggggttagtaaggygggggtttyggtyggyggaggtagygagtgggtggtggaggagggygygtaayggygggaagtagttttyggattgtygagggaggttygygggggtatyggygaygtyggtttttttggygatgttgtggaaagtygtttttygyggttttygygtttttttygaggtygggttattggttttgggttgaggyggggaygygyggttgtygggaaaggyggagaagattgggagggtayggaaatttayggatttttttttttatattttttattygttttagtagttttyggttgaagygtagygggagagggagggagaaaaaggtataaggygtyggggatggggagtagtygggaaattatttatttttttttygggtttttttttyggtttggtattattaygg

SEQ ID NO: 6971 - DNA, 1575 bp, Artificial Sequence
  Description of Artificial Sequence: Synthetic polynucleotide
yggtttgggtttttgggygygtttgtygttgygygggygyggggyggttgttatattattttggtygggtttygaaagggaggagtggagtttgttygttttygygagttttygygygtttagtttttttttatttgttyggygtgtttagggygtttttagygttggaagtygggggygtttgttygaggygggagtygttgggttatgtttttgtttattaggtttttygaatttttggtagggtagygtttgttygtgttttygatttttttygtaggtaattygygygaatttggggttygtagagagygagygttygyggatatyggttgaatagtttggaggttgygygagggggygtygyggggagggataaaagttagtaataaagagtatagatttygtttagtagttgattgattygttttaaaatagtygtttttatttgttgtttttygygtttygtttttaggygtagtattygggtttgtagttyggtygttygaaagtgggygagtaggttgagtgttagygagtagagggttagygttagtagttygtaygattttggattyggtagtygtgygtygygtttygttygygtygttattagagttatygtttygggygygtttaattttttagggtygygggtatyggtggttgtygttttgtgggtgygtttygttattattttttygygttttgagaattaataaataaataaatagaataaataaaggygatagtygttgttaaaaggttttatttaaattgyggggtagggggaaagggtttgtatygttggaaaaygttttttttygttgttttyggtaaagaggayggaaaaattagtagtaggagaggaagtgtygaaaaagtataattagyggtaattggggtatatttaggtgagaaaaaagttatttygaagaaygttttaagtttaggaaagttaggggaatttgatyggtttttttttttttygtttagtttttttttttaagtgtttgtagagtagttggtgtygygttgttagtttttttgggygtttygtgtttttygggttagttagttttagttttygggygaaggggygtatayggagggttttatgggtagaggtgggtygtggyggttggygaggagygtaggggtygatttyggygtttttgtaatttgatatattttttgyggyggtayggatyggatgagtaattygtgttattttttaaattaatttttttttttttttttttttttttttttttttttygttattttttttttatttttygyggggtygayggtttggatttgtttatttatgtaaattygtttagggtggggggygtggtgagtaggttyggyggttttagttygtyggttygggagtttttttgtygygtttttygttttttttgaagtgatatttggggttatttataggtaggaagggggtgtggagtggagttggygttgtattttttttttttttttyggatttatatygagggttygtttggttttttayggaggyggtgaggygggtattattttttatggaygygt

SEQ ID NO: 6972 - DNA, 2401 bp, Artificial Sequence; identical to SEQ ID NO: 6748
  Description of Artificial Sequence: Synthetic polynucleotide

SEQ ID NO: 6973 - DNA, 1579 bp, Artificial Sequence
  Description of Artificial Sequence: Synthetic polynucleotide
yggttyggtgtaygtyggtgttattttygyggttaagtttggggttgatattatgtagtatayggygttatttataatgtatyggtttttttttgttatatataggtaygtatatttattttygygttyggagggagtttagggttyggttygtgggygtttaggygtygattttttygatttygtatttatttagaagttgtatyggtygygatttygttttggygttttygggggtttggggttyggtyggyggyggtygyggygagygatttygggtaggatttagttagygtygaataaaggttgygygtaggtagygggygtygtttgtattttygtttygygtttyggyggyggyggyggygygggggttygggygggttyggygttygttygtttygygttgttygtttygagggygtttyggttttygygttttygttygttgttgttygttatygtygtygtygttyggttatygtatygtatatattaattatttatygttygtttttagtttttygggygaagttaattataggyggaggtttygttaatggggtygtygtygtygtygtygaggaggtagttagtygygygttygggygtaagygatagttttttagggayggggatgggtygggggygygyggggggygggggygtayggggygygtyggagaaattttttayggttygygttttgygtygygttygyggattttgygggygtgattatttattttgygtgtgttygygtggggttgggggtttygggggaggttaggttagtygyggtggggggaggggagggaggaggaggaggagygygggaggaagatgaaaggygagtagatttgttttggygtttttagggagtttyggttygygygygtttttttygtttygygagtttygtygttygtatttygttttttagttygtygttygtatttattygygygygtagatygttagtttagttatttygttgygagggagygygagygagtatgaatyggaggtagtttatattttaaatttgtaygtaggggtggtgttggtgtaygtygttgtygagygaaygtaygattygaygagtagtattttagttttygggygggggyggygaygaggtttttttttttttttygtttaggtaattaattggaagtaatatttgtgygagtggggttttyggagygttgtygttygaggaggtygtygggaaggygttggyggtggatgatttygggtgtttttygttttttagygaatttttttaagtgggtatgttaatgagggtttayggyggggagggggtggaggagggagttgaattggagggggtttyggtyggggggaggggaggggaggggaggggagggyggggttaggtatttagattaaatttyggtttaaaggattttyggaaygggttayggggtggagaaggtaggyggttyggtattttatttttttgattttgggtgttttggtattttygggatttttygagygaggggtttaggatagggtgaataygygtaygtaygttttygtttttygatttygg

SEQ ID NO: 6974 - DNA, 919 bp, Artificial Sequence
  Description of Artificial Sequence: Synthetic polynucleotide
yggtttatttatttygygygtttttatataygttttttttygattttttaygagtataygttygtttygygtgttygtttttttttgtttttygtttygattttaygtttttttttttttttggatttygttttttggagygygttygtttttttttgttaygtttttttttttttatttttttttttttttgttygttgttttttygtgygygtttttttttttgtatatygttttatttttgtygtaggttygatttttgaaygtttttttttttttggtttttttttttggygygygttttttttygtaygattttttttttttgtygggygtttygygtttgtaygtttttttttttttgtygygttttttttattttgyggygggtttttatttttgtaygttttttttattttgtygygttttttttattttgtygygttttttttattttgtygtttgtttttatttttgtaygtttttttttttttgttgygygtttttttttygttgtttatygygtgttttttgtttatttattygygygtttttttygttttgyggygtttatattggtttttgaggygygagttttygttgtttggtaaygggaygtygtttttgggtggygagtaggygygtgtgtaggggtgagygtatyggaaaggttygaattgtttttgggatttgtttttttagtttygttgggttyggygggtagaggyggttttgatygttgggttttgggygtygagtaggatttatttgaggyggagagaggtygtttygygtttggggttttygaaagyggttagttgtttttttgttttttttgagyggggagygttgygttttttgygggttgygggagatttttttagattttygggtgggaaaattatattgagygtttygg

SEQ ID NO: 6975 - DNA, 944 bp, Artificial Sequence
  Description of Artificial Sequence: Synthetic polynucleotide
ygttgggygaggttagggttgyggtaggggagtygagtygggagaggggygtaagatttggygttgggygggaygttygggtagggtgygggaggggttgagggtygtttttattgttttttygttttggagttggggttaggyggtyggagattggttggggygtayggygaggttygggttggagtttygaggtgggaggygttaggattagtyggggygttygtagygtaggttgttatttatttgggygatttttgyggyggyggyggyggyggttgggtagagttagggtygggggygtaygtyggaatatttgggtygtygggtatygagygtyggggggttgygyggygygtatttggagagggygtagttatgygggyggyggyggygggggggggygtgyggayggtygygttggygttgttgttgggggygttgtattgggygtyggygygttgygaggagtaygattattatggttggtaggtygagtygttgtayggtygtttttattttaagtygtygtagtgttttgatatttttgtygatttgtygttttgttatayggtgggttataagygtatgyggttgtttaatttgttggagtaygagagtttggtygaagtgaagtagtaggygagtagttggttgtygttgttggttaagygttgttattyggataygtaggtttttttgtgttygttttttgygttygtttgtttygatyggtttatttattygtgtygttygttgtgygaggtygtgygygtyggttgygygtygtttatggaggtttayggttttttttggtttgagatgttgtattgttataagttttttttggataaygatttttgtatygtygtgtagttygggtatttgttygttatygygtttttaggtagygtygtygtygtygttttygygygtttygaygg

SEQ ID NO: 6976 - DNA, 1096 bp, Artificial Sequence
  Description of Artificial Sequence: Synthetic polynucleotide
ygagtattaggaaagygaagttatataaygyggttttttttagtttyggygyggtagtttggaggggatgttttttttgtaaagygagttttttaattttttygggttttggyggagtttygggatygygtaggggtaagtggagtgtyggggaaggggygttggggttggggtgtyggggtaggggtgttttgttygtaygtatttaygatagtgagtagtatgttgtttagtagtagygttaggaataygatgaataggatgagttttygygagyggyggtttttttgtagttagyggattagygttagttygtttagggttatggtttyggggtttygttgygggygyggtgygyggtgaggatttaaggyggtygtggattttttattttttygttttttaggtygyggaagggygggttagggagtygygygtatyggtattyggggatattttygggygttttagtttyggtttatttgtttygagygygtttttaygagagttygygttttttggaaagagygttygygagygtygtyggggatttaatttggagatttaatttagaatttttaggaygttgttttgattttygtygtttttaattgtgttattttttaaattgtaygttyggtttygtgtattttgygttttgygttttgygtttyggttgtttyggggttttygtagtttygttygygtagttttgggggtttttttgtttttttgtttttttygggttygttttttttyggtatygygttttgygagtagggaatyggggtygtgttatttyggggtygtttgygatgtttgttygggtttttygtgttygygttaaygttygtatygtagtgggtttygttagttygggyggtttygggtygtagttttygttttagygtttygtygtygtygtttagtttatttygttyggttttgaygttayggtyggagggagygggggyggggggttggggygtttyggttttygttygttygygtygtygttgygtaggaggggttgtygtttttttgttttygtttyggtygyggtygygtttttttttyggatttagygygtggtyga

SEQ ID NO: 6977 - DNA, 4048 bp, Artificial Sequence
  Description of Artificial Sequence: Synthetic polynucleotide
ygtaygtttagatgggtttttygygttygggtygtagttatttgagttttygtgaggttgaggttgtgtgttagttgttttttttyggygtttattaygtagtgattttttttaaaggygtgttttagttttagaagttgggayggggagaaggyggttyggattygtttgggttttygggttagygygttgtgtaaaaggaaattttyggggttagtgtygttttttgyggggagtatagtagaaattttattagggggggttgttttgatyggagtygygtatttttttygagtygggttggttyggtatygtgtttagggttttygtatagtygygtygttygatttgygggggtyggtggtttttttaagggtttaygaagggaaygtttgtttagttgttyggttyggaaygtygggtttttatyggtgyggtatttaattagtygttgtygtagaggagttagtttttaggtttttgatttyggtyggtttygtagtygttttggygtygygggtttygttattttttygtygggygttggaggtaggggagggagtygtagagtttggttaggggattggygtttataattygaagaaattatttttttttttttttaatttttyggggaattttgatttayggtggaaaggyggygggttgttttttagagtttttatggagatttatttttaaattatttgttttattgttttttyggaaaagtatagaggyggggygagtygttgaagttygatygggatagaaatttggtyggygggtgtgtttggttatagtygttgttgtttttygygaattgggtttyggggttttyggttttygagaattagaagagaaaygygagygaagggatygaaattyggggggttatygatttgtagatatygttaggatagtttgtaaygtaggaagattttagyggtttygggtttggtgaggggattataagtatgattgatagygaatgaggaagggtagttttaaattttttaagtaaagttttagagttttgggtttatttattagtataggaaatygatttatygaaaatttaaataaagaaaaataagtygatagtttaggtaggatgtaggtaaatttagttygggattaagggtaaaaggttttttgggtttttttttttttggtttgattttttaaaatatggggaggggggtgatatttattygattttaggtttyggtaggaaygtaatgggttaatgaatggataagtygyggagtattgatyggttgtygtyggaggtaggttttttattgattttaattygtaaattaattatttttttttttgaagttttaatttttttttttttatttygtatttagagaaaaataaataaataaaaaatatygtaagaaatgaaaatataygaatagatatttttttttaagatagttttttgattaggttttttttttttttttttaaagaaagaaagaaaaataaaaattagatygaatttgttttttygttgtggttgttyggygttttaattaagtaggtygyggygagagygttaagttttggagtttttttttygtaygggttttygtttttttttaggttttygaaaagtaggaaagaaaaaataaattttatatttttttttyggggygygaggattttttygtttttagaagagggtggaagattaagaagtygygggtttggattgaaggggygtaaagtgggtggtgaatagggtygaaygtagtygaaagtaagtttggyggtygagttttgttygygtttttyggagttaggayggttgggggtattgtygagggtattaggagtttggggatttygygggttttgggtttygyggygtygggtaygtatagtttagtttgttttgattygagygtattgggggataattttttygttygtatttttttttaaagggttaagyggttygtaggttattattttaaattagtygtagtttyggagattggggatygatattaygttyggtttygygtygtttagttttttaatagggygygttggttygygagtyggaggaattttygtttaggttttgttaagygtttattyggagtaggtygggggtagtgaaggatgyggygggagyggygygttgtagtttygygaygtggtaygtattttggaagygatgatttagatatyggtagyggtggatgagttaggggtagaaggtggayggatttygttgttgygaggygaatagggggtgtggygagtgygaggagggtagggggtgggyggttagggygtgyggyggyggtatygggtgtattggtayggyggggttgggygggtgygagatygtttyggygaatattaagttygggttggagtagaygtttttatyggyggyggyggyggyggtygagtggaagtygttgaggaayggatttatggggttggagttagygtagttgagtgtygygggayggatggggttttyggagygygaggygggtaggggattgtttttggttattagygattygatggtgaagtagygtttgggygtyggttggaatatgttgygtygaggagygggygttttgggtttttagtttttggygatygtygtaygttgttttygtygttygttgttygyggygaggayggaygagaattggggattygtttgtttggggtgggggtgggggtggggggaaggaaaggaagaaagaaaggaaaggaaaggaaaaaggaaaggaggggggagggagagggagaggtaaagtygaggatttygagaattttgtattaaaygygtttaatttgaagagaggggggaaaatttttttagaagaatttgtaggygtggattggggtaatttttttttttttttttttttttttttttttttttttttttttttttttttttggygagatggygtggggggatyggagttagaggtagggaggagaaggggggaaagttttygggggaggtaaaaaaaaaaaaaagtttttttttttttgtaaaaggygggtagggygttttaagtttaaggataatttatggaagtgttygtttttttataagttgtgtaaaygatttgttagtttatgagtttaattagtgyggggattatataaatagtttttttygaagtttggtaaatggtttgatgattggtygttattattygttttgaggtggaaggggggagattttttaaagtgygttagagggaggtgagygtttgggaattyggaggtttggattygggtygagagtggaayggagtyggygtygtygtttyggttgagttttttgtygtttatygggyggtygggttttttygygttttygtttttygtttttagtttattygtttttgyggygttygttgyggtttttttttttttttygtttttttttttttttttagttttttttttttttttttttttttttttttttttttttttttttttttttttttttttttttttatttatttttttttagttatygtttttttttttattagtattatttttttyggggtatttyggtttttgtagagtttttggtyggygtygttttygttgyggttttttgaatttygagtttgtttygtttaagttggtaggatagaaggatagatagatttttttagtttagygtttygtygttgttgttttaygyggtttygygtygggagaattgggatygttttaagagtatygygagggtaagygggtaggggttggttttygggttaaaggygtygttyggttatattaatttttatatttagtaaaatttttagyggttttttaggttaggagggattttggagtgaggggtayggggtttttttattttattaattaygtttagtttygaggttttagggtyggtgygttygygatttttgattyggttygttygtttgygagttgagatygggagttgtygatttygtyggagtagtgggtttttaattttttttttttttygttttayggtttttagygt

SEQ ID NO: 6978 - DNA, 3292 bp, Artificial Sequence
  Description of Artificial Sequence: Synthetic polynucleotide
ygygtttaagttttagtttttgaaggtygttggatttttyggygttttyggttyggtttagtttttttyggggttyggataaggaggtygggygtttttttttttatttttttggggttttagatyggtygtagtagyggtayggaagagattatygggtgygagtagtagayggggtgygggaaggtgagtagyggttggttgattggtatyggggttttygyggttgtagtygtygygttttyggtygtygagttttygtggtagaggatgggtattygtaygatgygttgygtygyggtatggtttaggttggtygtttttagtttygtygttagttgtygtttttatttgttgyggyggttttggaattagattttgatttgygtttyggtgaggtgtagggaygyggttaggtyggttygtttygagttgtttagatagygttttatgtygaaggtggattygagttggaagatttggttgygygagaagattgtgygygttttttttttgyggtaygtyggttttttttttggatttttagygttttttttttagttttttgygttyggagtggtygtygtygtttttaygttygtttyggtygygtttggygtygtttygtttttttttttgtttttttyggagtygtttttttttagaatgatttygttygggtttttggagtttagttttttgtgatyggggtyggttttgagtagtggtttyggagagtygyggtttgtgtyggaggygggggaggagttttttagtaaggtttttttygaggttggggagatagatagayggaygtatatatatgtatatygatatagttttgagygaggttyggygtttggggayggtaggtttaattygygtyggtttttaggttttaggttatgaggttttattattttygygggttgtttttttttyggttgggttagagaagggaygtygagttttgggattttttttttttygaggataggtaagtagatggtggtagygyggttatttttttttatttttttagttttttygttaggggtyggtagaayggttttttttyggtttaggygtattggaattattttttttttttaggtygtgttttaagtttyggtygttygaagtttttttatttaygttygaggttatttttttygggaagtatygtgttyggggttttaattttatttttttttttattaagtgggattggattaaygggtagygtaatttagygygagggtaggttaggggtygaaaaaaattgatygagtagagggtttgygggtgttggggttttagaattgyggagggaagtagygyggggyggggayggggygggygygtagggggataaygaaagtttaaagagaggtyggtatttttaggtygygggaggtggtygtyggygggggttagggtgtaggggtattattaggttggggagygttttaggtagtgygygggtagggtaaatttttgygtygggattttaaagygagggaaagttaggtygtttatttgygagagygygaagttygyggygttttttagggtttttttggtygttgyggtagyggtagyggyggyggyggyggtagtygaggttggygygaagagygttygtgggggyggttgaggtttagggggyggtyggtggtggttttygttgagtaggtttttgatggagaayggggattttttgggagygggtggggggggyggyggyggttggggttgtgygttggyggtgtyggtagygttyggttygggtttyggtatggttttttttttttygggttttygggagggagggagygggataggygggyggyggggygagtaggygagaggtyggaaattagattataaayggaatttaattayggggygtaaagtygggggtygtttygggygtaaatttaayggygggagggyggagtgaggatttagaygggygggttygtatgagggaggggtgyggaggggyggggagyggttttgtygyggtatygagggatygaggyggttyggttgyggttgyggttttygyggaggaggtagtaagagtagttttyggttygaggttgygttaattyggygtyggatgttaatgatgaaattaaaatgttatttaagttaaatgyggggagtatayggygattgggygygtataatggtaaatgggattaggtaggygaaggtttagtygagtttyggtttygtagtygttttygttatygtttttttttygttttttttyggattttggygttttggtttygggttataagagttygttygttattggttttatatagtttaattaggtagtaaatgaggataagtttattagtataaaaggatattggttttygttaaagaggtattyggagygtttttgygagygtaggaggygagygagggaygyggagtaggyggygtttttggtygaagygtattaayggtygygagttyggagatygygtttgttttttttttttgyggygtagggattygtttttygtygttaggtttgygggaggggggaggggyggattaggttttttygggttatttyggggttatttgygttygtagttgtygttttttygttttttggggttggataggggttygtygtttttaygtagttggagagttaygtagygtyggtttaagaggtaggaygtgatttyggttttyggagaatttattatttttttattttttggggttyggygatttyggtattttttttaaagtttgttaggaagggygaggttaagaagagagggatttgggttttttatttattatttagtygatagtaagggaatttaggtgtaagttttygtattgygttttyggatttagaaattygygtggttttggtttttagttttggaaaatygaagagtgagttttttttygggattaggagtgggtgtgtttgtgtgygtatgygygttgattyggttaaaattygygygttattyggtggggttgttggggtaatagtttttyggtatygayggttgttttyggaagggtatttttttgttttggtygtyggtgtttaaggttygyggattaatttygagtttgtgatttygaygatagtatttttttttaggaagttttttyggttagttggygtttggagttgtttaattaaygttttaatgggggtaaggtgaatygaaggygtagyggygtagtttttttygtygyggtaagtagyggtattygttgygygtttygayggtagyga

SEQ ID NO: 6979 - DNA, 3753 bp, Artificial Sequence
  Description of Artificial Sequence: Synthetic polynucleotide
ygyggttattttttyggtgtagygtttttttagtttttgygyggtygtaggtgttagggygaggaagttygtgggygttttygtygygygttaaggttttatttagagtaagyggtygygtgttagtyggtgatttagttataygttgaattaatgtaaattattaataataaaagagtgtagggaagygtttttgttttttttattttttttgtttggtttygggtttyggattttttttgagtygtagaattgttttatygygtttagtttttttttygygygagatatataattttgttatyggtygggtagttgggygtagygataagttggtygygttaagttygyggygagtaaagtggaggttttattaggtataagtagygttatygtttgttttatatttttggagaggaagtgygyggtatagggtatgttatagygggagttgttgtggttaagtttaaggygagtttagtgtygggaatatgtygttgggtatttagttygtttgtttttagaaggtaatygtttaaatggygaggtttgttttttagtttttgttttttttygygyggatttttgagttggattttagtyggggtgygttttagttygygygaygattttgggygttaggagggagagtgggygggtagttttagttaygtgtagtttgggyggygttaaggtttygatttttaatttttgatttyggttttattttttaygtggagygagttaaatttttatagatagaygtatgtaagtttttttatygaaaaatttgaaaatttttygtgygttattatgtygggtaattaagtttattaaagttagtaaagatgtttaaaatgttttatttttttttttttttaaaaatatttatagatttgaattttttttttttygtttttattattttygggatgagggaaaygaaaagaagtaatttagtaattgtttaaagtttttgagggtttggtttggtygagygtgtatgtatgtatatatatataggtgtatatatgggggaggagtgtatttggttttgtaggtgtttttttgatttttttttttattaattatagtttgtttggttaaaatttttttttttattattattygagaatattttatttygaatggtttttaaagygtattggttyggtttaggtaggaagtaggttttttgatttagggaatgttaataaatattygaaataattaaaataaaaagtagggtagagattataaataagagttaatgaatatatatggtgtatttttttatatttttggaaataygtygttttgtttyggagttttgtttatagtatagtaygygttyggttttgygggtagttgggggyggygyggggyggygggtyggttagtagtygagtttgttgtataggttgtagagaggtaaggtygagaggttgtttttygggtagtagagyggygygggaaaggygagygagygyggtatyggtaygygtagtagygaattgtttyggaatattagyggtatgtttattagagtttgygtygaygygtgygttatgttggtygtttttagtttagtygagagttgtygtttttatttgttgyggyggttttggaattaagtttttatttgggttttygtgagttgtaggttggaggygaggtaggygygtttygagttgtttaggtagygttttatgtygaaggtggattygagttggtatatttggttgygygaaaagayggtgygygttttttttttggtygygtyggtttgtygtttagygtygtygtttygyggtygttyggatttyggygagggygagttygygggtaggagttttttttttttttttttaaagttygagtgygaaggagagaggaaaggygtgygttttaagtygttygggttygagttttygttgtttttgggggtatttgaggagygagaatagatagaaaggttatggagttggttggggagtttyggagatygttagttttttttgggattaagyggttggtaagygtttgtagttttggttttattttattaattttttttttttattttttttattggttttttaaatttagtatttygttttttaaaagygataagagagggatttagttatttggagtatggggtttttgtgtttttatttttatgaatgggttaggggtaatagggagaggaggtttggagggggaaatattagtatggttttaaaaggygaatttgtttggtggtaattgagttggaagagtttttygagttttatagggtggtattattttataggtygtttgtttggaaattaygttaaggattaaygtaggattttttttygttaaatgttgtaaagaggaatygtttttgaaatgtattattgttaattattttggagtgttaattattttaaggaggagagagagagaaaggtagagatayggagygagtgaggaagaagatttagaaagagattayggtggagatagattgtttagattygatttgtagatttttatttygtgttyggaaagaaagtattagatgtgtagtgattgaggatagtygggtgtaaggtyggtygygtgtttttttygttgtggtttatttttttaataatttaattttttttaggaagtttaagtyggtaygggtttgtgttygtttgtttttaggggtttatygggyggaggaggtattatagtgygygttttttttttygyggtttygaattttyggttgtygtagttttggttagagggggttyggygygggagttttggyggggygtttagttttttttttttygygttygttygttgttatattggygaygtgygatttttatttaggtaaggaaaagggatggggggatggtgtttggggttttgttttttagggtygtgttggtttgggtagaagtaggygggygttttttagtygtygttyggttttttttttttygaggatayggataggttgygttttttggttggttagtygaygggttttygyggtgttttygaggggttttygtttaggatggattggatggtgaagttggagaygttatyggtygtyggatattttttgttygtattttttttgttgtttattttgggtttataagaaatygaaggaaattaagaattttttttagagaygatttgggtgatttgggtggaaggtggtgtagtaggtaggtagtggggaggggyggggaggaaatttagggggagggggygtygaggttggtgaggygtttttttygygttagggatatgtaggtatyggatggttgygtaggggtttttgttygtttggttttgggtgygttygtttagtttyggtgtaaatgtttttttttygttygttaattygtygggttttyggyggygyggaggyggygyggttttatttgtatagaggttattygaaygyggttaatygtagygtygtygagyggtttyggaaaattttaaaaygtttyggttaggtatatagtatyggtgygtttttagagygygtygagggtttggygggtattagyggygtttaattaggggtagttagggttgaaagtagttgtagattttagttygggtttttggyggttgyggtaatttygattttttggattttttggatttttttttttagaggtaggggyggtgygggattyggagttggagtggttygaygttttygtaggygaygggttttygygt

SEQ ID NO: 6980 - DNA, 829 bp, Artificial Sequence; identical to SEQ ID NO: 6969
  Description of Artificial Sequence: Synthetic polynucleotide

SEQ ID NO: 6981 - DNA, 1328 bp, Artificial Sequence
  Description of Artificial Sequence: Synthetic polynucleotide
ygggygagagatgtttttttgggygtttagggtygggyggggtygygygtygggttgtgggtygyggtggagatttgattygtatttygagggtttttagagagtyggggagygagtagtagagttatygtttttagttttagtttgaaaagttggatygtgtygtygtatgtgygtttggtagtygggygtttygggttttgyggttatattattttggggyggggaygtgtgygtttygggygttyggaygttattgagttaygtttgagtygtttattttygggggtgagygagtygyggttyggggygggattttggyggggggattygagyggtttttaggattygygggaygtygttaattggygggggtgygggggagataataatttgtttygyggtaataagaayggtgattgttggtygtggatttattttataggtttgtttttttttattaaygttttttttagttttygggttaattyggatagtttgtttatttattgtaayggttaaggttggtttgtgttagaayggygygygygygygtaygtaygtatatatayggggggaaatttttttaaaaatgaaaggttagaagagtttagyggyggygygggygttgygygagggtttyggagttgattygtygaggtaggaaattttttyggtygygaygttyggtttyggttyggygttygygtgggatggtgtagygttygtygtygggttygagagttgttgtattgaaggtyggygaygatggtagygygttygttgttygtgtttttygttygygtttttttgttygttttggtyggtgttttgttygygttttgygaggttygaggtaagtygtygaattagggyggttygttgttygtttygtygagggtatygtaygttgygtttgggygygtygaggtttagggttgtttygaggggygaygygtttyggygtattttyggagtttyggggtttgygtttttagygyggygagatygattttttttttttaggtgttaattttttggggaagggygatatttggttygtagttttataggagttagtatttgtttyggagggtatagtttygggatygttttttygtttttatttttttgggtgatatttgtagatgtttttgtattttgatatttataygtgttattygggaygatgygtgtygggtttttttgttggttttatttygtagtgaatatttttattttaggtttygggttagttttttattaggttttttttttagtttygtttttttygttaatatatttaggggggygygtagyggtttygt

SEQ ID NO: 6982 - DNA, 2957 bp, Artificial Sequence
  Description of Artificial Sequence: Synthetic polynucleotide
ygagtygttttyggttttgygtttttttttagggtattaaggtttttaaygttaataygtggggttgttattaggggaaatyggaggtttgagtttagtatttttggattygtattyggttagtttttagtttttttttaaatttyggttttttttyggttgtagaggaggtgattgaggyggaagtyggyggtygyggtttggtggttaggggygaagttaggggaggggttaagggtttggggagygtgggtggygattgtyggtggtygtttttygaaagaaaagtygttygttaggttttyggggaaggtgttaaggtygttagttagagygtttatagtagaagygaaatyggagaagtaggtggyggtttygggtgyggatggagagggygaggtttgtaggtttaggtaagtygygttygggggttttagygttggygtttyggttttttttaygtttttggttttygagygtayggtygygttggttttagttttttttttttttttttttyggaagttttygttgttaaatattttttygtagttggggtttagggtttagtaattgtttttatttgtagaagaagaaatagtttagtttagaaggttygagttttgaygggtygtggtgtgagttagygaggaggttagttttagaaagattttttgttggtttttatagagggtttgagttttygtttttattttatttttgaygggtattttgtattygatgggtttttatagtaggattgggaagaaagtgataatttagaaaggaggaggaagggagttttgggaaaggtygagtttygttaaggtgaaggaaggtttgygagatgttaatggtgggatttygttagtygttttgttaaggatagygtagattaygttaggtttttaggtaggttttagagttttttaaaygggtattttatttgttttgtttatttttggggtaggygttgttttttttattttattaggtagggtattgaggtttagggaagttgagttatttttaaggttatttagtttgttggttttttygttttttttttygaaggagygtatagagattgagagtttygggatygtygtattgtaaaygygggtttgtggtgggtttagtygttgtttgagaatttgtttatgtttaagtattttttttttttttttttttttttygggtatttttaatygygtagggagaaattaggttgtttaaggtgtttttattttyggagtgttygyggttyggygggaagatggggagttttggayggagygagtyggygygtygttgttatttgggtygttttygtygyggggtatttttttgaagtagtygttgagygataggttgtggyggatggagttttgttagttygttttgttgygtttgtagaaagggaagttattagttaygtattggtagatttggttgagygttagttttygtagyggygygttttggatggttatggygatgagygtygagtaggagtagggyggtygtattagttttagtagtttttgttggtyggagaggtttagttaggygaggtyggygttygttaggtygttyggggygtygaggagygggtygggagtttygtagttyggggtygygtagggyggygtaggttygggattygaagygtaggatttggggttgagygttggygygtttatttataggagggggttttygtttatygygtttagattttttggtttatagttyggggggtgygyggtggtttgggtttggtygggyggggtygaggaggggtttaggtygtygtagtaggtggttatgtttagtygygttygggtttgggttagyggtgtygtatygaaatttattggygatttatttagtttggtygttagtagygttygggtgygattagttyggtttagtttttygttttttaaatatygtyggggttagagtttatggagagtgayggtggygagttttttttttggtagttttggaggagygaaatttttgttttygttttggtgttagtttttygtttygtttaggtttgataygttttggatyggaygtttttttgatttttttttttttttttgtgygattygtttygagtttatagtygttygyggttttggttgtagggattttaagttygtagtttygtttggttttaygggtttygtagtttygattgttttggatygtattaygattttttaaggtttttagggttgtggtttgggagtttygtttaatgygyggtttttttgttyggttygggatatttygttttaaagaaattygtttygtyggggtttttgggttattygggattyggggttagggatagagggygattatattgygtaagagatygtaatgaagttygtagatttttaggttggagtygtagagygaggtggygaggtggagaaygyggggttgggtttggatagyggttttggggtygtttggagttttygtttttttaattyggaaggtagyggattgatatttgygtygaagtygygygtattttayggagggtygggattttggaaatttygaaygttttagtagtttagggtagttatygttttttttaagtyggggagttyggggtttygttaggttttttygygttgtgatttygggygygtagagyggagagygttaagttttttgttgggtgtyggaggaygygtygaaaatagggaygtttttgtagtgygttygatattagttttttagttttgttgtygttyggggttgttgtagttygggttatttyggttttttaagttgttyggttttyggttttttttgtttttygygttgtggggtggyggaggatggatttaggttgaygttgggttgggtatttggaaagagggttygtttttyggatttygagtygggtatttgtgygaaagaggyga

SEQ ID NO: 6983 - DNA, 1860 bp, Artificial Sequence; identical to SEQ ID NO: 6755
  Description of Artificial Sequence: Synthetic polynucleotide

SEQ ID NO: 6984 - DNA, 1422 bp, Artificial Sequence
  Description of Artificial Sequence: Synthetic polynucleotide
ygyggggagtagaggtgtttagataygyggtttgttttyggtttttattttatagagttttttatttyggtattgagttyggaagttyggttattagttygttattttataatttttttagtttgggagtttttataygggtggtygttttttygtagyggtttagtttttagttgtaggattttygggattttygtatttattatgagygttgtaaagttgyggaagygtgagygtygttggaggaggygtttagggggaggygattaggtggygttttgtttttygttagtttttatggtttttggaaggttaaagttttagayggyggttaggaggtygygttttygggtttttggttttagggtgatygyggyggggygggygtagttygggagttgtttttatttgtgaagatagyggyggttagyggggygggyggagggttttygyggagggtagttygtagtttygatttygttagggagtagtygyggtttttgtygttttttttttttygygggyggtttgggggttgygtttggggttggyggaggyggtgtyggtggggatyggtggggggttyggatygaaygygttagyggtagatgygtttttttttttatatttaaaaattaatttgygttttattttyggtttyggagttaaatttaattatttygggttgtataaagttagaggygygtyggggggtttgtatygggaatyggtatygagtgattygttygttttagttyggtygyggygtttgttttgtttggatgtggttygagtttygggtygggygygyggggygggggttttggattattygtggygtttttygttttagyggagtygaaagttattyggagttgtttttttygyggttagtgttatttyggggygygagtttttttgtygagtygyggtttygygygtttttttygtygtttagattygygygttttttttatttgttgtggtygaagyggttgtyggggyggtygggtygygttttyggagatagaygygttgygtttttttygtyggggattygttttttattygygagggtagyggtygagttgggatygagttattaatagattgyggggttgyggygtyggtyggtgagttatagtttygygtaygagyggtttagttyggttagtagygtygtygtttttgygygtatttttygyggygatagyggggattyggggtyggaggtaggygygtaattatggggatyggggygggygatggyggygggygggtttttgtygtagggtggggatggtttttttagtygggyggtygtygttatattgtagagygtatttaaagagatatttygtttygygttygttttttagtattagattttygttygaaaaygtygtygggyggattgtayga

SEQ ID NO: 6985 - DNA, 1479 bp, Artificial Sequence
  Description of Artificial Sequence: Synthetic polynucleotide
ygaygagtttaygaattttatygtggtyggyggtagtygttggtygagtttagygtttaggtttaggttatttttatgtygtgygattygtygggaaygggtttaggttygtttgtttaaggttagaagtattttgttttyggtttaaygtyggatygygtttygttttttttattttatattaaggaaaggaattagaygtttgggagaaaggatgagtagtattyggtgggattyggttttaattyggggtygtttttaatttttaattttttagagtttttttyggtttygtttttttttttayggtttygaggtygtygyggttttttttygttttgagtgtagatagttygggaagtggagagygtagttyggagttagggagtygtttttaggagttttggygatgggagygtaggtggygggygtggtttttttaattttgttttagtygattyggagtyggttttygtgtagtagttatygttygggttttygtttggttatagtattaggttatagtgygttggtttttgattatttttttggttyggtggtygtttttygtttttttttagttygygtygttgttttgttttaggtttyggtgyggttttaagttttagtttagggtttttaggtttttttaggyggyggtggyggtatttatttgggtygyggagtyggggtttggtayggtttygtaggtggtaaatgaaattttggtagttgtygtgttttagggttttaygggtatagagttyggttagtagttgtagygtttggtgatagagygygtttttggtttygggtatygttttttygtattttyggatygygtygggtaggygggygtaggagatagtttttygtttgttagtttagagtygtygttttygggtygttygygtttatygttagggatttgtygagaaayggtgygagtttgagttygagttttagatttagtyggttyggttttttatyggttgtatgtagtttttygttagtyggtyggttaggttttttttttttttygttyggttttttygtttttttttagatatygaggagaggyggtgtygtatagtttagagygtttttttgtttgygtttygttygttattygyggtygtyggggggyggggttaggttaggagtgygygtygtagggtaggatagyggyggttttagatyggggatttggggtatttttyggtttttggtygagygygagatttggtttgggatttygygtttagagyggtygygttttggtttggggagtgtgagtgagtgygygtttygggygttttygttattttattttttatttttgatgtaaattaagtattygtttttatygtygagtgtgtttaaagtaygtttttggatgtttagtgygaaggttataatttgggtatattygttagatgygtagaatygagtttttgtttygaatttggaaagagtygt

SEQ ID NO: 6986 - DNA, 446 bp, Artificial Sequence
  Description of Artificial Sequence: Synthetic polynucleotide
ygtgygtttygygtattttgtttttygygygaygtygttygygtygttygyggttyggtygggagyggtagttygtgtttyggtttyggtttyggtttyggttggygtttgtatttgygattatygtgagtagttatggygtattttatagtgtagagagtygttttggtttttgggtttgttttggttttgtygttgttgttgtttaaggtttttttgtttygygggaagyggtaggagtygtygtygatatttgaaggtaagagtaggttagttttttttgagtttttyggygtygaagagtayggagaaygttgtttgagggaggggtgattttgagagtttgtagtttttatygaaatatttattaaattgattggagagggygggygagayggygttgaagggttaatgtttayggtttygttgttattagygggtggygg

SEQ ID NO: 6987 - DNA, 2991 bp, Artificial Sequence
  Description of Artificial Sequence: Synthetic polynucleotide
ygtttgtygtttataggygtygttgagggatagttggtttagtttgyggattttttttyggattttatatttatgtttagggaaagtyggagttayggyggtataaattagygtttttattttgattatttgagygagygttygyggttygttygtttgyggtataaaygtataaattttttgtagtattatatattatgttttagagataaatatagttttaggggtttttgttttggtaaagtaatttttatttataggaatagattataaaagtattataaaaagtggttttgaatygggaaaygggttgggggtgggttayggttatatttgttatatttgggatyggagtgtattgggttttaygtttttttaaataatyggtgtatttyggggtagggtttaggtttgygagggttttatttttatgggggagggygygagaaagttgaatttagttttttaaggtttagttttggtttatygaggaatayggagyggttatygtaatgggttttygagaagggtgttgygtggaaaaaatygygttgtgtttttgttttgtggggygggggyggaaattttagttttttygttttttttattttaagagaggtygtttttaaagygttgttgggaggggggtatttaagtttaattttttgggygygagggattttaggggtattatttttygggygggtgggyggttattatttttttagagtatttggtatatygggttggggttygtattygtagggtattgyggggyggygttyggtgattgggtggggtygtygttgttttttttttygttgggggyggtagttttttgtttgygyggaggygatttagaaggtaygttygttagtaggagggygggygtygtagggttttyggtggagatgygttttaygatgttggataggtagtttaggttygatatygtygtatttttttygggtttgggttttgygyggggagggttyggttagtaagtaggggtggggtygygataagttttttattttygggtttagtattttgagatagattggaaattgaggattttagttagagttygggataatttaaaagatagggagttatttgtttagtattttattttttgtattattttttaggatataggygtgtgtgagtgggggtgggagygttttagatagaggttaggatagttttatgaaggaggaggagygagtagggagaggttyggaatatttatygttgggygtttygttgtagtaggygttttygtagtagtttygtygtygggygtygttyggggggtygttgtagtttatttgtaaatagtaagggygattgagttaggttygygggayggttygaggttygaatattaatttttgtagtygttttttttttaattttagtttaaggttttagtttygggtttagatttgttttggttgggggggtaattaygggtgggtaggagatgaggtttgtaatatgtagggttaaattaagggyggatagttattaaggggygtaaatttatattttggaagtagggataagtagagaaaaagatttttaygttygygttgtagtgttttaatagygtttttaatggggtagttygaaygtttgttygtatatttttaaaataggttattttagtgatagttgtttaggataagggggttttttttttygggaaggattttggtttaaatttttygtaaggttagtttttygttttyggaaaygygtttttgatatttygagygtygttttaatttttttattttttggggtttyggttttattatgtygtyggagtagttggagygygggttggaygygtyggagtygtygttgtagtgttygtygtygyggttygggggtagygggttyggygtatagaaggyggttgyggygttagggggygyggygttttggtygygtagtagagtttgtaggttttygatatagyggatggygttgygtaggatttttattttgggtaatygttggtttggattgttygaygtgtagygtttgagtgttttaaaggttttatttattttgtttaggyggygtygttygygtatggtggyggttttgyggyggtyggygttggtggttttgygtttgtaygttttgtaggtttatagtaggtagyggttygtttggtggtgttygttgggygygygtatatgttygtttttaygtgygttyggggtygggtgtatygtygyggggaagtgygagtgtttttygggttttaggagygygtttaygtgtattaggygygggtttaggttttygaagaagygtaggttyggggagtygaaataygggtygttatagaagtygttygttgtggtaaaggagtagagagagtygtygggggtygttaggtttaygtygyggagyggtggygatagtagttttatattttggyggtggygyggtayggttttggtttygtttaatttaagyggtagagagtggtyggaattttttgtygttygggagtttyggttgtagatagtaaagtgttggtagtttgaatgtttatttattgttttttattttttttttttttgttyggtttgatttgtggttaaggaaagyggyggtagygttttagggtttttttatttttagtttttygttaggygttttgggttatttattygtagtagtttaaaygtttyggagtttaggygggtagttgggggagggggagttygaggttaataggaatattgyggggyggggtttgggggggttttyggggtggtygtaggggttygtagattggttagttagttygtttttttatattggygtgygygttaggttttttatygggtagggagggagggagygatyggtagttttaggyggttgtatttggtttttyggtaygttttttttaaatttttttaatattygattgttgtattygygggaaaygttggttgygygygt

SEQ ID NO: 6988 - DNA, 928 bp, Artificial Sequence
  Description of Artificial Sequence: Synthetic polynucleotide
ygagtttygtagtttttttttttygtttygttygttagttttttgttttttttttttatattttttattttaaagttaggygtygggygtttttttttgtygtygttyggtattyggttaatttttttaaaatgygtttttattttgttggttgtttyggtagggagtatggaggattgggggttygaagtttgtaaagggtgattttagygttgtagttttttygaaayggagatttgttatttttttagagggyggggaagtttatattattttttgttttatagtgttygtttygtttygtttgttggtttttygtttattygagatattttaggtayggttygtattggagagggtygygttgttgttgygatygtayggygttyggggtaggaatatgttygtttttttttgygyggggggaaygaaatttttagagtgygtttygataygttttttttattatttaaggtaggtttyggtagttttggttatttaggttyggggagttttagtyggatttgttgyggtttttttygtagygtaggtaaggattttaaattttaaattagggatttygattttttttttttttttttygttttttttttttttgaaagagaaatagatagaaagtttagttttgagataaagaaygygagtgattttttygaaataaatttgaagataaygatataatagtgaatggtaggaygtataaaattttatgggtttaggttaaatggtattagttataggttttagtygtagtygtygygtygygtagttttttgggttatygyggagtttgaaaagaygygtttaaggagattatttaaagtaagattttttygttygattttttgtttttttaggatttatttttttttttaygggyggttagttttygttttttygttttygt

SEQ ID NO: 6989 - DNA, 1267 bp, Artificial Sequence
  Description of Artificial Sequence: Synthetic polynucleotide
ygygggattttagggttttttygtagttttttgttttygtygtatygygttttttygggtttyggtygygttygttagtyggaagygttttttttgygggtgygattttygtagttatttttttttagtttggygggggtyggygagagtggtttttatagtattttataagttygggaattyggggtaygygggttygttttgttgygggtttygattttttgggayggaaagtyggttattagtagtaagagggtgygtttattyggtygygttttttatttttgygtttttgaggtygggttttttgagaaggggtatttaayggggatatttttaagttygtgagtttttatttttattttgttatttygagtagggtaaagagattttaggaatyggtttaygttatygtygttttttagattagygtaaagttyggttttaggtttttttaygtygtygtggtttgtgggtatttttatttttyggatttttttaatygttatagttatgtttatttgttttggtagtgtatatatagaattatataattaaaattaaatttatyggtatygttttygagggttttygtttagtagggggtatygaagttaggtggaagtaaatgagtttggattttgaggygygtttggtttggagtygttaaatttgttagygggyggygggggaggtggttyggtagygtygggtgttgygttygtatatgygttygggaaggtagtttyggtygtttygtttttagttygttttttatygttggygyggyggyggyggygtggggttyggggttyggtttttygttgyggttgygttygtttgggagttygggtaggagygyggggtttggttattgtggtttgttgygttttttattgggggtygatttygttygtttttttygttygtagaattgygaggatttggattgtaggygtygtagtygttattattyggagtatygaagtyggagttttaggatttgyggtygaaaygagagagygggaggygtayggygtttttayggttttaygygttttagttttttygagtygtagtygttaatgttgttttttttattttygtatygyggtgggggttgtygaagttgttatagtttattttygtygagtygaaaagtygtygagttttygygggtgggtattttttttygggggaatttagatygaggyggygttatygagygygtayggattttttyggaaaataattattygggattygt

SEQ ID NO: 6990 - DNA, 1225 bp, Artificial Sequence
  Description of Artificial Sequence: Synthetic polynucleotide
ygtyggtygttttttggtgttttyggggttggtaagygygtagttgaggaaagggtataaaggtggygagttttgygggagtagttgtgtagaatttgtyggattttagggtttggtyggtaggttygttttyggyggttgggttttttttttggagtttagattttttagtygtaggttgtttttygggygggttttagttagggygygtagttttgagygtttgtygttgyggttyggttggtaggtttygaggggygyggggtygygggtyggtyggtagggttttgtgtygttygttttygggtgtgygygaggygyggagtatttaaattgatattatatgtttttttattagttgtttygyggtygagttttaggygtataattatygttagtgggygagagygttagtagtttttagggaagggatataatgattgaggtttaatttttgaaggggaatttggagttgygttttttttttgttatttygatgttgggagtggygttttggttttggygttttttgggtaagtattagtyggyggtatttgyggaggtggttggtaygttgttattttttgaaatgagtgaggagggaggtttagatttaggyggttttaygygttygttttggtattagtagattgggaattgtygtggttatgttygaagtttggaaagtttttttyggtttttttttgggatagttttttttttttygggaagttttttgtgtttagaggtggggttttgtagttggaggggtagatggaatttgygaagtaaaggaaggtaataaaaggaagttaggagaaatyggaaaygtgggttaggttttgttttgttggagaagyggtgttttygtaaagtttttgtttgygttggtttyggtyggagtttagattttttaaaygtttgttattttttatygagttgaggtttyggtttttattygygttttggtgagggtttttttttagttttaagttttyggttattttgaaaaygyggtttttttygaaggggaaataagtgtagtttaatttygtttgagtgatttataaataaggayggaaagggtygttttattayggtttygtttgtygtgaygatgtaatttttyggagyggagtattgttataaagtgataaggttgttataagygtttygattgatttttttaattagttttttatgtatgattyggagygattttygt

SEQ ID NO: 6991 - DNA, 1627 bp, Artificial Sequence
  Description of Artificial Sequence: Synthetic polynucleotide
yggttgtyggygygagyggyggttttttttyggttgtagaaygtttttygttgtyggagaaggggtttagtaaaattgatttttttttatttgtttttatttataattgatggggagatgagaaygtaatatattttagtatygagtttttgtygtttggyggagattttgtttaagaygttttygtaaagtatttttagtyggggaataaagtayggaaagttgttgggtagagyggtygggaggagatatygggagtygggtgggyggtggggtggtyggtgggttgtttygggttygggagttygttygtagygygttttgttagtaaggggagagggayggtgggaagyggtygtttttygggtttgggtyggggatggggatggttaagttattygagttttygtttttygtyggtaggtattattygggggtygtgtaattygggygtttattgataggtattttaygttygygaggggttgtttyggttttaattgyggygttgygttttttttttaggaygtaggttaatgttygttygttygtttttagtygggygtagagttgttagatttygggygttttagygttygttttggggttaaygggygggagggggyggttaagttygtaggyggttttttyggttttggtttagtttttttyggttggtttttggagaygttgtgttyggtagagaagtaatttttgttaattttagttatgtgygggggaygtygagttggttttgtttggtaagaaatttttatttgatgtttttttygttttttttttaagggggtgtatagtggaggagggtttttaagtttatttgtttttttttttaagtygttagttttgttagttttgaygygttygttaaatttttttagttttttgygygttttttgtayggtaggtagagagagtagtttggaaaataaattaattgtttagtggtaatatatatatatatatatatatatatatatatatatatatatatatagygattygggattttaggtttygatttttatygygygtatatatatatatatatatatatatatagygattygggattttaggtttygatttttatygggygttataagagtattagtaaattgttgaaaayggttttattttattggggggaggttggtaagaaaaaagaaaaagaaaaaaaaaagtttgttaygygtaaggaagaaagaaaataaagaaaaatattgtaaaaatagatatttttttgtttttttaggttttggtttttttgatagaattttgaaattygttattattttttgtagtagtagtagtagtagtgggatagagtaggagtaaaataaatygatgtayggtaaatggtgtaattygatttatttttaagttaatttattaggygagtyggagtttggttttttttaygtattyggtagttttyggygygggttttattttygggtayggayggtaggaggygyggtyggtygggygygttygttttygygggtgaatygtggttagygtygtttggaggtttttattttggygtygyggttttgttgatttttyggtggttttygygtttttttttttyggygttttgttgygt

SEQ ID NO: 6992 - DNA, 1857 bp, Artificial Sequence
  Description of Artificial Sequence: Synthetic polynucleotide
yggyggtygtatttggttttatagtgtaaaatgtgtttggygaggaagtygaggyggygttgtagtagttgagygtgggggtttgtaagggyggttagttyggggaagygaggttygtggygtyggtagaggygtagtagtygggtygyggygttttgttygyggtgtagttttaggaygygtygygyggttygttygyggaataygtatattgattgtaatagyggttygttatatttgttttatatgtttgttattyggtagtygtgtattaagttygttttattgtttagaaagattagygtttygttyggatygyggtgtaggttgttggtggtaygttgtatgaygygygggttttattgtaggttgaagaggttgtttaygagtyggtygaagttggtygttaggtagtygaaaaggattaagtyggtttattgtattaggtttattagtttygtttggttgaggttggttagtttattttyggtatttyggagggggygtagayggtygtttttygagygttagggygygggtattattaygttygtgaggttgggtagttagygtgttaggtttattaygttgttttyggtttagtgygtagygygtagttttttttgtatttgygtttattgygygtttygagtttttattygagttagtgttagyggyggtaygtggygttggaggtttagtaggygygttagatagtaagatagggtttygttttgaatttgtttygggttgatgtygtagygtaygtaggygygggtgtygtyggtaaaaygggttagtyggttggagttgygttygtaattttygygttttagggttattattygggygtygygagtygtttttagttaygtygtygtttgggttttygaaaagttygggggtatttgtttttttaggtygyggttttagaagaygttttygtgtatygyggygttttttttyggtyggggttgtttggttgataygtgttatttgggttygtttygggattgtyggggygggtygttygygtyggtygttagggtgagtagygttyggaaagtttttagggagtygtygygggygttttaygttaggggygggggtagagggaagygaggygygggygyggggtygtygtttygggtygggygtygtgggagtyggttttygggyggtygggaggygggtagttyggttygyggyggtaggagttttttttatagygttagtagygagtttagygttagtagttagagtttygyggtggyggyggygtttygtatttttttgtttatgttttygyggttgtgtyggtgygtygtygtygttttaagtygagtttaggtattygggtttyggyggygaggygggttyggtagtttgtgggtttyggggtttygggygtttyggttttatygyggtygyggggygttgyggggttttgttyggygtttygttyggygttgggaattygagttttygtygttttttagttgtttttgtatttygttgtgagatttttyggtgggygygatttataggygttyggattaygtgggagttagggggatttttttttttttttttygttttygtttttygtttttygttttttygttttttttttttttttttttatttaaagyggygatggtttttttygagagggagaggyggttttatattyggttygggatttgggggtttggaggaagtyggattggttgygttygygtyggggygtaggagggggtggygtagagtyggagtttggggtttggygggagggaygygttttgggttttygygggggtgttttggtygtygggtttttttgtttaggtagygygg

SEQ ID NO: 6993 - DNA, 2423 bp, Artificial Sequence
  Description of Artificial Sequence: Synthetic polynucleotide
yggagygtagagaayggttggagatatagyggtygyggtttttttygtagygtaggagygttaggtattgygttgggttaattgyggttagggagttatttgttygygatagygagygygtatttatattttygattaatttaggttggtttttagtttattttygggttttaaygtttaaatatttygtattgttggtttygatatttttttattygtygttaggaattagygtagagggagatgygttttttgtggygggtgyggggygaggattttgattttagttttgggaagtgaattgtayggaggagagagttttttatygttagttttgttttygttttttttgyggttttattttagttyggatgtyggygatggggaatagattagggaygtaggagtatattggatygggggtggatttatttggggaggtaggtaatygattygygtatyggtggygtaatttygtttyggtgatygaagtttgtggaggtagttttattttyggttttttggttygatatttttttgttatttttttttttattttttygagttttgggagtttggatttygaaggtgtaaaaagttaagagtttggaaaattgtattgtgtaaatatattgattttatttgtttttttttaggagttttatagatatatttaggtaaaaagatygttaaataaatgtttttagttatygtaatgtaaaaataaatattaattttttagaygtagtagtagtygygttgygtttaaagttttaayggttaygtttaataattataaaagtgtttagygagagtgttggygtgagtgtgaatgggtgtgygttggggggtayggtggagyggtgtgtaaaatyggagttgtaaattatyggataagggtatggagtggttattygtygtygatttagygygggygygttttttygtatatatttatagtagagttygtattgggaagagttaaaaaataaatatttataaggaygaggaaagyggtttygttttyggygttttygggttagggygagygyggygaggggygtatygatyggttygtagyggggygggagttygagygygygaggagyggyggtttygggtttttgygggtttttygggagtagggygygggtattttyggggtttataygtyggttttygygyggatygyggaygygygygtttttttygygggyggygttttttatagggtygagtyggagtygttggagtttaggttgttttttagtttgtagttgttgagttgttttygttgtagygataggttttgygtgttgyggygtaggtattttaggttttgtaggaaygattttttggttttttttttttttatgggggatattttttttttttttattttttggatttygtygaaggttatyggttgygttttgaagygagattggygyggtygtygtagtyggtttyggtttttgggtagtttggygggtygtaygggttgygggaattygtyggttaggtataygaagtgyggtattatygtttggtaattggagtagatgtttattagttygtygggtttggyggttatggygttttyggygtttgyggggtygggyggyggggygtyggggtttttygagggyggtygttgygtyggggtttttygggaggtagtagtygggggttygtygggygggggatttaaatttgttgyggggtggyggyggttttygygggttygggtyggygtttttygggagggygggygggygggyggattygtyggggggtayggggttyggggggygttgtttygtygygtttygaggygttygtygtygttgttgtygtygtttgtttygyggyggttaggttygyggtttatatagttygyggttgtttatayggttttgagttyggatgatagygaatgttatttaaagygtgygygtttygygttttttygtttgaygtygtttygtygttttgggaaagtaayggtttttttttyggygtygttygtttttygttaatyggtttyggaaggtaggtttygttygygggggtttygggagaagtygyggtttyggagtaygyggttggttygagttgygttyggatagggatttttaatygtygygattgggygggtattgttttttttgggatttttaagtttgtattaatygggttggtygyggggtygtaggtttttttttttygttttttggttttagatgtatatatttgaggygttggttattttatygtyggttttgygyggggygygaggtagtttttagttttttttgtagtttggygagtttgagygttyggttttttagagttgagttyggaagaaggggtgggttttttttttggatttttgttattttttttygtaggygygygygygt

SEQ ID NO: 6994 - DNA, 1146 bp, Artificial Sequence
  Description of Artificial Sequence: Synthetic polynucleotide
yggtatttgggtttttgygygtttygtttygyggtygggtttatggtattgtgagtttgtaagggagtttygtttagygyggggagygttyggttttttttygttttatgygttygyggttttgaagtttgagygggggtygggggtygggyggggtyggggtygtygtaggtatggygttygggagtyggtggyggtygatattgtygtygttgttgttgttgttgttgttggygttggyggygygygyggayggtttggagttyggyggyggtttygggtagtgggttygttaygygygttgggygggygyggygagtagyggygagtttagttttagtttgygtattaaygttaygygygygttgttgttttatttggaygayggyggygattgygattttttggagttgttgttggtggayggtygtttgyggttgygttttaygttttygtgygtygagtyggttaygttgtagttggataygtyggtggtygaygatygttggtatatggtgttgttgattygygaygygygtygtayggygttggyggtggayggygaggttygygtygtygaggtgygttttaagyggygygagatgtaggtggttagygatttgttygtgggyggtatttygttygaygtgygtttttyggygtttaygttgagtatygttaagtaygagtygttttttygyggttttttggttaatttgaagttgggygagyggtttttygygttgttgggtagttagggtttgygyggygttatygtygattygttgtgygygttygygygtaatttttgygttaayggyggtttttgtatygtgttggttttyggygaggtgggttgygattgtagttataygggtttyggyggtaagttttgtagygaaggtgagtttyggggagyggtygttyggtgtttgggygygggggtgagggtttggggygtttygtgggggtyggagtgtgtgtgggtttttgaggtaygggggttgggtaygagggtttgtgagtgggtgygagygttttagggttgyggggaygygtgttygggygagggygygtggggttggyggtgggyggggygagtgggyggggtyggtttgggygtggttagygtgagttttgyggyga

SEQ ID NO: 6995 - DNA, 577 bp, Artificial Sequence
  Description of Artificial Sequence: Synthetic polynucleotide
ygttttttttattttgygygttttaygtgttttttgtaaataagagaaygygtaggygtygtaaattagygtttattggtyggygtgtygtygtttygttggagggaggatttaggtttygttggtygygggttyggtattyggtgggtyggtggagygtttgttgggttygggtygtyggtttygttttygttatggygttttggttgtagtttttgtygttgttggggttgttttygggygtagtggtygttttygtttagtttygagtygttagtttttaggtttgggggtygtygttttyggagttgttggygtttattygtttygygttggagatgtttaatygyggtygggttgyggggaygygggtygtgttgggttttgtgygyggtygygttygtygggtgaggaygygtygggggygggggygttaggttygggtttaagggataggagttttgatttaatattgggatggggtttgttygttggaygaatygatttttggtgatggggaatgggtagygtygtaygggyggggttttgggygtygttaagggtygattgtgttygt

SEQ ID NO: 6996 - DNA, 1721 bp, Artificial Sequence
  Description of Artificial Sequence: Synthetic polynucleotide
ygtgagttttygaaaggygaagggtaggtagtagtygttggtttttgygtttattaggagtttyggatgttygagttagggttgygttaaggyggtyggagtagagagggagayggggayggggataggtagggataaagtgtaagaggtaaaattggttgaaaagtagaagtgtaggagtygttaaggggygggaygaataggttygtgggtygggyggagttaagggtgggggtyggggtttttttaggtggtattygyggygttagtttttagtttttttttttttttyggttttgattggtaggyggtttgygattagtygygaaygttatagygtttygggygtttaggagaaygygaayggtttttygygggagygggygagtaggagggggygtygggttatatatatagyggttyggtttygggygggtttggygtttagggaggygygtattgttttttagagttttagttttagtygygygtttttygttyggttygtygttttatgtagtyggggtagagttyggygttygggggtttygtygtttgtttttygtattttttyggttgygtatttttgttygaggtyggtygtgygttttygygggaygttataggygtagttttgttttttagtttttygggygtattgatygtttgatygaygtayggttttygggtygggatgtyggggttygggayggtygyggtagygttgttttyggyggttttgttggttttgttggygttttgggygggtygagggggygtygtygtatttattgtatttaayggtaygttggaggtygagttggagygtygttgggagagtttggtggygttttygttggygygtttgtyggtggtagygtagtttaaggaggyggtygtttagagyggygtyggygattatttgttgggtattaagyggttgyggyggttttattgtaaygtgggtatyggtttttatttttaggygtttttygayggtygtatyggyggygygtaygyggatattygygatagtgagtggygyggttaggygygaaggggygggggyggggggtaayggtygtygggttaattygtttagttatattttgagattttyggygggtatttgttygggggtttygggaatyggggyggattygggtttyggttttttttgaygyggggttggggaygtagatatttttggtttyggtagtttagygtaatttttgaggtygggygtygtttttygtttttagaaattygggtttygagygtygaattttagygttttygttygtgggtatagggygygyggtgtagttatagggggttygagataygygtttyggtttggtttaggttggggaatygttggggtygggttygygtttgaaggttygggattgggtgyggtygtygggggttttttatataggtaagttaatttgagttagygtaggtttgggtttyggaggttttagagggtagtttgggttttggaggtttttgggggyggttgygtygggaattttggttttttatttttaattttattttagaaatagggttttyggaggygaataagtygaggggyggagtgggttagggattatttgtttygtaatgatttgygtttygtttttaggtttgttggagttttygttygtggagyggggygtggtgagtattttyggygtggttagtyggtttttygt

SEQ ID NO: 6997 - DNA, 1721 bp, Artificial Sequence; identical to SEQ ID NO: 6996
  Description of Artificial Sequence: Synthetic polynucleotide

SEQ ID NO: 6998 - DNA, 615 bp, Artificial Sequence
  Description of Artificial Sequence: Synthetic polynucleotide
yggagtttygggtaygtatygtygagygttttattttgagttttttyggtattygtagtttygatagtttagttttttttatttgaaagttttatttgaggttttttttaattttgtttttttgtatttttggygtygyggggagttaggggttaaatttygtggttygygtggtttttttttttttygtagttttttygtttttattyggygtygygtttggagygttygtttyggagattygtataagagaggaggggaaaaagtgggtttgtttttygggtggttaatttatygagttygyggtgttttagaggaggygttagygttaggttagygttaggtygggttgtttgtttttygyggtaaagtataaatgygttygagygyggygtttgaagtttttggygagtatagtyggttygygtttagttttttttygyggtygtygygtygtygtygttgttgggatygtygtttygtygggttttaggttttygyggttygatttygagtttatygagtagggggygtyggtygtttttagttygygygttygtaatattygttggtttygygygtttygttyggygttgygygttyggtagaygtygg

SEQ ID NO: 6999 - DNA, 1542 bp, Artificial Sequence
  Description of Artificial Sequence: Synthetic polynucleotide
ygggayggtygtygygygtttttttttttygttttttgtttataagatttaatgagttttttygggaggtagygtagygagttaggttyggaattagtaggttgygtygygygygtygygtyggggygggagttgggtttgggyggygggtaggagttggygggggygtaygggtagygttgyggatagttygggagtygyggygatggyggtgtaggyggygttttttagtaygtattttttygtgtttttyggtttygggggtttttyggaygggttagggggygttttyggagttttggataagggttgttgtttygaggaygatgagatyggggtttyggygggtgygttgttgtygggagtygaaggaggggaygtgygygaggttattygygatttatttagttttattgattyggygtttagtaatattaagttggygttggataagtygggtaagtygaagyggaaggtgaattatygtaagtatttgtagaagtagattaagygttgtagyggttttatgggygtygygtttttyggttygtttttttygagygtygtygataygttagttaaayggtygttggtygtttttagygtttygatagtygyggtttyggtttayggtaaggttgtttttyggygggaggygtygtaggtygtygyggtygttagtttgtaaagtygaagtttggtygygtttttygattygttgygttaygttttygggggtgtygagtyggyggggggtgaggtggttgygtyggyggtygggttaggaggtgygggtattgggggygygggaggggaygtggtaggtttygygggggttayggygattttaggggttaggaaggtttygttgygggtaygtaatttgttttygtttttttttayggagtygtttygggtaggyggyggygggtgtggttygtyggggtyggaygtgagtttgggygatttggagaagggygyggaggtygtggagttttttgagttgttggggttygattayggygtyggtayggaggyggtagttttgtttgtygtygagtttttygaygtgtttttygtyggagttttygtattgyggggattttyggagttggagttyggtttttttgagtygtygtyggtagtggtgggaaatttattgtatttygagttttggagygtttygggttgtttttygattaaaaagagttttttgattgtttttygyggyggtttgattttgaaygagtttttgagttttttgtatttygtygttgyggattttttyggyggggaggaygggyggggttatttggtttttttygtttttttttttttagattgygttttgttttygtygtygtygttttattaggtgttttaygattatagygygggttatagtygtatygtttattttagtttttggagattygayggggtttgggaaggggygtygggggaggagggggygtatygggattgatttygaggtaygtttttttttattagagayggttgtggagagygtygygttttygt

SEQ ID NO: 7000 - DNA, 1542 bp, Artificial Sequence; identical to SEQ ID NO: 6999
  Description of Artificial Sequence: Synthetic polynucleotide

SEQ ID NO: 7001 - DNA, 1768 bp, Artificial Sequence
  Description of Artificial Sequence: Synthetic polynucleotide
ygygtttggagtgggttttygatatttagggtaagtgggggyggtagagtttttttttyggtyggtatagtagtttttgtygyggtttyggtttgygaygygtttagttttagtttttyggttttyggygtttgttgagtgttyggygggagaggygtagggagygygttatygggaggygygggtagyggggattggttttttttygggttagggttttyggggtaatygtttttagygygtatttttggtgtaggtggaatagttttttgtttyggtagggttttatttatygygggagaggttaatttyggatttaaatttygtagtygtagagygggttaaaatygttattttatttttttttattttttttttttttattttaagataaaaagttttaggtygggtaggatttgattatttttgtttttttttattgygttaattttgygagygagaggtttygtatygaggyggaggttggtaaaggggagtggaaagggaggatggatggggtyggggggtggggtggtgatgagggygaygaaggagggggtgttattttttttttttttttttttttaaaaaaagtatttttttygygagaaatygttgygyggaygatatttgaagaggtggggaaaggagggggttgygggagtygyggtagagattgtgggtgttataagyggataggagttatagttgggatagttgygagyggagtygagtagtggttgtagyggttaygattgggagtagtygtygtygttttttygggagtyggagtygtygtttttttagtgggtgtagtyggggtttygaygggggtygggyggttatyggggttggagttgyggttayggaggtttttgygtttgygtygygtygagggtagggatagggattggggtgaggggttgtttyggaaygtttatagttggygttggtttttttttgtttgatagttttttggttyggggtttttggtgtygggtttygygttagatgttyggggggyggtggtatygttyggagtyggyggggayggygyggttggtttttagtttggyggagagggtaggttgaggagtggggygtttagagygygtatygygygtaattygtgtygttaaaaaaaataaatttagagagttygttyggggtttaggatygttggggatatgggtattttgygtygygtttttttggyggggttygggaggtygagggatyggtyggggttgttgtygtygggggtttgggttttttagttagttgtggattaaayggtttttttttatttaaattaattgygttaygygtaggyggygtaygggttgggtttgggaatggggatygygaggttttagtatttygatgttttgaaagttttttygtttyggggatttgtttttgtgttgtagttggtaggggtygtttgaagtgggagtagygtttggagaaggygggaggagttyggttygggggaygggyggygggatagygggatttyggyggygyggtgygttttagggygtagyggyggtygtagatygagtttygggygyggtaagaggyggygggagtyggtggyggttyggtattatgygtygagggygtttgttggagatygttttgggatttatygtgtttttagygttttataygagttatggggyggaygttaatttggaggttgggaaygtgaaggaaattagagttagtygggttaagagaagaggyggtggaggataygaygygt

SEQ ID NO: 7002 - DNA, 2656 bp, Artificial Sequence
  Description of Artificial Sequence: Synthetic polynucleotide
ygtataggaattttagtygtttaagtttygggtgggygygtygtatttttttaggtattgtttagatagttygttttttttttttgggygttttttttagtttggttggggtyggggygggttgggggaggttttygygggtttgtttgatatttgtaaatggaagtgggatttaatttggaaaataaaygygttagagtttgggggyggagaggagygggaggaggggagaggggggaaaaagattttaattattatygyggttttagygtttttttttttygtygyggttgttgtaggttygtttaaattygaagttgagttttattgggygygyggyggyggygggatggagttggagttttyggtygaggygttaggagtttattagatttygygtgttagagttatyggtygtttaygtttygggtygtaggygttattttttttygggagttttttttagttttttayggagatttygtagggttttygtagttttttygttttygaygtttatttyggggatttttttttatygtttggtttgagtttattattttagygagttgtagttttaggatgttatygttagtatatttatatttygggagtatttttgttttttttatttygagtaatttaagyggtttttttagttygtagttaaatttyggttatttttgtatttttgttttaagtaygttttygttatttttygtttataagaggagaayggtggaaagtgaataaaagttgtttttygtaaagtttaattatgtttaatgttaaattatttyggaaagtatatgtgataaaagttaaygagagaggagaggagggaatttagattatagtatagttaaaaatattygggttygttattatgtaagtyggggggttagatgtattttagtttagygatttttattggyggaattttygygtttatygygygtygygttaagatggtttaggttatttttattgttttttygttagygttttttagttttttatatttgttttgtatatatattggtttgtagaggggattygtttygaatygttygggagtggggtttgagttyggagttggtgtttttggygttttygtttttaattyggagatagttttttygtatttttggggatggttagattygygttgttttttttttaaagataagtagtttttttataygttygttaaaaattatgtattttygtaaagtatttyggttttttttttttgttaagatagtagggatagtttttgtttttaattatttygtaaaggatgtygtttttagtygaagagtygtygtygtygtttattatattttattttgattataagtttygtaagttygagttaggygtggggaayggattygtagattggtaatttttttttttttttagygaaagtggaggttgggttttttttttgygtygygtttygtttagygatgatttaatttgtatttyggggttttttaagtgtattatttatyggtatttgaatattttttattgygttygagaggtatyggttgttaagtaggttygttatttgaatttttttatttatttgtaggggyggttgggagtyggggatgggtgtattgattygtaatttttttygtaatttttttttagatttttagttttaaatttggttaatttttygtgtaaatttttyggttttygtygyggggttaagttattttttttttttgtttgtagyggtagtaayggyggttyggggttgygyggaggttggaattttataaggtgaaaagttttttttaygygtttygtyggttttygtttttttagtttatttygtagtttatttgtatttagtagttgaggttgtgtttyggtaggygygttttagtyggtgtattaggtagttaaattattaygttataaatttttaygtatttttgttttygttggygatttayggttttaygaggygtttttttygtggttttttttattyggtgttyggygtttttgtttygggygagtyggtttttyggttgttgtygtygtagygtttatygygygttagtygggattgaggtygygagtagaagygttttgygttygggaygtygtygtygtygtygtygggggttygtaagyggaggaggggagtygagatgaagagaatagtagygggaggagagggaygggaggygygagattttaattygtaggttagtttatagygtagtttgyggggaggagygtyggtttttttgtttgtttygagttgtagtygtygtygttattgttygtygtttggttgtttygggttttttattatagtygaygtygaygtayggttaagtttttttttagtttttttttygygtttgtttttygtagttttttttttttaaatygygagygaaaagggygagggggagaggagtttyggyggyggggatgattagygatttaggagygtggygtaggggagagggggygygygggagggggyggyggaggaggygyggygaattggagggtattttyggygtygggtttggaagyggttaattttagagttygagtttttttttagttttttggggttttaggatgatattaaygtatttttttgtygyggggagagygt

SEQ ID NO: 7003 - DNA, 623 bp, Artificial Sequence
  Description of Artificial Sequence: Synthetic polynucleotide
ygatattaygygagtgtgtaygygttggggattgagttttygaagygaagttttgtyggaggagttttaggygggagtgggaayggttgggygtggggttagtaayggygttattyggtagggtggggggagttaggtttgttagagttagagygygttatygtygtygygagagaygtygygttgtttaataggtagaggygttttttagtagtttggtgggagtagagatataaaagtgttttaataaattyggagttggygtgtygatygygggttggtggygggyggygyggtgtttygygygttygggttttttggtttttygggayggttttgtatgttgtgygtttygtatttyggttgygygtttygattttagygggaggggaygttyggttygtaggtttttaggggaggggtggtttttgtaaaatggttttttattttttgttgttttgttttttttttttggtgygagttatygagttttaygagggtygggtygaygagtagagygyggaggyggttttggtygtgtttaatgtttygtatttttttttttggaataattatatttttttygattggtagaattttgtgggtaggaggygttayggygt

SEQ ID NO: 7004 - DNA, 1967 bp, Artificial Sequence
  Description of Artificial Sequence: Synthetic polynucleotide
ygatgatggaaaggatygttaggygattttttaaaaggtttattaaatattygggttttattgttaygtttttattygggggygaggatgttttaaaaatattttttttttttygttttatgtggataggtygygtygyggtatttaygggtatygyggaaaggggtataatyggggtggttttygtttaggtggtagyggagatttagggttaggyggattaggtttggtttttatttttttttttygggttttgttayggtttygtttygtygttagtagagttttyggttygyggtyggtyggttagygtaygygygtaggtgtgtttgttaggatgtttttttyggygaygygtttaggttyggatttygyggygygagagtgagygttggygggggyggtgggatgttttaagtyggygtgaaagaggygagagtgggygagtaygggyggtyggattaggagtattttyggtgattatttagtttttattttattttttyggaaattgtygggtaggygggggatyggtygtagggyggggttttttttggyggtgagtgagygagatygttaggttgaagtatygggagattgttttggtagtttttggtygttattygygtygtaataaaagtttttygyggtttttygtttagttagtttygtattgattggtygtygtgggagggattygagttggttggaggyggyggtygagygttgtttttgtgtygttygyggagggggygtattgggtgttttttggttygtttygtgygttttttaatygggggtyggtygtttagggtaggtataayggtatttggagttgygatygygatatatagttttttygttyggtttttttygatygttttttagtataygtttttygtttagaatgttygtttaatttatttagttttttgyggtttttgttttttttttttttttttygtttattagagttaaagygtaaatttttgggtggaggtggggggatgatagttggaggggagggtgggtaygtatagaagaattttttagggaggtygggatggaaatagttaaaatgaaatgtatttttttgtatattgtygaggttttttgggyggyggygtaattttygttattygyggtagtattattattgttttttttttagttttttattgtttatattttgttaggatygggaatttygtttaaagaaaggagatagggygaggtgtttygggyggttatttgttatttttttttygtttygtgtaatattgggtaygyggygygtgtaaagatataygygygtataygygygygtatatattaggtagttttaattaygtttttttygtttttygttttttygtatttttttttgttaaaaygyggygttygatttttttattttttagtgttygyggtygagggtaggttttgtaattaattagtaatttggtaaatgaaaaattaaygttatgtygattggggtgtaataayggttatattaataataayggtygtgygattttgtttattttgttttattttgtaaatygttatttttttggggygggggaagtaaagtagygattttgattttattagatttaggaatataaygatttggggyggttgttttagttttattgtttatttttttyggagtyggggttgataagttatttttttttyggaattygagttygtgyggyggtattattygagtygygatttttttygtttygtygttygtttttggggaaggagygttgtttattattagygyggtygttgagtttttaggagtyggtyggttttgtttttatygtygygggygtataaagtgggaagggyggaygygtyggaggggygtygggygttggyggttyggggaggtagtttygtgtagygtagttttggagggagyggggttyggttgggtagtaagggygaygygt

SEQ ID NO: 7005 - DNA, 2558 bp, Artificial Sequence
  Description of Artificial Sequence: Synthetic polynucleotide
ygtttyggggtggggayggaggtygttaaggttgggatgagtatttagtygagtygagttatygygtgttttttygtagatatyggggtttttgagaattaggagggaatagttaaaagaatggaagtttggygttttgaaataagttttttgggttttgagggaaatttgggygtttaygggtagtygttttttttattygtygttyggygttygygattyggttggygttggttgtagygtttagttaggyggygyggggaagagtyggygataattygttygagtttyggggatygatygygtttttatatttttttagtttttagygatttttatygagatttggagaygattttagtaaatttggggaagtaatttttttygaggagttagatttttgaaagaaggagagttgagttagggaygagggaaagygaaagagayggggaggaayggygatagttygggygggttggatttygyggygagagyggtaggggaggyggattygtttygyggygaaggggaagtataaaagtttygtagygagttgtgggaggaaaggygagaaggggtttgttygtttttttttttygatttagggtygtgattttttgggagygatyggttgggttttaggtttttggttagyggygttagyggttagygygttyggtttaagtayggtgygagygtttyggggaggyggygagygagtyggtgyggagygtttygtgygttygggtggtttygygggtyggygggatygtgygtattttaagygygtgygggagtgtgygaggygttgtgygagttagyggygggygygttagggtgggaaaggtatttygaaygtattaggtgtagagatyggtatttatygagagyggtygggagygtayggygagtttyggtgttatygtyggtttygtygagagtygaggagggttygtagygttgtagattttttggagttttttttttttttttgtaaaaggggggtggggattaagtttaattaagaaaaagtttattaygtttttttaaagagaaataaaaygtaagtagttttagttttgttttttttygtttttagatttattygttagttttttygattttagttttttagtyggtyggygaataaatatataaataaataaattataattttattttgygttygygtatyggttygtatatataagagtatttaygggttttgttgtttygttagtttttggyggtataaagttttyggattttygatttttttgtttaygtttttagttttygtatatygttaygttttttattttttatttygatygtgttttgaagaggaagggttggggaggtagttgygtttaggttgatagtyggggtttttttttttagtygatttttaatyggtggyggygayggttgtagyggtaggaagggaataygttaaataaaaaaggtataagtttagyggtygagtggtygaagygagygygygttttttagatttttttagtttygggaagtttyggygygyggygttygttgggyggtgygttttttttyggttttttatttatygtagtygagtygggtattgtggggtgggtgtgygtgtttgtyggggggtgtgtgtttgtgtyggggaggggtgttgttggggaattgttgtttttygtattayggyggtagygatagtatygttyggtagttygtagtattygtttttatygtttttaatttttttttgttgygaggttagtaaattattatyggttgttgygttttygtygygttttaygttaaygtygagtttttttttttgtaaggtttyggygtttttttatttttagtgttggyggtygagttyggttttttgtttatagttgtttttttttttttttttttttygygtygttttygggtttagttygtttattatttygtattggtygagttygygygygtttttygttttatttttttttttttttttttttttttttttttttttttttgygtttygygtttygggtttygtttgatatttagttgttgttggggygtyggyggtygttttttatyggtygagyggagaggaaggaaggagttagaggataggagtgtatggggatttagaatttttaataggggaattgagggtgaagggygygtagtagtttttatttatttttaagattttaatttgtattggataygggttttgttttttttttttygtatttyggtgtttaagtaygtagttttgtttttttttttaatgtttgttttaatttagtgygtgttatttygtttttaattttttttttatggttyggggttgtagtttttttgatatttgttttaaaaggtygtttttttagtttaaattyggtttttttatttttttggttattgygygtttttyggtttgagtattyggattttaataagtttttygaggtagagttygygggygttagtgaattaggtgttagaaggttygyggggatttattgtygaagygagatattygtttttagttgtygyga

SEQ ID NO: 7006 - DNA, 2558 bp, Artificial Sequence; identical to SEQ ID NO: 7005
  Description of Artificial Sequence: Synthetic polynucleotide

SEQ ID NO: 7007 - DNA, 1508 bp, Artificial Sequence
  Description of Artificial Sequence: Synthetic polynucleotide
ygttttttagatagyggagtygggtyggggyggtttggttygggtygtygtttttgtttttgggtttgtggggttggggttygtttgggtttygggttygygyggygtttattattyggggtgtygygggggggyggggagagyggtygtttagtttagtttygyggatgataggagtyggggagtygaggagggaggagtygtygtygtagtygagygttgggttgaggagtagagagagyggggygtygagtgygggyggttgggagygygttgagygggggagaggygttgtygtayggtyggttataggattattttttyggagaatagggtttttttatggtatgtggttggtaattttttttttgtttttggattttttatataaaggtgagatttgygygggyggttgggyggyggaggyggyggggttagggtggygyggttggyggygaggyggggtgttyggygggttttaggtgygtgggggaatygatyggggtgtaaggtttygggtggggygtagyggggaggggtaggtattttgataggggtygagtgagagttagttttygatygtttygttagttattygygtttgtygttttggggygygttygtaggggtggtggtaaaggagttttttatttttttgttttttgtayggyggtagttttgttttggattttttttttagttttttgttttttttttgyggtttggtggtattgggatttyggagtgtttttygagtygaggggtttttaggtygtgatttttgatttaggagtttttgtttatttaggtttyggattyggyggttgattttttygttatgttygtgygtttttttttygtygyggattttagttttggygygaatgttggygtatygtatggygtttattygygtattggttggaggtagggtggggatagtgagagtttygagagttggaggtttttyggatagtaagtttgttttttaaatttagaggttattttttttyggttttattttatttttttgtttyggttttagtttyggtttggtgygttatygtggttatttygggtagygygttttaagatgygagatttttygttttygygtttggttagttggatttggggataagtttttaggttggggggygtgttttttttttyggagagagggggttgttaggggtgggtttaggtgttyggtatgtttagatttgyggttggggygttgygtatttgattygygaggtagtygggatygggaggttggaagagggtagatattttygattgaagttatttgggtattgagtygggattaggtaggygtaggtagtttgggttttaggttatygtagaggaygtgttttygggygygtagatggygggagatgaggyggtygaatttygygtttttgygtggtggagtatataygttttaataagtttagygttatttgtttagttttttaatttttttttttttygtttyggggygg

SEQ ID NO: 7008 - DNA, 1119 bp, Artificial Sequence
  Description of Artificial Sequence: Synthetic polynucleotide
yggtggygatatggtaggtagtttygygtggyggyggtygggatagttgggygygttggtaggagagtaggtatagygttttttataggtaggatgaygygggtttygtagttygtttttttaygttgtttygtattattgtttyggttttgaygtgygtgygatagatttatygtaaatagtttttagygggagtaygaggtygggataggaggtgggyggttatataggatattttattttttttattttttygtagtyggyggagtygatygtyggaaaagggaggyggtgggygaaaggaaagyggggagttgggagaggagttgtaaataaagagttgtttttgtgygaagttttgagtygggtttagttagttygttttttgtggtttaygtattgttygtyggtttaygygggagtttygaggggygaggyggaggttgggygtagtttttgtagttagtagttattttygygygtttygtygyggtttagttaattatttgttgyggyggyggtygtgttttttagggtgtattagtattttygtygygggygttgttttygyggygtyggtatygatgttyggttatttttaggttygaaygattgyggttgygggaaggygggtygaggggggttayggtattttagggagaggtygggagtygttyggatttyggaggggatggggttttttttgggaggtattygttttttttttgggttttaagattttttttagttttgygtttygattttatttttttygaaaygtyggggaatygggaaaggagggttaygggtaaagygggggygggygttttttgattagtatgyggygtyggttgttygggttyggattttygagtttttttttygygagygtatattaataagtttataaatggaattyggtggygtygtttgtaataaaaggtagaagttgygtttyggygttttaatgagagtattttttttygtaataaggggttggatttagttgtttggtgtygtttgagyggggygagttgttagagtaattaaggtttagygygtaygtggggagagggagttggttggggttttagygttagtygtygtttgygygttygg

SEQ ID NO: 7009 - DNA, 1119 bp, Artificial Sequence; identical to SEQ ID NO: 7008
  Description of Artificial Sequence: Synthetic polynucleotide

SEQ ID NO: 7010 - DNA, 653 bp, Artificial Sequence
  Description of Artificial Sequence: Synthetic polynucleotide
yggaagtaaggygggttagttatygtttygagttaaagtttttgtagttttggtaatttttygygygtttttgtttaggagttttatattttagagaaatttttyggygtttttagtttygttgttttttttaggttttgggatatagttttaagggattgagyggttyggaygggatttgaaatttttggaggattagttaygttygtatagttygtttatgygygttggtattaggattygtaggttgttagyggygagttttygtygyggttttttagggtattttyggagaagggggyggttttgaggaattttttgtatttyggatgttttatttttttygtttttagygttttagggttttgttygggttttggtygygygtggtgttttttttagtygyggagttttgttttttagtgtygttgaaaggaaagagaaagaaaaygttttyggttttggaggttttgtttttttttgaagygatgttattttttttttttatttttttttttttagattttttttggggtttyggtagaggyggggyggttgygtttygagttttttttyggyggtagygygggagyggggttggaaaagagggygtygggagtygtttygttttttatygtttttggttttttygt

SEQ ID NO: 7011 - DNA, 1768 bp, Artificial Sequence; identical to SEQ ID NO: 7001
  Description of Artificial Sequence: Synthetic polynucleotide

SEQ ID NO: 7012 - DNA, 1101 bp, Artificial Sequence
  Description of Artificial Sequence: Synthetic polynucleotide
ygttgygaggattaagggagatggaatgtagygtaaagttttaygtaaaygtgtygtgtaatatgaagttttttattttgagttggggagygggtggtaygygtggaagttgaatgttattatttttgggattaggygtagygttttttagaagygtttttggtgaygggtttttgtttttttttaggaygttttttttagaatgtttyggggttttggayggttttggagaggaygggagggaagggaaggagaygggyggaayggggaygtatttgtttttattgtatttttttygtttttttatttttagttatttgyggaggaggaagygttttyggygyggggaygygttgggtgtggagtagttggattayggggtgttttygtygttggagggygtgatttygatggayggtagttgtaggaattttttgtygggggttaagayggygggtaggtttygggttagttyggtttttaggttttgtttttgtaygttttttatgyggygtattttgaagygtyggyggygaagygtgggggtygaygaattggattagatygggttgttttygggygtattttgyggttygggtatttgtagggygggtagyggtyggttttttattatgttggtygtyggtatgggggtygtygtttttgygttttttttgagtttttygttagyggtttggttygygtttttttttggttgttttttattttyggtttygyggtatattttttaattttggggtygaaggaataagtttttttttyggagygtagygaggaagggaygygaggggaygyggygtagygygtygtygttyggagtttaatttttyggagygygygtttttygggtygttagtygtyggygaggttattygggaggggygggagtygtttgttagttattyggtagtttttttggggtttttttygygygttygtttgtttttttttygttgygttttttygtttgttggygtttttgttttagygggattyggtagttaggggttttagggggyggtgtagtaaatttttagyggtttgygtttagtagattaggttggggagtyggtttggygt

SEQ ID NO: 7013 - DNA, 1101 bp, Artificial Sequence; identical to SEQ ID NO: 7012
  Description of Artificial Sequence: Synthetic polynucleotide

SEQ ID NO: 7014 - DNA, 2341 bp, Artificial Sequence
  Description of Artificial Sequence: Synthetic polynucleotide
yggtttttgtaayggaggyggtttygaaggaygtaggattttttyggaggygatagttttaggagttttggttttggagtyggygtaygtttaggygygaagggygggggttyggggygttagggatttgtgyggaygggggttggggaaggtttttygtyggagaggyggygaggtyggtttaggagtttygyggagtyggyggttttttagygtttagagtygggygattgagtgtygagaggaagggaaagygttgatatgtaaataggggtttttatttggaggagttygtttagatagatttttygatatatttatttgtatttttattttygtgtaaygaggttatttatttattttagggtttattaggtagggattygagttygggygattgtagttttygttttygtygtgtttygtttttgyggagaggaagtttagtgtttagygttggggttaygggagtttygggtgtyggtgggagtggtggatttygaggtttttygtttttgatttygtttygtattttggggtttttyggtttttygtygtttttttttgtagtttyggygggtagygaggtgggaggggggtyggggttttattttgggggttgggatttygggggagggtygtttttaatgygggygtttggtyggttggttygygagtaggattygttattygagygtyggaggagtyggygygaagtyggggygyggagggaagggagagaggttaygtttttygggaygygggtttygtatttattygttygtygtttygttttttyggtyggttttygtygttygygttygttgtttygtygtttattttaatagtttygtttatttggttaagtttgtagtygagttttttaatattttatatattgattyggttatagtttgatttygtagttttttyggattagttyggygyggtttttttggygttttgggttttttttgygtgttttttgygagygttttgtttttatttttttgtgtaygtttgttgttgtagyggagygaaagagatagttaatyggatgaaattttttttttagttaattttgggaagtgattttattttgygaatyggggaggaagttttatttttttttttttttttttttttttttttttttttttttttttttttttttygtttygagtttttttttttttttttttttttttgtttttttttgttttttttttttttttatatttttttttttttttttgttggttttgtttttygtattatatattatataaatataygyggagatgtttagatatatttatgygttgygtatataggatatttgtttttgggagataagagttagtygggaataatgayggggtttaygtttagygttygygttttgattttygaagtttgaatttttttttattatttttttttaaaatttaaagttaaagatttttggtttttttgttttttttgaggyggttggtygaaggtggtttttttgatttatttatttttygtttttttttatagataygtttattaatgttttttttagtyggagataaattttttgggggtggggtagggggggtatggagggagagttggttagggttgygggtaatttagygtttattgtyggggaagattyggaygaaaatygaggtaaattaattattaaaaagtgtatttaataagaatttttttatttaggtttttygttgtygagaygyggtagatttttagagyggtttatttatttatygaagyggattttgggyggtttygggttgattygygttgttagggygyggattttatttygggygtattgttaggagaaggggtttttyggggyggygygtttygattttgggttttyggtgttygtagagggyggagattygyggygttttaggttatttattygtattttttygagttaaatttttagygtttattyggattygayggtttaagtattgatttttaggtaagagtygttttttttggtttttagggaattgatattatygygggaygttttttttaggatagttagtaggttttaggagygtagtaygtaatagygtagagtagatttagatttttttyggggtgagattyggaggttygygttttggatygttttttttatttagtttggaggtyggygtttttyggtttaattyggagattttttygttttttttttgggtygtygygygttttagttggagtagtttygaggggttgggttttttyggtyggatttttttttttyggatatttaaaataggttattttgtttaygtttttyggattaygt

SEQ ID NO: 7015 - DNA, 3857 bp, Artificial Sequence
  Description of Artificial Sequence: Synthetic polynucleotide
ygagtagaaattatygtgtttttgggggtttttygggygtygtggggygaygyggtgtagygtttagggtygtygtaggtygggggtagggtttttagyggttttttygyggttagyggttaygtaggaaaaattygttttttygtttttgtatttgttgataagtygttygaggtgtttgygttgagygtggttatatygatgtagttttttaggaaatggttygggagggggagggggygagtgagggattaggttyggttttttttygttttttttgygtaaatattattattttttttttttttyggaggtatgaggtttttaygttyggtttttygttygtattttygtygattttttyggtttygygttttattygttaggttttttttttgggagtygattgyggtgaagtygtygttagtayggtyggttttgataygtgttttaaygtatgtttgagttaaggttgtttttataggagataygatttggtggygtttttttattttttttttttygttattttttatttttatygygttttttggtgtattttattttaggaggaaggggagagattagygttttgatgtgttggttaagttggtaygtgtagygggtatggygtggttygagttttttgggtatatygaggtygattgagtgttttttttatygagagagggggttygggtaggggygyggagagttagtaaggyggggtggggygygggttgggtgagtygtatattaggttttttgtaaggyggaggaggggagygaataaattagaggtgtaagygattaatttaggtttyggagttagtttttttaaaygagggtggggyggaaggggtggtgggggggaaaggaggggatatygttttaaaagggtgaggaagagtttggggygtygttttttttttttttatttgtatagttaatagttttggggtttttgttattgygygttgattgttatygggtagattattttttttttttttttttttttttttttttagtaggaygygttttttattatattaaaaggaagttaagggagggyggagggagagygggygttggggygggygaaagttggggagaggttyggtygttttygattttattaatagtagygggaatgagtattttattttttatatgtaaagaaaggggagggaaggggygggygaggaaaatgtttaattgttgtggaagttattagtttttaggaagaaaaaaagttygttgaaaaatttaagttgtaaatttaaaatgaaatagtttagygtygyggatgatattygggtygaatatygtgtatattygtatatagtyggtttygaataattatttattggttttagttaygttgggtttttygatttaagtttttgagttatttyggataaggatatttatttatattttaagatttttataagggaattattttaattttatttaagttatttttgagyggattaaagaaagttgtagyggggagaggygagagaaggagggagggygggaggtatttttaaagtataaatttaattygataggtaagggatagaggtygtyggggtttttagtttttggatattatttgatatagttttgygagtaaggttttttttatttygatttygtatattttttttttttyggggaaaggtatttagagttttgggtttttygaagtgggggtagygggggygaggaagaagygggtggtygtttyggggtttagtttatttygaggagaatgtttgggtggygagtttttaygtttygggagtgagtygagggttttttygttttttttttttttttttttttttatttygttttgttttatagagaaattttagyggggaggggggtagygaatgggaggggtagagagggtygyggtyggatgtttttttttttyggygttttttgtatttatggagattygtaagttygggygtttttygygtggtaggttygttttttgaagtttttttgtttattttttttttygattattgattgttttygagygtgaagttygttatygaatttaattttyggtggttttgtagatttttataygtggggtggggygtgagagggtgyggaggttggtaggaatgtttttaggaggtttggattggaaattgagtttttttttttggtygttattttagttatgtgttaaaattttaatgttttgttaaaatgtattttatttagtaygygggaaaaygtatgttgttttttaggtaaaagtgtatatttttttttagtgtagatttyggttttaagaaaaagygtaagagtttgtgttttggttttgaagtttaaattgattatygtggygygggggtggggggyggygggagggggtagattgttggtttttttttattttttttttattttttayggaaaaaaaaatatatatatatatattttatgtaggattggtgataaattttagygaaygttagttttattggatttttatttttttttyggtyggttttttattttttaygttagygttttggagtttyggttggaaagtgtataaagtttggaggtggagggtgtagtagggtgttgggtgtttataggtatttttttgtaggagtttgtagtattaagtatatatatttttaagtttatttggaggatgttttttagttaggtgatttygyggtyggtttaaggttygggagtagygygagttygagtttygtttttttygygtaggggygtttaggttaggtggggagygggtagtgattgagtttaggtttagaaatgggagttattgtttttttttyggtttttttaaagagtggagttgtgtttgtgttttttygtggagggatggayggttaattaaaatygaaaattygattggtaaaatgygaggggatatataaattygaggggatatataggaggtatattaagaggaaggagggagtgtaggtaaagtagaaaaatgyggataaggagaagaggaaaaygtygggaagyggagagtaygggggagtagggtgggtggggaygggtagtgygattgtaggtgtttattygttttygggattttttggtygtagtygygttygtyggggygttgggtygttgygttttggaggggggtagagttygttaggtttgtgtattygtatttttttyggygaatttyggtttggayggggttggattattgaggyggtagatgygataggygtgagttaagaaggygagygtttgtygtttgttatttatttagtattttattttttttttttyggaaaaaaaaaaaattaaaagattygaatttttttttttttttgtttgatttagtttaggataygttttaygyggtygaaaatagttttggaaatatatttgttttataaaagtgaattttttaataagttttggggyggggggygttyggyggtyggygtyggggggttttgtttttygggaggagaaggaatyggtygttttygtttttttttttttttaggygttttygggagggggtygttgggyggyggaatygygttttygttyggggagttattaygyggttttttygyggaattttgaygttatttataygtgggggaaggggttgggagagtaagaggaagyggygggggagggggtygyggttgggagagygyggyggyggygyggygggtttggtattttygyggtgggygtagygtygggtagggttygggttttgggtagygyggtagaggaggtygtgtygyggatttyggagttagygtygygattygttttttttttygtttttygtttttygt

SEQ ID NO: 7016 - DNA, 1439 bp, Artificial Sequence
  Description of Artificial Sequence: Synthetic polynucleotide
ygygggttttttygttaagygggaygtygygtygggygggtgagagaaagttygggtaggagagtatagagtyggygattggaygygagygyggggygggtggagagygttttttygggygtygttgttgttgtttygggtgttgaaaagtygggaatttttygggaagtagyggtatttttttttttggaaggtgggtgtgggggttttagattgygtatttgttaaatttttttgggtttttygggaggggttygttagatgtgtttttttttagttttattygggggagaaggatgggggygggggygtgggggtgagtatagtyggatatygtaagtgggaatttggggtgttttttttygtagttttygggtagtygygygtygygaatttyggtttatttgtaagtaaggygggtygggggtagagggygtygggttgtgygggggaatyggttygygtttygggattggggggyggtggaagagagagygagygggtatgygtagtggggyggaggaggtggygatggtygggggaggyggggggattgttgtttatttgtagttgggttaatttygyggygtaggyggyggyggagygyggggagttygyggygggtttagttgtygtagtattatgttygagttttttttygggtagaygtygygygtygtyggggtttyggtaggggaggatgttagaygttygggagaggttagggtagtagyggyggyggyggygygatggtggtgattatttttgttygaggyggyggyggggatygtatattttttyggyggyggggttgygggttagygtyggtyggggtygyggygttgttggtyggggtaagttgtttgtgttayggtygttttttgtagggygagttygtgtaygaygaygtgtgggygatygtgaataatttygaygtgyggttyggygtttygtttygttggggtatttttattaaygatttttggggtaagggtatggtygagaatattagttataagttttatyggtygttttgygtttttatttttaagtgagttttttatttygygttagtygtygttgttttttttatttttygttygtttttyggatygggagaagttgygggattgatttgggggtattttatttttgtygttttttttttttaygttttttttttttttaggatgtgtatggtattttgtttygggatttattgttyggttaatttgggttttyggggyggttygggaggygtyggttggggagttgggatygagttttttaattgtttgtttttttagygggtttttttttygaggtagggttgggagygggttggtgaaatygttttygtattttttygtttgtyggatygtgattaagtgggattagygyggatttagagggtttyggaggggtggyggtggtggyga

SEQ ID NO: 7017 - DNA, 1288 bp, Artificial Sequence
  Description of Artificial Sequence: Synthetic polynucleotide
yggagagggtttttygggttaattttgggtaaygatgagtattttyggtttyggtaggggygtygggtygttygtttttttttttttttttttttgygagttttttttttagaggaygyggggagtygggtttgygygtttygtygtttgttatttagygttygygtygggttgygattggaygygtygtygttaggtattygttagaaatattagtgygttggggagaggaggggggygtgtttgygagtygagggtttgttttggtttttttayggtttttttttttttttagtattttatgtygggtttttagttttagygygtttyggttygttygygyggygggagagttggygtaaatttygyggtagtygtagttttttygygygttttttttttttttaygtttttygttttygttatggggttaaygtggggtttttaagagttgtyggtttttagyggygtaatttttagttaaagttatygygggyggattatggtttagggygttagaggggttagaggtaygggaagaggaaaagayggttaattgggaaaaaaagagaaaaygaaagaaaagttaaaygatgagtttttataaggaggayggagtgaatagtttgtgttagaaggttttgtatatygttatygagttgtgtttygtyggttaggtggagtgggagaagtgttygggtattttttttygggataggggtagttagggyggaagtagtataggtaatygggagggtttygttygygttttygygtttygttgggatttygygygttaggttgtaagtttyggggttttgygtttttygygtygttttygyggtatatttggggygttaygtttttttatttygttttttttttygtttagtttttgaygatttygagggtggggygtttgggttttgtttttttttgtttatttgtygggttttttttattttttggttygtttttygtttttyggygtygtttttygtttttagtttygtygygttttttygygtttttttaygttttttatttttttttyggagtggagaagtgagtgygggyggtgayggygtygggayggttygyggtttggttgtttgtgggggyggtttatttgtgggattagggttgttttygttygttttatyggtygttggtttyggttttgttgatgggggttaggygggayggataagttatgtttggaygtagaatttttttgtagaggtggttgttttggttttygaggtaattygyggttgtaatttgtygg

SEQ ID NO: 7018 - DNA, 1006 bp, Artificial Sequence
  Description of Artificial Sequence: Synthetic polynucleotide
ygagttygggtttttaygttttatttggtagggggygygygggtttyggagttgtttagtattttttggttaagttttttgygtttttygygttygggaagtttttygygtyggggaagttttttagygtttygttttyggtagggaatttttttattaggatattyggggttttttaggttygttattygtttttattagtttttatttattttgtttagttttatttyggtagtgtagygtgttttggtggttttttttygtaygttttggagggggagtgttttgtatttyggggttgtttyggagtttagtgtaygagtgtatatgggttttttttttttgtttaaagggtaggygagygttattygttttagttttgttttttgtagttgggtggtttttttttttttttgttttttaagataygygttygaaatygaggggtgagagtaaagatygtttattaatttagtattttggatttagagtttttaatttygaaaggaggttggtattgttygggttatygagagagggagggagaagagttgaggttgtaayggtttttgggttttttagatygggtttggtatttaggagatygtgygggagatygaygttgagygtyggtttygttttyggyggttttttttttttttttatttygtttttttyggttygtttttttttttttggaggagtagttttttygygygtttttyggagttttttttattgtttttgtttttataataggttygggyggyggggaagaygggggggtgyggggtygttttagttygggtttttttggggtygttttttttttatygggtgtgygagtttttggttgtttttattyggttygggagttaatttttygayggagtygygtyggggygagttygattttttttttygggtttttttygggtygygttgtygtttyggttttgygtgtgggaatgatgtgygtattggagggtttaagttttttaygygt

SEQ ID NO: 7019 - DNA, 1185 bp, Artificial Sequence
  Description of Artificial Sequence: Synthetic polynucleotide
yggagagttagggttygtttaataggagtaygyggagatattttagaygatagygygttttttttatttttatttygtttttygggygttttaggttagygtttattagattttaygtttgggggattgtttgggttttagygagagtgttayggttttgtayggtagyggggaggtggygagygygttygatttaygtygtttttaygtttatttttttttattaygagttttttttttttgttatagtattatttttattgttggtygygtttgttattttgtggggttggtgatatgaatggatgggttggatatatttttygttygtttagaaaaaaataaaaaataaaaaaaaaattygtttagatttgtatagagagggggaaagatttttttttgygtttttagagtttaygttgtyggttagagaaatttatagttttttttttttatatttattttttttattttttaaaaaaaygtttaaygtaaataaataatatygttttaagttygtygtygtttygggtggttttttttttttgtttggtttygygygttttagttttgygggaggyggyggygagaagttgyggttttgggtgyggtgyggggygttygggygataggygggygtaaggygggygygtagtagatyggttggygtygtattatgttttttagygyggtygtagtttaygtyggtgygtattgggaygttgtggtttttttygygttttttaattttttygttgygttyggttttggtaatttgggtaagagttttttgatygagaatttgttgygggtygggggygttttaaygtttaggttgtagtygttygygttttaygattyggygatygttttggttatygygggygygtagtttyggtttttgtttgttagtttagtttttttaaagttgtgtttygtagtygaataagttagtttygtyggggygttttayggaaygyggtgggttttttaagtgtttagtttttttgyggatagtgygaggttgtygggtygggtttygggggatygagattgtattttttagtttttagygttaggtgagttagtttttttttttttttttagtygygttygygtttttaggtygggtggtttagggatttgggagygtyggyggtgygtattgygtttagggagagtygg

SEQ ID NO: 7020 - DNA, 409 bp, Artificial Sequence
  Description of Artificial Sequence: Synthetic polynucleotide
yggttttggttttaygygggtagygttagttggtyggtgttayggagttttygygtttttygttygtttagttttygyggatttatttattggggttgtttygtagygygatttttttttatttygggggagggttaagggyggyggtggggggyggggtgggggggaagyggygggagggggyggtgygtygtygttttatttygggttygygaattygtagygtttttygtagtatttttttaggttyggttttttttttttttygygtygatggtaygygtyggttygtttggttyggttgtagtggatgttgttagaatttaygyggaggaaggaagagaygtaggtaggttgyggttatttaagyggttattygggttttagggatttttttttygagagaygg

SEQ ID NO: 7021 - DNA, 1813 bp, Artificial Sequence
  Description of Artificial Sequence: Synthetic polynucleotide
yggggtygttgygtttttttgattattgayggttaggayggttttagtttygttttatttgtaagttttattttaggttygagttttygagggtagggatagtttttygggtttygaggtttgattagagtttgaaagtttttgtygggggttgtttygatttagygaggygttaggttgttyggygyggttgggggygtttagygtygggattttagttttgtttyggtygttygttggtttagtgygtaygtttyggtagtttagtttttttttttayggyggtaggagagttttyggtatttgtttggggygggggygggggyggggyggggygggygtygygtttttttgtttgattggtaggaagatagattaatyggaggggtttttyggggggaggggyggtgtygtgtttgagtygggygygggygatygagggagttgtagttattygygtgyggtaygygtyggtygtttgttyggatygyggttattagtgtygyggtttttygattttygtttygtygagtygygygygygattgttattttttttaattgttttttaygattttttttgtgtatgtatttattttttgtttygttttgttttttttaaggyggtggyggyggygatagyggygtaagttygtagyggggagggggyggtyggaggatgyggygyggggttgygttygttaygttygttgttgttgttyggttygggtttgagygtygagtaggtgggtataggtgygtyggggggygggaggygagygttggttagagggaattygtggattyggygatygaggggyggatttggyggtaagggaygyggygatyggtgtygtttygttttatygtttatttttttttttttyggttatygygttttttttgggttttttttttattttygtattttattttagtggttttttatttttttatatttattttttatttttttttagatttttttgtaaaattttttagtygttgygtygttttttttaatattttttttyggtttygtttttagtttttagtttttttttaygttatttttatttttattttttttyggatttygtttttaagttaaggagygggagggggatttattyggtgtttgtyggagtggygyggggggtgtggtyggttygtttttttygtgtttttygtagggtaggttatagttttttagattttygtttaggtggtaaagaagatggagttgggggtygygtttyggyggygyggggttygaaggygaggtygtttagttygtattttattttaygtayggtataygtygtygyggtttttgttaygtatattttygygttgtttygtttaygtgggygtyggggaggaggttygagagatgggaagaaaggttggtatttatttttttgtygggtyggygygttttgggygtattggttttyggagatggygygtaaggattgattttygtggtgttagatattttgtygggygttttgygtyggggttagyggtttygttggtttgygttagtgygttgyggtttygttttttagtttttyggtttttygttttattttttttgttgtgggtttttgagtattyggtttgggtagtttagatagaggtygtttaygaggttggygttttttttygttttagaagtatttygtttttatatattttagttygtyggttttttgaaggttgggttagtttyggtttttygttagtttttgttyggttttttgagttttagygatattgtatttaatygttagttttttttygtygttygt

SEQ ID NO: 7022 - DNA, 1294 bp, Artificial Sequence
  Description of Artificial Sequence: Synthetic polynucleotide
yggttggagaagttttygttagygttgtttgtggttagattygttttttgttttttttygggygtatatataygtttatttagatatttygygygttttttygygtttttgtttgttygttygtygtygtttgtttttttttttttgttttygtyggtygttttttttttttttttttttttttttttttttttttttttttttttttttttttggtattatagagttgttttgaaaatagaagatagagggagtttyggagttygttatttttagygatttttatattgggaaaaaatatggagttagtttyggtagttttygatttygtygttagygagttaggtagtagyggygyggaygyggtygtyggttttagggagatttygttgaattaggaattygttygtaagagygagtygtttgtttyggtgygtagatagagttattttagtattagtagaggtaggaggttggagaggggttggggagggggyggygggagttygggygyggagyggggggyggtygggagygggygttyggggygyggggttyggyggtygygygygagtttgyggyggygtttygagttyggaggattttttttttttttttttttygttttttagaaatgttgtaaatttttgtagttygttttyggtttgygggagtagagtggggygggggaggyggygggaaggttgatagtyggygggtttatttttttggttttgatttttttgtaaatattggaggaaagttgygttgttttaattaaataygtttttttaaaatayggagatgyggggagtgggggttygggaaagaaatttttaaagyggtagtgtttttttaagaaggggtaaaaaaatttgtttatggttatttttttttygttttattttttttttttttgatagtttyggttttggttgttygagtygggggtgtgttttyggttttttttagatttgggyggggggygggaggagtgagygatttgggaagtttygggggtggagagggggygtttyggggtttgggggygaygtggatattttttttggagtayggyggtgygtttgggatttgaaggaagggtygaaggaagyggggtgygggygggygagttgttygttaagttgtttggygggygyggygaggggagatgygtaagtttgtagatygggggttyggagttyggygtttaggttggyggggggygtgtgygygttaaygygtagagggyggyggttttgtggggygttttaygygtattyggagggagygt

SEQ ID NO: 7023 - DNA, 939 bp, Artificial Sequence
  Description of Artificial Sequence: Synthetic polynucleotide
ygtygtaaggttatgggtygaagtggtgtaggggyggygttyggggaagygattggtagagttgtgygtattgggggtgttgtaggygttggggagagtgtggagaggttgygtggagttgygygttyggggtgggggttgtatttttaatgaagygygtgaagggtaagyggtgatgggttttgygttagtggggttgggagttygttyggggttgtatatggggttgygygtaaggtgaggattgygtatgtgggtttggggtttgygygtatyggaggttgtaggygttggggagggtgtggggggttgtgygtggggttgtttttatyggaagttgtaygttttgggaagygtagaggygggggtgttgttygygttggggagtaygtgaggggatatttagggattgttygygygaatggtttttaaygtatgygttttattttatattttatagtygttatgaygatygggaggttygtaayggttgyggggataagttygttgaggttgttaggygagttaggtttttttggatttygtttgattyggttgggttgtgtttgaaattgatttagttttattatattttttgattatgagaaaataaggagtaagtttaaagyggttgtaatttttyggtygtagttagtttaaggggyggygyggggtttttttygttygggagtyggaggtagaggaggagatggaaaagtyggttttaggyggygggaaattgttaaggggtttttggaggtttttttyggggaggatttaaagtttgaaagagygaaaaggtttggagttagaggtggtggttaagattttttttttyggttttttttagttygttygtaattttttggygtagtttygggaaaaggtgtaggaattgtaggygyggyggttttttagtagaattattttyggtatygg

SEQ ID NO: 7024 - DNA, 939 bp, Artificial Sequence; identical to SEQ ID NO: 7023
  Description of Artificial Sequence: Synthetic polynucleotide

SEQ ID NO: 7025 - DNA, 899 bp, Artificial Sequence
  Description of Artificial Sequence: Synthetic polynucleotide
yggtttttgagggttygggtagttattygtattttttygttaygyggagaaagtygagtatataggtygtagggtgggggttygyggggagagggtggaagtagygggtttttygygtttggggtggtygttgttttatttaggttttygtttgttttttatttttttagattaatygttttttgtaggtgttaaygyggtgtttygtattaggtggtaygyggattttttttagagtttttyggtttagayggagttaggttaaggtagaagygygggtagtttyggygttattttatagygttttatttgtagttttggggtttttattyggttttagggtgtatagtagtyggggygyggttygggaaatgtagttgygttttttgagtatattgtttaggatggtgtttaygtygtygttttgtygttttaggtattttttttygygttttagagattyggttagtttgttttgtygtattygagagygtttygggttttggtayggttatygttygtttyggttttygttattttattygttgagyggttgagttygyggagttgggtgagtgtttgyggttgatyggttygtgggagtagggagygtatagtyggttggtgttggagggttayggggatttayggggtatygygggagtygtygagygtagggaagttagtaggtatttgtagtgyggagtttgtaaggttgaggtaggagatygttygaggyggggagggygggagygagygagygagygagygygtgggagayggaggyggygtgttygtttttaatttyggtatygtygtgygtaggyggggtygttttagttttttygtgtttagaagygttagagatagggagttagtgggygygtaattgygttygg

SEQ ID NO: 7026 - DNA, 899 bp, Artificial Sequence; identical to SEQ ID NO: 7025
  Description of Artificial Sequence: Synthetic polynucleotide

SEQ ID NO: 7027 - DNA, 547 bp, Artificial Sequence
  Description of Artificial Sequence: Synthetic polynucleotide
yggygttttggygaattyggttattttagttttttaygtggtgagtatttagggtagygggtygatttttygaggttttatatttgggtttgaggggygyggttygtagyggygggtgtaggggygattgttagtttttatttygtttyggggtgygttyggaggtygatatttggaggaygtttttagttttygygggaygttaygtttgygygttagggattygggataagaagtgygygtygggtttyggttgygygtygyggggttattagtttgygygtagggtttaggygatygtgyggttatggataygttayggggtatyggtattttygtggtgtgggattaygtggtgttygygggtatgttggttatttyggtygttatyggtatttattaygttttygttgggggyggttagtagatttttaaggattttttgatgggyggtygtagaatgatygtagtgttygtggygttgttttttatygttagttttatgttagtygttattgttttgggtatttttttygaggtttatygt

SEQ ID NO: 7028 - DNA, 2505 bp, Artificial Sequence
  Description of Artificial Sequence: Synthetic polynucleotide
ygtttygtttygtatygggggyggaatttygygttttyggatttgggatagtattagtagygtgaaataygygtattygagtgtaggagtaaataggtaattttttgttttggttatttttagttyggtygtttttttagyggtttgggatagtagygygtggttgggaagaygygggagggggaygygaggtaaatttgygttaagagttggttaggttaggtgagagggagtggtattygygtagatatttatygttggygtttttttygtagattaggtgttggtagggttgtaggagattttagattttygagtygttgttgatygtgtgttttagggtttttayggtgaatttgggygtttygtggagygtatggtggtggtgatggtggtggttggyggyggttgtyggygggattgyggyggtygyggyggtyggyggggygtaatagttgttgttttygttggygttgttggttgygttgtaggygtygtygttygtygtttttttttygggygtttttygttttttattygtygygggggtygtattagggttygagttygggtttgggtyggagttygagtttgatttagggttattgtagtttyggggtatttyggaggttaygattygygagtagatgtttyggaagaggttttttatgtaggttgttaggtagatggyggygtgttygtggatgygtagygttaygyggttgtttattatttagygatataygyggtttayggagaaggtgaggtygtagygggtygatttgtygyggtttaggyggtygtygtyggygttgtttatgttgtagagggatagtgyggttagygtagtygtygtatagtgygyggttaggttttaggatagtaygatttttatggygttttggatttygtatttggtgtatttggygaagygtaggtttaggygttgygtttttttggttatgygtattagygttyggtttattagygtygatagtttggttagygygtttttgggtaggtygtyggggatygtygggtttgttyggggatttygygaaygtagtagtagygtttttagtttttggagagtttaggggatttygtttaggttyggtagtagtygygagtagtgttggtyggygtagtttagtttttyggagttttttattagggtagtgttgatagtgttaaagttgttgtgtyggttgtgtatggagttagttagaggyggttagtagttttygttatayggggaygtygggtgygagtyggaatagtataaagataagttggaggagygtatygagttygtygygttattataattygagtttagygttagattttttagygtttttattaygggttttttattttttttggttatygttgygttattttatgttgtagtygtttgggagttaaagggaaggagyggygaggagtagygagtgtygyggggygyggggagagtygagttygygtygttttggtttatttttttattagtygttgttattaattgttagtattttyggttgtttttyggaattgtygtygttggaatatatagagtagattttggagttattttttagagttygggtyggagttgggygtaatggggagygagttaggtygggaaggaagttttygtyggggtttgttttttttttttaaaataaaaagtgtttagatygtttttttttgagtttygttgggygtagtagttatygggygtyggttayggtgttygtgggattgagattattttagatgtygtygtygtygtagtttygygggtagttggttttyggttttyggtttttagttttyggttttggttygttyggygttagtttgttttgtatyggagygtagtagyggtygtggyggttgtaaattttgtygaattttagtaaatttygggtagttagtgggaygggygtatgtaaagtaggggyggyggagagttagtggaatyggagaatgttaattatttygttttttttttttttttttaaattttttttttttatgyggtttygttttttatataygttttyggyggatatygaggttgtaggaagtggggagtagtggttagggatttggggaatttttgtaagygtagagaygtggatgttgttttttgttgttgtttttgttygtattttttyggagggtggtgggttgggtyggtgatttttttatttaggtgtgttttttatygyggtttataaggtgtttgtttgayggtygtttttttttttgyggttygtattttattttttttttttygtaatatttgaaatatggtttttttttttttttatttttatttygggtaygtaaattaattagtgyggtttttttttagtyggggtttgttttagtatggagggaaataagtttgtygagyggaggttygtggyggtggatattattgggaggtyggattttyggttattygttatttgttattagggygygttaattyga

SEQ ID NO: 7029 - DNA, 1587 bp, Artificial Sequence
  Description of Artificial Sequence: Synthetic polynucleotide
ygaggagtggggygttyggaaggayggggattgggaagyggttaggayggggagaaggygygggtgttggaattatttattagaagaaatttaaygagatttgtyggyggattaaaaaaaaaaaaaaaagtgggtttttttttatttttagattgatgatttygygtttttygygaatgttayggttaaggtaggatgttttaatygttttgttattygtattattttttygtttttgattttygtygtattygtygagattttgygagattttaaggttggggggttttgttaggygygttyggggtatttygggaaagaatagaggtyggagtygygtttttayggtgygttttttgagattttattttttagtttyggtttttayggggttygtagagaatatttttaaatttaggggaggtatatagatttttataaagggaggatggggagaaagtgatggggtttygaagagtygttttagggaaggagagagaaagagtagggaagagaggaaagaaatagaagaaaagtagagaygggagagaggagaygaggggagtagyggggagaaaygtaggaggtagaataagtaaggaaattttttatttaaaagtttttttgggttygagggttgggagttatttgttttgygtygttttyggttttttatygttttggaggtaggagygtaaatttgygagygttygggtttatttttatygttygtttgtatttagatttgggaaggggatggaaggggygggggggtaaaggtaagaagtaagaygaattttaagatttyggttygaggagaagaggtttgtyggygtttgyggttagttyggyggyggyggttttggyggyggyggyggyggttttygggtggyggygygttygggttgygtagttaggygggyggygaaggttgaggtgtyggygagyggyggggygyggagtygttttttygttaatttyggtttttttttttttttttttttttttttttttttttttttttttttttttgttygttagttttttttttttttygtyggagttttagtygggtgyggattggtaagyggygygtttygyggttttttygggygtygygaagttgggaggygygtaaagtgyggtttaggggggatygtygggggttttygttagtagttttttgttygaggtygtagtttttgtttttttygtttttygttyggtygtttggtygttyggtygtttygtygatygagggtttattagygtttttttatggtygyggtagttaatygatgattgaatygaataaagagtagyggygagattaatttttaatatttatygatgggtagygggyggtygagtttyggygagtttyggtagtygtygttygtygttttagggygttygtttgttygttyggggatttttttaatgygtttagggygygttygggggttttttayggtygygyggtyggygttgttygtattaatttggagtygtygtagattaaatygtttttaatattgaaatatygattttatattggyggttattttgggggttatygagaygygt

SEQ ID NO: 7030 - DNA, 5693 bp, Artificial Sequence
  Description of Artificial Sequence: Synthetic polynucleotide
ygygyggagagggtttaagagygtttttttaaaggtttagtttygtttggagagagtgggygggtatygggtttttgggggaggggttgtygtaggtttgggagggaatttagyggggttggtygtagtttgggtaggtygtagtttgggtyggygggaattygttattggattgaagaggygtttggtygtygttgaygtygttgtttttttttygattygttygttygtagtgttattttgtayggatygtagtttgttttyggatttttaggaygtattgtaggaygattttaaagagayggataattygatttygtyggataaggagayggttaataaygagaaygaggagtagaattygggtattaagyggygyggttttygtattattattaaggttaagtagttggagaygtttaaggttgttttygtygttaygtttaagtttaygygttatattygygagtagttggygtaggagatyggttttaatatgygygttatttaggtgyggttyggggygggtatagttttttagtttygttggtttgggagtygggagtttyggaggagtttttygttaagtttttttggttaygagygygtttggttttggtttgggagtagatygtgygttygagtggggtatttgttygaggtyggggattgtgaatygaaagattttatttagttttgttgtttttttggtattgygatttgggggygggttattttatttttttgaatttygtttttygttttgtttatggaaggttgtaagtttttttggggttygggatttttttttatttttatttttygagtagagaaataggygatgttttttttttttttgygtygaagygygggtagataaayggttagaggttggtttyggagtygaggggtygaggygagagtygtgtygggagggaggtttttatagagtygttaggtygygggygagtyggggattaggaagtttaagtttttatgagtygttttaygggttygygaaattttttatttttggttggttygtygaagtttttttttatttttttyggtttaattyggttyggtttygtttygggggagttttggtgyggaagaggygtaaggatttagtaggggtagtttagttagggaagggagaagagggggggagaggatatttttgattttgggtttatagtttttttttttgttttaggtgtggttttagaatygayggtttaaagaaygtyggatgaaatagttgagygttttaggygttyggaggtaygttttttttyggagttygyggygtatgygttygttgggyggtygtttggaygagtttgagatgttggggtttatttygtatatttattayggaggtaaggggygtttygggattygttgtttygtatttgttttatttygggagttgagggygaagggtttyggttagtaygtttttygtygttttagaatatygtttattygttggatataygattatagatatatgtatatttatttatatgttttggatataaaattagatatatggttttatttatatagtgatgtatatagaagtatataygagatatagtgatatatttatttaygtagggtataaggtgtatttatatttgygtttagagattttagggatataygtttagataygatygtaygattaygtataggtaaattttatttttttatatataggtatatttayggagatataattttatagaygygtatatttttattagttatattgaggttagtattggtaaatttatatgtatgyggtttttayggatagaygtatagtttttttgtygttttgtgtttggtgtatttggtatgaggtggatttygagygttggagggtagtgtgaggggaggggatgggggtttggatttattttaagtygtttgtttattagtatygaaggtagtaatttttgttttatgtggyggggtgtgtgygtatagtatttggtagtgttagtttaaatgtyggtagttgttttgggtaggattgtagtttattttttagtttygagatttttggggtttttatagattgggggtataagtgttgggttaattttagatttttatygtttttggggttgtagagagygaggagttttagtttataaagggttttagatggtggtattaggtttgggtttggggtgagttgtttttttgttattttagttttttttttttttattttttttatattggattggtgagttattttaattttttttattygatttttttagttttttattttgagtygtattgtttgagtttattaagtttattgttttgttttttttagggttgagggtttaagaaagtatttttttttttttattttgaagtttttgaatttggagagattttaggattgtttatgtttgagaggtatttgtatttttgagttgtaaygtaggttaggaagaggtaattttttttagaaagtgggtttagtggtagtgttagtaaggtaggagttaggtatttaggtagaygtagaagggaagggaagataattttattattaattttagtatattyggaagtttgaggggggattagattttgagatyggatyggggtttttagaaattgtgggtaaaatgttaggttgtgttttttagggtagagattttaggtagtggtagggtttaggttggagygttttagtygtttaattttggatagttttttaattttggatagatttttaatttyggatagatttttaattttggagagttyggatggtgggygtgtttttyggagtttttatttatygattttttttatttaaatttgtttttttttttataaaatttgggttyggagtagygaggtagtgggggyggtatyggttyggaattttttttygtttggataattaattaaggttttttygaggattatttygttttygtttygatttattttatygttttttttttttgygygttggatgaggtggggagttggatattgggggtttttygtttttygtaatggtggggaagattttttagtttttagygaggtagtttygtttaattygygttgggagatttyggyggtggygatyggtagygggygagaaaggggtygggyggyggggtyggyggtttttygtgggagygyggataaagttttagttgyggtttttgtgttttttttagayggygtttgttttaattattttyggttyggtygttatatgggyggaggyggygygtayggygygggggtagyggttttygttggtttttyggttygtygygggtygyggtygttttttatttttgtttttttggggttttaaatttgtygttttttatttttttttttattttyggggagaattaaattaatggttttaaaaagtaattggtaatygttttagttgttgtttaaattgtttttaagttaygtttttagatattttttatttggatagattttagggtttggagagggaagagggtggtagggggtattaggaattygttttttgattgagattttaggatttagtagggggagtggatttgtagaagagatttaggtttttggattygttggttttttygtygtataaagygggtgtttggtataaggtggttttttygtgaygttttttaygttagttttttagggttttatttggtgggggaaggtaggatatttygaaggttttggaaaaggggttatgtggggyggttagagagttgatatagatttgttgaggtagaatgggtttgtaattyggagtttttatattttttgaatttatgggtaaaatttttatttttgtattttttttgagagagagtttatagttattattagttttttaaaagattttaatgtttttagatgttttagaatttgggggtgttggtaaaattaattyggggtaaggttggaggatygagtttttattttaaggagttygyggagttttggttatgatttagagaattttygtgttttttttttttttttttaagtygttggagtttagtttttttttttttaggttaggttaggtyggtataaatggttttatygggatygaygyggyggtygtatttggygaggygaaggatttggattgggttggtagggygtagggatygagtttagggygttaaggtygtttygttyggtttaatttattagtygtttttgtygyggttyggatttagtttttttyggttaggtygtttttyggttttaattatttygygttttgttttgttygttggtttgtttttgttyggttttttttttygggtttgttagttttygtttttttggaggtttttgggatttatttttgatttatygttttgygttttttgggygtatygatttttttttattttygggtttatttttgattttttygttgtygttttygggggtttttaygygtgtttttaatygyggtygttttttttttttttgygttttttygattttttygygatttttygatgtttygggttttygggttttagtygyggatttygtgtttttgggtttttttttygtttttttttttgtttttttgtygattttttygtttgtttttygttgtttygtatttttgtgttttttatygattttaagatatttaggaattattgtttgtttttgygtttttggtygtttttgtttttttttatttttaggtgttagggaatttgtgattgaagttttygagtttttgtygygtgtgttttttayggtttyggagtttttttygtttttgtgtgtggtttttggtagtttgagttttttgttttttygagattttttattgtttttttttttaatttttttygtgagtttgygaygtttatygttttaaggggygtyggttttygtaggtttttttaattttgggtyggtgtygygygtttttttttttygttygttygggtttttttttygggtttygggtttttygtttatttygtttttttttatygygttttgtttttttttygttttttttttgtagattattaaggygattattaygygtygggaagtaattaygattttttygygtayggttygttttygtaggygtagttttyggtygattttagttttttggyggtttttggtttyggttygaygtygttgggagygttggaatygtygttygtyggttygtaygtygyggataattttaggtttatygatatgatttygtattyggatatatygagtttygagttaggtttgtygggtaygttgtattttatgttyggygaggtatttagyggygggtttagttygttttttttaatgagyggtattagyggttatagyggatttttgtygtattttaatttygagtttaaygaagtygtygtgtggtaaggtygtygggtygtttttygygttyggttttygggggtttygtttygaagtagttttttgaaattaaaaygttygaygtagaygyggtgggagaygtgggtgtttttygggggttttttttygggttygtatttaattggtagttgtttttyggttgggygtygagggggggtygatttttatttttatttygygggttttttaggagttttagtttatygttagtatttttttagtaatygyga

SEQ ID NO: 7031 - DNA, 589 bp, Artificial Sequence
  Description of Artificial Sequence: Synthetic polynucleotide
ygtygyggaggttttagyggtaggtgygttttagtaggtagtagtagtygttattttgggtaagtagtaaatttygtataaatttyggagttattatgtttgttttttygttttatygtyggtttttttgttaggagtagtagaggatgtggtgaatgtatyggttttatygaaygaggtaatygtttyggtagatggttygggaggtttaggagggagttygtyggtygagtyggttggggyggygggaatggyggattttagttyggttttgtattttgtagagtatagtttgtagagattttgygyggttyggagtttttyggtaaatggagtttgggaggtygtygyggttggyggagyggtattgaggtttgtagaagtayggtttggttttgttaaatygtattttgttygttttygttagtttagagtttttygggattttggygagggygyggggtaggatttttttygyggtyggtagtgaatgggagygygtgtaggggygttagttttgtttttttttgttgtgagtaggtagyggggttttagtygtygtttttttgaagtttygagaaygaggyga

SEQ ID NO: 7032 - DNA, 1294 bp, Artificial Sequence; identical to SEQ ID NO: 7022
  Description of Artificial Sequence: Synthetic polynucleotide

SEQ ID NO: 7033 - DNA, 1373 bp, Artificial Sequence
  Description of Artificial Sequence: Synthetic polynucleotide
ygattttygttgagtttayggtttagtttttatatatttatgtygygtttttagtygttgggtgaggagttatttagygtygyggttttttygaggggyggtygggtagygagtagyggtygagyggayggggtgagttaggggygygygyggggygtttagtattgygtyggggaagttygtagttttygtttygaatttgggttygttgaggttgagggaggggaygtaaggggagggaagaagagaagggaggagtgggggttaggggagagggggtggggagggattttggaggtataaagyggaggggaaggggagggaygygygyggtttttattaggaggygagtgggtgtaatyggygttttttagtygygyggggyggyggattyggaggatttagaattyggagygyggyggtygygggygttygggaggaagaggaggagtaygaggygggygggygggtgygtagygygaagaggtagtttyggygttgttyggttyggygttaggtgagtttttgatttaggygtttygygtttttttttygtttttagggtttttygttttygttygagtttttggtgtgygyggaaggttygggttttgttgygygttttaatttggttygggyggttttattttttttttagygggyggttttaggtygggggtttyggttygggggtttaygygtttaggttttaattttgtaagattttagtygttttttagtygygygtttggtttygagttgtgygttggyggtaatggyggagtttttggtatagttygttattttttygygggtagttygggttgggggatgttagtttttggggatygttgtatttgtttaagtttaattttaygtttttttyggtgttygattttgyggtygaatygtaattgygagtygtaggtaatggyggagtttttggtattgttagttgttygyggttgggggttygaggttgggagggtttygttttyggaatatygtttyggtttggtttttaattttgygaggagtttttttgygtttttttttygyggttatggyggggtygttygtattttttatttttttygtttgggygagattggggtgtaagagygtygtttttaaaatttgggaaagttgtgtttttttygtaaaggaggttttagggaggtygaggggygygtttygttayggttyggggttgggtagtggaaggagygttygatgaggttgtttttaggtggttagggttyggagtagggttttygggggatttaatttttagggttatttaggggttttgygttygaggtttyggaaggggttttttygggattgygttttagaggaygttagaygttygt

SEQ ID NO: 7034 - DNA, 1524 bp, Artificial Sequence
  Description of Artificial Sequence: Synthetic polynucleotide
yggggaaaggygtggaggggggttgagygggttyggggttygttyggaatttggggggttgaggggtygggygttgggyggtggagggaggaggtagggggatgyggggagtggtgggggagtttttttaggaagtgagtgtgygygygygtttgtggggagatgaggtagttgttggtgygttttggggttttygattygagttttgtggygggtygtttgttttttttttttttaagtttygatttttttttttttattttttttttttgtattggygggygggyggygggggyggttggggttttagtttttttattttagttttttagttttttyggtagttygggggyggttttagttttagaaatgtygtyggttttyggtttyggtttttyggttttgtygtygyggtygttggggttgttgttatygtygagtygggygtygtagyggttttttttggggtttatatttgtttygttagttygtgttyggagtttttttygygggttatataattaggttttyggtygagtgggygaagtttagtatatttygggggyggggggtaggggagggtttttagatgtttttttagtgttttygaagatatyggaggggagtatttygygtagagygtagttggattttyggggtgygggtttttttttttgttttgttttttagtatttttggtaattgygtaaagttgtttgggttgtaatggtggggtgtagggggygttyggttgttgtatttgttagtgttgggtttaggttgagaggygatttttagtttttataataatgtttygggttttttggtttgggttttygtagygttygattgatygttagygataygaygagaaygaggatttgtyggaygtggaggagatygttagygttygyggttttagtttggaggagaagtttygtagttagttgtattagggggatttygtgtaygttatggagggtaaaggtgaggygtttttatttygggtygttttttgygttgygggtygagygtaygtggggagggagttgtyggtggttgggttygtatttygygttygygttttttattttaggggattyggtgaygaaaygaggtygagtattgggggggtggggtggggtggtgagggaggagggtaggtagtaaggggggtygggtatgggtttaggttyggttygygtttattattagttttagggtgggtagagttagggggtyggyggatagagggatttggagatggataggyggatygagggagggygggagygtygygtttttttttttttygagtyggtygygttttttgygttgtttgaggtgtygtygtttggttggaattgggtttagggygtttttggggtatyggggtaaggttttttaggttygaagtttttttaatttygttttygtttggggtttgttagtgaggaattggtgatgggggygygtygggtgtttgggaygatgtttttttaggtttggggttygtagagtygt

SEQ ID NO: 7035 - DNA, 1009 bp, Artificial Sequence
  Description of Artificial Sequence: Synthetic polynucleotide
ygaagtggygggtygtggttattttttttatttgttgtattttttggagtttyggggygtaaatagtygttgtatttttttttattttygaygggatgatattatagttttttttttagatagygygggtttttgtttygtttttttttagygatygtagygaygattttgttttagggygggggagtagttttttaagtygygggygtttattttttygttyggatttygggyggtgttggtyggggygygyggggaggyggggattagggattttttaggaattagtttgggttgttgtatygttgttagggtygttttgygtttagtygagtttagggygtygtyggttggaygttygttaatttttattgygttyggttttygagygygttyggttggattyggygygttttttygttttaggygtygttaagttttagtattatgygtttttttagatgttygaaagygtttttttagggtagtttatgtttttttgtgtttttttygygaygggtygggtttattattttatatttttygggtttttttatgtttattatygtgtgtttttttagtatttttttttttttttaagttttaatatagtatttttttatatatttttygygtygttttagaggtttttttagttattgtttygtttttttatttttttagtttttttagttttatygaggygygtttttttagtaygtttttatttttttatttttttttygygtttttgtatttttttttygtatttttgtatttttatttygagtttttttgtgattaaatatygygtttttttaagygtttttttttygygtygttttaagatttttttttatattttgtatttttttygtatttatttaygtatttttgygygtttttattyggyggtttttttatttttagattygttttygygatttagygygyggggtattgggtagggatatttttygtttttaygygagtttttygttgtagaygt

SEQ ID NO: 7036 - DNA, 961 bp, Artificial Sequence
  Description of Artificial Sequence: Synthetic polynucleotide
ygtygtygttgtgagygygygaggattyggggttttaagtggtgagaattattygagggatttttyggatgtttttttttttttttgtttttgagttttgtagtatagyggtgtyggtygtyggtagggaaggttgtattttttttgygtygttaaatygtgtttattatygyggtgattgtygtttaggtygtatttttgagtygtattygygygtaggggygtaygggtaygygtatagggaggtygtatatatatatatatatttgtatagggaygagtygggggtttttgaygttygtygtttatttygtttyggtttggagttttttggtttygtaggtgtagygaygtttagttttygtgyggttagygygtygygtyggyggattttgtagtttagagagtttagggagtttagggaggggagyggggygygggyggggtagtgtygtataatygtaggygygtttygygtygttttygtttygggtttattttttttygtygygttttttttagtttatttayggaygagyggattttygattttygyggtagggatattttaagagttttgtttaggtttgygtygtttagtatttygttygtgtygggggttyggyggtttygggygagagayggaggttaygygtagggttgggygtaggggtygtygttygaggattatgggtgggttagygtttygtygggttgttagttggyggggatygtyggygtttgtgtygggtygygttygaggttgygtygttygtgtygtagyggttaatgyggtagtattygygaaygttatygyggygggtttygttggttygggttgyggygtgggggygggggatyggttttgagyggagtttygygggaggaggagyggaygggaggttgggagggattygtaatattaygtaggatyggggtttttaggtgtyggggaaggyga

SEQ ID NO: 7037 - DNA, 961 bp, Artificial Sequence; identical to SEQ ID NO: 7036
  Description of Artificial Sequence: Synthetic polynucleotide

SEQ ID NO: 7038 - DNA, 980 bp, Artificial Sequence
  Description of Artificial Sequence: Synthetic polynucleotide
ygtttttttgtttygttyggtgtaagttyggggtygtyggttggggtggggygygtagygyggtaggtaggtagggttattatgtagtttttagttttttggttttttygtttttygtttygygtttttgggtygttttygtttgttygtattttagagtagttttgattygtgggggygygyggtttygyggggattttgygggygggygggyggtygggygygygyggggygggggyggygygygygyggggagygtgtgggtygggygggygyggyggggaaagttgggygygygagtygaggttgttgtttatttgtagtygygtygtttatttgtygyggagtgygygtttygygttttttyggttygtttyggagttyggtygttttttttttgttatagygggtaattgygtygatatgygataygagtagtttaygygtttyggaagtatyggaggagttttttyggtttgggygagttaaggtgattttttygatgattttttygttttygygggtygtttgttttygtattttgtttgtttttttygygttygattttygttttygtygttagggaatyggtagtagtgtatgggtatttgtttgtttgtttgtttyggtatttttattgtatatatttttttttygtggttttttygattgtttygtgygtayggggggagtttggagtttttttttgtttyggtygggggtgygtttgaggatgtgtaygygygygggggatgygtttggagggtgggagttygatggaaataggygatttaaatattttatygaggatggyggtttttggttygagatttgtygttgtygygtggttttttyggtagtagtttagatgttaaatagttgttygtttttagtatgtaagatgtgattttttaatgtgtatttttagygttgttgtaaatagatygtygygagttygtgtgtgtttgtttygtttaygt

SEQ ID NO: 7039 - DNA, 408 bp, Artificial Sequence
  Description of Artificial Sequence: Synthetic polynucleotide
ygyggygtttttttygaaatatttgagtataagtagtygtaagggygagygtaggaygyggggygtggaygtygggttgggaagagtttygattaaattygygggtggttttgattttttttttygggaggagttttgygtagaggtygtggttygygygggtaagttatttgtggtagtttggtagggtagtttttttyggtaaatagygatatgttttyggtttttgtyggttttggtttggtagagtygtttttygttttttggtttttggtgygttygaggygggagaggagtttyggtygygtggattttagtttgygyggtaattatygygttttgattttaggttyggttgtttagggaaggatagtttagggygygtttagygagttttagggggtaygg

SEQ ID NO: 7040 - DNA, 2190 bp, Artificial Sequence
  Description of Artificial Sequence: Synthetic polynucleotide
ygggtgtattaatgyggtygaaaaagatayggataygtttttttgggatttgagttggttygtagtttttttaaaggtgttaagtaagygttagttttttttaggygttttaggtttagtgttttgtgtygagggttttyggtgtttttttagatttttygggatagtttgaaggggttaggagyggygggatagygygggaagagtaggtaaggggagatagtyggattgygttttagtttttygtgttaagaatatygtygyggaggygyggttagttttttttggatyggatttttygtttttagggttaggyggyggagttttagttttgttttttttttagtttygggyggtttttagagttgagtaagtygggtggagggagtttgtaaggattttttgagygygatgggtaggaggaggggtaagggtaagagggygyggagtaaagattttgaatttgtyggggtygygttttygggttygygtygttagtatttttttaygygygttyggtttygggttattygttttygtyggttttygttttttttygtagtygtagggaagygagtttgggaggaagaagagggtaggtggggaggyggatgaggggtgggggattttttgaygttattagaaggaggtgtyggggtaggaagtgggttggggaaaggttataaatygttttygttttyggttgttttttatygaggttygygggaggttyggagygygttaggyggatatttttttyggttttttttyggtagyggyggyggttyggagygggtttyggggttygggtgtagyggttagygggygtttggyggygaggattattyggggaagtggttgttttttggttggagtygygagaygggygtttagggygyggggtyggyggyggygaaygagaggayggattttggyggtygggtygttggtygyggggagygygggtatygggygagtaggtygygtygygtttattatggttagttattgggatatyggggttttgttgtgygygttgtttagttgtttgttttttataggtgaggygyggttgggggtyggggtttgaggygggttgygatggggyggtyggagggtagagttttygaggttagggyggggtgtaygyggggagaygaggttgtagttyggagaagttggttayggygagaatttgggatattagttgtagygggtaygtttggggtygttgygtttttttttygagggagygtttygaggagtggttggtttggattygygagtattagygtttagatygggttygygttggggttgttygtttgygataggatygttgattttttatttagttgtygggttggggttttattgtygaggttttgggtattaggagtagtaygtatygggatttgtttggtatttagagtttatttttagaggatttggggtaggtaygtagggtttttyggagtygggagtagaggtttttgaaagtttgttaggttgttyggggttgggttgaggtygggattttggtgatattgggtattggtygygatttygygttaygagagtgtaggaggggagtygatttggaggggattygtgtttgygggggagtaggaggattttaggagagggttagygtyggtattttatgattygtttgagtttttaagtyggattgtttyggggaaygttyggygagygttygttttttttygtygttttyggatygyggggttttagtgygttgygtttagttattygggtggggtttttgtygggagtaggygtggtgygyggtttagttygtgtygyggatattagtgattttgatttataagggtagtttagggtttaaatatygttaatttattgatttataagtttagtttttaaaattygagygaagagagggygggygattttgattaaaygatgtggtttgaggaatygatgaggttygttygttatttaagttagttttygttgggygtttgggagaygggyggtggaatagttaggggtygggggttttattagtagttagatygtygttattgaggggttaaagtttygaggaatttgagggttyggattygtagtttttgtttagtggggttgagtggyggagatttgtgtttygtttttttgggygtagagagttagatttyggagygt

SEQ ID NO: 7041 - DNA, 2190 bp, Artificial Sequence; identical to SEQ ID NO: 7040
  Description of Artificial Sequence: Synthetic polynucleotide

SEQ ID NO: 7042 - DNA, 679 bp, Artificial Sequence
  Description of Artificial Sequence: Synthetic polynucleotide
ygtyggtttaggtttygtgyggtaatttttyggttttgttgtttatttygttttatygttttttattttttagtttttgtttagttyggggaagtygygtygtagygttttagatgttatttatttttttttgygaggggtttgtgatagtttagggtgttgtgtattttgtgygattgtttatygttyggtttatgyggtggtttgagtagtttygygtyggtattttaygtatygaatttygggattaygtgagtyggyggagggyggggaggtggygttygggygtyggygtgaattygygtttttyggagtttagygtygtgtttttaggtttyggttttgattttagggygtttaggtggaatggtttygtagttgygygttgttttygygttttygttttgtttygyggaaatygttttygatagttaattygatygggygygyggygttttyggtyggttttygttygatttygygtagggtatagatyggggygtaygygttattygtattyggttattygygggttaggtyggtygagyggttgggtttagggggtatttttaygtgygtagtygttattyggtttggtygtttagaygttttygggggttygygtyggttagtttagttygagtttggygtygygttgyggtygttgttttttattygg

SEQ ID NO: 7043 - DNA, 2013 bp, Artificial Sequence
  Description of Artificial Sequence: Synthetic polynucleotide
ygttaygtagtttagggygtttagtttatatygtygtatatttattgtyggtttagaggtttggtygttgagygttttttggatggygtggtttgatygtttttttttttgatttatttttagtttygagggtygggttttayggyggyggagagggygtygttygtayggtttyggttgtgttatygtttyggattgttttygygtagygaggtttttttttyggggttttygggtggggtyggtygagtygggtgygttatttttttaagttygggygagatgagagttgttagyggtagtygaggttagygygggaygtygttattttagygttaggtyggagttagtagtygyggagtygyggagagyggagggggyggyggggtygggygtggygggttttttygtygtttattgygygttygaattttgggtttygygagyggygggyggtattygttgtaatgyggagaatgtgagaggtagygtagggyggtggggaggaaggggygygggagagggyggyggygagatagayggagagtagyggggagaaygaggatygggttgggtaggtgggataaggtagggaggygtyggagaggtyggattggaagggggggagaagggyggyggygtygyggagggggtyggygtttttygygggagtgygagaagttygagtyggtatttgggtttaggttygggttgggagygyggtygyggttyggttaggtagggtgygggagtygggtygttygyggggtttttayggggagtagyggggtatttaaggtyggygggtttyggaggggtttagggtygygtttygtaggtttyggtygtttyggtagggggtttttgtgagygttttaggagggygagtygggagtgyggagtygggtgtgygygtttgggtgtgygygtgtgtgygygagtgtgggygtygggtagtgggggygygyggtagagattttgtyggtatygtatygtggygagtaggaggtaggagygggaygygtaggggagtygggattttttygygtataygtatatgtataygttgygygtttttaygygtatatataygttttttttgtygygttygtygtygyggttattatygyggagtygagttttgyggagygggaatygaggtyggagyggggatyggaggtagtygagtygggggatgtyggttyggagyggagtygygygyggayggygygttygggayggtgagtgtggtygggtygggaygttgtagyggggttagggtygtaggggygtaggtyggggagtyggtgtgtttgttygtyggyggygyggygygygyggtttttgattgggygggagtttygggggtagyggygggggtggggtgttgggtgygygttygtggggggygtgtaygtttggggttgggagggggygtgttyggtagtttaggtygyggtttygttttatttttatttgtagttgtagtttygaygatttgtagtaagtttgtggagtttttggggygyggygggtygggaggggtggggayggaggygttttgagggtgtaatttyggtttttttttttagagaagagaaygygaggggagtggggygggggygygggtygggtygtttggygggyggaggggtgygtttttagttttttagtygygtagtygttygttttttgggatatttatttaggttygyggygtygygttggagtygtttygggygttagattattatgatttygttagggttaggtaggatygygyggggatagtttttaggtttagggtttgggatgtttttgtaggtaggaggaagatattaaggtttagttgggggagtgyggygaygtgttygggygtgtatgtgtgtgttttygygttttttgttttttaggayggtggttggaagaagggaatttgtygtaaggygygttttattygatttggatttttaggagtttttaagaggtygggggygtttttaggtttgtygg

SEQ ID NO: 7044 - DNA, 1501 bp, Artificial Sequence
  Description of Artificial Sequence: Synthetic polynucleotide
ygtggtttttygtttggtttttygtatttattaggaggaggttgtgygttattaggtattygagtygygggttgtttyggatgtygggggttaggygttyggtggygtagtygtgttaggttattaygtaggggttgtygatggtgatttagtatttgatttgatygtygaagtggyggaagtagagtttygygtaatttttgaagtggtyggttagggygyggttggtttagtygtygtaggygttttgtaggygttggggtaggttttagtggtatagggtgattaygggttgtaygtttagttttygtagtygttttagtaggygtyggtagtagygtagtttttygyggttggggaygttygygttgttattggggagtattygygtttaygagatggagaagyggtagtgagtgatttygagttygygtagygttttygtgtygyggaagaygttgttgtagttgtygttggttaygttttyggtggygggttgtagyggygayggggygtttaayggtagattggygtttygggagtttttygggggtgttagggggtggtgggtgaaygtattttagatggaygtatttttgtygtgttgttgttagtygttttyggtttggtaggyggygttgtttayggtttagaggaagtygtyggggaaggtgttttggaagaggttygyggtttygggggtaggaggtygygagaaaygggtttaggtttgygygtygtygttyggtttygtaygtaggyggyggtygtttaggtttagtagtattagtagtagygatagygayggyggyggyggtygygggyggygyggyggggygttggygggtatgttgygygggagttaggtttyggggtttygygtygygtttttttatgttygygtttygtygygttygttygtttatygtyggygygtttattttygtttttyggygggtttygttggtaataattatttgygagtygggattgttttygttttggtattgggggygggggtaggggygtygagggygaggggtgttygggaggggygyggtagygggtaaggtgyggtaggygtygttygyggaygtyggagaaaggtatttgttttttttagttttygggagtygtgtaggaygtttygtggaygtttaggtttattttttttgtttgtygygygttttttgagagtagttttggagyggtttygtyggggagaaaaggygtygattaatttttttygatttgggggygggattttgtygggttttagyggagygygtygttggggaagtatttgtttttattttttttttattyggaggtttaaagaagtttyggttggatattgttggagttaattagggattggtygaaattttagagggattgttaggtgggatagtygagggggaatttygtygtgygttgaaagggatttttttttaggtgagatgttygyggggagaygygtttattygygtttttttttyga

SEQ ID NO: 7045 - DNA, 668 bp, Artificial Sequence
  Description of Artificial Sequence: Synthetic polynucleotide
ygaggttgttgyggtgggaagagggygttgggagggaggaggatttggggygtagtygtggtgggtgygttttgttaagaagggygggggygayggggygygtaygtggaggaggaggaggaggagggagaygggagggygtgtgagygagtgagataagaaaagggagygygttygtygtygtygtygtygtygtttttttttggagagagaggttggagtgaggttgtgygaagygtygtattttaatgaggaygggtygaggtatatttttgtattagtggtygtaatygaggygtygygttttagtagttgttgtygtttagttyggtttygtygtygttttttagttttgtagtttygtagtttyggtygygtttagttyggygaggatagtattaggaggyggtttttagygyggttataaagattttyggyggygttttttygyggatyggtgygtggtttgttttttttggggaygggagttgyggggagggyggtygggggatttygtagagttygtttygttygtagtygyggggygtygagggtagggygggygtttagtttggtttygtygtttygttygtagtttttygaaaggyggtygttttgttttggttagtttggttygattygggggygttgygtgygggyggtttygg

SEQ ID NO: 7046 - DNA, 1006 bp, Artificial Sequence
  Description of Artificial Sequence: Synthetic polynucleotide
ygttatagtygtagagtttttatttygagttygygtttttttggtygygtygtgttattttgtttatttattgggygatttgggtaygagtatygygatttttygtttygygtagttttttagtatygtggttttagtatatttgtagagtagttaggygtaggaatygaaattygtygggtggtgggygggaagggaaaggtagatgtttaagtgaaggygtttatttttttttttaygtgaatagaagttgatttttaattttaagtgagaaatgatagggagaaaaagtatgtaattattattagaaaaggtgagaggttagtgttgttttttagygaagggayggggtgagatttaaatttatygttyggttaggggagttygtttttagagtatygagaagttggggtgygtgggyggagagagagtagggtgygttygatagttttgygttaggttgtttttaaatttaatatttttttttttttttttggagttattttttttttyggaatatgtaagttttgggtggtttagttttgtygttagatttagtttttaagtgygggggaaggagatgggygtttttagtygygattttttgggaaggtggttatttatttgygttttgaaatagaagaatagggygaygttgtagataatttggtttagttttagttttaggagggttaygaatatggagygggaggyggtagggggttggtgyggygtaggyggyggyggggygtgtagggggttttygtgyggggtttyggggtygtygtttatttttttygagttaygtaggtatttggtgtagtttttgttggygyggygtatggygttyggttttttygtttyggagtttttttttttttttygtttttttttttttttgtttgyggttaatttyggaggttgyggyggagtttygaygtggggygtygatttggagttyggttttgggttttggggygygygggygagygggtagggygttygg

SEQ ID NO: 7047 - DNA, 867 bp, Artificial Sequence
  Description of Artificial Sequence: Synthetic polynucleotide
yggaagtaaagttygtagtgaggtgggttggaagygggttttgtagtagtygygagttygggtttaggtttttaggygyggttggagtagaagtgtagggatygttaygatttatygtygyggtyggtttygtttygttagaggagatttygtaygygtagtygattggttygggttgatygaggggatttagaygttgttattttttttttttaaggtagttttygtggttttgtatgtaggaagtgtttygattaatttttttttyggttttygtagagattttaaattttgyggtttttatttttygttgtatttttttttygtttttttttttaatgtttttgttagtaaaagtttttatttgtagtatygggtatgttgttygtttaaygygtttyggggatttgttggttygtgtttttaatttaggggtggttataygtttygygtttttgtttttgggtagatttttttatttgtgtattttggtttttttatttagtaaagagatgtgygaagtgtgygtttggagaygagtygtttyggtgatttttattygttygtagyggtggttttggtttttyggattygygttygygttttgygggtttttygygtygtttttgttygtyggattattygggtttagagggtygttygtttttagygtttgygagygtygttttygttygggtttggggagygttagygygttttttttaygtyggattttgtagagtatgtttagtgtattttatggaattyggtttttttggggttaggattagattttygggttttygttgttgtygagggggygyggaggaggggaggttgggagatagttagygttttgtttygygt

SEQ ID NO: 7048 - DNA, 1072 bp, Artificial Sequence
  Description of Artificial Sequence: Synthetic polynucleotide
ygyggagaagattgtttggtttygtyggtttygttaaygtgayggttagtttygtygagygttygtattygtttatatttatgattattygtatattygttttaataygtgttaaggygygatygyggggtttttggtagttttygttgtatttttttttttataggggtatttatagttgttatttgtatagggggtaatttttttygatttagttgtggtygtygttttttttagttttttttggtttttygtatttttyggtttgggttygygtyggtyggttttttttttttttttyggttttttttttygtygtttttattatatttttttttggttagtggygtaygtygggggaygagttagagggagygggtygygggggtgtgtatgtatttttygttttttttttgtagygtatattgtatatggtagtgagggggygagtaaaggtggtatyggtttttyggttgttttagygaaggyggyggttgtagtttttgygttgtttttygttttttagygtagyggygattatygygttgggatttygtygaygttgttttygygtygagttygtygtygtygyggtttttaattagtatttgagaggtttttgtatttttttggtagttttatttttayggtgtttgtagggtttttttttgtattttttttttagatgyggygtataatygttattagttggaattttttattatygatattttttggggtttttgggggaaggggggggygggtagtaatygygtygttttatgtttgtggtttgttttggtagttyggtggttttaaaaaaaatttygagaaagttgygtttttttttygggygtygaggaggtggtaaygyggtaagtaatatygggtttttgagatagttgtttyggagygggtgtagggtttagtttagtgtatttgtttattgtygygtttttggtgygagttaagttgtagtagatatgatgggttyggggygaagygggygttyggtggtygatagatggtagtygagggygaaggygtttttgggttagggyggygtaatygg

SEQ ID NO: 7049 - DNA, 1633 bp, Artificial Sequence
  Description of Artificial Sequence: Synthetic polynucleotide
ygataygttttatttatagagttttagagaagttyggattyggttggagttaagagtyggaaaataagtatttagattgtygygtaagttgtyggagattaagtgttatatatattggygtygagagaaagggtgggygtttttaagtttttggtggagtaatgttagtggtygggtatgygggggatayggggttttygaattyggattygaatttttagttgagttattygttaaagttggttgttygttggtagaygaggtyggttttagatygggtggtagggtgttttygggttttgagtggttaatagtaattggggaagtattgaggaattttaaygggaaagttygttttatatttgaaataggtagttygtgaagtttttaaattagttttgaaaygtyggygtttagaggttaggttttyggygagggttttttttagttttgttygttttyggttygagygtygggygttttgtygttygaaggayggataggggagagaggggttgggggagtttttygygtttttttatygtttttgtyggygtaagggygggagtggagaaggygttatttagattgtggygttgggtaaattgyggtygtagtttttttaagtttgttygaattagaaygyggagtgagygttyggttyggtttttygtttgygttttgtagtygtttyggagtgattygggttttttggttagtygggtttgagttattaattaaggggtagaagggygygagagtagygggaggygggagttagggtgttttygygtgtgtatataatgaggyggyggagaygtatattttttttygtygaagaagtygtaggagtattygtygtttaatayggagaygyggagttttatagyggtggtagaaagtgagtattaatttagtaatagggggaaggaaggggaygtygggyggttagtgggaygtgyggtagtygagggttgtagtttgtttttgtagygygttygygtttatttgygattttttggtaggggatgttygttaggttgaattttttggtatygtaygtttggyggattttttygtagtttygagtttttatattygtttyggyggggagggagagtagtagttttaagaggggaagaattatagtttygatttaagaaggtatggtgtaatatataaatttagttyggtaaattttayggtyggtgygttttttattttgttttttaagtygaaagttygttagaggtagyggygygtttttygtygttgtttagygttatttttttttgttagtygaggggaygagtagygtagttttttggattgygtttagtaaatttttataagttagatggaygatggtaagttaataagggttggttgggaaggttgttgttttgtttttttagtttttagatggaaayggtgtaattaaaaygaggaagagaaggaaaagaagtgtttaaaaaattattatgggggtttagagttgtaattygagtttygagtygtagaattttggagygttgygggttyggttygtyggagtgtgyggtaaaggtgggagygygygtyggttttttygggagggagatggataagygagagygagtgtgtatgygygygt

SEQ ID NO: 7050 - DNA, 1143 bp, Artificial Sequence
  Description of Artificial Sequence: Synthetic polynucleotide
yggtatygtgtatagtttgattttaygttygtaygttgggttttyggttttttggtagtgtatttaagtgtatttygygtgtgttyggyggattttygtgtatatygtygtygtgttgttgagtaygaaagattttygagaggagttygtagatgagagtttagttgttgttgtgagattgattgygggtggtagtyggtaagaaggaattgttagtatygattttggygttttttattaattgyggygtagttttttttgyggtgttygtttttyggtattattgtagtttttgtagtaaagttaattttaaaaatttaaataaaataataattttttaaaggttygaaaatttyggtttttattttttttttagtttgttyggyggyggyggygtttagtgagtgatayggygagygtgagtygyggttttagtygggtygagygygttgtttgagttgagtygtygtaggtgaggggttygygttttygttygttttgggygtygygtttggtattgattttgtyggtygtttattgtygtygtygtygtygttygygggtattatgatagttttgagygttggggttataggttggttatygtygtyggtgttygggaggttgyggygyggtyggtttygtgttttgygttygaggttygygatgygygttygttagttttttggtyggttygggttaggayggtttaggggygttggggttgygagaggggttgttagaggggttgygggygggggtttygygygggggaggggtggggaggggygtttttattygagagyggggyggtggggtttttgtyggtttggtyggggygygggagtygygatgygttttttttatttttgygygtgggtgtygggggygtttgtygygggatgtttttgggttggtttgggaagtttagggtyggygatatttygggtttgtttygtttgggtatttagtaggtgttggggggtaggtggttgaggaygaggttattgggtattattatagygttgtatttgttttttyggtattagggtygttgtttgggtaaatttttgggttaaygygygggtggggaggtgggggtgggtagtttggttttagtaggttttygygggggtttygygg

SEQ ID NO: 7051 - DNA, 1143 bp, Artificial Sequence; identical to SEQ ID NO: 7050
  Description of Artificial Sequence: Synthetic polynucleotide

SEQ ID NO: 7052 - DNA, 1371 bp, Artificial Sequence
  Description of Artificial Sequence: Synthetic polynucleotide
ygttttttttayggygttygtttagttyggtggttttaattttttgygggagttgtataygtttyggaaatttgggatagaaattgagttttttttttttttggtggtggtgatagtatttgtttagatttggtyggaygtygtyggtyggagtatttagttyggyggagaaggagttygttyggygttggggattgggatttggagtttttttttttatygtaygtaygtttygtttygygtaygttygttygttygttygtgtttggygtagttttatttyggatggtttttgttttttygygggttygagggygttggaaatttagyggyggygaagyggagaggagtttygygygttttygttygtayggttttaggtttggggtttgygttggagtygygyggggagaggtygtttttgygatygtygygttygttttygatygttygggttygyggttagttyggttattagttatgggttttggttygttttygttgtttttggtgttgtygtygtygyggttgttgttgttgttgttgttgtttttgttgttaggtaygygtataggygttagggtttyggagggaygggygttygagaaggggygyggggttyggaggggttgtyggygagaatatygygygggygagyggagagggttggygtygtygtyggggattyggaattygygtagattggttttagttyggyggygatttgggtggggtggttttttttttttyggtttattttttatttttagttattattaaatttgggagttattgagygggygttggtaygygtygggtgatggggaggtygagatygggtttttygttttgggygtaggagttggggattygygttttygygttgttygtygttttgtttygygtattggtttttaaattggygygtttaagtttttygttttatygtttgtatttygtttatttttttatttgayggagatggttgaagatttggttaaggttatttygggaagaggggagtygtttygggattggggttggagttggagygttagtttttttttyggttgtagttttttagygtttttggttgygtygttgagggattttttatygggagagygttttttgtttttttttygttttttagaggagtttgttgggggaagtyggttttggttygtygttgggaggtttttgggtgtttgggagggttggtgggtagygagagtyggggatygggtaaggttgtagggaatttttggagggtttaggtyggyggtttgtygtgyggttgtgagtttagagygtttttygttttyggtgtygaggtttgtattatttagaaygttataygtttttaatyga

SEQ ID NO: 7053 - DNA, 1545 bp, Artificial Sequence
  Description of Artificial Sequence: Synthetic polynucleotide
ygygttgtgagagttaggttatttaaatgttaygtttttygtatygtyggygaggggataaatgattattttgatggattyggtagtttaaggaaattatygttttyggagggatggyggtagagtaggtygggtatgttgtatttgtttgagttggatygygtgtgagygagtttaygtttttygygggttaggtttagttttygtgttttttgataggtgaagttgagtatttttattaaattttygggaagaataaygattttattttatattaaygtgattggaaattttaatttaagaattggatgtatyggtyggtttatttggggtttgtttagttttttattttatttygygtttttgatgtgttaggttttttgtatagatagtttatatatttaatttttaaaatatygttttttgaagygatgtttaattaggaaaatttgttttaaattgtatgattatttttygtggttttttttttygaatttttgttttgtttattaggtgyggtttygtttygtattygtatatatttttttygtygttgttttgagygtagygataagggtttttatattttygyggttygtaatgtttyggggttaagtygaggtagggaggygttttygtagtttttgattttataattygygygygtgtgtatygagtygygggtatatygygaatatatatatatatatatatattygtgygttttygtttttygttyggttygggtttttygaatttattttygaggygtttygggygtagggttygtttttttttgygggtttttagyggttgttyggtagtggttygtayggttttygatgtygygttttyggtaggttttagagttagttggttattgttattyggtagttyggatttygygtttagggttgtatttygyggatggagygattttygttttygtygttygagtttaggtttgygtttataygygyggygtttataygygyggygtttatttggttgtagtttyggttagggttagygygtygyggttgaagggggygttyggatttttttggggyggygygtagtygggatagtttygtatgaygttygygttttagyggtttygggaygyggttttatttttaatttttggyggttttagtttyggtttttgtgtttyggtyggygtygttaygttatgggtttgtaggttgggagtagygygggtygggaaygyggttggggagagttgggttgggtttttttatygtygttygttyggggygtttaagttggyggggygtaygggtagtaattgagygtattttgggggatygagggggyggtttyggggaggggygyggygtygygttaagggggtgttttgttagaggttgyggyggaggaaagtgggagttagagygtygtyggagtttygggaaggyggtgttygttyggttttaggtygyggttgtagygtygaggggaaagygagyggaagttgygygttggagggagtttattattyggagttattygyggggttygygt

SEQ ID NO: 7054 - DNA, 1545 bp, Artificial Sequence; identical to SEQ ID NO: 7053
  Description of Artificial Sequence: Synthetic polynucleotide

SEQ ID NO: 7055 - DNA, 1027 bp, Artificial Sequence
  Description of Artificial Sequence: Synthetic polynucleotide
yggtgygtgtataggggygtttygggaggggtggtgatyggtagtyggttttttatttttygygtttattttttygtttttgttttttttttagttggtggygggtagtgtggtgatggtttttgaggaggtttgttyggagygtatygatttgatttataaaaattatyggaaattttgtaatttgttgatygaygtggaggagtggggttaggtggttattattagtatgtttattygttaygttygtaygtagtttttgagttttatttagaaygtaagtgggtttagtttaggtagagygggtygaagtgtgtttyggggaggygtttatagattygtyggttttttygtttaggaatttttattagaggagaaygyggaaaaagttttttayggtttagaggaggaygaggttaagggygyggggtttgaggagayggtygtygyggtygttttttttygaaagttttatgttatggatttygattatyggttgttgttgygtaatattaaatttttgttgtagagtygtagygtygyggtggtgatggyggtggygtagttttatttttatttggygtttaaggyggaagtgggygttatygttaaggygttggtgygtttgttgygtagttataggtgygtttygtttttagtttygttttttttttygttttttgtttygttttaygggttgttyggtttygtttttttaygtttattagtygtttttatttttgtttattygttttatattgatygtagttttgtttttygtattggtttttttttygtaaygatttgttttattttttttttttattygttgatttttgttttaatygaggggttyggggtgttttgattygtttttttygtagtgaggtgtagtaygttgtgttttagaaygtggttattatgtttattaagygtygggtgagtttgygayggygggttgttttygttgttygagggtygtttttgygggtattggaggygttgtyggggttgggatyggggtygg

SEQ ID NO: 7056 - DNA, 693 bp, Artificial Sequence
  Description of Artificial Sequence: Synthetic polynucleotide
yggattygttttatttgaggatttygggtttatataggygatygtttyggttttagattggaagygatattttagggattaaagtttttagttygygttyggttttagtttttgttttygttttagagtygtagygagtagggttttgyggtatygtttagagattggtttaggaggttttagtttttagygttagtatatatttatyggttgtagtagttttattagttttgttttttttttygggtttyggttatattaagagtttyggaaaygtygagaattttgygggtttagaaygttygygyggaygttttttttayggygtyggaagtyggygtygagtttgttatygggtatttttttgttgttttgaygayggygggygttgtaagagtggagaagttgtaggtgttgaggygyggtgaaagaaattttgggagttaagagtaygaggagttggtgtttgtgttatatttgtatttgygggtaagaaatygttggtgtagyggygggttagggtttgggagtygatttagggtttaggtgtayggagygggtttttygggaattttgagagtggtygtttttyggagatgaagggaygagggygtagygattttygtatttatttygttttaygaatattygtttygtattygtyggttattyggggataaaaygtttgttygt

SEQ ID NO: 7057 - DNA, 1496 bp, Artificial Sequence
  Description of Artificial Sequence: Synthetic polynucleotide
ygttttygaattyggagaaagtagttygttygtttttttattyggtagttagtttagtttattygagagttgagttygagaagtyggtttttgayggtgttggygtggygtttgttaaaatatgttttttgtattttaatttttttyggttattttttttgtaygtatagttygttyggggttatttyggttttttagygtagttttttygatttttgtttttttttttttygatttatgtttgtttaaggtygaatgtaaaatttatttttaagaaagygtagygggtayggggggtatttagygtgttatgtttygtagtttttttttagttaagattagagttttagattttagattayggaaatgagtgttatttagattaaggattgygygtttgyggtttyggttttyggttttgggtgtttttttggggtgtttgtgygtttyggtatttttygtygtygttygtgagtttgygttttttatttatttaggtttgggagygttttttatttaaggtttgggagtattttttaattattttygttaygtttattttattttttatygyggttyggattgtagtaaaatygggtagygygagggttaaaaagtggaaaggagagygttttttygtgtygtgtagttagttygttaattttttttttttagtttygattttygtaattttaaatgtaatttttttttttyggtttyggtttttttygggttgyggttagygggygtygygttgygaggygtggagygggygggttgtygygaggttgygggtggyggtgtyggttatagtygygagttggygagtgggtgggtgggtgggtggggaggagggagaggataggyggggagagagaygggtgtggggaggggagggagggggagatttygtttttttgtygtttttagttygggyggggggyggggggaggaggtygygatgagggaggggaggagggagggaggaagggagggagggagtygaggaagaygtttygataattygtgygtttygtaaggttyggagtatttgtatatttttgtagtygygyggygagttattygyggyggttgttgtagtttttattgtatttttttttttttttttttttygggtttygggtgtgtgtatgtgtgagagtgagtgtgtgtgttttgtaggtgygtggtgtgttygttttaattttgtttagtaggtgggatttggtgattttagtattattttttttttttttttttttttttttgtttttttatygtttgttgtaattttgtaaagtttyggagtyggagagygygtttygtttttagagttttyggattyggygagttagygatygtygagtyggttattatgttyggtagatygygttattaggygtttttygyggtttttattyggyggyggyggyggyggyggyggygttygygatggttttagaygttgaaggattttgtatttgatygttyggygt

SEQ ID NO: 7058 - DNA, 5820 bp, Artificial Sequence; identical to SEQ ID NO: 6811
  Description of Artificial Sequence: Synthetic polynucleotide

SEQ ID NO: 7059 - DNA, 699 bp, Artificial Sequence
  Description of Artificial Sequence: Synthetic polynucleotide
ygtygyggtttttaaaggtygttgttgtgggtgygtatattygggttggagaaatttyggyggttttgtatygygyggtttygtttgggttttggagggygtattygtttygtttgggttgtttygyggtttatggttaagygttttttgtttagttyggaatygggygttygagttagygaataggtyggttygttttagttggtygagttygattygtygygygttygggttaggygagygyggygyggyggattagttttgagttygtagtttygagggygyggggygggygygtttggggtatgagggyggggygggyggyggtygygtttttaatttyggygttgygtgtgggagyggtyggattagggaattagygttgtaatttyggattagtaaygttygttaaatgagtgtttaatttygattttttatgttttttagygtygyggttgagttttaggaggttttttggttaggtttttttygygttttggttttatttttygggaggttyggtygyggtyggtagagaatttttyggtttgtggagattyggttttaggtygygtygtagttttttttyggtagygtattttattggttygggtagaggtttatgtagttttatagygttyggagttgggagttygtggattagagaaaaggaagtttyggatgtttygtttattaygg

SEQ ID NO: 7060 - DNA, 1845 bp, Artificial Sequence
  Description of Artificial Sequence: Synthetic polynucleotide
ygtaygyggygygggattygagaagagygtttggtagagtataaattttatagaagaagagattttttgttttttttgagattttattttttttttgtttagggttaggaagtttttttygggtttttttagaatttyggttgtttttttatttgtygtttatygttttttggaggtttyggagaggggttyggttyggygagtygaaggttgyggggyggggygygagttttagtttttgggatatatagtyggtgygtttygygttttaagtgygtattttaggaagttyggagtygggaggattygggttygyggttttattttatttttggygaggtygggagaaaaaaagygttagatygttygtttgagggtttagaagtttatygggyggyggtatagattttttygaaatgttttygttttygygttgygagygtataggaatttagggtygtyggggttgtygtggtttggttgaaygtttaaagttaggygagggyggggggttttagtttagttatgygagtttttttttagtggtgttagtttttaygtygggttttygggtyggygggaggygygtgtgtttgtttgtgtgtgtaggggatatttygttttttagtagtttatgtagaatttygtttttygtttyggttttaggaattttttttttagtttagagatttttgygygttttttgtttattttgttaaggygagaaagyggtygtgttggagataaagaaatttttgtttttttttattttyggttttttygttygttygagatatttttyggygttttttttygatttyggygatattgygtttggataygttaggtaggggggtagggtgggygagttygtttttygaygygggttagttgggggtttttygtgaatttygttyggggatattttatagtagtygygtttttatttttttttttttaaatygtttygggtttttgtygtygttattttttgttaaatygtttttatttttttagyggagttatagyggggygyggygtatataaagggggtyggagggtggagagtatagaaggagggagagatttygttagggttygtggtaygggtttgggagtagttatttattygatttttttttygatttttgagatgtttgygaagatgaggaagattaygagtagygtgagygyggttagtatttagtttyggaattgtagttgtatggtgggttygygttygtygggatttaygygggtyggygygaggagtaggggtyggagggygtagyggyggaygtyggagttttygygygtygygygtagttgggtagatattttgygtttyggaygagttygggtyggyggyggtagyggtagyggtagyggtagygataggtaggggttgtttaggygyggygagttygttygttttttttyggttttygtttgtttttttttttttttttttttttttttygttttgygttyggtttygygygtagtttgatagttttgtttygygtttttgttygtttttttttattaattttagygtttaggygttagtttttgtttttttygtttggttttatttagttttygagggygyggggatgtagtyggaygttatttttggtttagagagattgggttttggttatygygagygatygggtayggagttgagtttagggaagtgygygtatygttyggygtattttttaggttggtaaaygttttttttygttygttttttgtttagttttttygttttttygtaaagttttttygatataaagattaatatttggggatagtttttagygygyggygagaaggygg

SEQ ID NO: 7061 - DNA, 1844 bp, Artificial Sequence
  Description of Artificial Sequence: Synthetic polynucleotide
ygattagagattyggygtayggagyggagtttttggtttttatttgtattaatttagttygyggtygtagtttttgttaaagaagtggggtttygtgtttaaggttygtaygttygggtgtattyggataaattttagtayggttygggtgttttttttttttaygtttataatgagggtttggggtaatygtttggtatttagtttgggtgagtyggagtggttggaatyggagaggygaggggygggtayggyggyggygggygygttgggagygttgggttygttgggygtyggttyggagggattataggggygggatttttggagaagtttttggtygttygygttggggtygyggaggtagygaggygygtygaggaggyggtttygatttaggtygtygtagtagtataggaagttgtaatataggtaagtgtaggagagygagagygtgaaggygaagagtagtttgygygtttttygyggttgaggtggtttygygyggtttaggattttataggttatggttttatgggttygygtygggggttatggttttygagggggtatyggyggttgagttgttgtggttttgyggtygtttagagggttygygtggygttgttayggttaygygggtygggygttgggggygtygtttttttygggggttgttgattagggtgygtatagtgttagggggtttygggggtagyggtttttyggggaataggyggttgtatttttagtatttttyggttttaggygatggggtttygggtagtygggyggttygggygtttttaggtttttaygtgygtygggttyggagygygtttagygttygaagttttatttttgattttyggagygtygtttaygaaaygttyggyggyggygyggttgtgygggttggygggtggatyggayggtggygttggygtyggtygygatttggtttttygggaaatgtygagyggagygygttgtyggttttatttaaggagtggtttgaygttagtygygygggtttttygagttygygtygygtttagggatttggttygttttttgygtttttatttttttattttttttagaaatatagtaygygggttttttttatgtaggttattttttayggagttttaggttagttttggggyggtgaaaygaaggtgttaaggtatagtattttttygggaggttggatatttttattaygttggtttttygatatttagggataygaatttaggtygagatygygtygatatgtagattagatagatttagaygtagaygtaggtattttgttttgatgygyggttttattattttgattygtataygtaygtataggtatagaagtataygygttttagttyggatatatttttatatttaygygggggtggggaggagaagttttttaatttgggtttagatatatygataaggatatttttttygttttygatatttygttaaatggatatatatagttyggaatyggatatygagygtaygtaygttttggattgggataygygttgtagaygggatgggtggaggagtygagygtgagtgagatttygtgattatttatttagttttttagtttttagygygttgatttatatttyggyggttygttttgtttygtatttatgaggtaygygygtattttaatttattgttattttattttttttygggtttgtyggagagygagtttyggagyggtagatttygygttaggagggttttttttttagtagtygtygtttagyggtagattgtttttyggggagttgtttagggtattagagggtygtyga

SEQ ID NO: 7062 - DNA, 1480 bp, Artificial Sequence
  Description of Artificial Sequence: Synthetic polynucleotide
ygttttyggygggttttgttgttttaygttygtygtggggatttttttttaggagygttttgtttgggattttttttgygttttagatttttattttggttyggatttttttygggggygtttttttatttttaggttttygttygygttyggygtggyggtttttttttttygtgygggygggtttyggaatagtgtygtyggtygtttgtaggtgtttttttayggaggggygygygtttttgygtygtggtygttgttaggygttagyggtttttagtygaggtgtattygygtttygggtttygggygygtygtagtygtttttttatygtygttygtttygttagttygtttygtaygtttttygygtygygtttttatttyggggttggggggggtatgggttygygtygygttygtygtygtygattttaggtattygagtttyggggygyggygggtagyggtygttgaygyggggygttagttgttaatttygygygyggagtttttyggyggtgtagtttygtttyggyggygygggyggtatgaagattagtygtygyggtygagygtttttggtygtggttttgaatttgttggygttgttgttygttattatygttttttttattaygtattggtgttagggtaygtagygggtttttaagtygggttgyggttagggygggygygttaattgttttaattygggygttaaygttayggttaayggtatygtygttttygtygtygtygtygtygtygttatygtttyggggaayggtttttttggyggygygttttatagttgggagatyggygaygatygttttttttttaggaatttttatatyggtatttggtattygtgygaggaggagtttagygggtttggtgagtgygygygggyggyggttagttyggtttyggttttttyggggyggygyggttatygaggttygagtttyggattygttygtttttttttygtygtttgggtttagtttttagygtttygtttggttaggggygaygtttyggggtagggggygygygtygtttyggggtyggggattagtatggggggaygtgygggaygtttygtygtggagaggtgtaaggtagagtttttattygttgyggaygtttygyggttttggggaygttttygygtttygggaaggygtttattttygttgtyggtyggaggggygygygttgtttttygtttttgaatttatttttaygttygttttttttttttttttttttygyggggtattagatgtttttatttatttyggaaygtttttgggggtgggggtgatgtagggatttttgttattagtygttttttttgtygtagatttatagattygggagttttttatttttatygttaatttaygtygaattttttagaygggagtggggagtgggggagtttygygggttttyggaaagtygtattygt

SEQ ID NO: 7063 - DNA, 5065 bp, Artificial Sequence
  Description of Artificial Sequence: Synthetic polynucleotide
ygttaagygtttttttygggtgyggttttttttygttagtgaggtygygatttyggygtagttgtygttttatttygggttatttttattygttattgyggattagtttttaagtattaggttttttggyggaatttgtaagtttaaatttygttattyggattttttagtagttttttttttattttatttttatttagagttaggagggtgttatygtaygtagagygygtaggtttttggggtgagtagggygygtggagggattttaggagtggtattttattttygttygtygtttattttygattygtataaaaataaagaataatttttattttgtttttgtttttattgatgtatttttttgtatygyggtaygyggagtttygttagygttttgatattgtagygttygtattagygaattayggaatttgggatygagataatggttygtaattgatgtattgttattaataataaagattaattttttttttttygttatttygattatttttttttttttattttttttttttttattttttattttttttttyggggttatygagggaaagaaaataaataagaaattagygggggaygttaagygtagatygaaaygttygtttttaygtygtygaggaygtaaaaaaaygaaaaaagttattaaagtttggattttttaatttattygtttttgttygtttatttttaattaagtatygygtagttgtttttygtatgtttatttygtttggttgtttgttgtggtgtttttttggggggggggaattttttttttttttatatttaattttaaattataygtagattaagtaataaataygtgtgaagttattttygggagttttttgttgygtaygyggygygtattaggagaaaagttttgygggatygttagtttygttaggtttttggttgtatgyggtgttygggaggttyggatttttaagaagttaagattgttagagaaggatgygggyggttttaaataygggtatatttygggaaaggagtgtgtaagtgtatataaaygygttygtgtatttgggatagtgtggattggtgggtgtgygaggatttttgtttgtgagatggaggygggtgygggatttataygtgttttygtataygtttttyggggtttgggagatgygagtygtttatattttaggagtgygtagatttatttttgtygagggatttttttaaatatttagtgagaaataatggtatttgaagtattatttatggaaatattattatttttattttttaatattagttttattgatagtttygtttgtttttttattaaaatttattgtatttattaggatttggygagaaygggagagygaggyggagagggtgtgaatgtgtgtgttagggagtgagygagggtagaagataagtaagagaaaaggtggaaaayggaygagtagggagagagaagggagaagttatattaataaaaaaaaataaagttagtagatgaaaaatagaaatatttatyggtatatatatatatttatattttaaaagaaaagatttaagaagttaagagaaagggaagggttttttatyggagygtagtataggttyggagtataygaagtyggttygggagatyggtgtttatttygygygaatygatygtggtatyggttagatttaagggygttygygaattggggygtttttatgagttttttttttttttgatygtgagatagggtagggattgtgtatttgtatttttttttttttttattatttagtygaagtttagtttagtttagtttttygggygtaagatttygagaattttggagygaggagatttygaggygygaggggaaagagttaggttgagtygygtatygagttttaggttygygggygtttgagttyggtagagggatygggtttttggttttgggttttggggygagggtagggaggttgtattttagtttgagggagatggtgatagagygaaaagttygggygtygygttyggtaagtgtttaaaaagtggaggygagtttyggygtygttaggtagtttyggatagaatatttttttatygttttttttttatttygtttttyggttttgygtygttatttygtttyggaaggttggggygyggttttttttttagggyggggtgtttaggggttttagggattggtttagtttagtgtygggttygttygggttgtgtttttttaggtyggtgttygttgttgygtttagtgtgagtygtagtttttttttttttttyggtyggagttgaattyggagtttaggtyggttttygtttttygttygttyggggttttgyggygttatygttgtygtygttttttygyggagtgaygygttttgtagttaatyggggtagtygggggggaggttygggaggggttttgggyggagtygggtygtttttttattttaygggttyggggttgtttttttygaaaattttagttttaattgttttgggaatgttygaggtagagaaagggagygagggagtaagtaagaagttggaggattagtgtttttggyggggaggggatggggtggygggagaattgtttttttttttagttataaatttattaggtttttaaattttttttggattttttttttygygttttygygagttygggatttaggggatggagaattyggggyggaggagygtygagttaggygggagggaggtygagtygtgggygggaggyggatyggygtggggttggtttttttttattygtttatttttttttttaatgggggtgggggtgggttgttttttggtagtttttaaagaaaygaagaaatatttaygaaaygggaygtttttttttttgatttygtygygggatttttttttttygygggtyggygygtttygttttygagttgggaagttygtagygygtyggtagttygggtttttagttttygtygttyggttttattttttattyggggyggtttaatttyggggagggtatgttaatttgggtyggtttagttygggattgtgggggggggygaaggagggagggaagagggaggggagagggagagagyggggggygtttgtyggggygtygggttygtagtggagaggaggtyggttttyggyggtygggtygyggagtttygggyggtygtaaagagggttaatttagtgtygggyggygyggygygtagagttagtttygyggtyggtttattgggttagygygyggagagataggggtttgtagtaaattaygaattaattgattaaggygagygggtttgaatagygttggttyggtgttaatygttttttaaagagtttttttatgattaatygtaatgtattattgataattataattatagtaggatatatgygygttgygttyggggtyggggagtyggggagggggygggygggtyggygggyggggggagtygtygtygtygtygtygttygattttygtaattttgagaagatttttttttagtaattttttattttgttttagttgatgtttgagttagtatgtygyggaggaagtaagygaagttttaatatttttaattygatttygaagtggtttygttttttyggygagatggtgagtgtttyggttygygtygtggatatatatataygtatttatatttaygtatattyggatttatttataygyggttggttttygygttttttattttatygtygtygyggtttygattgttttttttattyggygtaattttttttttttttttaatttttaatgtgtttttgttgggttttttttygttgtttyggggaaagygagtatatttttyggtaggattttttyggagttgttgggttttttygggggaaggagggygggtatgtyggtttggttttttygtttttgttttttyggggattttagtygyggttaagattygggagttttatgaggygtgggtgygggtggaggtygtttyggtttgatygtayggggtttttagygttttyggygtyggttttagggtattyggttyggttttygtygttyggttttgttgttagyggtaaggaagtttatttygggygttgggttgaatttygagygtgggggagttygttgygtttttttgtttttaygtatattttttttyggtttgygaggtagaatygggtgtttttggaggtttagagttgtaagaagatggggattggtgtyggggygttagygtttgattygttggggttgyggtyggggtggagagtgttgttggtygttagttgtttyggagayggtgtaaayggayggggaaagtgtyggggtttggttygtaaaatttattttygtatttttttttataatatttgtattttttgttttttaaaatttttttggtyggtatgygttttttgyggatygtggtgttttttatttttaggggggttagggaagaagttatagaatagttttttaggtttgygggtggttagttagagtggaattttttttgaaataggggtatttgtttttttygatggaggygataattgtgggtttygaaggggttgaataagtttagaataaagtttgtgtgtgggggttatggtagagagtggaagagattygggtagggagttggggtataaagggaggatatttggaatttttttttgtttttaaaggtgttttayggtatyggttttaaagtttttaggtttagygttygaggyggtgtagyggygttyggattygggttttygggtygtttyggtaygatgttggtttttyggttgtgggaggaygtataaggagtaatttyggyggggttttagyggtttyggatgttattygggatgtttaygttttaggyggtattttggggtgtgaaggagggagttgggtttygatagagtttygaagygtgattttgatyggtattttagtttattaagttgyggtygttygggtttttaggttttyggttygt

SEQ ID NO: 7064 - DNA, 2372 bp, Artificial Sequence
  Description of Artificial Sequence: Synthetic polynucleotide
ygagggaygtaggatgaaagaagttaagagtgtygttagggtttgygttagygtygttagattttygggatgggggagttttagggtayggygttagyggatttayggagaaggagaaaagttttattgtygtgtagaagtttaggttygggtgagaygtttgygaaggttgttagtagyggaagagaaggggygtttttygtgttgygtagtattygttygyggtaggtgggygyggagtttagagttgggagttaaaygtaaaygttggygagaagttttagtttttttyggtagtttattygttgyggggaggggttttttaygtttttagtttttgggagattgtatyggaggtyggaagtaagtygggygaggatgaattatttygtttaatttttttttttyggttttttagttttygtaygtyggttttttttagagattttgtagtygygagygaagattgttttatttttagattttatygaattttttgtggtttgyggagaygaggagayggaygggtttggtggttaatgagagtttygattttttgtttttygtttaatgggtygttgtttatgggtyggggygggattaggagggtaggtaggggyggttygggttggygygyggygyggyggttaygyggttgyggtttatagagttagygtttttttgggtgttygtgttagtgttgygygggaaggtattattattatagtygtygtygttggttagggtgttggataagaygggttygtyggttatttygttagtttaggtattygttgtagtygtygttgtttttttttagatyggtttttatggaggagatggaagaggagttgaaatgtttygtgtgyggttttttttatygggagtttattattttgttttgtttttataatttgtgttaggygtgygttygtaatattttggtgtagattttagagtttgaatttttttagagttatygggtygygggtttyggggttttygattatgattatttggatttggataagatgagtttatatagygaggyggatagyggttatggtttttayggggggttygttagygtttttattatttygtgttagaagttttttaayggygttygygtgtttttttyggttatgtygttatyggttatttatttgttatyggttttggtttyggtgtttygtaatttttgtattatttgtttttagtgttatygtagttttattttggatgatygggggtttygyggtttttttaagaatygygtattggaaggggtaattgatygttattagtagagtaaagtygyggtttttaagtgttagttttgygagaaggygtttaaggaagttatygttatgtgygaatagtgygatgttttttattgygattygtgtygtttgygttgttattygtttygggggtttttagttaagtatygtttggtgttttyggtttagggtygtgtgagtyggaggttgagtttaygtaaggtttttatttgtatagattaygagttggagaattatagtatgtattgygtgtaatgtaagatgttygtgtgttattagtgtttggaggagggtaaatattttagttaygaagttaaggttttgggggttatgtggaaattatataaggtgagttttaagaaaatttatttttaattttttgygttttygattattyggttttgtagtagayggttttygttttttgygtatagygtattttagtgggggygtaatgtaggtgttttygatgtttatttttttggtttggtgtattgtaggaggtatgggggaattttaatyggygtaygggggagttgaatgtttttatagagttgttgyggggatgttttagagygggtttttyggggygygttgtttgygagygggatttagggygtttttttttygyggygggtttgtagttagtggtygyggttagtgtgtgggaaagtattgtatagttgggtagagtygygttagtgtttagggtygttaggtaygttygagggtagggygggttgygaattttyggggagggattgggatgggggyggtggggtygygyggayggygggagtttgtygttgttggataggyggatttggtgaggtayggyggagggtyggggagaygtygtaggyggaatattgatgagttyggttttgggttagatttggttttygagttggagagaaygyggggttttggtgttaygtgtttaaaagatagagyggagagggtagttagyggtygttatggtaaygygaygtgtaggtttgggtttgaattttttyggagttgggatttgagattagagtgttaggatyggagtttgygtagtygygg

SEQ ID NO: 7065 - DNA, 2372 bp, Artificial Sequence; identical to SEQ ID NO: 7064
  Description of Artificial Sequence: Synthetic polynucleotide

SEQ ID NO: 7066 - DNA, 2372 bp, Artificial Sequence; identical to SEQ ID NO: 7064
  Description of Artificial Sequence: Synthetic polynucleotide

SEQ ID NO: 7067 - DNA, 2142 bp, Artificial Sequence
  Description of Artificial Sequence: Synthetic polynucleotide
ygtagttggtttygaggttgtgyggtttttagttttgyggagtagtttaggttatygttttygtggtygygggggagggtattttygayggtygtagtaatgggtaagagattagggtttttttattttygygattygtttttttttgtttggtaattaagygggatgttttattttattttttaaayggagyggattatatatagtagtattttatggttttttttgttgyggttttttygggggaaggtatttttagagggtggttaagttttttttagyggtyggttttygggagggggatagaatttaggagttagttttttgttttygtataaaggttygtttttttttagggygtttttgggtggagygaagyggtygaggggattaygataatgtttttttgtttttyggatygatggttaggtttttagagttaggagygttygggattttagggtagggagtaaagtttatatygtaatttygttattygttygygttttgttagtttgttggggttatagygygtaggttagtagtygtattygtygttgyggggttttttttgygttgagtttattttttgtaaygtygttgttttaaattttgygggttatttggtttygggggtggggttttttgggggtygyggggtagttyggatgagaggatgattygggagttttttgggggyggagtggaaggggtagttttaggtagttttggttaggagtttttatttygttagtttygttgttttagyggtygttgttttagaaaagttaaygagaattagatgtggtggttattgtygaatttttttagagtyggtgattggtttttagtygagggttttagttaattagtttgttgggtgggtttggagtttygtttygtttaggygttygyggagatttaggttygaggttggygyggygyggagagtgggttggaggtyggggygggaygygttgtgtagygggtaagygtayggtygagygagtatggagggggatygggtggtygggyggtyggtgttgtygtygttattagtgttattgttgttgtygttgttaatgttgygggtygyggygttgtatttagaygagttttttttatayggggagtygtggggggattagtttttgtaggaaggygaygaygaaagtttagtygtggtgaagttggygaattttttgtatttttaygaagttygatttagtaatttttaygtaagtttagtttttttttggtatttttttygtagttttttttttggggtyggttttayggaaattttgtttttagaggggaggaaatagattttatttttggagttttttagtatttttgyggtggtattyggttagagagygatgtygttgtttgtttygttgttgtaggggagtaagaatgatttggaggggagagtaagaattgttygtagttaygtaygygttttaggtagaaaaggtggygttgttagggyggttagygggttttgtagttaggatygygagaaggttgtgttygtttgyggagttggggtgttttttttttagatttggaggtttttttttygaggatatggggtttyggggttgtgaggggagtgagaagataggtgaaygagttttagggtttttggatttattgtagygyggagttgggatagtygtaaaagttgygtttgtttttttgaatttagattttttggttagtggggaaggagagagaggttttttgtttaagttagtttttttttttttttgygygaaagggtagygtttttgggtttgagygattgttatttttttgtttttttttttttttaggtgggtattaayggtattatttttatttaggatttttttagggaaaygtagtatgtggattatgatttttttatygatttttyggttatygttttttttttggyggatatygataygagttayggtagaggtygagttttgtatygagaggatatttttttygtagtgttgggtttggtygttygttatgtgygygttggtttttygygttttgygygttttatttttatttaygtttttttggttatttgggagtaggtaggygtttaygaggaggttaagygyggggygttgttttygg

SEQ ID NO: 7068 - DNA, 544 bp, Artificial Sequence
  Description of Artificial Sequence: Synthetic polynucleotide
yggtttttagtyggttttgtgttgttygttgygaatatagttygtgggttatygggtagtygagttatgtaagttattttgatttttaaaaggtagaygtataaattygatttagaattygaggygaattttgaatttatagygttaaaaaygygtagtgttttygtttgttyggttygttgaaggttggttttgggtttgggggtagtgttygygaagggttgygatggtaggtttygttgttatayggtatygagggttttttygtttyggygttaggygtaygtttttttgttatatttttygyggggygygtygttagggttatttgtttttttaagtttygttaggtagttaagggtgaggagyggagagggattyggtygttgttgtygygagttagtataaaggtagygtttgaaatygaattttttattttgggtatygyggtttttttttatttttggttttygyggtyggagygtatttattgttagtygttatggtyggaygagggggttgttygayggtygtttaggttygg

SEQ ID NO: 7069 - DNA, 2002 bp, Artificial Sequence
  Description of Artificial Sequence: Synthetic polynucleotide
ygttttygtttygtgttaagygggtttaaggttygaggttttttygtttataatttyggtgttyggaataygttttygaggggtygtgttgtyggggttattattygygattggatttygygtygtgttgtttttttygggtttygagttygtttagyggtttgtayggtttaggtttgagttgygggttttttttgtggggygygttgggagtgagttttatttttaaagtttattttaaygttttaggtatgattaygayggtagaggtyggtygtttattttygttttttttttyggttagagygtttttgtygggagtygaygatygyggtttgatttygggttttatygtttattttyggttttygttttttttttayggttaggggttatatatagyggaygtttygtttttagtygtttttttgatttttgaatttgggagttagygtgttygttggggtatgtattgttaygggtattgggatttttttgttgttgyggggaggagtttygayggtaggtgggaagatttagtttgttygygttttygttttttagtttttgygattygggtygaggtttttagtttttgggttttttygtttygggtttgagggaggggtygggttttygggtttgtagattygttatygygygtgygtatgygtyggtygygagttttygggtgtaggtttgggyggtttyggttygygtatttgtttaggygttgyggtttagygygttttaatttttagttygggyggagagygggggygggattgaagtatygtgttttttaaagtattttttygtygtyggtagttttggtttygtaaatgttttagygygtttaggygtaygtagagattggygyggtagttttygggttaayggtaygygagtaaagttggttggygatttgggataygtagtagaagttgaggttgtatygattttygtygtttygggggaggtatgggttygggtaggtttaggaggaagttgtatagttygaggttygggygggagtggygggtygygggtaagggaaygtatatttggaaggggttaggatttyggttggagtttggttttttatggygaggaagtygattgggaagggttttttggygaggtttttttgttgtgttattttttttyggtagygtygggygyggggaaygyggggttgtatyggggygggggagggggttttattyggyggtttygaggattygattttggggtygggttyggygggtaggtttgtttaggagttagttggtaaatgtagyggattgttaygttattttattgttattatttattgtaaattattgttttaagttttygggagaattygtygaatttgagaggggggagggggatgggggtgggygygtaggaagttttataggtattagggattggtgatttaggatattagtttttygagttttttttgggaatttttagtatttagattgtttttgattgtagggattayggtggggygttttttttttaagtttttttygggatatygggygygtttttttygtttttgggttagygtatatttttttaygygatgattagtatagttattgtgaggttyggttttggtygygtttgttttttgygagtgataataataaaaattattggaattgtaaggaagtttttggtttyggttttttagtygttgttgttttgggtgtttyggttgyggaaagatttygtagtygggttygatttaygagtggaatatygggttgyggatttagtygggtttataggattggygyggggtttyggggataggtttygtagggtttttttgygtatygtttgggaygtygattttgttaatttggaggataatttttgtttttattttattagtagatttttaaaaatttagtygtygttgaaaygtgttttttattygttyggtttgtttgtagtttttgaygagtttyggtatagttttygg

SEQ ID NO: 7070 - DNA, 983 bp, Artificial Sequence
  Description of Artificial Sequence: Synthetic polynucleotide
yggtgtygygygttygtttgttgtttggagtttttaattyggyggaatttaggttaggaygygtygtygttttgaygtgttgtyggtygggaggygygggygttaggttttaaygattagggtgggtggtygyggggtaggggttggatttgaattygtttttygggggttttggatgygggatgygggatgygggatgygggttygattttttygttgttggtygaggagygttttgagagtttttttttygygygygaggataaatatgygyggtttgttagttagtgyggygttgttttttagttgatagggtgaygtttygtttggaggtttggagattggttttttgatttggtttttttyggtagtttaatgggtaaagtttttygttygtttagaaattagttttttygygygttttttttgygygyggygaggtygagaygtttttygyggtgatagygtgtaaggyggagattyggygygtttttagtttagggaaagtttaggygaygygatygtaagttygagtttaggtttttyggagtygttagggygygtygggttgtttgtttttttgtttttttttgtaggaatttttygtygttygyggtygggatttygggtttttttygggygtagattttagttatygttttgggtyggggtttttttttttttgaaattygtgyggaaggatttttttyggggtttttygttttggttttagatatttttttttttagatttygygttttagatgygttgtttygtagttttttgatagttgygagtttaygaatttyggygggagggyggyggyggyggattgatatgtttyggaygyggttgyggtyggygggtagttygygggggygatgagtygttgygatyggtgaggygtygggyggygggggtatygygtattttttttattttttttttttgtttatttygttygggaggtygagaggaaaygg

SEQ ID NO: 7071 - DNA, 947 bp, Artificial Sequence
  Description of Artificial Sequence: Synthetic polynucleotide
ygttyggtgtttattttygggattttgaatttygttttttttttattttttgttagattygygagggttaggaagggttttgggaggaagygggagygtagyggyggggtatggaagaagagggttgggggygygygttatttgtaaaggttttygaggtttttttttagttttggtggtaatttygtttagygtygygtttttttttagatttaaatttttgttgggtttttygggtggyggyggyggygayggyggyggttgttggagttaagttttgtygttygtagygtyggggygygggggtgyggaggtyggagttttagagyggygygygttttttygtagygggtyggggtyggggygtttagttygtttygtttgttttygtttaygttttttayggagttgyggtatygttttttttygtttttygttattatygtttttagggttygggtatgttatttttttttggtttyggtygtygygattttygtttttttttttttttygttttttttttttygtttygttaagttaaygaattttaaaagaagtatagygagyggggaaggyggtagaaagttgtttygyggygtyggagtttttyggatttggaggatttygggattyggygggagagttaggygggttttttttygaygygtgtgtgyggatagttyggagtygggygtgyggygttgygygggggygggygtagggttygttttaagtgttgygttygttyggygtgggtttggaggttgtttagattatattattgttttaattygaygyggtygggttaatgtaggygtygyggtttttatttttattttttttgatattttyggatatgtttatagtaatgaattygygggatygttttygtagttttygygtttttttttttttttygtttttygygttttggygygtttygt

SEQ ID NO: 7072 - DNA, 1362 bp, Artificial Sequence
  Description of Artificial Sequence: Synthetic polynucleotide
yggttttygggttttgygaagggagttttgttygygaggyggagggtttggtttatygagaagygtattyggaggyggttgaggggygygyggggtaygtagtagagtygtagttyggttyggattyggagygtyggagtygtaggaaggygaggagaaggaaaaaaaggaggttgtygtyggtttttgttttattttttygggtagygttgattygttggtygtygtyggatagggttggtygtygggygygggatttygtgygygttgtttatgttttygtttgtygttggttaggtgtgygygtagtttgttggtttttgggyggtattygggggttttttatgtttygygtyggggttyggygggaggatttyggagaggtagygyggagggaaagagagagagatagtatgagaaygygtagagttgtatttygygggggtygggygttagtagtatygygttgttttatttayggygygtttgtttttygygttgygygtttagyggggygtygagttttagaaattttagtatatggtyggttyggyggttayggtggtygtagttgttttgtttttygagygttttttattgttttttgttttaagttttagagygtagtttattagyggygatygygatygtagyggyggggygtttattyggtygtaagtatagtagtgygtatttgygggaaaggaggaaggggttggyggygtyggggtttttataggggaggggtatttyggyggtagtaatyggygtaggttaaggtattttgggtyggggttgygygygagttaggtggtggtaggtygggattggggagggtttttgygtttttygtttygyggygtygttgttgatgaygygygygggttttttyggtttygygtttgyggagttagtttygttatttagygattygtttyggggagttttygttgaygygygttgygagtygggttgyggtagtygaggggyggggagggaggggagggggagttttagtgyggggagggtyggyggttgygggttaagttttttttttygttttttttttygygttggggagggggttygggaaagaygtggttttygtttggttttggaggatgggaggttttygyggggygggggggayggagggaggtattgagtgtttttgttttygtagtggggatgtagtagtaggtggyggttatgtggtttgtggaggttyggtatttagaggygygyggtgagttygtttyggygggagygtggygaatgtggttttgggygygygggtgtgtgggataygtttttatttaygtggygtatatggggatttggggaygygggtgaaagaggygt

SEQ ID NO: 7073 - DNA, 1092 bp, Artificial Sequence
  Description of Artificial Sequence: Synthetic polynucleotide
ygatygyggygygtygaygtttggygggttayggttataaagygggttttagagttttttttaggyggyggtaaagggggygttygaggttatyggtaagagatagattattggygtttygggaaaatagagtggggaagggygagattgtgtgtttatttaygttygygygggtttgagttggttyggttttggagggtttygggattttagaagggggatagtagtgggggatgggtagaagggggygattygggttgtttaggtttttygtagtttttttgttaaygagaggggttygggygggaatagttygagtygygggggtgyggggygygtagttygttttatttygggagagtygygatygtygttttygaygygtgtattaagtgggggtgttyggttygggataaaggatygggaygyggatygygggygggygttattgtttagttttagygtggagggygagatygtggtttygaatttttttaaatttggyggttyggggygygtgggggggaygtttygttatttgygyggttataaaggagagatttatggtgtygttgtagttagygttygagttttygttgttgtygttgtygttgygggttagtygtttgtatagttggyggggatygggttgagtagygagygttyggagatygtayggygtattyggttgtttttgggtttttggttttagatttttattaggyggagggtttygagtgygggggygggyggggyggggtggggyggggttyggyggayggggygtttttttaygtgattatttttygttttattttyggggyggggttygttagaaattttaagygttygtaatygttttttttygtgggygggatggggaaattgaggttygaggtygtttygttggttggtgtaagaattagtttgtaatttaagttttgagttgttggygtttygtttygtgtagttgaatttaatttattyggggttgtgggtagygtttttttggggttgataygttatttygagtttgaggattaagatyggagtgatttggttttttaygttaaygttttttttagagttygg

SEQ ID NO: 7074 - DNA, 1092 bp, Artificial Sequence; identical to SEQ ID NO: 7073
  Description of Artificial Sequence: Synthetic polynucleotide

SEQ ID NO: 7075 - DNA, 1092 bp, Artificial Sequence; identical to SEQ ID NO: 7073
  Description of Artificial Sequence: Synthetic polynucleotide

SEQ ID NO: 7076 - DNA, 580 bp, Artificial Sequence
  Description of Artificial Sequence: Synthetic polynucleotide
ygtgtttaggggagttygatagagtaygygggaaaagtygggtgtttaygttttygygatttaggttgtagagataagagaaggttaggttttgggaggaygygaggtygtttaggaatggtagggaggttygttggggtttgattttggttttaatggattaaagtttygayggagtaaggtygggtgttygtggtggtattttttattagtggaygttggygaatgattatggaaataatatttaatagtagtgttttttatgttaggtatataatygttttggygtgggttgataattatgtttattttatygygtggtattgagtygatygtatatttagggtttyggtttttagggttygtttattygtttattgygtgaagtatttattttygtaggagtyggagtaggaatagggttgggttttggggygygygtatgygtaggtygtgttttaggaagggyggggtattgagtygagggtyggygyggggyggagggtagggggtggtygtattttttagggtatttgtgyggtgattgagaatygattyggtaattygygggttygggygg

SEQ ID NO: 7077 - DNA, 888 bp, Artificial Sequence
  Description of Artificial Sequence: Synthetic polynucleotide
ygattygttttttggtygtttttttygyggttaggygtattttgtagygtttagatygtygygtttttattygygtttttaatygygagygttygtttgggtygggtygggygttygagattygggagagattaggggttygtaaagtagaagagtagatttagaaagaaaaaaaaaaaagygagaagtgygagaaaaatatattgaatttagttaaatatayggtagatgaaaaaaatattttgtttagaagttaaaaaygagttttygagtygtgagatattgttgygttttygttaggygtgtaggtyggatgttaggggggtaatttygaggttygatggtggtttygattttagggyggatttgygtttatttttagtttttgtaattgygggttaggagaaagggatttgttatggygaagaaaatygaattttttttaattaggtttttttttaaagagagaaaaagtaggtagttgggtaatttaatttaatttgggattygggaygtgtgtttgggygtttttygggtagttggtyggagygtgtgggttyggagtttttagygttggtttygygttgtttttygatgttattagtaaattygtagggygttttggygtaggttygygtttgtagagtyggtttgggaagyggaatttttttyggtttygatgattaggtttttttagggttttggtttaggttgtttttgtgggatagagttttatgaagggatatagaaatagagatagtttttgggyggygttttygggatgtggygtttttgtgtttyggggagggggtattatttttgtttatgyggagygattyggaygttgtaggggtgaygtygggtagygttygttttgattttttaygg

SEQ ID NO: 7078 - DNA, 1483 bp, Artificial Sequence
  Description of Artificial Sequence: Synthetic polynucleotide
ygyggttttgggygttggtagggggaggtttyggtaaygtttgggggttttaggttagtttttttygggttggaaggtatygtataggggttttygttaatttyggttttygygyggtygggatayggttatatttgttygygggggtttgttttttaggtygtygtaggtttttyggagtttaagaggattttataagtagttaaagttagygtygtttgttttttgtagaatattgttttttataagttttgtagattttttyggttttttagaygtttttayggttttygygaagttattttygygttttgaatgttttygaatttttgtagagttttygyggttttttggaagttttygygttygtggagtttttttttygttttygggggtatygygggtttttagtttagttttttygaygttggtygttgttattttttaygaggygtyggtttygatttattttattgtygttgtyggggaygggygygtygggttaggggygattyggyggyggyggyggyggyggyggggygygggaygygggygttagygggggagtyggtttygggygyggyggtttygygtttgattgggttgyggggggtagygggggtttatttttttygggtgggygtyggggtygttagttgyggggaagggtygyggyggyggygattgatagttgggtttyggtttttgttattttggygggygygtgttygggtyggygtgtgygygggygygtgtttgggggtygtygtygggggatgggggggyggggggygagtyggttggggttygggyggygggaaygygtgygygttygtttgagattyggggyggyggtttttggygagtgygygggyggtttygagttttygagggagaggygygygggygygygggttagttttagtatagtagttaagagttagggtaygygygttgttgttygttttatygtttttygaggggattgygygygygtgygttttttygttygyggtygttgaggtgaatgagygygygyggyggttaaagttygatataaaaggygyggggttttatygttygygttttygggagygttgagtttgaggttgygaggggyggggyggaygagagtggyggggttgaggggyggggttttgagggaagygygaggggygtggtyggggtgggggyggggygtygggygggtaygtggygyggtgygttttttttyggygyggaygtttttttagttttygtttgattttagagtttatagaggttatygggggagttagggttygtgttygatggttttatgatttttattatttggttttgttgagtattttgttygttyggattyggggtatttttgattygagggtygtygaggttatyggygattgattttttttttttgtatataaggagtygtggyggggtyggagagttgtagttttggggygatattagtattyga

SEQ ID NO: 7079 - DNA, 3714 bp, Artificial Sequence
  Description of Artificial Sequence: Synthetic polynucleotide
yggygtggttttgttyggaggggtyggtttaaggaagtgttatttattyggagggtggtttygggttygttgattagtttttaygtttgtygtttgagttttattagtttygtgtggtagtggyggtattagtygttttygtyggtygagtggttttgttttgggtyggtttyggygttttygggagtagggyggttgtygtatgggttttggtygggttyggygggtagtttttttyggggggatatttttagtagyggyggyggttygygggtygggtygttttyggttatttgtagggtgtgggggyggaagyggatagtgagtttgggaygttygtyggatttagatttttgygygttttgttttagygtgaygtttttgttaaagttaggagttttgggtaygattttggygtttatttattttttttattttyggaggtttygtttgygggttygttatttttagtaggaggttyggtttttagggatttagygtatatygygagtattttygtygtttygggttttygtygttygtttttttttttaggtygggtygygygtatygygggttgygtagygtatagagggaygtygyggtygattatggtyggggygygggaagagttyggtaggygttttyggttaygttggtttttygggggygtygyggttaygtgattyggtttygaggygtttttatggttyggtttagtygttyggaagttygtagagtttgygagtgtygygaggagygyggtggtttyggtgggygygttygggaggygagggyggggtyggggaagggyggggttygggttttyggggygggyggygaggggygggagtttagagagtgtttygtttttgtttagtgttgggyggygygtggggggggtagggttttygtttttttaygyggtttygygtattttaaggattttaatttgttaggtgagtttttgtttyggggaggggygttgggggyggyggygaggatttagttgygygygygtatgygtttttygtttttttttygggatattagggttgygygttttttaggaggygtygaygtttttttttttataggygggaaaattgaggttgyggaggggaygtttttgtttaaggtttayggygaggtgggtygaggaaggggygggatttyggtttygagatttttaggygtttttttagtaagtttagygtattttgtgtgtygygggttattttaggtttaattgtygygygtgggttagtgtygtygyggtgtgygtttygagtygggtagygatygygtyggygtatttgtgtttyggygygtttgygaayggtaygtgtttttatagtygygygtgtgttygtaagtgggtgtgygygtygtgtygttygggaagygggaggttttgygggygtgygtyggatttgttgttagtaggtttggtagatgggaatttagtttyggaattaattgtttgtttgttttyggttgggaggtygttttttygtttttttttggygattagttgttttgtgtttagtygggttttaaatgtygtyggtattygyggtygtaggtagtttygggttaggtttygggttagttttaaagttygggttaagttaggygggygyggygggygggtttttygtgaygygagtgttttttgtyggtygttgygtatayggtttygagattggggagatagygtygygygttttaggtttgaggygtattyggaaatttygaaggtygtgattyggyggagattaggataygyggttgtyggtatatayggtgaggttttygtagagatttagtaygttaaagtgatttttttygttttgtttatttttttttatttggataagttttttygtttaygtaygtattttttagaaagtggggtgggtgattttttttyggtttttygggtygttgatgattttaggggttygaaaaygtaagggggtatggaataaagtggtaggggttttttattttttttgagattygtaagtttgtagtygttttttatttagtttggggggtyggaagygttttttttattygttttttygtagtttggagaatgaaaaygggygttagtttatatttggatttgggtattgaggataatatttaaattttatttygtattgtyggtagatagtatygtttttygtygttttattgtttygggatatatattttttatatttygtttttttatttatataygtaatatagaagtaygtagyggtygggagtatyggttttgygtttttggttagttatattygtaattttagygtttttatygtygyggygtttygggaagtataagtttatattttatattygtagaatayggggtgtataaggttggagttatttygggggtttaygattagttaggggtttygattttttatttygtttattttagtaaggygtaaggtgagttygagaatttttgygttgygtttttygttttagttatagttttygggtgggttyggttgggatatagttttgaaggtagagggagatttggataaygttaatgggggaaagtgyggtagygagttttagttygggttgygggaygyggtttyggatttgtygtttttttttyggygtagtattttyggtygygygagtygygyggtaaagtaaygggayggygtttaygtygttygtttttttttygatagtttttattttgtttygtygtygtaggaggtggttggtgaagtttaggatgattttygagtttaggtagagygtttttatttttagtaggttgggagttttgyggggygygtygyggggyggttygggyggttggggtagygttatggaagagggaagygyggggagyggtttttagtgtttttygttatygtygtttygttygygygtttattggtygygygttygtygtygtygygtttygtatygygtagggtygttygttaagttttyggtttttygygtttygygttttygagttttgygttygtttygygtygygygttttygygtttyggtttygtttgtttgygtygatagygtttttttygtttyggyggygagttagatattagttaygyggattggaggtgtggggygayggtttygygygttattgggyggaggttggaagttagaatygggtygyggttygygtttatttgtttygttagtttttagaygtyggtgtttattgtygggtattyggtagggagagggtagygyggttgttgtaaaattttttygattggggtataatygtagttttttttttttttaatttgttttgaggatayggygygttggggttttggtttatggaaaygtttagagtttagtgatttgtgtattttatttygtttaygttttagagttttygtttaattttggtttatggatttttaaggtttattttaatyggattayggagygtgygtagygggattygtagtttgygtttttattttaggatttygattgtgtygttattygtggttttttttgtttygatttygattttttgagggttggaagattygggttggttgtygggtaygaygattttatttttagggttygaagttaggggygggggtgggygttttgtttgggtgtaaatttaagttygggtttygygttttttttgtgggttgttttagtttygygygt

SEQ ID NO: 7080 - DNA, 1266 bp, Artificial Sequence
  Description of Artificial Sequence: Synthetic polynucleotide
yggttygggygttaggtagaattttagttygatgttgtygtygtygggggagagggaattygttgggagggatagtygggggttggggaaggaagagygggtgttgggagggtttaatattggyggagttttaggtggygaygygggyggygagagttgtttygaggygggggtttygggtaggtygttttttaygtagtatayggagtagaagatttgttttttggygagggaygggygtygttgatttagtaygtttaggattagttygtyggyggtttttaygygggttttgggttttagtttttygtyggggggygttttttgttgtttatttttttttttttttygatttttagttttttttttttttttttttagttttaattgtagtggtaaggtttggggattgagaggttyggtgagtgttagtttygtaggttgygtyggtgttyggtttttattttagttygggggttttaggtttttygygggttttggggygttggtgttygygtagttttagtygttttygtagttatygtygttyggtttygyggaggyggygygtagygggggygttygggygttgtttttttgaggtttygggggtttagggtggttygtagtgttattggttagggtttgygatttttggggttygtygtygtygtttatygtgttttgtttttygtttatygtygttygyggttygygtygtygttgtttatttagtygtygggatttttattyggygttygygggtagygggggtagtggttyggttygattygyggtttygtttttgttttygggtttttttttttgggttgggaygttttaagtttttttyggggagttygtgtttygaggttgyggygygtggggagtttggttyggttygtygttttttttygtattttggygyggyggggtatygtttygggggygtygagggtygttygttttgggttygggygygttygttttatatgtagttyggggyggygtygtagttttagygagttttaggygggatagaggggtttgggaggagayggtygttagtttygygttattatyggtttyggttgtyggaygygyggttygagggyggtggttaaagggtygaggggtttgtggygtygtygyggygygtattaggaggtgtagtyggagygttggttagtygtagggtttttgggggagaggtyggagygggygattttttttttttygygttttatttatagtttttttygtygt

SEQ ID NO: 7081 - DNA, 1316 bp, Artificial Sequence; identical to SEQ ID NO: 6958
  Description of Artificial Sequence: Synthetic polynucleotide

SEQ ID NO: 7082 - DNA, 10783 bp, Artificial Sequence
  Description of Artificial Sequence: Synthetic polynucleotide
ygagtygggataaaggtttttaaygggagygggatatttgtttatatttygtttattgttygtagtttagtaatyggtttgtatttgtgtttgttygggttygattatttaggaygygtygaygaggggtttgttttaatttgggttattgttatttaygttatatattgggggygaggtagttagggttgtagaaagtygtygagyggttyggggagaggtgtttttatttagygttggtaattygggggtagttggggygyggyggygttygttgtagttgygygygaggaggattyggtgttygygygtttagtttggttygygyggaggagtttaggttgtgggaagattagatttggatttygtaggggtggttttttgtgttttttttygtttttagataaagtttttttttgatatttttttggggygaaygagtattaggtagttaatttatatttttgtattttttttttaaaaaagttttaattagaagaaggggtggtaaatgyggygtggttttttttaattttagygtygaggaggaagtgtaagtttygggaaagtttagtttttagagtygagagtggttggaaattttatattaatttgatttaatttggaaaygtggagygygtatttygaaygtatttaaggygtttaaaaagagattatattaaagaattygygtgggagaagaaaattggggagaaaaygaggtatygtygggttatttagygatttttttttttygtagttttttgggtttttatttaggttggagatataatttttatttttattttygtaatttygtttygtygttttttygttgttttatttttagttagaggttggagagggagggggtyggagagggagggataatagagggtaggaaagagtagggtygtttgtttttttttttattyggggaaagaggttygtagagtttagaggtagtagggttagggttygattttagaygaagttggagttttttatttttatttygtttttttygggatygttygtaaagtagaaagtgaattgygygttttttttggtygtagagaggtggaggyggggggttgggggtgggaggtggggggaggyggagtgaaggaaataaatgagtttttagtaaataaagggyggttggaagggggygggtygtttggtggtggttttggtyggttyggagyggagtttttttttgggttttgggttttttygyggttaattggaattaattatttgttttgttatttttagtatttatttttaagttttaattaaaatattgatttaggaggtttatagaagttgggtttttgttatttgaatyggattttgtttaggtaattattaaygatggaaaggagagattttygtagttyggttttygtttttttttttttttttaaaggygttataaatygttaatttttyggtttgtygggggtgggygygygggggyggggaggtaggaatyggtgaatgttaaagaggattttttttttttttttggtttttgttttgtttttttttttttttttttttatttttattttttttaagatgtaatttgttaaaayggtttttttaagtgtgtggattygygagygaygyggtggttttttgtatgtaaatattgggtttaaaaaaaaaaaggttygtttygtttttgtaattaattgataygttatattttttattttgttttagagggtygttggttgggagygyggagttttttaaaatttataattttatatttgtaaatattgtttttatttatttgatttttaagattygtttataygtggttaatttttgygtttttaatgtttttttttttttttttttatttttttttygttttttttttygtttttttttttttttttttttttttttttttttttttttttttttttttttttttygtttttttaggttygtgagtggagtttagttttatatggattgatygttygggtaatggtttatttttttttygttattagtygttatygygygtygagyggtygtyggagttygagttgaygtygttttggtattttttttggagttagaaattaaggtyggggttygyggygttyggygygtaggtygttyggttttttgygtttattttygygtgtttttaaagaagatagagagaggtattgggttgggttttattttttttttttttatttttagtttttttttttttttaaaaataataattattttaataattaaagttaatttttttttttttttttttagtttttttttttaatttttttttttttygttygttggggtaggggagygttaygaattgattaagtgaagttataattttgygatataaattttggggtttygaattatgtygttgattaatataaagayggggttttyggttaaggatattttagatttgtyggatattaaygatgaggagggttttgtggtygaaggttyggaggaagagaaygaggggttygagttagttaagagggtygggtygttggggtagggygttttggaygyggtgtagagtttgtttttgaagaattttttttaygatagtagygataattygtataygygttggttggttagtatygagggtttttagtattttygtaagtagtaaaatttggttgtygaggtygtggttttttttatttttgtagtygtagttygggttggaygttgggagtgaaaggggaaggggttatgtaagttyggatttttttattyggattygtagaaagatttttaatatttgtataggatgttttttgtttttttttttaagtttttttagtttygggaaagaatttggtttttaaaattttttttaatgygagaagttaaggagaaagagggagaagggttatattttttaggggttggtatatgatgttaattyggatygatggttttagtygtagttttyggatttyggtygttgggagggattggtttggygttttggaggtagttagygagtttygttygggtaygggtggagggtggggaggtttygggtggttygggtataaatagtttattttgttttttgygygattatagaggaygttttgtgtagtgtagggggtgtttagaaggttygaaagtagaaaygaaagtttttaaaaatttgttttaaatggtygagtygattaatgttgggattgtggggtattttttttaaaaatttgtttaygtttygtyggagaggaaatygtttaagggygtyggagtttttaattygygatgatttttagtgttatttttttttttaaatttttatttatattatgtgagttttttgaaaggygagtttttagtttttatttttayggatttttttttttattttgggaggtttygaygttttygttaggygtagaggaaggtaggggttatggtaaaggtagyggggttgggttgttaggygyggaggtttagggtygtayggaggatttagggtgtttygagtttggtgtaggttgygygyggtttttagaygtttgaygygtttttttttttttttttttttagtgtayggtttggttgtyggggygtttttttaggatttaagttttaagttttyggagttttyggtygaygagttatyggataatgataaggagatttygggyggygggggggaygtyggtaagaagygaaagyggygagtgtttttttttaaggygtagatttaygagttggagyggygttttyggtagtagyggtatttgtyggygttygagygygaatatttggttagttttattygttttaygtttaygtaggttaagatttggttttagaattatygttataagatgaagygygttygggtygagaaaggtatggaggtgaygtttttgttttygtygygtygggtggtygtgttygttttggttagggayggtaaattatgttaygygtttaaagtttaggatttggtagtygttattttttaggygggtatttttttttttgtttatagygygtagtygttgtagtatatgtagtataaygtttagtatagttyggttagtattttttagtattygatagtatattttttggtttaggtttagtagtggatttggtgagygtygttttaaygagattygyggttttaggtttaggttttatttyggyggyggtggyggygaggaggtttyggtttttatggtggttattattattattataattattattatggagtygagttgattttyggttttattagggaggygtygggaggttgtttgygtttttttggagtggtagattttatttatttagttttgtttatgtttttttttttgaattttgggagagggttgaattttaygtygtgtttatagaatgtttgygtagtttygtttttttgttttttttyggggggattaaatygttttagygttaatgtygttatttgaaaaygagaaaaagatygattttttatttttgttttygtgtattttgtaaaatatgtttgtgtgagtagygatattgttagtygttttttaaagtaagtggagaatattttaaaaatatagagaatttttttttttttttaaaaaaaaataagaaaatgttaaatatttatggttatgtaaaygttttgataattggtggtagatttygtttttygttgtaaatatyggtggtgattgttgttaaaatgatttttaggatyggtttgtttttygtttgggtttaatttttttttttgtggtttgtttgggtttgttttttgttttgtttttgtttttgygtttttttttgttttttttttttttttttttattttattgtgtaaatattttttaaatatggaaaagaaaattttgtaggtagggagttttttgttttgtttttygggtttttagtttygaatttggagtttagttattyggygyggttttttaatagygtygggygtagaaagttttygattttttaaataagaattttaataaaaattttgtgtttaaaaaagaaaaaaagaaaaaatttttgttttttygtttgttttattgygtygggtyggaggtttgggtttgggagtygggttyggtygttygyggggtttttataggyggtttttttygggyggggaggtygggggtatyggggttttggggygggyggggttttyggtgtaggttttttygattataggttgtatttygygtttaggattggggyggggaggagaaygttyggttttyggtttgygagyggtyggtyggaagtttagggtygtttattttttttygtattttttttggtttygygygttgtttgaatttygggyggtagygttyggttaygggaggaaaagtgatttygggagtygtaaaggygaggagagtaaatttttttygttggtttaaatttatgagtggtttttttagtttgagaagttgttgaagttattatattygatgatttttattttgttatatttgatttattttaygttaagaaagtgggtgggtgggggtttgaggttaagattggttgttttttttttattttttatttttttttaaaatttgygggttggtgttgatttaggagatygttaaggttgggggtgggaayggttagggygygygaggttttggtttagggggtttgggggaagtaygyggggttttgggttygggggagggaggggatattgtagttttttttaggatttttggttttaggaagttagggagygagaatttttggtaattttagtaaattatgtttttttttttttttaygtttttatttttttygggtttttaggttttttttyggggattggatttygggtttttttttttttagygttyggyggttygaattagggtgtgyggtttttttaggttagtttttgagygtggaattgggtggattgttaggaagtagaggtttgggggtggggtgagtttttyggatgggaagtgggtatatagtttygggtaygttygggaagggygtatttattttttyggyggggaayggatttygttttatttttgttgttggaggaagatttttttggtagatgttggygtatatttggttaygygggggagygttttaggaagtttggttaattggaggatgagttttttttttttatttygygggtttttaaaaatatttgggattttagtttagagtttagygggtgttgtagaygttgagggattgaaygtyggygtatttggaaattgtatttttgtttttttygaagttgtattattaaggttggggggttgggtggtagtgaggaggtygggtaaaaggagyggttttagttgattttttygttttttgtagttgatgattaggtttaatttaatatttaaagtaaatatgattattygtgygattaaatttgtgygtygatagtattttgygtagtagtttagggaygygatgatattttattttygygttttatatygtttttggataattgagggttyggaagtttttttaatattttagtaaaggtttttttttattttygggtttattttyggggaaagggtagtttttttaaatgttaaaaggtttttttttgttttttatattagtttggtaatgtttgggggtttatgttttattgtttttaaaggttaaygaattttttttaaatagtttgttgtgtaataattgaaygtttaatttgttttggtattaattatttaatatttatttgtaattttttttaattttaaaatttttttgggaggaaaggtgagggttttaagttttttggagyggagttgttagaaggtttgaggttattttgatttttttaggttttagggtttttagggtgagaatgattataagagatttttaggtttttagagaggaagggggaagygtggaaggtttttattttggtaggtttttattatttgtttattgaggataaatttggagttgtggttaggatygygggtttgtaatttgggtgtgygtttttgtggtyggtygggagttygggaggtggattyggygttygtttttttttgttttygggtttttatggagttaataaaagygtttgyggagttttgtgtggttttaattttagygttttgggagygtattyggygyggggttygttttagtagtttattttygtttaatttatagygggyggtataaaatygtataatgggaaagttgggagtyggagatgttagaggygtgtatattaaaaagggatagagaaaggatygyggggatagagagaggggaagaaggagaaggggttygttttttatttttygttttatttygtattatttagygygtttatygtyggtagtgaatttyggagttaggtagaagtttttttggggttttgttgggtttgttattgggtttttttgttatttaygggttttatgttggattttatatggttagttgggtygagggagygygaggagggattygtataaaatttaaattgtgttyggtttttaaattttgtattgttgtttgtgaaaggaagaygtattaaaaattygtgttatatttattggggaggaggttggaggaggggagaaaaagttatttttgtttttgatggtttyggagggygtttgtttygtttaggtttygtgatattgaaagttggattttttttattttgttttttttttttaaaatttttttttttttttttttttataatttygtttttataatttttttttttatttttataattttttttttttataattttttttttttttttatttttttttttttttttttttgtttttttgattttaaygttgggatgggagttygygaatttgygtttttagggtttggtttatttgtgygtattttgtttattgttgtgtgtgtattaggaaattaatttttgtttgggagttttgtattatyggatygttttggggtttaggaggtaatttagggtatttagggtttgggtgatgttyggttttttaygggtttagyggtttttgggtagatgaaaatttattttttgatttygtaatygatyggtttygaagygttygygygyggagtygtttttttatttatygygagaaaggttttgagaggttaagggtgtygtttagtttygggtttagttagatttgggttgtagtyggttttaaggygatttgygttyggtyggattatttggttattaatttygaagagttaaagaygygygygtttttttgaattatgygyggggatttattttattggttttttggtgygatgggaaattattttagaaattttttttaatagygtttttttttatgttggaggagggagatattttttttttaatttttaatgttttttgtatygygtgtttataaaatttagtattagggagatatagtagggtttttaaggaatttgtttattttttgttttttttaagyggtttaaattggygygaggtagtyggaaataatttgggttatgtttttttttttgtaattgttaggttaaaatttttataagtagtttttaaataaattatatgtattaaataaaaatagtttatgttgagttttgtggaaataaaaattggaatttagatatgttttttataaagttattyggtttttaatgagtagaattgagttggtggaaatttygattaatgggaaatttggatgygtttttttttttatttagtataayggttatatttagtagaattagataatttggtaagagtggaagtttttttttttaatattttttattttagatggggaaataatttatttttttatttattgattgttgggtttagttgagatttggtgtgtatttttygagtttttttaagagtttggttattgaaaagttaatttaatatttatygagtataaggatagtttttagaygtatttattaaggtttatygttaagtgattatttggattgaagataaaggttaggggagggggygtttaggtatattagattttttttatttgggttttttttatttagaattaggaaatygggagygygtttgtgygttgttgaagtttttttttyggtgttaagtggygggyggattagatattgtgttgggyggtattttaggaaatatgtatttgtggttttttgagaggttaagygtagtgatattttaaatygtgtygatatattattttttatttaggatttgtaaataaatttttgattttttyggygtattatagtygtygttatttygttaaggaagygatttgagttttattgtttttattaaygtttygagatatatatatatatatatatatatatatatatatatatttttttttygtattttgatttttaaaggttttattttttttttttygaggtatygttattaataaagaggygaataggttttagygtygttattygagtaagyggggaaatgtgggttagtagtttaggttygygygyggatttygygtaygttttaygygttttttygggtyggagaatygagygtgtgtygygtgttgtygtygttaggaggygttygagtttagygttttygagygtttttgygygygggttygggtagagttygggagtygtyggaggtagttgygtattagyggattygyggttygggtyggagttyggtgagtggtgttaagaggtggyggygagtyggaattttggggagagtygygagttagayggyggygggtgtttgggaggtgygagtygatttgtgttyggttgtggttttttygttatgtttttttttttttaygtgygtattatygttygttttagtttyggtttttatygtgtttgggtatagattatagtygattggtttaggagygttttggttattgggagggttttattaggygttagggygygttgttttygygattttagggtttttggyggygtyggtygygygggtggaygyggagagggyggtgttgygagggttyggagagtgggtgttygygtggggaggyggttygggagygygggagygatgyggaggagggattyggtttggttgtaggttttyggggygggggtttygggaaggagagattttygtttttygttygttttggattygggtttygtyggattttyggtttttgtygttygtygtttggaagyggggtaggygtatagtttagaygttagggagagaygtttygtygatttagatygtggggttagggttygggaggtaagaaygttttatatatagtagggtattttaggtaatttttatttygtgttgaggtttyggttagggtgtaaaggtgttygggaatggaagggataygagggtgtggaygtttygtattttatttaygtttggtgttttttgagaggttgggygtggggtagagggtaggggataagggggtgatattttttaaggttttttttttaataaaagtagggtttgtagttttagtttgattygttgattgttgggtggaatygttttatattaaaggtatygtggttttaaatattgttttttttatttttttaagttttygttttaaaattagttgtyggtgggtyggtgagggygtttgtagtatttaggtttttygyggggyggygyggttggataagaaaaggtttttyggttggggygygtagygtagtttagatatttgygggattygagatgttttygyga

SEQ ID NO: 7083 - DNA, 810 bp, Artificial Sequence
  Description of Artificial Sequence: Synthetic polynucleotide
ygagtgtygattygtttgggygggattttttgagygtatttttttygagygygttagtgtttttgggagaggtttgtttgggtgagggattggaygtyggttttttygtaagtyggtyggttgagggtgggggtygaggyggggtygggaatagttttyggattagggtttagataatttygttyggygtttgttttttygygygtatttgtygggttygggggttgttagaagaggtygtagttygygtttttygggtttttaygtttygtagyggygttttttttttyggyggtayggattggttgyggygtygttttaagttygtttygygttgtyggyggggggygtygyggattagagygygttgygtygttatygtygtygttatygtygtygtygtygtygtygttagtagtatagygygtttygggtttygygygtygttagtttttggttygttygtyggtttygtygygttygttagtttygtagyggagtttyggttyggtttygggtygtygttattaygtygygygtygtatttygygttaagaatggggyggttaagttgtttaagtygttygtygtygtygtygtygtygyggtygaggygttyggygtyggygygggtatggagygttygtagagtygttttagtttgttygtttttttygaggygttygttatttatttttygtgtatgaattttttygaygaygaggaygtaggtaagygygyggttygttttttagattttyggggtgtttygggatttaggttyggtagtttttttttygattygtgygt

SEQ ID NO: 7084 - DNA, 1142 bp, Artificial Sequence
  Description of Artificial Sequence: Synthetic polynucleotide
ygygtggagygyggtttyggggtagyggagagtggggttttaatatttagtatatgtagattttggggyggtgttgttaggggygyggattygggattatyggagtatttgtatygyggggaaagttgatagggygygygattttaggaggttgtygygtygtttggtgygtgaagttttagggtagyggagygyggggattttgaaggttgtygygtgtaggygaaggggtygtagggtggtygtttttgggagagtagayggggaagaaggtaaygggagggagggygtagygygagtagtttyggaygygggtttaggaattggtygygaggagygtaatttagtaggygygttagggttttyggatttaaggtgyggggtttygattgggygtttggaygtttygtgayggtggygtygttgttattgtttygaagygaggygaggttaggygttgygttttyggttgttygtttttttttttygtttygygtttagtttttttttttygtttygttttttgtttygttttttttttyggyggttgttgygtygygttttyggygtattyggagttyggyggggatygggaggtagagayggggyggtygtggtttygagggygggagttgagtygggtttygggatygaagtttggyggyggtttygggaggtagagygggtttttygggygatttttaggtttttttygygttttygtttyggattygtgggtagtyggggggaayggaagtygyggtygggttaatttygaggyggggaygtygygaygggaatttgaggtgggaattttgygygttgtagtttygtygggygttattaaagygygaatyggatttygagtttgtaaattygggttygggggyggttgtaygtggtygtggttttgaattttttgygggggtttygaaattygtttgyggggaggttagggygatagaggattygggagttatygttggtgygtggyggygtggagygygtttgttayggttaaggtgygggttyggtttyggtttattttaaggggttatygggatgygaagttygggaygttygtygtygyggtgatttyggygggggygtatttyggttgtgggtygaggtttttttttyga

SEQ ID NO: 7085 - DNA, 2885 bp, Artificial Sequence
  Description of Artificial Sequence: Synthetic polynucleotide
yggaggtttygggaaagtttattaagttttaygygtttygttgatagatgtttaggaagyggttggtagggaagaggyggttttgtagtttatagagttttttttttattttyggggagttttaggtygygttgttttttattttttygtttttttyggtttgtaaygttygtggygttttttaataggttttagaaatttttttttattttgttttttaagtttggttatagggygtttygagtagggagtgtgygggtttygggtataygttgygtygyggttgtattagagygtttaygattttgatttygattygaagyggttttttagygggatagggtgttggygttggygttgttgttattgyggygygttttttygttttggtttttgygtgtygttagggatttttgygttagggttagatttaaagayggatygaggygggtgtttatttgggaygygtgygtttggtggyggaattttyggggyggtyggaggyggyggtyggggagtygagaagtaagtattagygttttaggatygygygygtygtttygygtygtttygygtygtttttyggtttagagtttttattttyggtttgtgagtttgyggygttggtggagttyggttttaggaagaggagtttattyggttttttttgattggatagtagygaggttttatygggygttttygyggtttaaaatygaagygggggygagggggaggtagagttygttttttgygygtygyggttgggagggagaggaggtgggagagaaggaagaggyggaggaggtagygggygtygaggttttgggattygtaggtaagttagatygaygygtagagtygggagttttatygtagyggtagyggtagyggygggttygggtyggtttygggggttgtttatttatatgagtattygtttattyggygagttttygagtttaggyggygyggttatggtygagtttaagtygttgtygggggaygygtatttggtattaagttayggttaygyggyggyggttgygggtttygtttayggggyggygygagaattygaagyggttygyggttayggtatttygggttygggyggygattttttygyggygtttgtatttygygttttagtttaggyggyggagagtagyggygaatagagyggggaygaggaygaygttttygagtagyggyggyggyggygygggttagggagygyggyggaygggyggyggyggtygygagagtagyggtttttgyggtttagtattaaygygygygagyggyggygtatgtaygatttaaaygaygygttggaygggttgygagtygttattttttaygygtatagttygtyggtgygtaagttttttaagatygttaygttgttgttygttaagaattatatttttatgtaggygtaggttttggaygagatgyggygtttggtggttttttttaattagggttagggtttggtygygttygtaaaygtygygtttttgaygtttttyggttaggttattgtgtgtttttttttygtaggygtygttttggggttttgttttgataagtgygtygtttttttygggaygtttttygygttttgtaaatattgttaygagaagtygtgatygygygggttttyggttttttygtaygygtttttygatygtttttgtgattgtttttttgttyggataggaaaggtttggagggattttgtagattaggaggagggggttygatttygtttttagtttgtgygyggtggatagtttagygtagygggaagygttaaggtygtyggggygygggattgagttygagagtyggaygttggattttgygttygggaattygyggtatttattgggtattgtygggatttagtaagtttaggaaygggggtgggtagagtatttttygggtattgtygttygtttttaaaagaagattatygyggggttttagggttayggygaggaygggtattggttagatttyggataggyggttttggtttygggygtaygaaaggtggagaygaagaaaagtyggatttattggtttttgatttttttgtagtgggtttygygttttygttttagtyggtttttygtgttaaattgtagggtagtgttttgtttttgaggaygygygtggtyggtattttttatttyggtgatttygagatttygtagttttgyggagagtttaygatggtygtttgtagaggagttggatygygggygtaggaagatttyggggaaggttttttttaagtaggagtttgttttatttatttgggaattggaygtygtygtyggttgtttygaagtttgaggaatttgttttttaaatgttttttggtttttttttttygtygttattygttgtttgggaygttygyggggtggagttggatggagatygttttgygggttttttgtttyggggggttgygtggaggagggtttttatagttygygttttatttaattttgayggttaggggagggtttygtttagttttggtgtttagtaaattttttttttatygattttttttttttttygagggaggaggtygggttaygggtgagtaagttgttgygggtttygtgtttygtygggtgtgaayggagatgygttgygtagtgttygttttgygtagtttttagttttgttattattygggatttagggagtygggtagggtgttttyggggatttatttgttygygtyggtttgygtttygyggtttygtygtagtattyggttttattaatttaattttttyggttgtyggtaatgttaaggggagagggtygtygttttgtaaygygtttgtttatagygt

SEQ ID NO: 7086 - DNA, 1460 bp, Artificial Sequence
  Description of Artificial Sequence: Synthetic polynucleotide
ygygtttagttggaatgtagagatygtygttyggttayggygtataggaygattygttygttygtygygattgtgtatgggtttygggatayggggtygtygttgataygygyggtttygtygtyggtttygtygttttygtygygttygtygygttygtttygtygtttagttygtagygtagtttttygygtagtttygagtyggggygttatggttttagttyggtyggtygyggggaaygttaggyggtagaygagtygygtattyggyggtttatgaaygtttttatggtgtgggtaaaggaygagygtaagyggttggtttagtagaattyggatttgtataaygyggtgtttagtaagatgttgggtgagyggygggagggyggtagagaagggggagagggyggggggggttygggtyggggtggggyggggggggtaggggtttygggtygyggggtgygggggttgygttaaattttygyggggygtttygggygtayggagggttyggygtttattygttygayggygttttatttattggygtttayggttygtaggtaaagygtggaaggagttgaaygyggyggagaagyggtttttygtggaggaagtygaayggttgygygtgtagtatttgygygattattttaattataagtatyggtygygtygtaagaagtaggygygtaaggttyggyggttggagttyggttttttgttttygggattagygttttygtagttatygttygagttttttttygyggygtttggttyggttygygtttttygygagttgttttygttgggygtygagttygayggtttggggttgtttaygttygagygttygtttttggayggtttggagttyggygaggttgttttttttttatygttygyggygttygaggattgygygttgyggttttttygygygttttaygygtttatygagttgtygygggatttyggyggttgttayggggtttttttggyggaggygtttaggatygygtttttygyggygtygttygttggtttgtattayggtattttgggtaygttyggttygtatttyggttygttgtygtygtygttygaggtttygtygttggagagygtygagtygttggggttygtygtygatttgtgggtygaygtggattttatygagttygattagtattttaattgtagtyggattyggttygaygttttygggttttygtattaygtggtattggttaaattgggttygygygttatgttttgtttagaggagagtagtttgattttygygttgtyggaygttagtagygyggtttattatagygygtgtattttyggttaggtygtyggygtygttygggtttttgtagygttttttttygtagttttygygatygattygatygygtygttgtygttttgtttttttataygygt

SEQ ID NO: 7087 - DNA, 1560 bp, Artificial Sequence
  Description of Artificial Sequence: Synthetic polynucleotide
ygttttttaatygaatttttttttttgggaatygtagtttagygyggtaattgagttatygtaatygggyggtggggaggaagggtggtttaggaaatyggygagggagaaaagyggtggaagggagagttttttttttggagyggttttagtagtataaagtgttggttatagygtttttttygtttttagattgaygagtagtggygtggagttagygyggaggttgttttttttttttttygagttygtagygyggagygyggtttagtattaayggagtygggggyggygtttttgggatggaaaagggttaaaggggaggagtggggtgggggtgggggttttattggtttattataaaaggatygttyggttgttyggtttttgtattygttggaaagyggtttygagttaggggttattgtaaagttagggtgygttatyggayggagaggggagagttttgagtagagtgagtaatatygtagttaaggyggaggtygaagaggggygttaggtattaattttygygttgttttagtttyggaggygttttagagygttttttgttttagtagagttattttgtttgygtttgttttttagtgtttttaattttgygttggaagaaaaatttttygygygtyggtagaattgtagygtttttttttagtgatttygggagtttyggttgtagtyggttttgygygtttttttaaygaataatagaaattgttaattttaataatttagagtaggttaaygaggttttgttttttygattygaattaaaggtttttygtttygtgygttgttaygagyggtgttttttggggttttaatgtagygagttgtgttygaggggttyggaaggygtaagttgggtagygatatggggaaygyggagygggtttyggggtttyggagttttgggttagtatttaygttgttgttgttygtygyggygttattggtygtgtyggaygtattygggygttttttygaggaggaygaggagttagtggtgtyggagttggagygygtttygggataygggattaygygttttygtttgtaygtttttgattagtagttggatttggagttgyggttygatagtagttttttggygttyggttttaygttttagaaygtggggygtaaattygggttygagaygtygttttyggaaatygatttggygtattgtttttatttyggtatygtgaatggygattttagttyggttgtygtttttagtttttgygagggygtgygyggygttttttatttgttgggggaggygtattttatttagtygttgttygtygttagygagygtttygttatygtygttttaggggagaagtygtyggtattattatagttttattttttgyggyggaatyggtagggygaygtyggyggtaygtgyggggtygtggaygaygagtttyggtygattgggaaagyggagatygaagaygaggaygaagggattgagggygaggaygaaggggtttagtggtygtygtaggattyggtattgtaaggygt

SEQ ID NO: 7088 - DNA, 5118 bp, Artificial Sequence
  Description of Artificial Sequence: Synthetic polynucleotide
ygttttttttygygatagagttttygagtttagygtaggttagttttygttttttygyggtttttggtttttttgtygttagaaygygtyggygttagtyggtttatttggygtyggaggtgaggygyggtaggttgtyggygtttatagtygataygtggtggtgyggyggyggtatttggtatatgttgtaggggtagggtatgtygttttagtgttggaagttttygttygttttattgtygtygttttygttttttagyggggyggtygyggtagtagayggagatttgagtaggtygtgyggtggayggatggagtygatygayggtagttyggattygggtagagaggygttggatatagtygyggttgtagyggyggtagtagtygttgyggyggygggyggtaggatggggtggtgtatygyggggtgatgtgyggygtgygttgttgttgtygggtgygyggtggyggygggtaggggygyggagtgygttaggtygtygtaggtygaygggtggaagttagygtggtggttttygtagatttygtttattagtygttttattttttttagygagttggtgagtatgaggatgtagttgygygttagtagtagygtggygattttggaaagtttgygtatygaagggtygtgtgygtayggtatgatttygyggaggttatttatggygatgttgaggtygtgtatgygtttgygttygyggttgttgattttgagaygtagttgttgtagtttyggttttgttatttgttttttgttttttttggtggaygaygtagtygtygaygaygtagaygaygaggtgttggaygaggatgatttgaagttattgttttttagtttgtttttaggatgygygttygtagagtttatagygtygygtagttyggygtttagtttyggygggtagttattyggggtggaygaggatayggtgtttttagtgaaggygttgtygttgttgtttttatttygggtyggtagaaaaaggttatygggttttggygaygaygggyggttggatattaggttggygttygagtttatggttttaggggaagatagtygtygtagttttygtagggttttttttttttyggattygaaaatttttaggagaggaggagaaaagagagagaatgagagagagagagagggagagagagagagagtgagttagtgagagatagaaaagttgttttygtttgtatygtagtattatagygyggggtttyggtataggtggttygtggtttttygtttttttygttattatttttggttttttttttagttgtaygygggtatttataattaagttttttttattttttttttgtttttatgtaataggttattttagggagygttggtgattttyggggtgygggtggtattttagaggtttygggtttttagttaggtgtgggaaaattgagttttygggttggaataaaygagtgggaagtgagggtttttttttggggagaatggagatttagatagagaattaatgatttggttttttaaayggatttattttatttttatygatattaygtagtaaatataygtataygtatatgtatttagagtyggygyggggtttagagtttatgtgttgtatttggagattayggggagtttattagttgattggggtttgggtagaaagagttgttgtygtttygatttttygtttttggtgagggagatgtagyggtgagtgtggggaggatagaagagtaaagtygttttggagaaatggttygtagagtagggatttagattttttgtatyggagtattttgggttatagtygagttgaggagagtttgtttttgggatttaggttgyggttgttgtggggyggggatatttattttggatgygatttgaggagttygtttygaaaagttttaggggagaatttggtatygggygttggtgtygygtygatttataataagtattygtatttttaggggttyggtyggtttttatagttyggtggtagyggygayggyggtagyggtggygggggygggggyggggaataatgtgygtgttttggaggggttgtttygttaatgagttgggttygtyggggggttgggaagttgatgttattygggttaatttygtttaatgaaattygttaggtygggtataygttttttttttgygtataattaatgggygttygtggtygggagatttttggggagggattggaggagggattygaggaggygagggggaggagaagggyggtttaagggggatggagggagggttgagygygtttgggattaagggagaaagggaaygtggttaaatttttgtaaaaaatayggttattatagagttaggttgggggatgggatggtttggagattttgtagagtttaataaattaatttgatgttttaygtagtygtattttttgggatgygygyggaaaattttggygatttaggattyggggttggggttttttttttagttttttttttgtttggtttttygtygtttgtttttattttattggttttattaataygtgggtatttggygttttaaatgtaaaygatgtttaggtataaagtttttattattttggtgttttattygygygtttaggagatggtygtggttgtagtttygayggtagtyggtagygtttttagttgggggtagggatttgaggggtagagggygggtaaggagggaggggayggattttagaagagtgttttgaaagaatttataatttttttttaggttgaggatggtgtgggtatagggaygagttattttygtayggtaatygygttagtataagggtagggtygtgtttgtagttaaatatttttttatttattagtaggggagtyggatgatagtaagtatttttagtgtygtttttgtgattattataygttttggggtaggggtaaygttggtatttgtagtttaagtagggtttygttgtaaaaggttagtaaagagtttttygttttagtygtttgttttttggaattgtaaagagaagttttaggtttgggtaaggtttttttaygttgtgggttagatagygagatggaattattygygatygygttgggatatgttttatygattgtaggttggttttgaaatttgaaaatttttgaygatgaggaattaagttygaattggagaagtattttayggaggtagttgaggtayggatgtatttatttattttatagatgggaaaagttagagatygtgtgtagtaagtttatagaaaaaattgttaagtttttatagagtagttttgtttggattatagatgttggygttggyggttttttatagtataggtagttatttgttttttttagtttttaatttttttttygagttgaattttttatatttatatatttygaatttagatatttgtttttgtagatttyggatgttagtatttgatattgtgagygtaygygygggtatataygtatatagttttttagggagtgtgaggaaygtygggttattttygttgttggggaatttttattgtgtaagtayggttttaaaaataagtaaataaattagtatagtaaataattggtttttaagtagtaaagttataaaataaataaatataaagagaaatttaygttattgtttttagttttgagatatgtttttttttgyggttttygttagaagtttagttygttttygttttygttttagtttygtgttttttggagtattattttttaattygygtgttttttagttggttttgtagttattygttaaatatgtatttaaaatatgaagaattgaagygtggtgttatgtygtttaayggttataaggatgatttataatygtttaattagtagaatttgttattyggaygaygtagggagygggggggtggggattagaaagggttygggtatttgtagatgtttttttygggtttatttygttaatagtagygaggttatgtgtggtgygygttgtggggttattagtyggggygyggagttgtgygtttgttagtgtagttaataaatattagtaggygtaaygtgygygttttttggttgtagtygttgaggttagtttagtygtyggtaygtgtttyggaattyggtttttttttttgttgttgtttattggtgtttgttttgygatygatttgyggyggtgagagtaagyggttttaggttttttgygygttyggtttagtggttggagttgggagttaggggtgaaagtygaggggttygttttggtatggygygagtttagagtttggaaggtaaagtyggaagttttgtgttgttgttggttttttttttatttggtaggttttttttaatattttttygtygtyggagtagtttgggaggtyggggaggtttgtgtygtttttgggtttttttggttttggtgttaatyggatgttgagtatttttyggtgtgttttttatgtttttttatttygttttaggaataattagaaattagatttyggtgtttaagtttgttttggtgygttttggaggygtttttaggatttgttygggttttgygttyggygttyggggtgggygatttgggygggttttaggtattgyggtttttattagygygygtagttggggtttttttttggggaatggagtgtttatttgtagaggttaatgggtttyggtttygggagtttttggttggttttygygttttggtgttgttggtttttttygtgttttttttttttttttgtgttttttttttataaaagatygggtgygtgtyggggtyggtttttgttggatygtygggyggttygggaggagttygtgttaaatyggygggttttygyggggttttagggygtagattttttattgtttttygggtttttttygggttttttttttgatttttttttttttttttttygagtttttgtttatatttaggttgygtttyggtttggttgttaaatagaaygaygtttttgygtagagttgattaggggtggyggygggaggtaaggttttyggtatygg

SEQ ID NO: 7089 - DNA, 1423 bp, Artificial Sequence
  Description of Artificial Sequence: Synthetic polynucleotide
ygttgygggataggtttttagagatygtttygggayggtygtgayggttttygagggatatgagagaagaggagyggygtttaggtaagttggattttgyggtyggaattygygtagaaaygaaaatttttggaaggggtttagtttygagtttyggaggyggataagttgagttttttggttgtattttttggaggttgttggttgtagaygtygtygttttttaagggyggttgttatygygtgygtyggttagattaggtygyggtgttttyggtattttygygtttyggyggttgtattyggtttttttttaygatygaggtttygggtatygygttttttttttyggaygttttgygygaygtygttttagtttttattagtatygagggtagttygyggttattttataaaygttttagtgtygtaatygtttttatttttattatttttaatgtttgtaayggtttttaatgaggttggaaaaatattatttttygttaaaagygatttygagttaggaggagygygtattttygyggtttttttttttatatttttttttttttgattttttttttttttttttggttttttttttgtttttygtttttttagtagtygygtgttgggttttttttttgttggggtyggattttttttttyggtygttttagtttttgttttttygttttttttttttttttttttttttttygtttttttttttttttttttttttttttttyggagtygttagtygygttttaaattygagtagggygygtagtgtttaaatttgttygygyggttygygtttttggtttygagggygygygtayggataygygagtatatttatatttaygygtatayggataygygygtattygaagattttygygygttygtatttaygygtatttggttaygygygtgtattttygtttaygygtttttgtttygttttyggygygtatttygggttygtaagtygygygtyggggyggtygttttgtttygygattggygggagtyggagtttttttgaattyggygtttatattatgggttgagttygtyggygtygagggagttagtgygattyggttyggygygtayggttaaggtaygygygttggtataygygggygyggataygygyggatatataygtgygggataygttttttttygayggyggygttaatttttyggtaagtttagygttttaygygatttgttyggtttttaygttggttatagyggttgyggggayggggaggaaggtagyggggtggttttaggggtttattttgtagggttttttygayggygtygggataggtggggygtttagygtygggagggayggttygttagtgyggggttttagggaggygygtgtagtygggtgygg

SEQ ID NO: 7090 - DNA, 1384 bp, Artificial Sequence
  Description of Artificial Sequence: Synthetic polynucleotide
ygagygttttttgaagtgayggggtygggaygygtagggaggyggtttaagaagygygttttaggttagtttagaatgygttyggtygygattaggataayggygggtggggttgggggyggttgtygggyggggagyggtttygygtttttagttattttttaagagtygttgtttttttaattttagttgttagaggttttgtgattggttgyggtaygatgattygygtayggattggttgtttygggtyggggggtygggttygggggatagaattygttttygaatttttaaagagggtatttttyggtaggagttggtagatttaggaggtgygatagattygyggggtaaayggattggggttaagagtygggagygygggygtaaaggtattagggttygtttagggygtygygtagtayggttttgggggttttgygggttttygggtgygygtttygtttttagttatggggttygtagygttggagattttgggtttggtgttgtgtttggtgggttgggggggtttgattttggygtgygggttgtttatgtggtaggtgatygtttttttggattataatatygtgayggygtagattatttggaaggggttgtggatgtygtgygtggtgtagagtatygggtatatgtagtgtaaagtgtaygattyggtgttggttttgagtatygaggtgtaggyggygygggygtttatygtgagygtygtgttgttggygttygttgygtttttygtgattttggygggygygtagtgtattatttgygtggtttygggttyggttaaggygygtgtggtttttaygggaggygtgttttatttgttttgygggttgttggygttygtgttattttgttggttygttaatattgtygttygygagttttaygattygtttgtgttygtgtygtagaagtaygagttgggygtagygttgtatatyggttgggyggttatygygttgtttatggtaggyggttgttttttgtgttgyggygtttgggtttgtatyggtygtttygattttagttttttygtgaagtatttagygtygyggyggtttayggttatyggygattaygataagaagaattaygtttgagggygttgggtayggtygggttttttttgttagttaygtttgygaggygttggataagtttggggagtttygtatggatygyggttttygtygggtagygyggygygtaggtttttyggaaygttyggttttgygtttygaygyggtttttggattygtttttgtttgygttygtagttgatttttttttgttattagttyggttttgtttttaatagayggaatgaagtttttttttttgtgygyggygt

SEQ ID NO: 7091 - DNA, 1361 bp, Artificial Sequence
  Description of Artificial Sequence: Synthetic polynucleotide
ygtygaggatgtggttttygtttttygtagtygtygtaggagtttttgtttttaaagyggtaggtaggggttttagygggtttattttaatttgggaaggtyggtgygtttttttatagatttygtagggygttttttttggggattattgaagttttggtatttttaattttagttttttygygttaygggaaaygaagaygatatttttttgaataatttyggatgtgttattatagaggggtattttatattggtttttattttaatttttatttagtatattgtttgtttattttttaaatttygtgyggattgyggtatttagtttygggggattttttagttttgttttttygattygygtaggtgygttygtttatttaagggtagggaggtatgttttttygggttttttyggtygtatggtttgtttgtttttttggtttttttttttygtattaggaggggygtgagatagttaggtygatttttatttyggtagtttgyggygatyggtygtttygagygtagygttagatatttgggttggggggtgttagtttgaygygtaggaagggygtagyggygggagggggttttattttagatttgggaggtttgtttggygtyggttttygttygtttttygtyggtggaggtygyggttggyggagatygttaagttagaggaggggattygaggtttyggttgggygaaggttttggagggggagaagayggtygaggygtggaggggtagtygyggyggggygatttttatttgtttattgyggggtttgttygtggggtyggggtagatttygtaaaggaygygtagtttgtaagttygyggttygygyggygyggggatggggagygtgtgygtygaggagygygygtygagtygggttttygygtttgtgtggtyggttggyggtyggggttygtgtgtttttgygyggyggygtgtgygtgtgygtaygyggggattaygttygttyggagtygtygtygtygtygttattttttgttyggggtygagygtagygttttttttgttygtttygygyggygyggtagtttagtttggtttygttttgygggagaggygtygttttygtygygaagttaggttgggygttggagggaggygatygattatygtttttttttgtttattttataggttggggagggggtgttgtaggttaatgagygttygggggyggggttagatygagggyggtgyggtggggggygyggtggggggygtygggttgtttaattygattttattygtagtatagattggagtaggagttgyggygggaaattttagyggygggggtygggggygt

SEQ ID NO: 7092 - DNA, 1175 bp, Artificial Sequence
  Description of Artificial Sequence: Synthetic polynucleotide
yggagagtygggatttygaagtttttattgtttttgtygaggygtyggygtygttttttgtgtttttgattaygttagttttygtygaggaggygatattttttttygygtttttygatagygagyggtyggygtttagygtggaggggttyggaggggttttgtaygygygygtggttygaygygaggttyggtyggttygggttyggggygagattgggggtttgtygttgtygttatygttygagygtaggaaatygtygttatttgatttygttattaagtttaaggtgttttggatttayggtaagtatagygtygttgtagttggtygtgygtttttattatygtygttaggtttygaggtygygtttagttttagtaagaggaaayggaygtttagygataaatyggygtatayggtygaatayggtagttttyggattygygatttaaygtygygtttttyggggttgttygaggaggygatagttttygttgygttttygtygtttagggttygagygygygtygygtttyggttttttggagtttayggaygtyggyggtttttygygaagygygtygaggttgtttttatgttggtygttgaygtgygyggtaagattygtagtttgggtygygtygaggtggttttgggygygtagggttttagggaaaagtyggygtttttatagaaagttaagygtttygtgtygttagtttygttygttygygygtttttagygatygaaatttyggggtttgagaaggyggygatygatttgttygygtttgagatttttyggaagaagatttttatttagaagtygtygygtaagaagagtygggaggyggygggygagttgggtagggygggygtatttattttgtagtaggttgtggttygttygygygtagtttttttagtttygtagygtygttygttattttatattttttaygttatygggtaygggyggttttttattggtygggtatygygyggttagyggaggttgygttttattggtttaggttttgtagtygtttttggattggagtagtgtgttttggygggaagggtttatttygttggtygaggtttgataggygtttagygggygattttttttttattggtygagttatggagygtttygattagatagygt

SEQ ID NO: 7093 - DNA, 1087 bp, Artificial Sequence
  Description of Artificial Sequence: Synthetic polynucleotide
ygtttgtagttyggtygygtggaggtgatygggyggaatttygagggggygyggggagagttgggygggtttatygttttagyggttgttgttaggggtygygaggttttttttgaagatgtagygtagtatattttgtatatgagtttagaggaagaggaagtgtagtyggyggaygygyggyggyggyggygggggygygtyggggttggagtyggagygygtygggygttgggygtagygagygagagygyggyggtygygggtttyggygagggatagaygtatygatygtyggagggatagatataygattaygyggygttatygtttaygtttttatttatyggygtttaagtttttttygygtygttttttttgtatggtataaatttttttttygggayggaataygttgttttagggagttygygatygygttttttttttygtyggttttatayggtaggyggyggggggggygygatagggtttggggtgtygatyggtataggttttttygtttggttttatggatygggtttttggygggtagtgggaatygygygtggygtttttttgtaggttgttttttgtyggggtttyggagttgttagagtagtattttttggttygygtyggatggggatttgggttgatttttgggaygtttggattttgggttaatttttttttgyggggaaygggtgtaggggagttatttttggagygatgtagggagaggtatttyggagtagtttgttgggggtygtaggttttgtaggtttagaagygtttaggaaggaygtagaggtgggggagtttggaggttataggtgggtttaggatatattgtygttggggttttyggaaaagaataggagggagttggtygyggagtttaggttttyggggtgygygyggtttgggtggggtagggtggaggyggtgtttgattgtttttttgygtgtgttttgggaggtgggtttgttttggggatagaggtgttggaygtgtaggagtagatatgtygygygtttygaggaagygtyggaattattagaagtatagggaygygggtgtyga

SEQ ID NO: 7094 - DNA, 693 bp, Artificial Sequence
  Description of Artificial Sequence: Synthetic polynucleotide
yggtttaggtattygggtagagggatgatttygygttttgygaaaagtaataggyggttgtattttattttgygttagtttygggtyggggtggttgttttattttygtggtttagggaggaggygttgggtgygtatgtttaggggtgtgttygttgttagggttgtagyggtygttatttttaattagttgtaagtygagttgtttatttgggatygggtyggttyggygggtttggttttyggygaaggyggyggygttggtgygyggyggttggggygygggaygtaggtagtgygtggygyggttggygttttygggygtygttatygagygagggtgyggtttygggyggtygtgyggggtaygatttggttygygttgttgyggyggtygttgtagattttgttttaggygtygtagttttgtaggaagagtagataaagataggagagaggtaaagygtygtttgtttagagatgtagtyggtttagttaatagagggaaatygtttttaaatttaggttgggaatgagggaggaggggygaggyggttggggattagaaaaagtagtagggaattaaygtgatagttagagtttagttagtgtttygtyggygttgttttttygtttygyggttgyggggttyggaatggagagaggaggygggggttgagygttggttgtygg

SEQ ID NO: 7095 - DNA, 5065 bp, Artificial Sequence; identical to SEQ ID NO: 7063
  Description of Artificial Sequence: Synthetic polynucleotide

SEQ ID NO: 7096 - DNA, 307 bp, Artificial Sequence
  Description of Artificial Sequence: Synthetic polynucleotide
ygttttgggggygatatygtyggggaatttgatgatgggygayggygyggyggyggygtggtttagtaggtagtttaggagatagagygtttttaggggattygtgagygygtttygggttattagygtttttatygtagygttttttggtttygygygtygttygggggtygttggttyggtgygtgtggtygtttygtygtttggttggagtttgtttygyggygtagggttgygtttygagggttygttggttyggtggtttggggtttgttyggtttagyggtttatggttyggttttygygt

SEQ ID NO: 7097 - DNA, 1563 bp, Artificial Sequence
  Description of Artificial Sequence: Synthetic polynucleotide
yggtgttttygtagttyggaygttagygttagggattygttataattttaagttttttttyggggttgggtttygtatataaataggtagtataaaattaggatttagttggggttygtatttttttttgtttagattygagtygttttagttttyggtygtygygttyggagttygttttaattyggaaagtggyggtyggttgyggggtaggygggyggtatttgtgagtagttttagtyggtgttttagtatttttatttyggygttyggygyggttyggttttgggtggyggygtyggggtagygygttyggtygagtyggggagaggagygygggagattyggagyggagyggtaggagagygyggagygaagyggtaggagtagtttatagttaggagygttttttygtttttaaygtygygtttttttttttaaaayggtttaaaaaaatttattaattgtatggtygygtatttttaaaaaggtattygtygttatttggtttyggtgaattttaggaggyggaggaagggygyggggtgggtgyggtgatatygtgggaggtggtttttygtgttygtygttygaataaagagatttygtygttttygggygtygyggtggggggtygyggayggyggttgggggtttttagygyggtygggaaggygaggaaggagagygggagtygyggggaggagggggygtygttttygyggaggygaaatggggygggagygagtyggtgygggattygyggggttagggtygtgygtggggttggggtygtgttyggggttgggttgggttgggyggggaygygygtagtagtygyggyggygagagaagttggttttgggtttaggggygagggygtygtygatttatygyggagatgyggaygagatagaygygtaggyggggagyggggtttyggygtygtygaygygygggtgtaggtgygggtagttaggagttttttygygtgttygyggttgtaggggyggaggtygggttgggggyggtgygtygygggggygtgttygygtgggtttggygggtgtgggygttyggttygyggggyggtgtygggtttggggttagtttyggayggatygyggtttttygygygtggttttygttttttgygyggttggggtgttyggtgggygggygggagggygagyggggatygygaygyggagtttgggggatatttyggtygattygygttttygtygattttttattygtttygtygygyggattgtgttgggtgygttgygaggttttgttygtttttttaggttttttgtggtygygyggygtygggttttygggggaggggayggygttgtygtagtttttgtttagatttttaaggggaattttagatttgtagagatatttttattttagygtttttgygtttgttgtttygygttattygtygtygtygtttgggaatygagggagaaaagtttttagggtygggaagaattaggggtttaggggtttttggggygtygttttttttttttygttttyggagttyga

SEQ ID NO: 7098 - DNA, 512 bp, Artificial Sequence
  Description of Artificial Sequence: Synthetic polynucleotide
ygattygaggttgtttattyggtttggtatgtttyggygtttttggggtttttgtatttygttggtttttygttgtggtgtttygtagttygattatttttgtgtttttaggagtttattttgggyggtagggaggygttgygtggggtttaygagttttaygttgttatttttattagtttttattttttaggygtttgttttttygtattgttaggttttgttttygtagtatttggtagatttgagttyggtttttgttattttttygygggagttttatagtgattttggaggagaagtagtaggagtttataggttatygygttyggtygygygtgaagtttgtgtagtygtatggtyggttygttggtttyggttttttgtygayggataygttgttgtttatttagaggttgtttygggtyggtttagtygtggatttagtgttttgtttagtttyggagtttggattgggtagggagtyggyggggtgygttgatttgggtygg

SEQ ID NO: 7099 - DNA, 1070 bp, Artificial Sequence
  Description of Artificial Sequence: Synthetic polynucleotide
yggygttyggggttygattggtgggaggggttyggtagaggtttygtttygagattttagtaygtttygtttygttttayggtgtagtatagatttygyggagaaygygagtatggtyggaaattatygtttttattttttggygggtttygagggaaggtygggaaygggygggttttgttggtttagagggygttaggggtagttatyggyggttygggatttttttygtygygagygygggggagtttaggttyggtttgtygggggttgggtgaggttgyggattaggtttttaygtttttygygttygttygygtttgttttaggtttttatygyggttttttttgttttyggggtygttttgttttttatagattttattttygggggtygtttttaggattttygttygtttttttttgattyggtttttgttygtttygtttttttttttygggttttttatttttttttygtyggtttygatttygggggygtttyggatttgtttttygaatatttttagtttygtttttagtttgyggagaaggggtygaggagataggaggaagagagygagagtttaggggaygaggaggaagttatygagaygyggagattygaygaygtygagggaggtataggtyggggaagyggtagtygggggyggagygggggatttgggygggttttttttygttttgtttttgtttttttygtttattttttttttttttttttattygttatttatygttatggygttttygattttaggyggygagtgtagtygtygttttatttttygtagtttggygygtattagtttttttgtyggtgggygggygttaggggtagggtygaggttygggtatattttttttttttygtttatttggygygggaggtttatttttygagagtagttgttttttgtttttttttagggtayggatttttygggttagtygttgttttagtatttgygaggataaagaggaggttttttygtttggtygtttttttggttatayggttygtttttttttttttgtgtttttygyga

SEQ ID NO: 7100 - DNA, 766 bp, Artificial Sequence
  Description of Artificial Sequence: Synthetic polynucleotide
ygggaattttaygtttttgtattagttygggggttyggaygagttygggagtygttggtygttaattatygygyggtggagaggygggygttyggtttyggygygttgggggagttagttggygttgttttttttatygttttagaygtttatatygatatagatagaygtatagaygggygggtagatatygatagttttttaatygtttgygttttagtttyggtttagggagtttttygtattttttggggtgtygtaaattgtagttyggtaggttygygtygggagaagggagggygygtaggyggtyggaggaggggaggttttagygygttttygttgygatgtgaayggyggyggtttttatttggagtygtatttggggygtygagtttyggggtygyggaaagaatgygygtygttygtgygtttygtttgtygygtttggttattygtagtygtygygttygtatttgattatggagtgygtttttttgttygygtgtgttttttyggttgygggttygggttygtygaggggtttggygggattggggygygtggttaaggtaggtgtygtygagyggagtttygagagygggtggtagggggygttygaygttagtttygtygygttttttaygygygatgttatttttttttttgtaggygttttagttgtgttgtttttgttgtgygtyggtygtygyggttttagttagtgatagtagtagyggygttagyggattaaatgatggttygt

SEQ ID NO: 7101 - DNA, 363 bp, Artificial Sequence; identical to SEQ ID NO: 6874
  Description of Artificial Sequence: Synthetic polynucleotide

SEQ ID NO: 7102 - DNA, 2919 bp, Artificial Sequence
  Description of Artificial Sequence: Synthetic polynucleotide
ygagygygtaatatgagttttaaaggttaaatttyggttagttaggagtyggaaggttgagttyggttgatttgattttgagttttttyggagttatttygtataggygttygttttgtttaagggtaygygaygttagygggtagtyggttttygtgaagaatggtttttaaataatttattttatttygttgtaaagagagggataaaatgggttttttttttttayggatgtttagttttttgggtaggygtatggtygggyggygtttagttygtagtttygattyggatattttattgtattttttttttttyggtttttttttygtaygggygttygagagayggataaagagttggggttaagtttgagygtygggtayggttaggtttagggaaggaaggttttyggtagatatttgggtattagagttggtgygaggaggaaaagttgggaggygaatttataattttgggggtggagggtaggtaggggaggggaattaggttaattttagtygagtgagtttttagygagttggggtttyggatgggaggtttgtttygygttttaaagaaaagtaaatygtttttttaggttygttyggattgtygaagtttttttggaaaaattttttttttttttatattaaattttgygtygggtttygttttttttygggtaggtagyggygtaggaagggttaagttagttygttttagttgatagttagttgattgggttttgattgatagtttygaaaagtttttttgtttttatattattatgttaatygyggtygttttygtygttttttattggttyggagtgttagttaattttttatttggatttgaygttaygagtgttataaaatttagtaattgttttaaattttttttgttggattagaggttttaaaatttttttttattttttagttgtagttygggttgtttgtyggtttggttttttttttttttttttgttttttgtttygtttttttttaggatttygttattttgtttttttaaaaaaaggtaagaaagaattaaattttttttttttttttttttagtygggttgtatttttgttttgtattttgtatagaggtagagagygygygagggagagagaggaaagaaaaaaaataataaagagagttaagtagaagaggaggygagaagtatgaagtgttaattttttygtgttaaggttygygtygttyggatagaygttygtygygtttttagtttygagyggaygtygygygygttttgtttgtagttygggtyggygaggygagtttttttttatgtaaagygygtagyggagyggygagygggggaygtygygtatygggtygggtttttttagtttygtygtygtagttattatygtygttatygtagttygyggaggattttttygagtttgaagtygtyggtttggygygtaaggaggygagygagtaaggaggggtyggggygagygagggagtatattggygtgagtaggggggagggagggygggygyggggggygygggtagggygggggggtgtgtgtgtgagygygttyggaggtttygggttagttatygtygygtaagttagaagygttttagttyggtaagttggtttattygttggttatttagtatagttygttggttttttttttgtagtttatttggyggagyggyggyggyggyggyggyggyggtaggagaatggtattagaattggtaatgagtaatttygatttgtttattagttttttggttatggaatatgttaatgatttygatttgatgaagtttgaagtgaaaaaggaatyggtggagatygatygtattattagttagtgyggtygttttatygtygggggttygttgttttttatttttatgagtaygtygtgtagttyggtgttttttttttttagtttttyggygtttagttygggttygggtagygagtagaaggygtatttggaagattattattggatgatyggttattygtagtagttgaatttygaggygttgggttttagtttygaggaygyggtygaggygtttattagtaatagttattagttttagggyggtttygatggttaygygygyggggygtagtagttggtygyggyggtyggggtyggtgtyggygtttttttgggyggtagyggygaggagatgggtttygtygtygtygtggtgttygtygtgatygtygyggtygtygygtagagyggygygggttygtattattattattattattattaygtygtyggttattattattattygayggtyggygygttyggygtygygggtagygyggtygtttyggtyggtggygttgggggygygggyggyggtggttyggttagygttgggggyggyggyggyggyggyggyggyggaggyggygggggygyggygggggyggggggygttttgtattygtattaygtygtyggyggtttgtatttygaygatygttttttygaygagtagttggtgattatgtttgtgygygagttgaatyggtagttgygyggggttagtaaggaggaggtgattyggttgaagtagaagaggyggattttgaaaaatygyggttatgtttagttttgtygttttaagagggtgtagtagagataygttttggagtyggagaagaattagttgttgtagtaagtygattattttaagtaggagatttttaggttggtgygygagagggaygygtataaggagaaataygagaagttggtgagtagyggttttygagaaaayggttygagtagygataattygttttttttygagttttttatgtgagtttgataygygattttagttagttattttgataagtgtttygygggggttyggttygg

SEQ ID NO: 7103 - DNA, 2267 bp, Artificial Sequence
  Description of Artificial Sequence: Synthetic polynucleotide
ygggygggggagggggtttgtyggtagagaaagtgyggagagggtagagtagyggttyggggygtttttgtaggtggatatgaaaygtaygatatgtaaatgaatgtaaagtgtatgtaaatgatttggtttygggattygygggaagygagggtttygtatyggattygttygggaggttgagyggggggagygygatttttgtyggttaygtayggaggtggttttgggtygggttaggygtygygttgggggygagygyggggtagggggygggggyggyggtygaaggagygattttttttttaattttttatttttttattttttttatattttttaattttygtttagtttttygygyggtygttagaagtygyggttttaaagttgygaggttygyggtygtygattgttgygaggtgggtgtgygyggtttgyggagggggagagggtgggygtaggygggggtygttttttagagtygygttttttttayggygttygtattttttaattttttygttygttttygtttgygttttttygygtygtttttygtaggaggyggygygttygtygtttttttttygygttttttttttttttttttgttttyggygtttygtatagtttyggtttttatggttagtttttagggygtygtttyggtggyggaggygttgggggyggttttyggyggyggggagtttttttttaggtyggygtttyggggyggagttgagygttatgggygtygggygggaggtaggtggygtagyggyggyggyggggggtaggaggyggaggyggagygygyggggygggggtygyggggtttygtgagattttygggygagygygyggygttggagttataggygyggyggttggattyggygygggtygyggaggtyggagatygtttygggyggggtgygygttttgttttygygyggggtggtyggagtygagttttyggtatggtttaggyggtygtttygygygttttagtttygtygygygtttgagttyggtgyggygttagaagatagygygtagtygtttttgagtygtggaggyggggattaagttggaaggagtagygattttyggatygagtygygagtgtgygtygttygtygttygtyggatttttyggatttttygatygtaagtgtygtgttygtttygygygtygtygtygttttatttygatttygttygyggttgtygttttyggatttgygtygtagtygygtygagygtaygggtygtttttaaagttggtgtttayggtagggtggagttaattygtttagygtttatttattygggttgagygtagtttttygtgagtagagtttgatttgygggggttgyggygaaatttygaggggaaygaygygttygggygttgggagtttygygggtttttttggggtygttyggtttttttaataaaggtttygyggttygygtgayggagattygggagtggggaggtygagggyggttttgggagaggtagaggtggyggyggtyggtttggggaggggggtttagagtttttttttgttttttttttttttgttygggttttyggygttgtttygtaggttaaaggtggttygygttgggggttttggattttgtttggtatgyggtttttggggttttgayggtygygggtttyggtatagtygggtggtagygatggygygtatagtttttgggaagygtttatttgtgttgggtaggtttygagttaggttgtgggaatagyggggagggaggtgtgagtttttgtggagggatagatggttggaaaygtagttttagayggttgattttatttaygtggagtagaaggyggttaggttggtggyggygatttagagtygttgggtttygaatatattgyggggttggygttttttygtttttgygttygttygtgtgtgttggggtygyggtygggttgtgtttattttttatttattttgtgggttgaggtyggttgattttaggtttattttagggtttaggaagaaaaattttttttttgaaaagagagtaygtygygtgtttttgtgggtgggggtttgtyggtagttgttaggtttgtggttttagttagggtgyggtttttgtgygttyggttygggtgtgygtttttttttttggaygaggaataggaggtttttagggtagttatttyggyggaygggtyggtyggggataaggggygggggtyggtttttygg

SEQ ID NO: 7104 - DNA, 265 bp, Artificial Sequence
  Description of Artificial Sequence: Synthetic polynucleotide
ygtagtttgygatygatggagtaggaggygygggtgttgagagttgygggyggttttggtygggttyggygtttgttggttttygtttygtgggtattttgtatagtgttggggttggtgttgagtttygaggagttgtttatygygtagttygygttttattgtygatyggattttaygttgttgtttttagygttgygygttttgygyggattygygttgttggaygtygttatttygygtttggggtttaygygagtygyga

SEQ ID NO: 7105 - DNA, 374 bp, Artificial Sequence
  Description of Artificial Sequence: Synthetic polynucleotide
ygaatagygttttgaaaygtagaaaygtgtttattygaattgttaaygygagygtagagtttattgataaagtaaaataagataaatygggagttagaaaatttagygatttataggatttatygtgatgttttttataaatgttatygygaaaatagtyggatttgaaaataaaygygatttatttggttttyggaaggggagaaggattygggygaaaggygttagttttttttygttygtttygtagaygtagygtaggtttygagttttygagyggyggttttagaattygygggttattygggagtttttttygtagtattagtygaaagtttttagygtygaggagggygggyggttgtttttttyga

SEQ ID NO: 7106 - DNA, 1133 bp, Artificial Sequence
  Description of Artificial Sequence: Synthetic polynucleotide
ygaatagygtttttaaatttagaaaygtgtttattygaattgttaaygygagygtagagtttattgataaagtaaaataagataaatygggagttagaaaatttagygatttataggatttatygtgatgttttttataaatgttatygygaaaatagtyggatttgaaaataaaygygatttatttggttttyggaaggggagaaggattygagygaaaggygttagttttttttygttygtttygtagaygtygygtaggtttygagttttygagyggyggttttagaattygygggttattygggagtttttttygtagtattagtygaaagtttttagtgtygaggagggygggtagttgtttttttygatttygtttygttygygyggaygttttyggttttaygyggggattatttygggattttygtyggatttygygygttygyggttaatttgygtgtatttgygtttygygttaygttttyggygttttaygtttagtttttattgggtttygttttttagtggttttaagtttygttttttygttggttatygtaagtttygtttttygaggtttygtttttgtaaggttygtttttttaygatttaggtttygtttattayggttagttygggtttaggtttygtttygataygatttaggtttygttttyggttagtttygtttttygygygtttygtttagtaattttygttgaattyggygyggtttttttagygttgttttaygtygtagtttagygtttggagttygygygtttygagtttttgttygtttatgygtagttgggttatttaggtgtatttatttttttgttgtttygtygttttttttgtttttatttygtttaggttttgggtgttttttttttattttttttggygtttttgttttaggttatttggtygtttttttgggtttttygttygggggyggtttttggttygayggtgtygtagaygygygygtataggttagtttygyggagaggttgtttttaggggttaggyggggggttgagttagaggttggggtttgttaggagyggggyggtttggggygtagtagtattggagttgaaggygagggyggttygygtygg

SEQ ID NO: 7107 - DNA, 2358 bp, Artificial Sequence
  Description of Artificial Sequence: Synthetic polynucleotide
ygggattygttttttaagyggygttttttttatttttygygaatttttyggyggggtttgtgtggattaagggagattagagatttttygtygttattttatttaggyggagayggtttattygaattygtaygggtttttttttttttttggaatttgtagttggtttttttygaatgtttgttttttttttttttttaygaaagaatagtgttttgggattyggggtgyggggtagtygggttygttggagttgtttagtgyggggaagagtygtygagattgggagaaggggygttggttagggaggagayggggtagggagyggattygygattygtattttgggyggyggttttygygttttagtygygtttttygatgatttttagtygygaagggygagygggygggggttgggttgygggttygggttttaggaggtttgyggggtyggggaggggygtggagtggttygaggatyggtttggggattgggggtaggtgtttggayggaygygggtygagtatttttttygggggygggygtagtgaaaatattttgggaggyggygtygygyggttgagygttgttgttttgggaataggayggygttyggtattgygagttgagagtatttttataaattttgtatgggaggygtttygtgagygggggyggggagyggagygagagggagggagttagagagtaagggagggagggaggaggagaggagggggaagtyggggggaggaagggaggygtttygtttygtygatygttyggttttgtaaaygygygtygggygtttttttyggagttyggyggtgygtgygagygtttttttgttgtagtygyggyggyggtggttygagggggyggagaggagggggttgyggtyggtyggttagggggyggygtttttttttaaaatygtttgygaagtgtttygggtggtagaagtaggtygtyggtttygyggagtaagtygttygtttyggggttgagtaagygygyggggttgtygggtagtattayggttgtttgygggygtyggtgttttyggygyggggttggagtttattatgtttttgyggggtygggttatygggtaygagyggattttyggtttgttttygtttygaygygttyggattagttgtagttggygtttagggatttgaatttggatttygggagggagtgygtttaggtygatttyggagyggyggtttygtggttaatatgtttygtaaaggtgagttggagtygtaggggtaagttgaagttgaatgygtttyggaaagagtygygagttygggygtygttyggygtyggggttttyggtttgggaagtagttttyggygggttggtgggttttgtygggygtattygtygaggggttgttgttggggtttagttttygttagyggttagttgtgagatayggggttttttttatggatygagtggttaggtttagagattyggttyggaggggttagtyggagattagagtgagyggtyggtggtggaaggggagtyggttttttgggatttttgttttgttgggataaagttttgtatttgtagtttttattttttgygygggtataygtttttgtttttgtygttttgtggaggtygagttygtayggygttttygtgtagttagyggttagtgatygygyggttygggygtttttygygygttttagttttttagayggggttyggaygyggaygttttttttgtagttttgttttgatygttagggatgggttttgggtatttagyggttgagggtggggagyggttagygtttgatgtttagttttttaaatttttattatgttgggagyggagggaygygaaagtygtgtygttagtgtgygygatyggtgtatagtttaatttgaggatagttggtttygygattatygtagttagaygttttagtagttyggttyggtayggagygyggtaaagttggtgygggtatyggggaagtttygtygygtttttaygtggttgttaygyggggygtygtttttygggttttgggagggtaggtgattaygtygggagtttaygggtttygttattagttgttttagtttttgygtttgtttttttttttttaggttygagtaggttgtggygtttygtygggatttttttygygtttggttyggttaggaggttgagaagtygyggygtttgyggttggttgtttyggttttgygggagyggttgaggygggagtttaggtagtygaggggtttgatttttgygttttaygttttagttttaattygtttttgtttttatggtaatagatygaggtgtygt

SEQ ID NO: 7108 - DNA, 1050 bp, Artificial Sequence
  Description of Artificial Sequence: Synthetic polynucleotide
ygggygggtagttgyggttgttgaggttyggtggggtttttttaagaygygtgttygtatttgttygtygggygtttgyggggtgtagygtttattggagygygatagtttttgggatagaggaggatagtggtttygtttttttgtgygatygtttaggagtttygggtyggagagtgygagyggggaaaaggggttttgtatttagagtggggyggaygtggygaggaagttaggggggatygggaagygaggttygyggtgyggagggygyggggygtggggggatatttttyggagagatatyggaggggyggaagtaaggagatggaaaggagagggagatyggggagatagatttgagagatttagaggtttgtagagagttttattygggattttttagagtttaggaaagagtagatgyggaygygggagggygttttaygttaaagygggtagtattagtgattaaaataygtttygtttggtagtttygggaygtatttttgtttyggtagygtaggagaggtttggatagygygagatgttagggtttaggttgtttttagagggttggttygaagygttggagtttaaagaygttttttatygtygtygggtggtagaattgggggtaggygygttttatagatttygaggggtggtttygttttagggtygyggggaggygttttygtgyggggyggagttgttatygttttttttttaattttyggggattgtggtttttttttaagttygyggygtttttagttgttttttattygtttygttygttagtttttttttygygygatggtttyggygttgagttatgtttttaagtttaagtttttygtgattttgttygttatttygtttttgttgttgttattygttattttgatgttygttaaggttagttgtatttttaggtagtttttyggatattyggygttttgtgtttattaaygggtatygatttygggagttttgagttggagygtayggatttygyggggagtatagttttttyggggygygygt

SEQ ID NO: 7109 - DNA, 1731 bp, Artificial Sequence
  Description of Artificial Sequence: Synthetic polynucleotide
yggtyggttttagttgttatttaggtaatttyggagtygtygtagatatyggatttattggaagggggygaagtygyggggaggaatgggggatattggggaaggggygtygtttttgtygttttygttttttttagtgttattgggyggttgttgyggagttygygttattttttttttattttatttygttygtttggtttygtttggtygttggttygygtttygttgygttygttygggggttggttyggttygggtttttgaygttattagtaagtttgttgttttyggygttttaygtgtggyggyggttagyggyggtttaggaggtagtyggtgagygtttgygagtagagtggygggggtygttgataggtttygygtagtttagtttagtttagttaygyggtttataggtggggtttaagagtagtttggagtaattyggygttayggagaggggtggayggttttgtaygggttttttgtttttygttygggtagagggattyggggggatttygttttttggttgagagaatttgaattygggyggagagaaygygtttaggygggtaaggggattagagaaagtyggggttggaagttattgtygttygttattgtttggagygtayggagygtagaggttyggtagtygygygtgtttttayggggatygagttagtgatgtaggatygttgagyggagattygygtygagaagtttttyggggtyggggttgagaygtaygttttygatatygttgttaagatttygatttyggygatttttgyggggaatygaggggttaaggttgttttaagtttaggatttgggygagtttaagaygatggttttttaagtayggattygygttttttttttygttttttygattggaggtagggattttgygyggggttttygggatttygttttttygyggagtttyggtygttgtttttygggatagttygtayggttataggggygtayggygatgtggttttygtttagygygttggttygtyggggggatgttttggtatttgtyggggtttaggtttagtatggtyggygygttgttygaygtygttttyggttaggatggttttttygggttyggttagtgttttttttatttyggtygagtygttgtttygtagtatttttyggaagtttttgttgatgttttgttttttgtttaygtttttttaygttttttattgtttggtygagygttgttagattttgttyggtttygtygtggggttgttyggyggyggygaggaggygggggtttttggtggyggygttttggtyggaggttygagggagttggyggtgtggtyggyggyggtatagagaaagygttttttgtaattgtygtagtggyggaggygtyggtygttygygtttygygaygayggygaggaggyggtttgggaagaagagttttttggtttgttagggggttygggyggtttyggggtyggaagtatygtggtygaggtttygtyggggattttggygttgtttttggaygaaggtagtaagtagttgtygtaggttattattatyggagtgaagaagggyggtaygygggygttgttggagtttttgygygtgtatttygaygtgygygtygtgggygtygagttttattttttygatygtagttaygataagggtttygtttggtatyggtgagyggggygggttygg

SEQ ID NO: 7110 - DNA, 3535 bp, Artificial Sequence
  Description of Artificial Sequence: Synthetic polynucleotide
yggtygygttaggagttgttggtgtagtttaggaaygtagtgtttggggttagttgyggtatttatagtgggttttttyggtagttygattygtygggttatygtttygggttttgtgttttttggattygggagttttgtttgttagtttagggagatggttygggaggaygaagaatttttygtttttygyggtttagttaagtttttgyggtygttygggtttagtygttatgygtggtygttygtagygtagttttygggygtaagtyggtagtygaatttttygggttgygttgttygttgtaggygygyggygagggtttttaygygatttygttttttatttagygttttttagttaattaaaaagaaygtggtaggtggagggtagtygtttaagagattgygtgagtttttttgtggggatttttatagtttgttttaggtgttttaaaatygtttgatattaagggtttagttttttttttgttagttttttttaattyggtttaagtgtgtttgattttagaaaattttaggttgtttyggggttttggygggttttatttggaagggygttagttatagtttgtygtttggttttggaattattattttaggaggagggggagtggtggtggtagaagttataataatataatyggtgataatagttaaygattagagaggtttttaygtgtttgygaggtattttatygtattagygtatttattttttttatttttgtttagaatttgtattatttttattgtatagatgagagtattaaggtttaygygattagttaggaygtgaatttaggygtyggattttagagattttatttttatttattagtgtttygagaatgggttatagttygggaayggtgggaaagatgattgttayggttggttaaatttygagatttgggtaatttttgataataataaaaaattattaaggataaaggggaaggggtaggaygaggttgggaagggagtygttttaattygyggggttagtttttttttattttttaatttatttaggtttygatagtggggtgggtatagggagaggggtttagttattttttttttttttgtttttttaagttttgagygtttgtgaagttaattgggtttggaggggtgtttgaatgtygtgttggttggggttaygggtggagattttaaygaaaatgtgggggtygttatttgggtttttagtygaagatagttatyggaggtygaaatttagattttttgtttattygygttttattygaagttygggtaatttaatagtttattttaaagattagtagttgyggaaagtagtgggtagaggtagtgattgtgatttyggggttattgtttttttggaatttgattygtaattygattygagaatagaattttyggaagtygygatttygaagtaatttttattttttaattaatgggtttygaatattttttgtttyggaygtgtaaaagtttygyggagataygygtttttgttttttttattttagtatygagggtagggaggyggaaaygggyggyggtgttyggaggttyggaygtttttaaagtttygygtygttttagtyggttgtagtgygygtttttgttygatagggattagtatagttttaygtttygygygtygttygttygttaggyggaggygtygggttattygttyggtttattttttygagtttaggyggttygygagygaggygggtttgatatttttggggtttyggtaattaggyggattgtaataaaaagttaatagattttgyggtttygtygggaygtygyggtttttattttttttttttatttgggaagtagaagttgttttagaagttttttgagggyggagatygattaaaggggtttagaatatttttagygtttygggtttygggaggaaaaaatttaaaaygagttataaaataygattygagtyggatatttttatggttagagggtggttygttttgttgagggyggttttagtygttgttttttttttttgyggygaggtygtttgatgaatttaagggtattagtgtttygygagaattttttgtgggttgtgaygagaattaagyggagygtaatttttatygtattyggataggatgygttgygtaatttgtygtagtttttttgttttatttygggtggttygaagttgtaattttgttaattttttattataygttatgttttttttagtttagggtttgaatygaygatggagattttgtttttggtagggaaatttatyggtattaagygaggtttttgtygtagttgygatygaagaaatggggttyggygtttayggygygtaygtyggggtgtaygygtagaaattttagtagygttygygtgtygtttttttttaygtygatgatgatggtttgyggtagttgtttgtttttagatttattgaaaaagttggagatggggtttggggagttyggtatttygggattttgttttttygggttygtagygttttyggttatttttttgtttgaagttagtggggtggttggyggygttyggaayggtagtttggggggygtttygttyggagttgtggttagggttggygggtygtgtgyggygygggatttagagtttaggagtagtagtttyggygyggyggygtaggagtyggygtaygagtataggaatatatagagttagaygtagagtatggygaagagtagygygagttttttttttatyggyggygggggyggyggyggttgyggtaggagtyggtyggggatatygaggtaagatttgtygttatttaggygttgttttatgygttgttygygggygyggttagggatatggtttagtatatggygtgggtttygtygggtagtgagygtagagagggtttttyggtaygttggaygttygggtggttyggtttattgttttygtgtgttygyggtygtygttgttgttgttgtttttttttaggtggyggyggtagttgtagyggyggyggtttttgatatgttgttyggtaggagttgtaattggaayggaaagtygggayggyggtaattgttgggygagggtttgttttyggggygygaygaygygttyggggttaggaggaygttgtattttygygttttggttattttagattgtgygtatygtygtaygtyggggttgtttttttgtagttttaagaattgagtttygagtagtttyggtattttttygtagaggttgtagaggygaattgygtaggaagagagttgtggatygaggtggagtgggyggtttyggttttttagagtgaygggttgttttatttattaaaaatttygaaygttatgtaaatataggygttttttygagagtttagtagttaattygtttttaggaygagggggtgtggaaaggtttttgggyggtgtagggyggttaggggttgttattggtttyggaataaggggygggtttaaaggggygg

SEQ ID NO: 7111 - DNA, 2896 bp, Artificial Sequence
  Description of Artificial Sequence: Synthetic polynucleotide
ygattttyggtygygaatttaagtttgtygttttygtygygtttattttttagttttttttttgtttyggygttattttaggtygaygtttttaattaaaataagttttttttttaggagttttttttttttgttygaggtttagggttagtagttttaggagggattttttttttattttatttttttyggtagaggtgygagattttattgttagtttggttattygatygygygtgagattggggygtagggtaggggggttattgggtaggttttygtgyggggagtggggaggggtttttaggggaagtgtttgaagttatttttgtagttttgtttagattyggaagtygtygaggaagggaggaaggygggggtggggagagygygattttaagygttggygggyggygaggaggggtygtagyggttygaggaagygtttggaggygttaggggygtygagtttttagggaggtygygttttygggaagttttttatyggttgttyggagtaggatyggaygygyggatygtttttttyggttygattagtttyggggygtagattgygaatttgaatagaattttttttttttttggtatttttygtttttttattygtggttattagtttygttattttagttttatgtttttygttaatattatattygttaagatygtttattaatgttttgtggaggaaaggggaggggggaatttttagtataattaaattgtggttaaaagyggttaaaaaaaaaaaaaaaaaaaggaaagaaagaaatttttttttttgagatygatttttttaattagygtggaaaatttttaaatatgtaaattygtaattttagttaagattttggygtygygggaggggtgttygyggygggyggygattttagtttgtagtttyggatttygggtaggtttgygygyggyggygggtygggggttyggggagttttggygtttatagtagttygtygaaaatataaagtttygtygttaataatatttgygggttttttttgggtttttygggygtyggygttgygygtttygtygtttttttttttttygtygttttttttttttygygtaygttttttttttygttttttttagaaygyggtggttagatgagatttttgggagaaataaatgtgagygttygtaygaattttttttttygttagtygtttgtaayggttttaggttygtttttttttttygygttttygygygygtygygtttttygygtttygygttttttttttagtagtttttgygagygtttttagtagttattatttataggtygtygggggttaggaggtaattagagayggtttygtggtygtatttattyggtaagygygatgttggygyggggygygygyggggaggggygygygatgagggggtttggttgygygtagttygygttttagatttgggggaagggaggaggaggagggggtagggaaggaggaggygggygggggggygagagatgagttygggaagggagygggaggagggggygtyggggagaygtttttttggtttttatygyggggtttyggggttattygttgygaggtttygaygygtttagggayggggggtgtgagtgtaagagtgygygygygygtaggygtgtgtatgttaaagatagaggaggggagggagggaaygttttaatatttttttagtgatttaygagtttgygggtgaggttttggttgtgygtttaggttygtgtgtgtattaatgtggttgtatatttttggtttgttttaygagtgaatgttayggggtttgggggggggggtttggatataagttagtgaatgtgtttttgggttttagtttgattgaatgatgtggygttgygtggggttgtgtttgtgygattgtttataggggggttgtgtgatttygtgaggtattgygtgggtgggattgygtttgtgtgyggttgtgtgtatatgggattgtgtttgygtggggttgagtgtttagagggtagttgtgtggttatgtgggtttgtttgygagtgggttggtgggtgtgtggggtygtggggttgygtatgtaggggtagtgygtttgtayggggttttgggttaatttaaagggttgtggtgggtatttgtaggyggttgygtgtgtggttggatttgygtggggtttgaggtttggygggtgggggttagtttttttggygtyggggatygtatygyggtagaagagtygtttaaggygttaataggtagygtyggggtygyggygtagygygaygtgtagtagyggtggggygtagagagaaggyggagaagaggggggtttttatygygygttttttttagtygtattagagaygtagtttggagattttgtygtttgtyggtttygyggttttagaagtatagggtttgggggattttttttagttgggggagaygtttattggtygggaaggtagygagaattgagattygatgattttggygtagtatagaagtatgyggtaaggatygttaggagaggtgggtygyggttyggagatagtygagaattaggtygagataaagaagagygggatyggggattttggggttaaatygygtttttaggtttttyggyggtygaggggagygtatttaaggtyggygygtggagtttggyggaggtggygygggttttttttygttgtagttttagtagtygttttagagttttgggggtaygtaattaggygttatagggtagggttayggtgaggggggttttgagtgtagttggygggygtygagtttyggggttgtgattgagygtttagttggttygtttttttttyggtygtttatygtttaygt

SEQ ID NO: 7112 - DNA, 2567 bp, Artificial Sequence
  Description of Artificial Sequence: Synthetic polynucleotide
cgtttttaacgcgggagcgtagtgtattttagtggataaattcgagaatcgtacgttgtttttcgtttttatttttgtttttttcgttcgcggttttaattcgggatttaaatgtacgagttcggtgaatgtttcggtaggagggcgagggtttagaggtagtttgtttagtaaaaacgatagttgtgttttggtgggttttgggttattttaggtagaagttagagaagttcgagaatttcggcgggttggtaaagtttgtcgagaagggtttttttggatatttttattacgggttttaggttcgaatttttttttttatttggttttggagttttagatatagataagtttcgggcgcgtcggcgggcgtatgtgcgtgtgtgtttatagcggggtggtcgtcggagttttttaagaattttagttttttcgttttagttgttcgttagttgtgagcgttcgtcgggttcggaggttattcgtaaatagttgggtcggtagttgggagtttgggaggtttttgtttagtttcggggtttcgagaaaggagaagggggagcggagtggttgtttggttgtggttttttttaatttcgtttgcgaagttttcgttgggagttcggagttttagtttttttcggtagtttcggttttcgcgttcgtcgcgtttagcggtcggcgtttcgtttcgggtttcggggaggaggcgcgtcggggtagtcggttaggatattgcgttgttggtttttagagttgcgggcgcgtttggtcggttttatttttcgggttgttggggcgggcgtcgttgtttcgatttcggacgcgcggaattttggagattcggtcgtttttcgttagggtcgcggtgttgttttaggtttcgggcgggcgttttttttcggttatcggtgtatttcgttgttcgtttgcgggaagcgaagaggggttttttgatttgtaatatagaggaaagcgtcgttttcgtttagtttggtatttacgcgtttatacgtattcggcgtcggtcgggtcgtttatttgagttttaaaagttgttgaatttatatggttacgtttcggggagcggggttttagatttggttcgtttaggttatttgcgcggcgttcgcgttcgttcgttttcgtttcgcggcgtcggttttcggttttcggttcgtcgtttttcgtcgttcgtcggtcgcggggcgtatagcgagttagagcgcggtcgcgcggggttttatgtcggtcggcgcgtcgtcgtcgttggggcgtatggtttaggttgggcggttcgcgggggcgtatatttttcggtcggggcgcggggttcgcggtttttttcgtcggcggtatagcgaaggcggtagcgaggcggggcgtgtttcggcgttgtcgcggcgtagtaaagggttggggagtcgcggtttcgtttttcggggcggcgaggagggaggtcggcggcgttgtcgtttacggtgcgtgtttttcggcgcgcggtttttgtttttagtcggagtttcgcgtcgatggggcggcgttgtttagggtttggggtgacgcgacgcggacggacgcgagtttttttcgcgttgtcgggtcggggggttttgttagaggtttcgtcgtcgatcggcgttatttaagttgttcgggggtttcgtttgagcgttcgttttgtagacggtcgcggttcggagattggtaggaggcgggtacgagaggcgcgcggggcgagggcgtcgtggagcgcggggcgtggggacgcgcggcggcggcgtcgcgcggaggaggcgcgcggggatttcggggtttcgtcgttcgcgtttatcgcgttcgtcgtagagtcgttcgcgttgtttagtcgttttttttttcgcgtttgttttttcgcgcgttcgttttcgtttttcggagtcggttttaatttcgttcgttcggttcggtttacgttattcgtttttttcgtttttcgaacgggagttcgagtttttggtttggtttcggtttttgttcgtcgttttattttgcgggggtcggggtcgtcgcgggtggtggggggcgttgtgtttagtaggggcgatagcgtaggcggggttttttgtagtttttttttttattttcggtcgcgtttcggtttttattttgcgaaaggttcgagagaggtcgtaggttaggattggatcgtcgggcgtcgtcggatggtgttgttagggtaatcggatggtacgcgaagtcgttcgaggtttcgattcggttacgggggcgtttagtggattcggagagttattttggggagggggcggtttcgaagaaggattgggtgggggcgtatggagcgggggttgcgcgaaaagttttttggggcggagttgagttacgcgggtcgcgtaggagcgtttgttcgagggtcgtttacgagggatttttttgttcggttgcgcgggtttttgcgttgatgaagttatcgcgtttcgggtcggagtttcggcgtttttgtttcgaatttagcgaagttcggttttatgtttttaattatttaacggttttttatcgtttagcgt

SEQ ID NO: 7113 - DNA, 573 bp, Artificial Sequence
  Description of Artificial Sequence: Synthetic polynucleotide
cgttgttcgtcgggtcggtggcgtttatttcgtatcgcgttgtttcgttcggggtattatggtttggggttggattatgttttttttattttagtcggcgttttttatttacgcgcgttgagggtgcggtgagttgagtgcggggttaagtatgttttggcgtcgatttcgtttaggggtttaggatttggcgtttaaggggttttttggcgacggagattttcgacgtagtagcgattcgcggttgtttaagttgatttcgttcgcgtttcgagcggttttgggcgcgcggggtttcggggattggaggatttcggggggcggcgtcgcgtggtggtcggaaggggacgttaagttcggggtgggcgtcggacgtttttcgtcgcgtttgttcgttttgtttatcgcgattcggcgggtcgtgcggaagcgggggttgttgcggtttttgttgtcgttttttttgttgtcggtcggcgcgtttcgggaatcggcgtttaggtagttagggtttggagagcgcgagcgttttcggaggcgcgtggttagggaggatttcgattttttgggcgt

SEQ ID NO: 7114 - DNA, 383 bp, Artificial Sequence
  Description of Artificial Sequence: Synthetic polynucleotide
cgttcgtcggtttttataggggcgaaattaggtatttatcgtgacggcgagcgtgatagcgttcggttcgattttgtttagatgtttatagaagatggagttgacgaggttgattataaagattattaattgcgtaagaaattgcggaggcgcggaaagtaaggcgcgtttatagtcgtttttttttttggaagttcgcgtttatttttgcgcggcggtcgtttcggaggcgtcgggttgggcgtgaggacgtcgtatttattattgggttcgcgagcgtcgttagtttagtcgttttttttcgtaggttcgggggtagcgtatttcgtaggttttataagtcgttacgttattcgagggttcggagtcgttatgggggtcgg

SEQ ID NO: 7115 - DNA, 853 bp, Artificial Sequence
  Description of Artificial Sequence: Synthetic polynucleotide
cggcgcggggtgaggttcgggggtcgttttattgttgaggttcggtcggttggggtcgtcgttaggcgcgttggttgggtagtttttgggagatgaagcgacgtaggcgttttaggtattggttgtagagttcgatgtcgttgtgttcggcgttttttatttatagcggttttatcgttttggggtagcgttcgtagagcgttagttcgtgcgagaagtcgattatttcgtttttcgtgtcgtggatgatgagtacgggcgacgtgatttaggatattttttcgatgttgcgggaggggcgtggagcgggtgagatttagcgttcggttcgggtttcgtttcgttttcgttttcgtttcgttttcgttttcgtttgggtcgtttatttagggaaggcgtcgaagtagtaggtcgttttggtgttagggaaggcgacgcgtatgttcgaggtgagcggcgagtgtagtattatcgcggtatattcgtagcgcgaggttaggtttacggtgggtatcgtgtcgatgttttgtcggtataggatgatgttgttcgggttgatgtcgtatttggtagcgtcggagtagggttagtcgcggttttcgacgcgcgtatattttttttattagcgggcgttttcgggtttagtttcggatgcgattttttagtttttttatttagttaagttagtgggttaggtttaggttttatattagtttcgagggttatttttagtttttaatatcgcggcggtgggcgaagttagcggtttcgtttcgttttttgcgttgtcgtttattggcgttttttagttaggatttgtagggatttcgtttacggagtgtttttggggcgg

SEQ ID NO: 7116 - DNA, 1062 bp, Artificial Sequence
  Description of Artificial Sequence: Synthetic polynucleotide
cgaggaaggaaggtgggcgtagaagttattttaggcgtgacgcgtgacgttcggggtacgggcgtcggggggcggaaagcgagggttcggttgggttagggatattcggggggggtcgaggttttgggtttcggcggagggaggggattgggagggaggttatcgtttcgggttacgcgggtgattcggcgggggagttgggggaggggcggcggggttgggttggggttttcgggtcgggattggggtcgggttagtttattttttcgttttggtcgaagcgtagttcgagcgtcgcgacgcgttttacgcgtaggaagtcgtcggggtcgcggtcgtatatttcgaatatttcgcgtaggcggcgtacggagcgtagtagagtcgcgggggcgttcgattagttcgcgtcgttcgttattcgggtcggttcgtagtttagttcggatttttcgttcgtcgcgttcgtcgtttgttcgtcgtcgttatcgtcgcgcgtttttcggggtcgttcgtttgggtttgcgtcgcgtagttttcgttcggtggcggtcgcggtcgattcgtgttagtagcggcgtcgtagttttagtcgttttggaggggaagggaggggaggggagggaaggagaagagtggggaggggaaggaggaggggtaatagggggcggggaggggaggggcgggggtcgcggcgaaaatgggagggagagggggaggcggcgggggcggcggcggcggggacgttgtagataaaaggagttcgcgttttttcgagtggggcggtttacgcggggtcggtaggcgtagcgagttgttaacggtcgcgtttttcgcgattttagttttttttcgcgtttttagttttttttcgcgttttcgagtttatttttttttttggatattcggagttatttaaaggttttgttttgtcggaggatttcgcggggtcgcgttttttttcgttattcgtgttcgttgtcgcgtttggcgtttttcgagcgtttaggatgttttgggggttttttgtattggcgcgtttcgtgattgtatttatttcgg

SEQ ID NO: 7117 - DNA, 918 bp, Artificial Sequence
  Description of Artificial Sequence: Synthetic polynucleotide
cgcgaagttttcgcggcggagagcgttgcgcggggagataaagggaagggatagggatcgtagggatagggataggagcggttgtcgggttttgggttttcgatcgttattagatatgttttcgagtagtcgaggtaaagggaacggatgggaaaggaaaatagaggagcggtttagaagggcggttcgttgcggtggtggggcgcggattcgggaattcggggcgggtagggtacgggcgtattttttttttttttttttttcgttcgaggtcggtagcgtttttcgtttcgcgttatgtatatttattgtggtgatgagagttcgcgtttcgtgttcgttacggttattgtgcgtttaataaaaataaatattgtcgaggagtcgtcgcgatgcggggcggacgcgcggttcggaaaggggagggggttttaggaagagttatattcgcgagtcgggtttgggttaggggcgaggggagagcgttaagattgtttcgtcgtcgagggcgtcgatggaggtataggggttttcgtggggcgtttcgagagatatcgtgtttggtcggcgggacgtgggttggttttttattcgacggagagaagcggtatttttattttcgggtatcgggtttgggtttcgagcgggggtttttggaatataaggtagtgggggtagacgggtttgggtttattttaggttgggaaggggtttgagcggggcgttttgattggattcggttttggcggatcgaaggttttaaaagattttgtatttttaaagatttttgtagatcgttatcgtttaaggcgttttaggttcggttttatttatgggaagggtaggaaagaaagttgggagcgttttggggcgcggggtagagatagcggtgttggaggcgcgttgtggaggcggcgg

SEQ ID NO: 7118 - DNA, 865 bp, Artificial Sequence
  Description of Artificial Sequence: Synthetic polynucleotide
cgagttgtgtcggttttcgcgttttttttattttttttttttttcggattttcgttttttcgcggagaggttttgtcgttttaagagtcgggttagcgattgataagtaataaacgttgagcgttcggttgcgttggagtcgttcggagttaggggtttttcggggcgtaggtaggcgtttttcggttttcgggttagtttttattttaagattttcgtttttttttcgttttgatacggtatttaggattttatttattgggtttaaattttataggttttttttatttaggttcgttttttttttgtttattcgttttcgtttttgggttttttttttggggtgttggttgggagaattaagtttcgttgtttattgatattggttttcgtttttgcggtaggggttttaaagtggttttaggtattaaggtggtgagttgtgaggggtttcggtatttgcgcggttttttcgggggttgtgcgggttgggggtatttagaagttcggtattacgtaagaatcgtgttgttagcgttttcgggggttggggagcgagatagaggttgcgttgggtttcggtggttttttggtttttttaggtagttaatattataattttttttgggagggggttcgtagaagggcgcgcgttgtttttttcgttttttaagttgtagcggggcgggtcgggagttagggttagggtttggagatttgggaggggatcggtgttagaagcgaagagttagggttagaaagttaggttaattaaggggggggcggtgcggataaagacggggtgggggttggtcggggtagttatttagtgattttatttttggttttcggcgggcgcgtacgt

SEQ ID NO: 7119 - DNA, 408 bp, Artificial Sequence
  Description of Artificial Sequence: Synthetic polynucleotide
cgaagcggggagaattcggttgggttgacggagacgttatatcgcgttaggggagtaggagttttttcggagcgggaggcggggcgtcgtgtggttgcgagcgcgttttttggatgtttcggtcggcgcgggggtgggtgggcgttttcgttttatttttggtttcgggcggttagtcgcggtgtgttcggagggttttgcgagggttgtgggtggcgggcgagttttagcggcgtagtagaggaggggttttcgagcgagcgtattagggagaagggggttcgtgtaaattttaggttgacgatcgcgtacgcgtttttcgggttattagttttgtcgtttttggtggggtatatcgaggagatcgtcgtggggaatcggggatcggattgtttgatagtcgagcgt

SEQ ID NO: 7120 - DNA, 2245 bp, Artificial Sequence
  Description of Artificial Sequence: Synthetic polynucleotide
cggattttgcggagtttcgagtttcgggtgaggcgatgtttagattggcgcgaagcggggtgtttcggtagtagcgtagaggtttattcgttttttcggtcggttgtagcgggcgcgtttatattttgtaaaattaaaacgttttggaaagcgtttggggttgtaagtgacgtttgatacgagcggcgggtcggattgtcggtttttcggtttttttttggtttatataattcgcgggtcgtttttatcgtttacgaattttagcgggtagacgttggacgtgcggtttggttatttttttaaattttagcgttcgattcgcgtcgtagggtcggtcgcgtagcgcggggatcgcgggtgtttaggttcggagaacgagcgtcgcgtttttagtcgcggtcggggaataggaattgtcgttagaggtatcgttttttttttcgagattgcgatattgattaagggttcgtaggcgcgggcggtatttattttttcggattcgtagttcgtcgcggaggggaaggggtaggacgcgtttttaagattagggcgggggcgtgcggagtcggggagttgtttgggggcgttggggcgaggtgggaatttcgttttagagtttttagtttcggggtcgaggtttgtaggaagggcgtgggaggtggaatttttttttttttaggcgtttgttcgagagtttagagcgatttttggcgcggagtcggttattcgggtgggcggattttttttttcgttaatatttcggcggtttcgttacgatttttttttttatttgagtttttttttgtttatttaattttggttttaaaggtttagagagttaggttgtttcggagtttagtttttttcgatttaagtacggtttttttagcgttttcgtttttattatatttatagtttagtttcgtttcgcgttcgttaggggtcgggggcgttagcgttcgagggatggtcggcgggttgttattttgacgagacggagttgcgggtgtttttttattttcgggttcgttcggttatcgttttgaatgttcgggttttacggatattttagagggatcggcgggcggttgcgggttcgggcggtacggggtgggcggtcgggtttttcggtcgttgtttggtgaggagatgttcggttcggcgtttttcggtttcgcggttcggttcggttcggttcggttttcgttcgttttttttcggggaagtttggtcgtcgtttttcgacgtagttcggttcgcggtcgttttttgtcggtttcgttttcgttattttttttacggttcgcgtcgtttttcgtttcggtttttcgttttttcgtttagttcgtttttttttttttttttttttttttttttttttcgttttttttcggtttttttttcgcgtttcgtttttcggtttttttttagttttttttcgtttttttcgttttttttttttttttcggttcgttttttgtgtttcgtcgttaggattttttttttttgcgttcggggtttgcggtagttttcggggcgcgttggtagtagtggcggtcgtcgtagttcggggagaagtcgggaatgggggaagggggtcgcggtaaaggattagtttttcgttcggtcgaggtcggggtttgggaagttttagggatttggggtgatttgggttagggtgtttaggtgaatttatgagggcgaggttattgggggttagggaatagggcggtttttattgagcggagtcgtcgcggaatttagtgaggttgcgatttgcgtttgggtagttttcgttttgcggttggttaggaggagtttttcgtcgtttttattttagtcgcgtcgggcgttgggttcgatttttagtatttttggtattgatgtgtttggtgcgcgttgagacgcgaacgttttgtaagatgagtttttatttattcgtttttttttttttttatttgtttattttataaattgagtgtttggttattttggtttaggtaagaggttggatttgggaattttttggatttgggagttttaggatgaaagggagacggcggtgttttgtaggataagcgggtattgaacgttgtttaggggaaagtcgggcgcgtattgcgttgtagcgcggcgaacgttgttaggagttcgcgggtagggcgtggggaggatatagcgttttttttcggtcggtcgagttttttgggtagcggtgggttttttcgttagatttcggggtcgt

SEQ ID NO: 7121 - DNA, 2972 bp, Artificial Sequence
  Description of Artificial Sequence: Synthetic polynucleotide
cgattattttcgtttttttacgcggttttttagggaagaagcgaggcgtttgagttagattgggttggaatagtgcggtaggggttcgtttttcgcggagttgtttttttatttattatttatttagtttagttcggtcgtttacgtacgtttatttgttgttttcgttttatttttattaggcgtattagttagttcggcggttttggttatagacgtttgaatgataaagtgtttttattatcggcgcggttcgttagtcgattcgtcgggacgcgttttggttttagtttttttttttttatcgcggtttaggaagaaattcggatcgcgtatagttattttagatcgagtagtcgcgcgtcgaggcggaggcgggagtcgtaggggttgtagacggtaggtttttgtcggggtatatttttttaagcgtttaggttttttacgtttagtttttttttttttttgggttttcgcgcggggattttcgtttttgtttagattcggagtttaagtcgttgtttttttgggattcggtttttttttttcgtttttttggtttacgttcgtttattcgcgtttgagtagcgtttttaattagcggcgttagttagtagacgtgttcgcggtcgtttttaaattttcggacgtagttataggttttgatagttttagggaattggggttgagttttcgggttggggttcgtattcggatagaatttttgtttattttattcgtaggttttatcgtcgacggattttggggatagtgttaatttttttcgttttgttgggaaacgtagtcgtgatttcgagttgggatagcggttgttttttgaaaaggtgggggagtatcgagttgggaattaggtcggggagtttagttacgattttggtttaatttgttgtgagattttggttaagtcgtttaaatttttagagttttagttttcgtatttgtaaagtcggaatttggggcgtagtgttttgatgaaagatgttggcggggagagtgaagacgtttttttcgttgttagattttttagggtattcggtttatggttataaagtaggttatatttgataatttcgtcggattattcggaggattcgtcgatttttgtcgagtcggtggttcgggatatcgcgttatagaattcgaggcgttcgggcgttttcgtttcgttaggtgtttagcggtttgtatcgagagttaggagaggtttagatcggatttcgatttttcgaggcgcgggagtttacggagcgcggtgggcgcggcgttcgggtcgcgtagttaggtggggagcggcgcgtagttttagattcgtaggtaggtagcggcggattgtatttgtttcgtttcgtagcgttttttgtttgtcgtttttcgtttgcgtagttagagttgcgcgcggttaggaagggttttcgtttagtgcgtttcggcgttttgtatttcgagacgtagttatcgttagttcgggtaggggtatattcgtttcgtttttcgcgattcgttgcgttgttttaagtcgtgagaatacgcgcgtcggaggagttcgtcggtcgtgggggaatttcgggagcgggttcgtttcggcgaagtgggtattttttttttagttttagattcgtagttttaatttcgggattgggagaggtcgcgagtaggagcgcggggataggcgttggaaatgtttaagtttttgtttttttttttcgttttattgttttttagcgggtaggcgggatttcgattattttagggttcgcgtttcgttttgttttttttttttttgtttttatttttttgtcgttttcgtcgtcgttttttttttgttttttttaatttattttttaatttttttttcgttttttaattttttttttcgacgttttttttttttattgtttggtcggtttttattgtttttgtcgggttttttttgtttttagttttttcgattttttttattgttttatttcgtcgtttcgggtttttcgttttagtttagttcgttttttttatttttagttttcgtttagttttttttttttttttcgttttggttttgttttacgattttttagagatcgagatgttgaggggaaagttttttcgggatttcggtattcgagtgttttttttcgaagaatttgggtatcggagagttttatgtttttttttgaaagattttttttagtttttttatcgttttttgcggtatttgaggatcggtattcgtgtttcggttttgtttttatttttattttggagagtcgtttttgcgtttcgggaattttagattttttttcgtggtttcggtattagaggtttttttttattatttatttttagtatttgggattttaatgttttgttttgtttttttggtggcggcgttcggtttttttcggagttttgatttcgggaaagggagcgggtttttttcggttaatatttatttttagaagtagtaatagtagtaggcgcggttcgtttatggcgcggtcggtggtatttgtttttatcgttcgtttttcgcggtagcgttcgatttttagttcggttcgttttgcggattgatggggttgcgttgcgttgcgttttagcgttttttttgttcgtcggagttggtcgcggttcggttcgttttggttgcgggcgggagaggttgggtgaagttagtgttgcggtttcgttttcgtttcgtttagttcgtttattttcggaatcgcgttcgttcgttttgtcgtttcggggtgggaagtagaggtaaagggagggcgtgcggtttttcgtatttcgttgcgtttttttttgttttgttttttagagttttttatttatttcgttttggtatttagttttcggttcgcgttattgcgcgttcgtttcggatgttgtgggttcggggattagggcgtttttattgcggtttttgttttttttcggttgcggttcgt

SEQ ID NO: 7122 - DNA, 1026 bp, Artificial Sequence
  Description of Artificial Sequence: Synthetic polynucleotide
cgatcgttcgggttcgagtagcgggggcgtttttagcggcggtaggcgcgggtgcgggggagaggagtagaaaagagagtagtttgaggggtcgagggagtcgcgttcgaggtcggcgcggtggggatcgcgggtttattattagttaagtttagttatttaattatttgtagagttgttgtaggtataggtttaggttttcgttttttattttttcgcgggtgatgcgttttgatagcggtcgcgggagcgggggtaaaggcggtagttggggcggcggcggcggtacggtcgagtgtttcggggttgtcgtcgtcgtcgtcgcgtttttttttttttttttatttttaatcgtcgtttttttttcgggtttcgggttttgtttttggttttttttttttgtcgcggttatcgtggtcgtttttttttcgggtttttttatcgaagtttcggtcgttttagtttttattagtttaggttcgggttcgggttcggattcgggttcgggttcgggttcgggttcgggtttcggtttcggttcgtcgtcgtcgtacggttcgcgaaattcgtttaggaatagttttaggaagcgtcggtaagttttttttttagggatgtagtcggttatcgttgtttatgttttagggtagatcgggaaaggggttgggggaagtttaggaagggtaaggggttgtttttgagtttagggtttcggtaagggcggttaacggtcgtatcggtacgagcgattagtattaggttgtttggagagggttttcgtaggcgtgcgcgtcgtcgagtatcgacgtgcgcggttcgggggcggagcgcgtcgtttttttcggatttggagggaaagttggtggcgggcgcgcgtagggtttagcggcggtttattttttatttttacggagagtttagtttacgttgtttagagattgtcgttatggtaatcggttttaattaagtattgtagggtttttttcgtcgagttcgcggagtttaaaggatattttattcgttcgt

SEQ ID NO: 7123 - DNA, 10207 bp, Artificial Sequence
  Description of Artificial Sequence: Synthetic polynucleotide
cgttggtttcgtcgttagttttttgggttttttttttcgttggcgttgtcgcggggttataggttttatttgagatgttagtatgtgttgggagaggtggaacgggaagggcgcggcggtgtttgttgcgttggtcgcgggatttagttcgtttgcgtttagtttcgcggcggttttaggttcgttattttcgtcgttgtcgtcgtttgttatcgaggttagtaggtgatttatgtttatggcggagaaggcgttagggtttatggtgaattgtttagggtgtaggaagagcggttggtcggtttttagcggtttaaagaattgttgttcgtgtaagtggttggaaaaggttaggtcgggtaggtgttcggcgtttaggggggacgtattgtttgtttgtattattagcggcgttaggttttgttttttgttttcggtcgtttttttgcgtttttcgtttttttttcgagtttcggcgcgttttttttttaggttttttaggtcgaacgggtcgttttcgtcgttttcggtcggttttttgtttttttcgggattacgtcgttttcgggcgcgttcgggttcggttaagcgagtggggttggcgttgtttggagtcgggttgcggtttagcggcgttttcgtacgtttttcgtttaatcgtttaggtttcgggtcgttgttcgcggcgtacgatttttttttagttgcggggagagggcgcgcggattataggggtttgggcggaggtcgacgagtaggattagggatattcgggaagggttgttttcggggaggttgagtcggaggagttgttggagtcgggtaaagggtagttgtaggttatttaatttaagattttagatttatagtggaaggaatttagttttggagaggaaattttatagttatagaattatacggcgtttaaggggttaggttcggagttcggtcggattttttggttatcggggatcgttttcgtaggggagtttcgggacggaaattttattttagatattcgtcgacgttttttttttggttttttaggttagcgggtggtttagtaaaagattagtttagcgatttgaggatttttcgtcgttatttttttgtttttttttcggttcgatttttatttcgggttcggtgtaggcgtagcggattgggcgttgcgttcggggaggtgggtggttttcgcgcggggggagggtcgtacgacgaggcgtttgatttcgcgttatcgcgttcgggtttgtagtgtttttcgtataagcgtagagacggtagcgttagttgttttttggggatgagcggatgaattaggttagcggggagtttatttttttattttttttgttcgttgttttcgcgggtattcgttatagggttgttgttttcggttttttattttttttttcgtcggtcgttttcggtgtttcggaagtttttggtaaacgggttgttgtcgatttttagttgtgtgatttgcggggattaagggggcggcgttaagttaggtcgtggtttttttagcgtggtcggtggtatttcgaggttagcgggtgttggtcgtagagggaagattcggggagcgtttatttggtatttattcgtttgggatgggacgtttcgagttgaggtcggtgggagggtttcgcggaaagcgacggggtttgttttttaaaagttttattcgaggaattatttttagataggtttagatagttttatataggtttaaagtagtgttatagtgtcggaattagtttaagtatgtatattcgttcgcgggtttgcgtaagttaaacgatttcgtattcgagtaggcgcgaatagagattgtagtttatacgtaaggttgtaggtatatataaagttaaattatatttacgggttcgtatatacgtaagtgtgtatagatataataaacgtttacggaattaaacgaatttatatgtttttataggtatttaatatattttaaacggggtacgtatagtttagcgtatattttggtttataaagttataacgatcggtacggatattcgtatttttttttttattcgatagtggcgtataagggtataggtttagaggggtgatgttttgttttattagaataagggtggagaagtcgtaagtagaaaaagttttttgattggaaggtaattttttaagcgttttttaaggggtttggggtttagattgatttagagtagtagttaggagtgttttggggggttgtgttatttgttttattttttggtttttttcgagagagtgaaaattgggtttcgggttttgagtatcggtagagtttgggtagattgtttcgggcgttttttttttatttatatttttatttttgagttaagaaataaacgaataaaatgtaaaaatgttagcgcgggttcggagttttagttaattgttaagtaaatatttttattagaacgacggtttagttgttcgttcgttttaggggagtttgtgtgtgcgcgcggtgggattgagagggcgttttgaggattttcgtgagtgttgcgcgtatggatgcgaggttcggtgttcgggggcgggtcgtaagagcgcggatttcgtgtagggggtttcgaggggcgatgaacggacggttgggtttgtacgtgttgaggggcgttagtgtaggggtttagtttatcgttcgtcgcgcgtattttgttattttggtaggtagtgacggcgatgaagtcggttttcgggaatacgtaggtgcggaaggtgttgtaaggtagttttaggatgtcgttggttcgtattatgtggaagcgcggttggtatttgtgtatggagtttaggatggtttgcggggagggtgggggttagtcggtagttattagtttcggttcgagtttttttattttttgggtatttgatttttttttttttattttttttttttttttttttttttttttttttttttttttttttatcggtttttttttttttttatttttttttgtttttgttttttttttatttttattttttttttttttattttttttttcgtttttttttttttatagttttttttttttttgttattaaaaaaaattttttagttggaaatagaaatgagatagagtaaaaataaaataaaataaaaaataaaataaaaaaattaattaaaaaataatttttttttataaaagaaatttaaataaaataaaataaaatagagttttataattttatttttaatattttttttttttttggtattggtaaattttttaattttataaagaggagattttaattttcgggggtttattaattgttttattttagaatgggtagttttttttattttatgaaatattattttcgttcgttggggttttgtttaggtataaatggagagaatttttaaattttttttttttagttgggtatttgtttgtgggaggagggaaaggttttagggaggttgggggggtgggtggggagggtggtttaatttttaaattttttagttttgggggagggttagggacgcgggttttggtagaagggtgatggataagttgaggttatgggtaggttttttaagttcggtatttataggttaagagtagggtgattttcgtggtttagtattgtagatttagttttggtagtatttgtttttttattgacggtataagggattttttacggtttgaggaattgagattgtgagttgttagttattgattttattattttttaggtttgtaaaggagagcgttggggtttaggtttaggtttagtttacgtagattatagggtagtgattcgggtaggggtattttgggggtttgtttagcgtttttttttgggagattttgtcgttttgtttttttgtttagttgtagtgttgggttaataagtttttgtatcgtttttattttgttttaatatttacgaagtcgtgtttgttagagatgttgttggttagttttagtttgtggaaggttataggtttagttatttattgttttttcgtggttgggttgtttgggtggatgtatatgcgtttgggtattttagggtcggttttgttcgttattatttagcgcgagttgtggaatttatagcggtaatcgttagcggttataatgtttattagtaggatatatttggtttttttgtttaggtcgttgattcgtattttgaagggggggaatattcgtttgggagggagggaagggaggagattttattggaatcggttgttttaggttttaggattttattttttttttatttattttttttcgttgcgtatatcgttgtcgtttggttgttttttttgtggtcggttgttttgtttttttattattgttcggacgattttatttgtggttgttgtttttaggagattttatttttgtttgttagatttttttttaaatagttttttttaggttttgtgtttagatttggggattttttttttttttgatttgagatgaaagttgatgtttaggagagaagtttaggttttttagaaatattttcgtttttttttaattttttcgaaattcgtttaggggaaatatttatttgggacggaagtttttagaaataaatttggagggtgtttgtattgggaattgggttatagagtttgataagatattttggtcgtgtagttcgggggaagagggtgaattcgaggtttggattttcggtggttgagtcgaagggtggaggggtcggggttgtggttttttttaggttttaaggtttggggcggcggatgcgtttagggttcggatgttcgcggtggagaaagggtttttagttcggtgaggcggagggttcggttgattcggggttcgttgttaggaatcgagtaattagcgtggggttagttgggtttaggttttattaggggtttcggggtcggagtagagtttgagagaggttgaatttttttcgagttcggagacggattcggacgtagaagagcgagagcgcggggcggaggagatcgttagggttaagtcgcggggttttttttgcgttgggatttagaacggttggggttattttttagtagtatgttttcgttttattttattcggaggattttagcgtttttgttttaaaaaaaaatcgtttcggtgttaaacgagaaaagttaatttggttgttcgtgggagcgaagcgtggcgttagggttagaatttggagtcgggagtcgggagtcgggagtttttagttttgttttgattcgtgtagtttcgtgttttagttcgttcgttcgttcgcgcgttttttagtcggtcggtagttttatttttcggatttggtgatgattattttcgtgtttagtttgtggaattggttttatagttttttggtttttagcgttattttggggtcgttttttatttcgttttcgggttttaggtttttgagggagcgtagatgcgcggcgggcgggtgcgggtttagtgtcgagacgtgtagtttcgtttcggtcgttgttgtcgtcgtcgtcgtcgcggtcgtcgttttcgttaggttcgggtcgggtagcggtttggttagcgcgtcgggcggtagcgcgagtgtcgggaagaaggagggttgcgtcgtcgttagaaaggcggatatggggaagtcggcgggtcgtggcgcgtggaacgggtggtaagttatggcgttggtcgttagcgtcggtttttttatcgggatattcggtttaggcgttcgggggtcggggtcggggtcgggggcgcgcggttcggattttcggttcgggcggcggcgcgcgcggtggacggacgattcgggtggcgggcgtagtagttgtttttcggggtttttcgttcggcgtatcgtaaggggtattcggttttgtgcgcgggggcggcgggggttttgcgcggggtcgggttgggtcgggttgagttggttcgtttcggcgtcggggattacgcgcgattggttagattttgtcgtgatttttggaaaattgtgattattttatatgttttgtttagttcggattttttgcgttaacgagttaggttttttttgattgttgattttacgttttttggattaattgtgggttttcgggggcggggttttgatagtttaggttaagtttcggtcgggagggggggtttgggagaaggtgtcggaagttttagtagtaagaaaatatgttaatagaataaaatattaattaatgacgggtcgtcgggtttcgagatttttttttttgtttcggtttttatcgttcgttcgcgtttgcggttgtttgcgtcggattggagagcgcggagggtcgatttgattcgtcgaaagggtttgaggcgaggggagttcgggtttcggggttttggggaaggattcgtagtcgtacgtcggttttaagtgtaaagtattgatacgatttcgagcggagagggggcgttttttttttttcgcgtttagaggttcggtcgttttggttcgagttttagtttggttttcgatttagtttcgggtcgtggcgtcgtttgggggtttttgcgtttcggaaagagatagtaggtattggaaagcgaggtcggtgggcgggcgagtcgggaggttcgggcggtcgaggttcgggagcggattttaggtggcgggagttggtgagtggagttatggtcgagttttgttggggtcggcgcgggcgggagcgggacgcggttttgcgttggggaaacgcggggattttttattcgcgttcgtttttatcggaagattcggaaggaatttggagtttttcgtaggttcgggtttcgttttgagttttttagcggtcgggaggagcggattttcggggttaggaaggtgagcgtatttttcgttgagtatagggcggtatcgcgcgggcggatttcggattttttattcgcgatttaacgaattttcgttttattcggtatcggagacgaaagtttttttttttcgaaatatcggtttttttttttcgttttgttaattatttttttagtttttttttatttttcggaagcgtacgttttttaagttaaggagtgttgagtaacgcgtgagggagttggggtgtttgcgagtatttgtgattgaagtttttttttttgtgattagttttcgttttttgtttttcggtagttttagttttttttttatgaagtgatggtgtgtgtgtgtgtgtgtgtgtgtgtgtgtgtgtgtgtgtgtgtgtcgggtttcgtgtggtgttttttgtgcgtagcgagagttataatttaaggtgtgtacggggagagtgaagcgattacgtatttgtttttaatcgggttcgggcgcgaatatttaggttgatttttgaaggtcgttttttgaaggaaaagatagagtatgtattagttacgggtgatatttttattcgtataatcgcgtggtgggcgcgtatatttaatattgatttatgtaggcgttcgtttattgcgtatatcggtcgtagggtatttcgttgttgaacgttgggagtagcgtttgaaggtcggattttttttggtagtgcggattcgggatcggcggaagtagtatggtttttgcgatcgttatttttatttttcggggtcgattttagggtttttataattttttattatcgtatatgtgagcgtcgtttttatagggttttttttacgatttcgtttttggttaggtcgtattttttttagtattttttttttggttagaacgaatttttgatttcgagttgcgtagtttacgtagacggggtaggatttattgtagttttttataggtaaatatttgttggttttattttaggcgagatgtggtttttcggggagggattcgttgtggatacgtttgcgtagtcggtgaggtgattagataataattagggtagttttttttagtcgggaatttaggtatcggtttaggaattcgtgaatatattcgtaaagtcgcgcgcgcgcgcgcgcgcgtgtgtgtgtgtgtgtgtgtgtgtgtgtgtgtagatatatatttttgtttttgtaagagtatgtgtatatttaaatgtgtgcgttttagatattagtttattttattagtttatttatagttggtttaggggttcgaggtttgaagagtttgaaatatttaggtttgggttatttgatcgagaaatttggcggcgatagtgtagcggttgtatttggggacggcgattttatttatagtggtatcgattttttttttggtttttcggggttttgttcgggttaggattttattattcgtttcgtttcgcggtttcgcgattattttgaggttttgttgtagtcgttttgaagagtttgtagcgatttttagttaaattttttagttaggaatgttcgaggtttatcgaaagttggcgttggggaggtttgggaggttttggagcggcgtcgtgaggttttcgttgggttttttttttatttaggtcggttttttttttttttttaggaatttttttttttggcggagtttcgggggtcgagtgtgcgtgtttttttaagaggtttcggggggcgtttcgcgggtcgttcggggttggagggggagggcgcgggcgggggcggttggcgttaggcggtcgaggttttataataaagtttcggtttttgttatttcgtatcggttaggtttcgtagataggcgggggacgcgcgttcggtcgtttttttttttcgtaggcggttttcggttagggcgtcgggcgggtttgggttggtggcgcgcggtttgtgcgtttcgcgtttttcgtaatagtgaaatggggcgggagcggggacggtttgggtcgggtggggtcgcggttttgagtttggcgtggttgttttttcgtttttcggtttcgttatttttcgtagggttaaggggtattgttgggatttttttcgggttgagtttttaggtggtagggggttttcgtcgtttttttttttgtgtgtagggtcggggttgcgtgatttcgcgggtagtgggtagtaggaagttcgggttgtgcggtcgcgtggtagagcggacgacggatttgcgttcgagtgacggggcgcgggttgtagattggtttaagttttcggtggtagacgaatgtgtttaggttaagtttaggggacgtgtgtggtttcgtgttatgggttcgttgtgagggtgtcgttaggtcgtcgattattgtttggacgtgaggagtgtggtggtgaaggatattttttggatagagtcgttttttattacggttttttcgtcggatcgtatttttcggagttttggcgttagttagttcggtttagcggtcggatcgggttttttcgcggttttaggtttggttggggtgggggtcgcggtttcggtgattttagttcgtagcggttcggttcgtttcgtttatttaaataaattgtcgttgataggcgcgtagtttttttggagtcgtcgttttttcgtcgtttttttttcgttttaattatttcgcgtagggtggggttaattggttgggatggggcgggggacgcggggagagcgggcggttcgatttttttttggtcgcggggtggttcggggaagcgttttcgtagttacggtttgtgtggtttcgtttttggttttttcgggggatgcgagggtaaggtttagtttggtagttgtgggttttggaagggcgtcgttttgtatttaagggcgagattacgcggtcgagaattaaggtcgtatttcggatggatttcgggtgattttttcggagttttggggaattttttaattcggggagttgtagacgatttattggtttcgggtcgcggtttcgcgggtggtcgttgtacgtttgagatatttggttcgtagaagttaggtgtacgtttgtgtatcgtcgtgcgttggatgtgtatggaggcgagatcgtggttatggatgtttgggattacgggagcgtgaacggggcgatcgattgagtgatttgagagacggggtagagcgtaggaaggatttttaggacgggtttatttgcgacgggcggcggtgggggagtggggggtttgtcggcgcgtttataggttttgggttcgcgttcggaaacgttttcgtagggagcgggtcgggatttttcggagtagtacggtgacggcgtgttataattcgggttttagttgtgtcgttttcgt

SEQ ID NO: 7124 - DNA, 2392 bp, Artificial Sequence
  Description of Artificial Sequence: Synthetic polynucleotide
cgaggcgtatttgtttcgagtgttaggtttggggacgcggtttcggagaggggagaggggttcgggaatgcggcgggaggggtttcgaggggtagcgggtcgggtcgggtcggggcggaggtggcgggtttcggcggggcgggttttcgcgggcggcggtgagagttttcgtatagtcggttgcgagttttgggagtaggaggcgcggtgcgtagtttagttcgggacggagtcgggcgtcgtgcgagtttcgggagggtcgcggggcgtaggggcgggtcggggttagcggattaggtcgcgttattcgttttcgttttcgttttgtcgcgttcgggtttcggcgttcgcggagttgagattgagcgcgttagtttttcggggtcgaggttttgggatagatatcgcgagggaggcggtcggcgcgggttttcgtcgcgggcgtagcgtttttttttttcggtaagtggcgagcggcgggcgaggggtattaatttcgtcgttaatttggggttgggttttcgcggcgcgcgagtaaggacggcggagatagaggcgggatattcggggggttggatttacgtaggattttcggggtttaaggagggggcggttggaggattcggatttttaagaatttggttttgggttttgattcgggcggtcggagagaaggcgaagaagaggtcgagtagataggcgcgcggcggacgcgagagaaggacgcgggcgaagcgtttaagacgttcgtttttagggtcgtcgagttttttttttttttcgtttggcgcggtagtatcgcgggattaggggagtttgggttgtcgcggatttaaattgttgttgttggaagtcgtcggggcggagagcggggaatagggtcgggagtgggggtcggggttgggatttattagagcgaggggttggaaaggagtcgagaaggtgaaagggggttgtgcggttttttagtttagtgttttagtttttttaggtttgttgggtatttgttgcgtattcgtttcggcgtttagattttttttttcgtcgcgagtttcgttttttttttttttagttttgttttattttttttgttttagtttagtttttttttttttgcgatttgggagaatcggagtgggtttttagagtagtggtattttgtagatgttggttcgtgttcggttttcgggtttttagagcgtaaagggaagggtaggtagagagggtattgggcgagtaagatttggcgttgggttttggttgcgtattagtcgtttgcgtcggtttttgggggtttcgtttaggattttcgacggcggggaggggaagtttcgagttttttgttttttgtttacgcgggtagggcggggatacgcggagtaaaggtattcggtaatttgaatttttaggtgcgtttcgcgattttgtaaggagttgttgggtgagtaagacgggaattttcgttaggttttgatgtttattttattcgtttattcggttttttagttttggtcgtttaaggggatttttggttcggttttttagttttcggatggtggcgttattttagtttagtttttgatttcgggttataggaaaatcgaggaaagatatttatttggggagggtattatttcgttggttgtattttagagttcgtttaggttttggcggtgttagtgattttgagtttgtttttaaattttcgaagaataagagcgtgttaggggtaggtaggtaggttcgggatatttgggttcgtttagggttttcgggcgggtttgggatggtattggggtcgtttgttaggttggtttggtttttttattgcgggattcggggttacgatttagtttgggggagtgggggtgggggtttcggagtcgcggacgtcggcggggggtagcgtggggcggggggcgtcgggtgcgtggtgtttagtttggtcgttaggaggcgtggcgcgggttttcgttcggagtcgtcgtcgtcgtcgtcgtcgtcgtatcgcgagtgtttttgagtcgcgggtgacggtggttttcgttgttcgcgtttttttttttcgcggggggagtttgatgttacgttttttatgaattatttatcgtcggtttaaaaatatttcgaattttatagttcgagtgtaagagattgttgcggaggggagggggcggggcgtttcggtggttagggggagttcgggcggggttcgcggagacgggggtcgtagttttggaggagtaagaatttcgtgtttttagtagtggggtaagttagaacggcggtttttttttttggcgtttgggttcgggttttggttgggtaaaagggagggagggaaattcgacggtaaaggaggggcggtttatcggaagggtagggggttcgg

SEQ ID NO: 7125 - DNA, 564 bp, Artificial Sequence
  Description of Artificial Sequence: Synthetic polynucleotide
cgtttttaaatcgtttatttgcgacggtttcgcgagcgtgcgtagtttagtttttttcggacgttttcgttttcgttcgggtatatcgtgtttcgtatcgaggtagagaggggtacgcggattttagtttttgcgagtttttttgttcgtcgttattttatatttcgtattgttttagttgtcgttttagaagatgtatcgtttggcgcgtaaagcggtgtacggtttttagttcgcgcgtagtagtttggaggggcgttagagttttcgttttattttttggcggtattgttttcgggtagttttttttttttttttttttttttatgtttttattttattttgggacgtttttaggatcgaagaggtaggagggggatcgcgaggggaaggcgcggagttggggaaggaggagtagcgtcgggcgtagtagtttagggcggttcgggaggttgcgcggcgttcgcggatttacgttttaggatagaggacgtagtttcgagtatcgtacgtggtttttagattttttttatttttattttggcgattacgagagggggtcgg

SEQ ID NO: 7126 - DNA, 3277 bp, Artificial Sequence
  Description of Artificial Sequence: Synthetic polynucleotide
cgcggtatggtggttttcgcgtgtgtgtgtagcgtttgtaggtgtttcgtttagcgttttttgtataatagttgtaggttggattcgagggtttttttttttggggttttatagtgtttagaggtttcgttagttttagatatcgttttaggtttttttttttttttgacgtcgtttattttttttttttgcggaagggggatacgtttttttgtgtcgaggtgttaggtcgttgagatttgttgttttggaggaaaagttaggtagggtttttggttttgggcggttaggaaggttttacggttgttggggatagagacgcggggttaggttaagggttttcgtttcgtttaaatagtttgttttgggtagggtagggtttttttttcgcgttcgcgcgttttcggttgggtacggttcggttttaggtttgacgggcgcggtttttttattggacgcgtgcgggagggcggcgaggttaaagcgttggggttaggagggtattcgtttagcggttttttacgggagttggggtagaagacgtcgcgatttcgcgcgggtaatttttttcgaggcgcgttttagttcgtggcgttgtcggcgtagatttcgcgtggggatcggcgaggttaattttttttgcggttcggggtcggtagagtacgtaaggggtcgcgggtcgcgtgggtttgggcgcgtcgtggtgggtaagcggggttagcggagcgggaattcgtatatttttcgagcggagtcgaggataggttcgtgcgggtcgcggggtttttttggcgttaggaagcggcggtcgaaggagataacgagaacgtagtttcggtttagggaggtttaaaagttgagatgttgaacgtagacggcgggcgttcgggggttggggggcgggtagaggtcgttattttttaaaaaggtttttatcgagtcggtttttgttttcgttcgaggggcggacgttcgatttcggtattcgggattgttcgtgggtttttgttggttggggatttttagttttcggttgcgcgtagggaaaggttgtagaacgtagagattagagaagtcgggggcggcggggaggggtcggggggttacggttgtagttcggtttcgtagtttcggagttttagtttttttttttgtattacgggagcgtggacggagggattttcgaggttttgatcgttttgatagtttcggggcggggcggggcggggcggttgcgttagttttggttttgagtttttagttcggcgtcggaattcggatcgcgatttcgggagtcgagtttcgcggtttagatgaaggcgcgagtgcgcgggtgtcgggtggggtgtttgagcgagagcggagttttttaggtggacgtttttagttattttcgggattttttttgttggtttttgggtttgagaagtgggcgcggttggatagacgggaaatagttttttacgtataggtggatattcggggatatcgggcgcgcgcggcgtttggtaaggggaagttgttggagacgcgggcggttgttttcgcggggttttttttcgaagcgtcgttgcgaacgtttagtttcggcgacgtcgtttgttcgcgatcgggtcggcgtcgcggataggaaaggttcgattagttaggtttgttttcgagaagtttttagcgtttcgttcgtacggggtggggattgatagtttttcggggacggggtcgggtttatagagttcgggagttgggggaggggaggcgtcgggggtttcgattcgtgggaagtttttgtatttaggttgttcggcggttttttaatagtatacggatatttaagaaacgcggggcggttcggtgattttcgttttggatttagtggcgtcgcgaggttttatttcgagtcgttgattatcgggtattcgggtgttgacgatttgggtttttgggtatttagttcggttttaaacgatttcggtttaagggtgtttagtgtagttaggagggtcgaatcgaattttatttttcggacgcggtggtttttcgttcgtttggagtttcgtcggaggttcggggatattacgtaggtggtttattttcgagttcggggtcggagttcgatttttttttttttgagttttcggagttttcggggtagtagcgtcggtttaggcgggggcgggggaggagggggtcgcggtagtttttagaagggcgggggggacgcgagcggaggtagtttcggtggcgcgttcgtgagattttcgtcgcgtcgcgggttcgggtcgcggataattaaagcgggatttttttttcgttgacgtcggcggttcgaggtttttttcgcggcggtataaaaggcgcgggtttcgtagcgtaggcggtagtgggggtttgatagcgcggcggtgtggatcgcgcggtcgaagagcgcggcgtttagagcgcgggtcgttcgcggagttatagttcgagtcgggttttagtcggagtcgagttttagtcgagtcgagtcgggttcggagcgttcggtgttcgtagttatgtcggtcggtcgcgtcgcgcgtatttgtgcgttgttcgttttttgttttttgggcgtcggggtttaggatttcgggtcgacgcgttttatttgtatttcggtgttcgtggacgtcgatatgtgcgtcgcgttcgtggtcgtcggcggcgtcgaggagtttcggagtagcgtgttgtagtttcgcgagacggtgttgtagtagaaggagattattttgagttagaaggagattattcgcgagttgatcgttaagttgggtcgttgcgagagttagagtacgttggatttcggagtcggcgaggttcgggcgggcggcggtcgtaagtagttcggttcgggtaagaatattatgggcgatttgtttcggatatcggtcgtcgagacgtttagttaattcgggtaaattttgtaatcgtttaaaattcgtttggagaatttcgaggttcgcgcgcgttttcggtttcggtttttttttcggttcgttcgtttttttgtttttttttatttcgttttttattcggttaggtatttttcgttttcgttttagtcgcgcgggtgttcggtcggtgttttttcgcgtttgcgaggtttcgcggcggttattcgttttagttttttgttaggtcgttttcgtagtcgtttagaggggatcgcgtcgcgggttttttagtacggttttcgcgtttcgtttaacggtgtggtttttttcgtttttgtatttcgtagtagtatagtcgt

SEQ ID NO: 7127 - DNA, 5692 bp, Artificial Sequence
  Description of Artificial Sequence: Synthetic polynucleotide
cggacgttaattttacgaattttgttcgggttgggggtttgggacgttttttttggattttaggattcgtttgtacggagttatagaatatagcgttatcgttcgttcgagtttaggtattttttttttttttcggggtttgcgtcgtttgtacgttttttcgtagattttcgcggaaacgtgtatagtagggttttgaatagaatttaggttgttttgagtcgaatttttttcggttcggggttgatcgtgtttatttaagtcgtcgtttcgtttttcgtattttcgacgcggggttatttttttttatttttttttttatttaggcgtttttttcgatagcggagggagagttaaaaatttataattcggcggcgggattttgtcggttttagttgggcgatttgggcgtattcgtcggcgacgtagtttcgggttttagcgtatagaattcggtcgttcgtagtttttttcgttagttacgttttttgggttttttattggttaagtcgttcgcgttttcgcgtgattttattggtttgcgtcgggggtttagataaagggagtagtcgcggagggcggtgattgggcggggttgggggcgggtcgggcgggcgcgcgggtcgggcgggagtcgcgcgttggagaggcggggagtacggcgttgggggaggggcgcggtgtttcgggttcgggatcgggaggcgcgggtgtgcggcgaggttcgggtgttttttttcgtgggggcggggcggcgggggcggggcggttttacgtgggtggggttgggcgtttcggagggcggcggtcgcggggcgcggggcgttgggatttcgttcgttttttcgttttgtatttttttcgtttcggggtttttgttcggacggcggtcgtcgtcgtttcgtttttttcgagggtttcgcgttcgttttcgtagttcggtcgggaatttgggaattcggacgtagaaggacgcgttcgagttaggattcgtcgcggggtttttttggtgggtcgtggtcggggagaggacgcgggttttggcggtcgaagacggacgtagcgttcggaaaggcgagttaggttttcggtttttggcgttttttgtgagttggttcggcggggtgcgtcgtcggggagggagggattggtcgtggggcgagtagtcgggcggggagtggtttttgggggttttcgttagcggagggttcgcgaggtcgttttcggagcgtcgttaggtacgtgcgttttttttgtttttcgcgtttttagagcgtattttcggtagggaacgaataaaatttcggttggtgtgtaagagtttttcgttgtaaacgtgtttttttgcgggattcggggagtcgtcgaacgcggggtagatttcggtttaaagtgtttttgtagtttttattagggatttttttttatttttattttgggttcggagcgggtgttagtttggaaatgtttgttttttttgtagtttcgattgaattcgtttaggaggaggtgcgttttgtttcggttttagagttgggaggatcgggttttgtttttcgaagtttttttatttcgtttttttggaaaatgcggattttttttagtagggatgtttagttttgagggggttgttttcggaggaagtttgggttgggaaagttcgatattggttttaatttggcgggtagttttttttgttttggagtagttttttttagttttcggagtttcggatttatacggttaggagacgtttatgggttttgggggtattttgcggggttcgaggaggtcgggtggtttgggcggggttcgaggaggtcgggtggtttgagcggggttcgaggaggtcgggtggtttgagcggggttcgaggaggtcgggtggtttgagcgggttttttttttttttttatgtgtacgttaaataaaagaattttcgaatagttttggggatagaatttttcggaatgtgagtttgtttttttcgtttttttttttaggaaggataggggttttttaataaaggtaaggttgcggttggagcgggttgaagggaaggagcgttgttattttggggtatttgatgaaagagaaatttattttttttttttttttttaaaattagaggtagttgagttagagttttttttatttttttatttgattaatggggttttatacgatgtttgtatttggggtgattgggtttgaagatttttagaagtgggaaaggattttgtttgtgtgggagattggaaagttggtttttattcggtgggggatagaatttttatggagtgaaatggattttaggttattttgcggaagattggaaatttaaggatttgacgggggggcggtgattttgtgtttttttttttttttttttttttttttttagtttagaataaagggcggaggcgaaggaggtaagatgggtggtgggttcggaagtcggagtcgaaagaagaatgttataaaagttttttattttttagttttcgcgtatttttaaatagtttattagagtttgggtggggataaagtgaatgatcgtttagagtcgggtttggtatttatggttcggttttcggcgcgggcgttcggagttcgggggaagtttttttagttcgttttaagtcgcggttggttagggcgagagaggtcggggtatagcgcgcggttttttttgtcgttttcgaggatcgagattcggggttcgcggttttttgattgcgtaagttttttcgttttttttgtttttttttttttttcgtcgaaagacgttcggagcgtatattcgtttgtattaaagttagggattttattttttttaaaataaaataataagttataaaggtttttgattttagtggaaaaggcgtcgtagatttatggtttttttaaatttttatattttaattatttttgtttttagtttatttatgggtggtgattaataaaatgattttttattttgaattttttttttaatataaaaaatgtaagtttcgttttttttttattcgtttggatggatttttttcgtgcgggaagtaaagaaatttcgtttttttcggttttatcggtttagggttgagttgttgttttcggttgagcgaattcggtttgtcgtagtattttttaagtattttcgtttcgtatatttttaattgtaatttaagggagaatatttttttcgtttttttttcgtttaagggtatttgtagggatttttttttagaagttttgtcgtgggtttagcggttagaagggttatttcgtagagcgggttttcgatagttttagttcggttattttttaaattgcgtttttttgggtttcgtattgggcgcgagtttggggcgtttaagggtttttattgaggaggaaggttgtcggatcgagttttcgttatcgtttggcgtttttattttttatttttttttttttgttcgttttttcggacgtcgatttggagatggtaggaaaaaaaaaataattagatggaaattaaagattagtttgggtgcgcgggcggttttcgtcgggtcgggttatgttcggttcgcgttttataaatttttttcgcgacgtgataatagtcgcggtttcgtttttttgggaatttaggaacgtatcgatttttttcgtcgttcgcgtaagtttttttttcgggagcgagaacggagagtttttggtgattttgatttttggttagcgtaggacgttttaggttttagttagggtattatgtataggagtggaggaaggtggaagggaaggggtttaatttttatttaagaaagcgtagtaaatatttatatttcgtaggttaaattaaatatattattaggggtcgtattttttttttttcgcgtcgtttgagaagggggcggaaggaaggacggagaagggtgaggggcggattaatttttttttggcgatttttttgtttggttcggatattgttgagtcgagtggggcgtttaggagttagcgaggggttttcgaggcggtttcggttcggtttaggtgtgcgggtcgcggtggggcgtaggttcgtagcggagttacgagattttcgcgttttcggttgacgttcgggcgtttagggtttgcggttttacgtgcgatttattcgggagttgcgttttagacgtttcgtggagcgggggagaatttgaaggaagtcgtggcgcgtttagatattttaaaaattcgaattaattgggaaaataggaagggcgtttttaaacgcggagaagatatttcggggtggggaaggatgttttttaaaaattatatttttttgttgtggcggttgtttttgattttttttattattaaaagaaatgttgttacgtttaatttttgttgttatgagatatggagggggtagtttagtattttgaagtaatttgataagtttttaagtagtaaattcgaaagggaggtcggcggtttaggtatagtttttttgtaatttgaatttataatgaaagtatttttttttatggatataatagattagattttataatttaatttatcggaatggtttcgtttaagggagtttcggttgattttattacgttaagttaaattggatgtttgtggttttaacgaaaagcgatcgtgatataaaatatataatttttaaagtaaaaaattagcgggttggattttgtttttttttttatttttgttttttatttttaattttttagtgtgggaaatacggataattatttgtgtgtgttggtttttatcggggagataggcgttttgggtttttttttcggcgggttagaggtttcgtcggttagtgcgtacgcggcgtcggttttcgattaaggtttcggttcgttttgttggttcgtttgaaacgtcgatatttttagcgtacgattcggggtttcgggggtatttatggggttcgaagtttttgtttgtcggcggcgatcggatagttttttcgggcgcgtagggtagaggaagcgttttcgaaagttttcgtacgtatttacgagtcggttttgcgcgggtatagcggtagtcgcggcgggatattcggtagggttttcggcgttattttgtgttaaaaattgcgttttcggagattcgggtatcgtcggcgtcggtagttagagcgggatttagtttttatcgcgttttttattggagtttttttcggtttttcggcgagtgcggttcgtggggagtgggcgtcggcgcgaggaagtttttcggttcgggcgatttcggtttttgagcggtttttttttacgtcgtcgttcgttaggtcgacggaggatcggggcggggacgggggttttagcggtttattttgttgttatttttgatttattttttagtaacggcgcgtttttttttcggttttttcgcgaggtttgttgaagacggatttagttttcgtagagttggggaaggacggatggacggaaggtttagcgcggtttatttttttttttcgtcgtttttcggttggtaggagtcgtagcgatagtttcggggagcggggtttgttttaagatttttttcgcggtatcgggagttaggcgtggtcggaggtatcgcggttgttttacgtggttttcgtcggtcgttatttcgcgcggggaggacgcgtgcgtgcggtgcgtggtcggcgggttgcggggacgcgt

SEQ ID NO: 7128 - DNA, 7937 bp, Artificial Sequence
  Description of Artificial Sequence: Synthetic polynucleotide
cggcgggtttttagcgtagttttgcgcgtttttttcgaatttattcgcgtcgtttggtgatttttagggttttaggcgtggtagttgtttttattttgatttttttcgatatttatattaaagttatcgggaagagggttgttttggaggtttgggttcgttttgttaaggattgattttttcgggtagggagttagaggggatcgttcgagaggattcgtttttgcgaggtttagtacggcgttttacgttttttttttggagtaaattcgtttcgttttttttttggagtaaattcgtcgtattttcgtttgtatcgaaattttgagcgtcgtttcgcgttatttttagttcgcgttcgcgttgttttttttttcgggtcgtaggttgagaggttgggtcgtattttggttacgttttgttcggttttagcgggatattagaggtattcgttaaggtaaatgtatttttgtaaatttattttcgttttgatattttaaggttttatatagaaataggatttgttcgttttatattagtagtttttattaacgttcgttcggcgtatatattattttaattcgcgaggtcgcggcgtattttggtttttttttttcgttataatagtcgttttgttttcgtagaaagcgtttcgttgttttagtttcggaacgttttagggaggtgaatgtagaatgtagaaaagaggttttcgtggaatttagatttgtaggagggggcgggggagggtggcgaggcgcggaaaggttttaattttagtcggtttcggggttgttttttcgagattttcgggggagggtggttagggaagggtttttttaagtcgcggcgacgtagtttggggggttggcgggacgcgcggtttcgtttagcgtttaggtagttatcgcggtcggggtcgggaaatgaaattaaagtttttttgttttcgggagcggaggggtgggcgttttgtttcgttttcgaacgttttcgtttcgcgttcgtttcggtcgagtattgatttgtgtgcgaagttatgggtaacggcgacgggaagtattttttcggttggaagtgtgcggggggttgcgcggcgggtttagtcggggcgagacgcgcggcggtagcggcgttgcggtggtttaggttttcgcgtttcgatagtagatgcggcggcggcgtaaagtcgcggttatttatgtcgggtttcggtttcggttcgtcgtcgttttttcggagtagcgcggtcggggttcgggggcggttcggcgcgcgggcggcgtagaggcggcggcgttcggggttataggcggtggtggcggcggggtcggttagtacgcgggaggattgggtttttcggcgggcggtcgcgtatcgagttagcggtcgttgtgcgggtttatggtttgtggaggtaaaagtagaggagatacgggtgattggggggttcggttcgttcgggggttttcgtttcgttcgtttatttattttttttattttttattttcgtcggttcgagcgagcggcggttaggtcgggtggcggggtcggggcgttcggtgttttttcgtcgtacgcgcgcgtagtttagtattcggggtttcgcgcgcgtacgtatcgtttcggttacgtttggttcggggtagtcgggggaatttagtcgtattgttcgtcgtttttcgttttcgttttcgcgggtttttgtagttagggcgtcgcggcgaagaggttgttggttttgttgggtgataaaaatttaaatttgcgaagttattacgtatattcgtatatatatatatatatatatatatttatacgtatatttttttttttttttcgttgtttaaaggtgtttcggaggaaaaggtttggggtttatattagttttttttttttttttattttatgtcgaggtttagtttttattgtatttcgtttaatcgaataattatgttaattaagcgagtaattttattgattgtaatttaagagttttttttttttttaataattttttttttttttttatttttattttttttatgtatttttcggtttatttttttgaatttatcgtggttttttttttttagttttagcgggattagtttttgtttttagtatcgcgttaggattttaggtcggttttttagagtttcggaggttcgtaatcgttatcggtattatttgggtcgttacgtcgtagtgttcggtttgttgtttcggagtcgggagttttttgttgaggttgtaataattatttcgttttttaattaaattcgtttaggatttttttttgcggattgggggtttgggggtgtgtgtggggggggtgtttttagagttagaatgtttttttttaacggtttaaatcggttttgggatttttttttttagcgtttgtcggggatcgcgagtagaggtcggttttcgtttcgggtagtatcgggcggtttgggtacgcggggtttgcggcgtttagttcggttttttagtcggggaaggtgggttcggtttagtataattttttgttagtagattttgttcggatttcggttatttaaaataatttttatttttatttttttttatttttatttaacgcggagtatttatttaggcgaaattggggataattttagattttgggtgcggagggtcggagttagtgatagaagttgcgtgtattatcgtgtttttaggcgttttttcgaaggcgttttttggacgtattttatatattattttttattttttaaatacgtattgttttaatgtttattatttttaataaaagggagatggataggtttgatatttttaattaggaattttgcggaaaattttgtgtttttgtagttattttattatgataataaagcgattaagatgttttttatttattgaatatttttttaaattgcgatattttatggttcgggttttaaaacgttttatttgtagattattttgtgtttgatttaatttataatcgaaaatataatgtattaagtgaatatatatttgtttagttgataagtttttttaatatttattcggagagtttttgtattgtaaataaatgggtttatataaagagttttttttgtttggtaattatatataaaggcgtttggggtttttttttttttggggatcgttagtttttttttcgggtttaataaatagttcggtttttaagtttcgatttcggtttgtaaagcgagcgttcggtcgttagggttcggagagtgttttggcgagggggttgcgagcgtaggggttaggggaggggttgttcgggttggattagggacgtgggggtttttagtttcggtcggcgtttttcgagtttcggagggcgtcgggcgggataaagggaaagaaggaaagggagggaggttagaaatttgtagttttaaaggcgtcgaaggtcggagaggggtcgggggttgcgtacgcgggggtgttaggttttttggcggtttttagggagtcgtgtgtgttgtgtttttgttttgtggttgtttttttttttttttttttttttaataagaaattttaaagttgagaaagcgcgagttgtcggcgattttcgggacgcgggttcggttacgaagtaataattttaattttttattttttgcgggcggatcgtaggttcgattgttttttttttattagtttgttcgattttttaagtaaataggaggtggattattgtcgtttgtttgcgtcgttacggttttgatcggattggagagagtttttttttgtgtttttttttttcggggagaggtcgcgtcgcgttttcgcgtttgttcgcgtcgggtttcgggggtttggggagtttgaggcggttaggaagtggggcgaggaagggcggttatacggttcgagttgggagttttatagtttcgtagcggcgacgtcgttattcgtcgagtgtcgaggttcggggtttatttttagtttagttttaggagaggtcgcgtcggaggatcgcgaggacggcgtcgtagcgttaggtcgggttgaggtaagggaggaaatggagcgaaaagtggcggcgggtagagggtttcgggcgggcggagaatcgttgacgagggtatttcggaaggaattgaatttaggagtatagggttttttttcgggaaggtagggcgtgattttggagtcgtcggttttttttgtcgcggttttaggcgtggttggcgcgttttaggatttggagtttttataagtttgttttgttttttgtttttgtatttaaaaattcgtttttttttcgttcgtttgtcggagattaggattttggttcgtttgttttttttcggcgtcgttttcgggagcgcgggcgcggtggggtttgtaggtcgggttgggattaggcgcgttttggggcgcgagtggttcggtcgtcgtcgtagaattcgttttttgcgaaatagtcgtattcgttttttgggagagttatgagaattggggtcgcgtttgattttcgcgttcgaagaaaattagttcgcggatttcgttatacgggtcgtgattcgagtttcgcgcgtcgtttcgaacgcgcgcggtgaaaacgtttcgttgcgtcggttttgttcggttttttttttttatttttattttttcggaaaaaaaaaattttgaattgggaacgaagattcgaaaaattcgttatgattattttttttttcggtttttagtttcggttcggaaggttttttagggtagcggtcgtgggtattacgattcggttagtttttttcgtcgcggatcgatcgggtagggttaatttaggattgtttcggggaggggagtagggtaggggagcgaatgttggggttcgttcgtgggttatttagaattgggcgtacgttggcggcgttcggatttcgtttattgttcgttcggtgttattcgcgcggttcgcgttagacgtagtttggcggtttttgttttgttttcgagtatttgtttttaatgttgggtgtcgatcgagataataagcgtttagagtaaagtaaggatgtattacgggggtaattttaaatcgatcgataagattttttagagaaaaaaaaatcgtttatagtttatattttttaagaaaaaaaaaagttttaatattttaacggattttgttaaaagggaagatatatattttttaatattataattttgaattttttttgttaaaaaaaatgtaaaattttaaagttagaataaaaaataaaataataataaaaatataaaaataaaaaaaaaatgaaagtaattttagttatttattggaggttgttttttggatataattgaatgtaatataattaaattagtaaatgtgattttgttttgtatttttattggtatttttaatgtgttgattgttgtattgtaaatgtatcgtttttataataacgattttagcgagtttatttagagcggtttttaaatttgtagtttggcgcggcgagttacgggttttgtatattaataagttcgtgttatttagttcggaatagttagcgcgttgattggtcgcgtagttttttacggtcgggagttcgtgttatttattcggcgtaaataggttttttaataggttggcgtcgggttagggaattgttaattaggaagtagcggggttattattaagttcgatggcgtttaatttaagttcggcgattgcgtagtttttttgcgtagattattgttgttgaatgggaatgtggtggcgtagggcgggagagggagttggagcgagcgagtgcgcgtgtttcggcggagggggaggcgtagatatagatatagatatatatatatatatatatgtttaatttagtaggtttaacgtttggtttttgtcgtatagaaggttaagggaagaaatattattattttttaaaagtagttgttttttttttttggaatttgtttggtaggtggtaggtaggttagatttttaagtttagaggtttttttaggttgtttggtttatttatcgttttgaagttgttgtttgttcggattcgagttcgcggatgtacgtacgtacgttcgttgtttgggtagtaaaagttttgaatagttcgttcggtttttttttttttatgatttggggattagattttgggaagtgagttttgagtttttagtcgtttatattattggtttttaattttatttttttttgttatattttgtaatagagtagttattaaaatgaaaattagggatttattgagaagataaggattgttttttttttatttatatttagatttagaaaatatttttagtttggtaatgggggaagcgggtatggtgtggtaaattatgtatagtattttttaatgttgttttttgtttgtttatttgttaaatttttattttaattaaagtaagttattgaataatttttatcgtaattagatgtaaattatttttaaaatatttcgtaaataaatatttttgttagaatttggttttttatttaaatgttatttatttttagggagtcgaggtgatgttttagtggcgatggatatatttatttttgtttttttttttttatgtgaatttttgtttttttttttgggggaaaaaaggatatttaaattaggagttaattgatagatttatacgtattcgaaattttttatcgttttatttcggtagggatacgaaagagttaaatttaaagtttgttgtttttttgttttttcgtttttattttcgttttcgcgggatcgttgggattggttggtatttcgttagtggattgtttattatcgagtgtaaataaggcgttgattggttgttgtttagttcgtattgggttttttgaaaaaagtaattattggtttcgcggttttaaggcggtttaaggtcgtttgatgaaaggagataagttggggatcgtttttaggattttcgcgggtcgatcggggtagttcgggagtcgaggtgcggcggagagttcgcggattaaaggaatttggagagaaaggggaagcgggcggtcggtttcggtcggttttttttttcgtaggttacgtcgatttggggtggggggttgcgggtcgcgggcggggatttcgggatttttcgtttgtttgagtcggggtttacgtcggcgttcgtttcgggcggttcggttcggaggggagtttcggagagttcggggttcgtaggtaagtatcggcgtttcgcgggtcgggtcggggacgtaggataaggcgcggggtttatttcggttggttcgggagtggcggtcgcgcgggttcggttttcgttttcggcgtttttcggtttcggcggtcgggatttttcgcggtcgagtttttggttaggttttaggtcggcgttttcggaagcgacgtttggcgggtcgcggggtacgagggggagagtcgggaagcgtaaattttcgaagcgcgcggagattcgattagcgcgcggttatttattaggttgggggcgattgaattaggtttttgggcgcggtcgtcggttgggggtgtgtggcgtcgattttcgggtttttgtcgtggtttcgggaggttggagtagcgagtagcggttttagcgagtgtgtcggggaagcgggtgttttcgggtttcggtttcgcgggtgtaggcggaggttgttcgtttttcgcgtatatcgaggacggtcggttcggtttcggagaaatggcgtttgagaaaggaggggaggggaaggttttcggattttgggtagggattcgtcgtcggggattcgcggagtttttcggggatggaggaggcgcgagttggaagcggcgcgcgagttcgagcgcggggttaatatcgtggggtttagttttttttggttcgggtaagtggacgcgtttcgaggtttcgggtttacgtagggcgtttttcgtagacggcgt

SEQ ID NO: 7129 - DNA, 1408 bp, Artificial Sequence
  Description of Artificial Sequence: Synthetic polynucleotide
cgcgcgcggtagtttcgaggtagtagagcgcggagtcgggagcgcggggagcgcgggtcggcggcggcgagggaggacgggggcgtagacggtcggcgcgcggcgcggttattatgggcgtgcggtgagtagtcgttcgggacgattttttcggttgcgcggcgttcgcgcggagtttttcggtcggcggtgcgtttttacggttattatgaaaggtagggcggcggtagtttcgcggggttttgggcggggggaacgggtttcggggcgcgcgggaggttacggaggtgtttttcgcgcgaatttttttttgggttgcgggttcggggagtcggggttgttagggcgtcgggttcgtgcgcggatattgggggcgtattcggttttcgggttaggcgcggttggagatttcgaggttggggttttgaagcgcgtaagtatttttttttttatcgcgtttttgtaagtagtttgaagttttaagtcgttgtttacggattttcgtttttaattttttaattgaaaaaatttgtcgaggagagtggaggtatcgttatttttttcggtcgtttttttacgtcgtagcgttttttacgttcgtttagtttttttttttttcgtttttagtcgtttttcggttcgagcggttttcgcgttggcggtcgggtgtttttttcgggattggggatgtttttcgtgcgttttcgttatatttggtaatgattaggtgttcgaggagtttagttggttcgggaagtgtatttggtatttttttttattagatttatcgattggaaaatagttgttttcggtttcgcgttttttttacgtgttcgttttggggtgtgtttattggtgttttggggtgatatattttagttggttagtcgttttttgcgcggtgttttttgtaggtcggtttatggaagtgttagatgttatcgtattttagaaagaagtacgagaaggattgtagggtagttttttgtttagtggaaatacggagatttgttagcggaattttgatttatgtatgagataagtaatcgtagcggaggtattaaagagtcgtttaggaatgggttcgcgtggtgtttatataaggtttcgtgtgagagttgttggttttgtgttaggataatatagttttgcgtgggtgcgaaatgttatttgatcgcggttatttcgtttttagtcgttatagatttggcgatgtaatcgttttgatttttagggttgtcgttcgagggaggcgttcgggaagttttaaggcgtttggaaagtaatttttggttttggaaagttttttttttgaagggtagttttcgcggaattaatcggagcgatgatattttattaatttattttttttttaagggcgttaggtgtttacgtcgggagatttcgg

SEQ ID NO: 7130 - DNA, 208 bp, Artificial Sequence
  Description of Artificial Sequence: Synthetic polynucleotide
cgttttcggggtcgcgatttttttcgggaggtgtttgcgaaggcggttttgtcgcggtgggggtggggaggttagggtttcggatcgttggagttggggtcgtagttagtttttggcgagtgttttttggttgttgtcgtaggggtttgttttttcggattttttttttaatttcgtcggatttttttttttttttttttacgttcgt

SEQ ID NO: 7131 - DNA, 805 bp, Artificial Sequence
  Description of Artificial Sequence: Synthetic polynucleotide
cgtcgttcgcggagtttgattttgcgttaggacggaggaggttgtgtttatgtaattgttttgaagtattgcggtggttttttttttcgcggttgggagggtaggtaggacgaggttggtttttttcgtacggtttttgggcgtgggttttcgtcgtagtttcgcggagtttcggtgttttttgtaatagggggcggggggaatagcggcgagtagttttgggttgcggttttttttttacgttcgagttttttgcgtatcgtcgtcgaggacgcgcgttcgagtttagtttttacgtcgcggcgcgttcgggttttttgttgattttaggtaattttttcgtttttcggagtgggggattgcgagggggtttcggttttacgaggtgcggaggaagagttcgaggtttggggcgaggcgcgcgggatagtggggttgacgcgtggtttcggcgtcgcgcggtttttcgaatttcgagtttcgcgttcggcgcggtcggggtttttaatcgttttttcgttcgtcgggatttttatcgggtcgagtttgcgcgtcgcgtttttcgttcgtttcgttcgttgcggcgtagtagtggttgggtcggcgcgtagagtttgagtttcggttttcggtttgggggtttttttgggatttttggtcgaaggggcgattcggttttcgcgtttttttttcgttaatttgtataaatttttcgttcggggcgttatgttttaagttgtttttcgggttgggggcgagcgcgggtcggtttttttttcggggaggtgcgggggatagggggcga

SEQ ID NO: 7132 - DNA, 2462 bp, Artificial Sequence
  Description of Artificial Sequence: Synthetic polynucleotide
cgagcgcgcggttgggaggcgggtttagggcggggtagagcgcggggatcgttcgggtatcgggcgtagttaacgagcggacggggagggcgggttcgcgagggttgagcggcgcgggttgttataggcgttcgaagcgcgttgtaggtggtaatttggaggtgtcgttatcgtagttgcgggaggagttcgggtttggcggttttttttagtttttaggagttttttttcgtcgtcgagttcgagattggatttcggagaattcgaaggaaagagtttttgcggagggatttgtgagtagttttatttttttttgtttttgcgttattttttttttttaaggaaggttgtgtttgcgggttgcgaataagtttcgggaggggttttaaaggaaggtttcggtgatttaggtgagcgtttttttttttttggtagtcgggcgtaggtcgggagcgtcgtttagtttcgtgggtaggggcgcgggtgcgggtcgtttgtttttggttcgaggtcgatgggggagaaagcgaggaaggggcgaggttggttcgatcgggggttgtttggtcgggttcgttcggaggcgatagggatttttagacgggtatttggagattagggacgagtagagaggtgttttgagggggatagagggtttgcgttcggtttaagttgatcgggatcgatcgtttgcgcgttgtgttggagttgtcgcggaagtcgggcgcggcgtttttgcgaattttagagttagtgcgcggggttcggcgagcgtattagttttcggtttttcggagtttaaggttttggaggacgttattttttttcgttcgggtaatttttttttcgtttttttttgtttttattttttcgcgtcggtcgtttagtttatttcgagattttgtgtttttgttagcgcgcgttagttgttgttgttattttttttttcgttttcgtcggagttggagcgatttggggtttggtttttcggtttcggtagtttagttgtgggttggacgcgagtggggttggttagttttttgcgaggagggtaggagtgagcgcgggttttttttttagtgtttttttcgaattcgttttcgtttttttgtagttcgaatcgttagtttagagagcggagttttagaagttagattttgttcgttttggggaaacgcgggggaggggggggtttttcgggaaggtgcgaatttcgtagatgaggttagagttttcgtttttattttagcgttttagtttttgtttttttgtttttaagtggatagtggttttgattttcgtatttcggtttgtggcgtggggggcgttagcggtagtgtgtgtgtgtgtgtgtgtgtgtgtgtgtgtgtggtgtgtaaggatgagcgagtgcgatttttcgggaggtagaggcgtaggagttagtttttttagttcggcggagtcgtagggatcgttttttttcgtcgttagttgcgcgtagttgtatttcggtaatttcgcgttgtcggttttttttttttagttttagttttcggtatttttacgattaacgcggaattttaggattaaaattatttggttaaagggtgcgggtgggggatcgaggcgttttcgaggcgaatgaggttgttttttaaaattcgggaggcgtttttcgttcggcgttgtattttttcgtggttcggttgtaaggatttgcggtggaggtttggcggaggcgggttcgcgttttagagagagcgttacgttattcgagaaggcgacgttgggggttgttgagttttttaattttttttggcgcgttttgtttagaagtcggggagtttttggtcggcggttggcggggaagcgcggcgcgggaggtggggtggtttggttggtgttgcgggagggcgtttcgggcgcgttaggggttgcgtgtcgcggttggagggcgcgtcgggagttgcggcgggttcggggtattcgagtggcgttggaagttgagtcggggttcgtagggttcggtgatcgttttggcgtcgtcgttgcggattcgggagtagtaattacgcggcgcgttcggtcgttttttcggttcgtcggtcgcgtttttcgttttttttttgtagaagtgaagtcgtcgtttgggttcgttcgggttggcgatttttgcgttagaaaagtttgaggtgttggaggcgaaattttttcgggagcgaagggcggcgtttataagataaggaaagggaagacgtcgggttttggcgggtagcgtagtagcgggagggcggcgttgagcgttaaggatttcggaggcgaggcgaggttaggcggatttaatttagttaggaggtgttgttttcgtttttggggtttttttataggtatttggtgttagttatagattttcgttttcgttagttcgtaattttttcgtaattttttttgaagtgcgatggattaagattgggtcgcga

SEQ ID NO: 7133 - DNA, 990 bp, Artificial Sequence
  Description of Artificial Sequence: Synthetic polynucleotide
cgtatattttgtgcggttcgagtggttcggatggtatagtttaggtgttcgggttaaagttggtatttttaaagtttagaacgtaatttgggcgcgttagtataaattcggttttcggtttttttgaagttagttaagttcgtatagggtttttagcgtttggaaatttgagaggcgtggaagggtggggagtttcgcgaagtttttagtttttgggtgtttttcggtttcgcgggggagcgggtttggagttaaatcggtcggtcgtaggttggagtagcgggcgtcggagcgcgcggtggggatgttcgaaaaggagttagaggtttagtcggagagttcgagaatacgagggatgtttattttgtaatatggttttaagtttttttttgtttacgcggaagcgtttttcgttttatttcgggttgtgtagggtcgtttcggcgattaagtcgttttcggagtcgggtattggggagtcggtgttgcgttcgttgttggagtcggggttcgattgcgtcgttaggtagtcgggttttttttgggcggttatggtgggcgcgtagcgttcgggttttcgttgtcgtcgtcgttttgtttgcgttgtcgttttcgttcgtcggtcgggtttaattggtttttagcgtcgcggcgttagttcgtttttttgtagtcgtcgacgttatcgttaacgtcgtcgtcgttattgagttttcggcgtattttagtttcgggcgtcgtttacgttattcgttatttcgggtcgcggtttcggttcgggtttagtggttgcgtcgtttttcgttagtaacgttcgcgcggaatgagcgcgtcgcgttgttcgcgtttttattcgtagggttcggcgtttttttttcgttcgtcgtttttatagtcgcgcgtttattggttcggttagtttacggggagtcgcggcgggcgggcggtttttggcgtttatatattcgcgcgcgtatatatatattacgt

SEQ ID NO: 7134 - DNA, 2274 bp, Artificial Sequence
  Description of Artificial Sequence: Synthetic polynucleotide
cgtgtcgggttcgtttttacgtcggattttcgatttcgatttatagatttttttcgtgaggggtttttttgggtttagaacgttttcgcgcgcgcgtgtaggtatatacgcgtatatatttatacgtttgttcgtatatcgttagtgttttttttttttatttgggattttcgggtagtcgggttggatgaataagttgtagttggtcgcggcgtttcgttagggggacgagggtggggagggggagtttagcggggcgtagggtcgtggttagggtttggggatttgttcgttttttttcgcggtcgttaagttttatcgttgggatcggcgaggaattttttttagttttttcgtagacgttgtacgatcgcggggatttttcggggtcgttagtcgcgtcgggtagggggcgatagggagggtagggtatcgggagatcgtcgtcgtcggagcggtcgttagttttcggcgatcgttgcgggcgtagtcgaatattagcggtttgggttcggtcgttgttcggggtcggcggggatcgcgtagcgtttacgttaggcggttcggcggttgtaattgggaattttaagtaaagttttttgttgttttttttgtagtcggttagggatttaagagtgtaagtcgtttaattttgagtattagtttaggtcgcggaaggacggcggtcgagttggtagtttcggttggggagttcgttttcggggttcgttcgtttcgttcgttcgaggattgggtgtttgttagttttacggtttttcgtttagcgttcggtttataggtagaagcggtgttcggttcgtcgcgtttttcgttcggtttcgacgttagttttagggttttattattagggagttgtcggcgtttcgggcgtttcgcgtcggttcgcgcgtttcgggggcggtagaggcggtttcgtttatttgagaacgtttcgttcgtcgtagttagtaaaagttcggttaaagtcgttaggtaagttttaagtttttttatggtgttgagtgcgggtcgggtcgtttttcggcggcggtgggtgggcgcgcgagggcggagggggtcgggagttttggtttcgaggtagcgaggagagacgggtaaatagtagagcgttaagttaagtttttaaagtgttaatagttgtagaagttcgaattttagcggttttaggggcgcgggtatagggttttgggttttttttttttgtttttggttttattcggcgtttggcgtcgttggtagagggagcggagggcgagttcgcggagttaaaattttttttcggtttcggttgttgagttcgtcgttttttttttttttttgttcgggattcgggattcgagttgttggtcgtggtcgtggcggtggtcgtggtcgtggtcgcgcgcgtttcgttcgtcgtttttttataggtagttttaagtttagtttcgggcggcggcgcgtcgatgatcgagttcgcgtcggttgcgcgcggggtttttgtttttcgattgattggcggtgtttcgtaggtcggttgaagggagcgtttacgttacggtcgttcggcgtcgtcgcggttcgttagagggcgtgagcgttcgtgtttcgtcggttcgcgttcgagcgttttcgggagttcggttgggggcggtttcgcggttatagttattatcgtcgtcgaagcgggcgttagtcgcgcggggaggagcggttatcgggtttttttcgtttattttttcgtttcggtcgcgttttttattttggtagttggttttggggagggtgattgtggaagaggttgcgtcgtcgttagaagtttgtttcgggttacgagtcgcgagtagtttgtgagcgcggtcgggcgggattagcggtttgcgatttcgcgggcgcggttaggcggtttcgagtttggcgtcggacggcgatgttatcgtatagggttagttgtattcggagtcgtcgggtttgcgttgttcggcggttgcgggaaaagcgagttaggagatcgttgaggtttcggagggttgcgagtttttttacgtcgcgggcggagcgaagttggcgggcgtcgggagatggcgcgggagtcgggagcgtcgagtttcgcgatcgttagttcgttttcggtcgggttcgtcgggtatacgtcgttggtttcgagtattggcgttcgggaagtagggcgcgtttttgttgttttgcgtttttattatgtttcggtgtttcgtgtgggttcgaagcgagtcgtaggtagtatacggaaggcgg

SEQ ID NO: 7135 - DNA, 882 bp, Artificial Sequence
  Description of Artificial Sequence: Synthetic polynucleotide
cgaaggttgtggtcgcgttttcgtcggttagtttttagtagtagtttatcgtttttgtttcgcgttttcgttttaggttcgtacggttttagtttcgcggggattagtattgagtcggtttcgtcgtcgttttagtgacgggttgttgttgcgggaagttaatcgtttagcgtttggaggagggcgacgaggtttttcgcgcgagcgagtattagaaagtagtcgggttttttcgttttatgttggttcggttggcgtagttcgatcgcggtcggtgtttgaggttgggggacgttttgattcgcgtcggtcgtttttcggtggttttgggcgcgtttcgtgtagtcgggaggttggaggcgttgcggtcggaggagttgggggagttggcgggcggtttggtgtgtttcggtttgcgcgaacggttattgttggcgaggaagtcgggcggcgagtttaaggttagggagggtcggttttggcgttcggcgcgtttcgcgatttgtttggttgttcggggttgttgtataagtcggtgatattgttttgcgggtttacggtttgtgagcgttgcgtggagttggggttcgcgcggttacgggcgcgggcgcgggcgcgggcgcgtgaacgtagtgttgagtcgtttgttggagaggtttttttcggtcgagtgttcgttgcgtaggttggagggttaggcgcggagtttgtagcgttagtagtagttcgaggtcgcgttgtttaggtgcgattaggttttggagttgtgatttggttgtggggtcggttcgtttttttgatttttgttaagtttagcggttggagttaattcgcgggtttgggttttcgagcgttttgtttaggcgtagggggttatttcgt

SEQ ID NO: 7136 - DNA, 4359 bp, Artificial Sequence
  Description of Artificial Sequence: Synthetic polynucleotide
cggagcgtttaatttagtatatcgttttcggtaaattgcgagtaatttaaagtagttcgtttagtagggaggggagttggtgggaggggggtggatttcgtcgttcgtagaggtggggagatttggggggcggtttcgtttttaggttgtagcgtgggtttggttttttgttaagttaggagcgtagttcggagttagcgcggttttcgggtttttgcgtttatggcgagggtcgcgggggaatagtttttggtaggtaatttgtcgggtatttatttgagtttttcgtatcgcggttcgaaaatttgggagcgttttaggataaagggttagttttttggaattagtcgtgtgtgattagtgtgtgttagttcgtatgtgggggttttagtgtgtaattaatttagttgtttatcgtagtttcggagaaacgagtacgtttttttgtacgtgtttagggcgggtgcggcgggtagtgtattgtgaataaagtcggttatttttcgcgtcgtatttcggggacgattttcggacggtttttcgcggagagtcgggcggatgagagcgtggtgtgtgtgtgtgtgtgtgtgtgtgtgtgtgtgtgtgtgtttgtgtgttttgtgtttttttaaggagtcggaggcggttcgcgaggtagggatttgttttaatttgttttatatttggcgcggttttttcgaagttcgggtggcgtttagggtcgggtaggtacgcggaggattagtagcgttcgttgtagaaaaagatatcgttaatttttatttagaagtttatattgttttgagatttggttttttatttttttttaaaaaaaaaaaatgtaaattgatggatgggttttaattgatgcgtaaaatgttttttttgagagtaagataggagggttagggaagggggaaataggtagttgatataatttttatagtttaattgtcgagaattcggatttggaggtaaattcgaggacgtattcgaggagtaggcgaggttgttttttagtaggacggtttggtatcggggcgtattgttggggatttgattttttcgtgtttttttattttagggattcgtagttggttcgcgcgttagggtatatacgggttgcgggagaaggtgaaagttaggatgtagtacgagtttcgagagtggtttgggttgtgttttttaagagaatagtcgaggttttcggcggttttgggaagttgtttttgggtcgggagagcgggaggcggcgacgtaaggacgcgttcggagtttgggcgcgtcgggggcgggcgtttggttggaagtggggtagtgttttttatgggaaagcgagattcggcgagttttttggttgtttttttagttttcgaggtgttcgttttcgcgcgtttgaggtagcgtagttcggagggcgaacgaatggcggttggtaaattttgagtgagagtgcgtttcggattcgaattgtcgaattgtggttgcggtagggtcggtcgagatataagttcgtttttttcgtttgttcgatgggttttagggagattttagttttagtttggtggagcgtttcgttcgagggagttgtgttattttgtttaggggtagggagggcggcgttttgggcgggtggggaagggtttttgtggtttttggggttttaagcgttttttttttcgtttttttttttatcggttttttttagttttttttgtttcgttttttttcggggttggttggatcggcgcggatttgttttagatttacggggagcgttttaggtttttaatgatagtttaaatgtggttgttggaaaagtcgaaagggatgtggttgacgtggggcgtgtttcgtttttttgtaagagtcggaaagggagttgggagtcgcgcggttggttttaggttttcgcgtttcgtcgttagtaagtaggtgggggagtcgtcgtcgtcgttagttttatttcgtttttaagtttcgttcgttgcgttttggtcgcgggcgtcgagagggtgcggggtttcgtcgtgttttttttattttgtttattaatttgtttgtttcgtttcgtttcgggcggttttagatacgggtttttcgcggtagtattcgcggttcgttcggcgtagtcgtcgtttcgatttttcggtttcggggggtaatgagggggtagtggaaggggtattgtttttcgggtattatttagagaaacgagatcgtttcgttttttcgtcggttttttttttttttcgttcgggttcgcgtaatttttcgttagagggtaagttgggagtgtttcgtttttatcgatagtttttttttttttttttttttttttttttttaaagtttttttagaagtgggagtcgggtgggggaggaagaaggtttggttagttttcgttttttattttattttttcggtttaatttgtttttttttttttttttttttttattttttgcgcgtcgttgttttttcggagttgcgttcgggaatgataattggagcgcggtttttttaagagttcggttttgtttttcggtagttgaaggttattaaatataaaagtttttagcgttgcggtttaatatagcgtatgcgttttgttcgaggattggtagagagacggtaatatggcgagaatgtttggtagcggggattgtaatattagcgcgggcggtagcgttagcgttgtcgtcgtcgtcgtcgagaataatggggagcggggcgagggcgagcgcggcgcggggggtcgcggtcgtcgttatagtcgttcgtattattgtagcgcgggtgaggaggaggaggaagaggaggaggaggacgagatttaggaggtgtagataacgggggacgaggaggaggaggaggacggaggtggggggttggaggaggacgaggaggaggaggaagaggaggagatggggttggattgggacgagtttttggagttcgaggattcggtcggggaggagttggagttcgagtcggtttatatgattaatatggattagagcgtcgcgttggagttcgaggcgtcgtcgcgattgttggcgtttcgggttcgcggtgggtcgttcggggacggtttcgagttggatttcgacgtgttgtagcgtttcgagcgggttcggttgagcgagaatattcggttggttattcgttacgtcgtgcgtatttttcgggagtatttgagcgagaaggcgtagagttcggatttcgagattatggataagggggcgttgtgtcgcgtgttgcgttttttttatgtcgaggttcgttttaaaagcggttagttttatagtaagtcgtcgtttattagtattcgtagtttttttaatcgttattttaatgagttttcgtattgtcgtacgttcgattttattaaggatttcgagttgcgtagcgttaatttgacgttggtcgcggttattcgtaagttcgaggagtagggcgtcgggtcggtggtgtagaagtaagttattacgcgcgtcgatttgcgtaagttgtatatttttagcgtttttagtattaatacgtttttcgggttgtttaataaggtttggttcgagacgtgtatgtatttttgtattcgcggtcgcgagaattagcgtgagttggaggaggatttttttgggttggttatggacgaggacggtcgtaagttcgtttattttaagtttttcgggttttattataagtcgcgttcgtcgtcgtggagtaagaagcgcgtcgagagtagcgacgaggagaatttgtttcgtatgtatgagacgggtatcgagttttgtttttacgttagtttcgttaagtatttgtcgaaacgtaattttttttgtaaggcgtttttttagcggtttcgggattattgtagcgagggcgatgtgatttggtacgagaataaagttatcggtaagaatttgttaggtattcggatgtagatgttttttaaggcggttaagttttttaagatttatattaattattgtatcggcgtcgtttttatcgttacgtttaatagtatcgcgggtattggtattaagttgggttcgttcgtttcgtagggttgttacgtcgaggttttgaacggggcggtacggtattatttttattatttttttatttattttttttattattatcgtttttagtcgttttcgttggggaatatttatattttttttaaagatagttaggtcgggttcgacgtgaaattcgaggttgcgtttaagcgcgttttgtacgagtttgtgttcgggtcgggggaaatttgcggttttattttttttaaaagattttgtattcgtttttcggagtttgtggatgcggtggtggtggttttcgtgaaatacga

SEQ ID NO: 7137 - DNA, 2762 bp, Artificial Sequence
  Description of Artificial Sequence: Synthetic polynucleotide
cggggcggtgttcggcgtattttaggttttttttcggcgatttttcgcgggttgtagtaaaatacggggcgtttcggcggggcgggggcgggcggttgtcgcggattcggtcggttatagtcgtagtttggtggttttcgattggttacgacgcgggcggggaggtttggcggaggagggaggcgggggcgagggcggcggcggcggcgggaggaataggagaggggagcgggtcgcgtagttaggtagcgcgtggggcgagcgcggggagagcggcggcggttcgtttaggtcgcgtagcggaggtcgagcggggtgcgcggtcggcgacggagggcggcgcgcgcgagtgagcggcgtagggcgaggatcggcgggcgggtgtcggtgcgcgggtagtaggggcggttgcggtagtagttgcgcgggacggagtcgcggcgggagagatcgcgtcggtttttcgttttatttttttgcggtcgaggtcggagaatagtttttaattcgtcgggggatcggaaagaggagtcgagaagcgtttttcggtttttacgtagcggaggcgcggagtggcgggattgttgttttttgtgggtgtagtacgtacgattcggagcgtttttttcgcggcgttgttttcggcgttttcgtcgcgtcgagcggttttggagcggggattcggaggaagtaaaattacgagttcgaaatttcgcgtggcggagtttttggggagcgttattcgttttatttttatttttatattttttatcggttaaggttttcgtcgttgtatttttcgcggttttcgttgcgtttcgggtcggagtcgagtcgtttgcgttgttatagtagtcgtttttatatattcgtagacgtttatacgttttttttttttgttttttcgttttttttttagttttttgatttttgggtttgttttattatttttggtgcgagtttcgcggatttcgcggttcgttatttgttattagttcgttttttattggcggggagcggagagtagcgaagaagggggtggggaggggaggggaagggaagggggtggaaattgtttggagtcgttttttcgcgtcgttgttggtgttgtcgttgtttttttttttttcgtcgtcgtcgtcgtcgtcgtcgtttttttcggtttttcgttcggttttttttcgtttttatgtgtcggatagcgggagcgttgcggattttgttgtcgttgttggcggttttgttttaggtacgcggcggttttcgcgggtcgggttacgggcggggtggggcgggcggcgtcgggtttttttgtttttcgcgtcgttgcggggtcgggttgcgtattcgggaagggaggtgttacgtcgcgtcgcgtcgcgtcgcgtggtcggtagttgcgtaggtatcgggtttcgttcgggcgtcggggtagggttgtcggggttagtaggtttttcgcgttttttttggcggggttttaggggttggattgcgggttttttttgtttttttttcggggtcgagtaagttcgcggggggtgtttttaggtagtaggagggtgaggtaggataatttttaggttttgtagttttttgtgtttttcgtttttcgtatagtattttgttttaatttttttgtttatttttgtagggatgggtcgcgagtttatagtaggaatttttattttggtgttttagttacgggatttgtttttattttattttattttgtattcgtgcgtttttcggtgtttaagggttttattgttttattgtttttattttagtttggagttgttttttttttttttttttttgtttttataatattttgtgttcgttttatttggaaagaaaatttggtttttttgttcggaggagtttttgtcggttagcgtttgtttgtagaacgagtttggttttttacgtttagtatttttttcgggcgagaagtttcgttacgcggttgtttttttttttgttcggttgtttgtgttttatatgcgtttcgggggcgtttttgtttggagtttttcgtattttttatattttcgggagagagttagcgagtttttttatttaatttttattaagaggttttttcgcggtaggaagtatttgttttagttcgggcgtaggttttttcgttattgtacgttgcgggtttttagttcgggggtagtttaatttttcgtcgtttttaattcgaggatgtttttaggtttttttcgattagttagtttaggtttggaggttattttatatagtttcggtcgggattttttagttgggcgggtgtagtgttttggttttaagtcggttttcgtttgtcgtggggtttttcgaaggttgcgggaaaggggcgtgtttattttcgtcgcggggtaggaaaatttacggagggtttttttgtttgtcgttttcggggtaaggggagaggtgttttattgttagttggtagtttcgaaaagtgcggacgtagttcggaagtgtttgtttcgggggtggagataggtggtgtggattatttcgtttcgtggtttttacgggttagggtttggcgcgtttcggttcgtcggggggtgagtgttgttggggcgggggtaggggttggacggggttggttttcgtagtttttcgcgttttttttcgtaatttttagacggtcgtgggtcgtcgtcgcgcggagttttgtttatggtgcgttatggtgcggtacgtttgtttttgttcggttttacgtttttttttcgggtcgt

SEQ ID NO: 7138 - DNA, 338 bp, Artificial Sequence
  Description of Artificial Sequence: Synthetic polynucleotide
cggagcgggggcggtttggagcgttgatcgggcgtcgaaacgtcgggagtcgggggttaagggttcgagttaggaggtttcggagtagtagtcgttcgttttttacgtcgtcgtcgtcgttttcgcggttgtttggatacgggataatcgatttggggtttcgatcgtagtagagtcggaggggtgggtaggcgcgggttcgggagacgcgcggggaaacgcgcggagtcggtgagtcgggggcgtttgtgtttcggcgcgggcgtttgtgtttcggcgcggggcgttgtcgggcggcgtttattttttttggtcgttcgtttgcgcgattttcgcgg

SEQ ID NO: 7139 - DNA, 1435 bp, Artificial Sequence
  Description of Artificial Sequence: Synthetic polynucleotide
cgggattcgtgtgtttttcggggtttaaaggcgttgggcgggcggttgttttcgggagaggcgtagtttttatttttggattacggggttagtggttggggaagtttttggggcgcgcgcggggaggcggcgttgcgttttatttgtttagtttcggacgtagttcgggggcgaggcgtttagggattattttaatttaatattgggatttttaataaattaaggaatgggattttaattattgaaaatttagtttttttgggttagaatggtgttgggatggttttggttataaaatattaaagagatcgatcgttaagggaataggaaaaacgttcgagatagtcgttgtaattacgaatggattagatttggtagtacggggtattgattgttggtgtttaatcggattttttttttttttttttatttttttttttatttaaagtaggttttcgttgcggtcgggatttcgtatttttgtaacgtggtcggggttgtattttttatgagtttagggtgaataggtgcgaagtgcgttgggagtattcggttagcggtcgagcgcggggaatatggagagcgagcgcgatatgtatcgttagttttaggattggtgttttaggatttacggggatttaggtaagattaagacggtgattcgtaaaaaatacgaacggatcgtttagttttttaatggtttcgagtcgagttttacggataacgttaaatttaaattttgggttaaatcgaagggtttttagttgggttagtcggacgaggttcgcgggggaggcggcggcgttaagtaagtgttttacgtgtttgttaagattacggtgagtgattcgtttttttttgttatttgtttgtcggagtagttcggcggggagggaggaaggagagaggcgggagagagggggagtcgtgagtcgtcgttggttcgtgtgttttttattttttttaattttttttttaagtcgtttttattcgtattagttaggcgcgttttttttattgtatagtttttgtggttttttattttaaagcggtagcgtatttttagagttggttttttttttcgtttcgggttttcggatcggttgtaggagttttttttttcgggtcgggcggcggcgtttggcgttttcgggttgggttattgttttatgtttttttttgggcgtttggcgcgtgttttatcgtcgttatcgcgtttaaaggttaggttggaagttcggtcgtacgttttgagagtagacgagtttgatcgatagtttatagtgtttttttattggtataaagttcgaatgtagcgttagcggtggatgtggggttttttttaggatattgttaggttttatcgttagatcgttgttcgggaggtacggggtagttcgaatgtttcgattatttttagagatcgttgtcgcga

SEQ ID NO: 7140 - DNA, 510 bp, Artificial Sequence
  Description of Artificial Sequence: Synthetic polynucleotide
cgagcgtgagttagcgttgaaggtttagagcgcgttgtacgagtagaagattttgttcggggtaagtggcgttcgtcgtggcgtaagcggtcgacgcgtcgatagggggcgatttcgggaggtcgggcggcggcgcggcgcgcggggagaggacggtagggcgttcgtcgtttcgtttgagttcgggagttcgcgcgtttttttaaatttttgggttttcggtcgttcgggtttaacgggattcgggataggggttttatttggtcgtggtcgtgaagtttttgcgcgggtagtttggggcgggggagcggcgcgtttcgggttttcggagcgggagttgttttcgtcgggttcgcgggtcgcgtgcgcgatcgagttcgtttatcgagtcgacgcgggtcgttttagtgggggaggagggggtcggcgtgggagggggcgtcgtaagtgagattatcgcggtttatttaaggagttagttttcgtttttgataaattatcgcgtttcgg

SEQ ID NO: 7141 - DNA, 2722 bp, Artificial Sequence
  Description of Artificial Sequence: Synthetic polynucleotide
cgaaagtggttagtcgagggtcggcgggggttaggttagtcgtttagtttcgtcgttttagttttttagtttcgtagttcgcgggggagcgggcgcgttattttaatttgttaggtttttgaagcgaagaggttgttttgaaaaagtaaatatgagagaggacggggtgtaggtaaatattattaacgtgaaaatttgttattttagttaagtttattattagtatttatttttataggcggggtcgttcggattttgttttcggtttcgcgtttgttattttttttttcgcgtagtcgagatgttagttttagtgggtttggcggggagttcggcggggttcggatcgggcggttcgattttcggtttttacggtaggaacgatttagtttcgtatttcgggagttgtaggtgtcgaaaacgaaattcgcgggggtagcgtacgtcgcgcgagtttcggttcggcggtaatttagatagcgatttaggggttttatttttttgatggtgattaaaaaaatatattttatttgaattcgtaaagtagacgagggtaaattaagttatttttcgcgttggtttatcggttatcgcgtttagcgttttttttttttttcggcgggcgagcgggtaggggcgttcgatttttatttttttttcgttagttatcgggggattagtcgcgtttttcggggcgggggaggtcgttcgggacggggatttttatttttcgttttcggaagcgggttggggcgggggtcggatttcgagtttttatttttcgtttttttgtttttcggcgcggttcgatagtttttagttttattttggtaggtggtttgggtggcggtagatgtcgggcgggaggaagatgtggggttgttttggtaggttgggggtgtgaggaggaaaaaaaaatagagaaagatatatatagagagatagggagagagcgcgcgcgagagagtttttgtttatagatttatttatataatatatatttatgtagttttttttttttcgatattgatgaatgcgcgttcggattttcgggcggattttttttaagtcggttcgtttttttagtttaaataaataaataaagttagatggaagaaaaaagcgtttattttattttcgtcgtcgtttcgttcgttatttttgtttttgtttcgttcgtttggcgttttaatagagtatagtttggtggataaagtttttttatatatttatacgaaaataaaaattattatttttaaaatataaaaagttgtatttgttgttattataaaaagaatttttaaaaggtaaagagaggaggtcggttgttcggttttttacggatattcgtttttcgcggtcgtcgggttcggaattttagcgtttttcgaagagttatgcgtttggcgttatttatagtcgggggtcgtttcggattgtattatcgttacggcgcggggtcgtcgacgggggaggcgcggtggtcgtcgttttacgtcgttttgttttcggtcgtcgttcgtcgtggcgcgggtttttatagcgcgtttattttcggtttttcgcgttttttttcgcgcgcgtatattcgttatttttatttttggtttggttgggaatttgaatcggtttagtttgtttaaacggaaaggatagagattttgtttgtttaatgtaaaaaaaaaaaaaaaaaaaaaaaaaagaaaaaaagaaaaaaaaaattagattagattgagagagagaggagagagggagagagagagggagagagagagggagagagagaggagagggagggagggagagagagaggggggagagtagagagagagcgcgagcgcgagcgagcgagagaagaggagaaagagagagagtagagagcgagcggagagcgaggtgtagagaaatcgagggggagagaattcgagtgtgtgtatgcgtgtgcgtgtgtgagcgcgagcgagcgagagagaggagcgagagagtgtgagcgagaaagaataaaaggaaagaagattttttttatgtatataaagatggttacgttagtaaacggataggttgataacgtaagttttagtattaacgggttcggtagtagttcgggtagtgtcgggtatatgaacggattaagttatagttcggggaattcgtcgattatttttatgaaggattacgatgttattaagttgtttattgggtagatttttcgtaatttggatgagaaggattttaagttttttttcgaggagtttggtaaaatttacgagtttacggttttgaaggataggtttataggtatgtataaaggtgagtatattttttttttttaattttgtcggggagtaggagcgggttggcgggtcgatcggtcggtcggcgattgacgagcggcggattaagcgagaggaagtttcgggcgggcgcggtggagggaggcgttcgggtagcggagattagagttggggtgcgtggggagttgttcgttggggtaagattgggttttgggcgaggtgttgataggaacgatgttatggagagagtagcgggcgtcgatgaagagaaagagagaggggatcgaggagacggggtttggatttttgggtatagcgatttgaaagatggggatggggaaggttgtatcggtcgagtttaggacgttgagcggacggattcgcgggtttttggtcggtcgaggatcgagggtgttgtttatcgtcgt

SEQ ID NO: 7142 - DNA, 1133 bp, Artificial Sequence
  Description of Artificial Sequence: Synthetic polynucleotide
cgagggcggtcgtttttattttcgggggtttttttaaaatggggtggggggaagttatcgttcgttttgcgttttcgcgggtgtgttttgagttttcggtcgttcgcggcgttcgttttcgtttcggtgtttgcggcgatttacgtttcgaagtagatttcgaaaggaaaaagcgatatttttgtttcgtatagagttaaatattggaagtacgagatagtcgacgtggattaggattattttggtttttcgtgcggcggcggcggcggcggttgcgcgcgggttttttgtggcgcggttttggggcgcgggcgcgggcggcggcggggttgcgggagtcgtcggggcgggaggcggagcgcggggcgcgggcggcggtggggcggcggttggcggggagatagatggtttatggaaaggtttttttttcggtttttttcgatatttaaaggcgttggggtcgtagttgtcgttatataaaggcgcgcgtagttaatgggagcggagcgtagcgcggcgcggtttcgtcggaatcgcgggggatagcggggatcgcgggcgcgcgggtggcggagggagggaggggtgacggttggaagggggtcggcggttaatcgttgcggttcgttgcggggcgcgagggaggggttagttttacgggaagcgtggagtttagcgcgggtttttggtcgttcgcgggtcggagagggcgcgcgtgaagcgtttttgtatagatatgggcggcgtgaatacggaacgtgtatatatggagagggacgtgtatttagatatgtggaggtgcgttttttagtgtagagagacgggtacgagcgtttttagtgtatacgattttgaggtttttgtatatcgcgtacgggttattcggggacgtgcgttcggaggttggcgtacgtgtagagtttgattgcgggtataagggaagttggaatgcgaataagtagtcgtaaataggatttaggtattgttatatagatatgtatatattaaacgttttgttaacgtaggacgcgtgttaagaacgtatttttagagatatatagagggaatatacgatgtagatataggtaagatacgtatattttttaggttttttgtttggcgtatcgcgtcgt

SEQ ID NO: 7143 - DNA, 2401 bp, Artificial Sequence
  Description of Artificial Sequence: Synthetic polynucleotide
cggtttgatcggggcgtttcgtcgtttttttagtgtattttatcgttttcggttgggggcgtagtattttggagagaggcgtttggtttcgcgtttgggttgggggcgttttattttgcgttttgggggttaggggcgtttgtcgggtcgttgtcgaggggttttgtttatttttgtttagttcggagtttaggcgagttagcgcggcgagtttttttttttttcgtttgggtcgttttgagttcgcgttcgttttagttgttgtagttgttgttgttggcggttgcggggagcgcggggcgcgcgtcgaagaggtttgggcggcgaggacggggacgaggaggagtcggaggcggtaaggaggaagagcgagcggaggtcgaggggtttagcggcgtggcgataggattagggggtttcgagaatatgggttagtaggcggttacgggtcggcggtcggacgcggtgaatttgtcgcggtcgggcgcgtattggcgcggcgagtcggagtcgagcgtagtcgggggaggagggttggcgtaggggcgttcgggcggagggggtcgattatttattattaacgagttattatttaataagcggagagcggttcgttagtcgcgcgggaggcgttcggggaagggggttatcggtcgagcgtagcgtatattcgtggcgtacggcgggcggcgcggcgtcgaggatattcgggatcgcgcgcggagtcggggcgggttcgggggcggcgtagatttcgggcgcgggcggttcgcggcgttttttggttttcggcgttcggggttagcgtagttcggggcgagcggggcgcgggtcggggagggggagttgttcgcgtattttatttttttttttttcgggcgggcggcggcggttcgttgtatatatttcggcgtatttcgttaggtcgcgtatagcgtttcgagtttaggcgttttttcgtttttttttcgcgttttgcggcggcggcggcggcggtagtagtagtagtaatatggttgttgatgggtgtttggggtggcgttggcggcgggaggagttttttcgagtttttgcgtcggttgttcgttgttagttatggtaaatggtggcggcggcggcggcggtagtagcggcggcggcggcggcggcggaggtagtagttttagaatgagtagtaatatttacgcgaattattttagtttagacgcgttttttttttttttttttttttttttttttttttttttttttttttttttttttttttcgtttttggtttacgagtttaagatggatgcgtttattatttcggtgattatggaggtgtcgtgcgatagtcggggttaacgtatgtggtgggtttttttggttttttttatggtgatttttttcgggggtttttttattattttgttttggcggacgtttaagtatttgtggatcgtgtgttgttattgcgggggtaagacgaaggtaacgcgcgtttcgggcgttcgttttttgcgttagttttatcgtttttcggcgttttttgtagtttattttttcgtttcgcgtcgcgtcgtgtttttttttattttcgtttgtttttttttcgtcgtttttttttttttcggttttttcggtgttttcggatcggggtagcgggcggcgcgtcgggggtgaggagttgtttttagttagtgcgtttcgggacgcggacgtttaattttgtttttttgtttattgtagggttgttggcggttgcggttggggtcggggtcggggatttataggttcgggtgtcgtggtgcggggtggggatagttaatttagcggggacggaggaagttgggggtagttgggtgcgtgttttgtatcgtttatttgtcggggttcggtttttggcggtgggcgagagggagtatattcgtttatattttaggaatttgttggggagatgagttcgtggggttagaaagaagggaaaaattttttgggtaagggagagaataattttgtataagggaatttcgggggaggagtatggttcgagataatagggggatttcgaggggcgagagaagttggggagatttattttattattgggggtagtttacggggttgttatttttggaatgtgtcgaggtcgtatatttgatgtaattttttatttcgttttttaggtgttttagtggaatatattttaagtttttcggtttttgtttttttgtttttaggttatttattttgggttttcggaaatgttattagtagcgcggagttggagcgggagttcgtttgaggtcgcggttttacgcggagcgttttttttggcgttcgaggtggttagatgtcgtcggttttagttatttttggtgtagacgtttatcggtattgaggttggcgatattttcga

SEQ ID NO: 7144 - DNA, 769 bp, Artificial Sequence
  Description of Artificial Sequence: Synthetic polynucleotide
cgttgagtcgtagggaagttgcggggttagttgagtagtcggcggtttgttgggtttttagtgtcgcgcgatagtacgattcgagataaggtatttggggttggtgttaggtagaggtttcgcgttgcgtggtcggcggtaatagcgtttggcggtcggtttcgggcggggttgtaggcgtcgggttttcgcggtcgcgaggcggggttggagggcgttgcgggttgcgcggaggttgcgggaagcgcggggagtacgcggagttcgattagtagggagatcgcgtcgcgtcgggtataggtacgggattcgcgttttaggagggcgtagcgagaggcgtattgcgtatttaggggttgcggtttcggtcgtcgtgcggtgataagttgatttttcgtcgtcgtttagttaagttcgcgcggggtgttggcggagatgtcgtatgggaggtttttttaacgaggtgtaaatttaagttatttcgtttgagtgaatgaagggacggcgcggggcgcgggtggggtttatcgtgataaaagtttagtatttggtttaaattttttttttttttttgttcgtaggattagaatattcgatattaaaatgttttagtgtagtagaattttttagcgatttcggtggcgggagagtagtattttttaggtatagttgtgcgtatttttcgggttttatcgatcgtattatttgatcgcgggaaacgaaatttgagtttaggaatttgaattgttttacgtacgttcgttttcgg

SEQ ID NO: 7145 - DNA, 1169 bp, Artificial Sequence
  Description of Artificial Sequence: Synthetic polynucleotide
cgggagttaggcgcgcgggcgggggttttatcggttatttcgaaatcgtagaatgttttagggttttcgggatttgtgggtttaggggaacgttcgggacgcggagcgggtttagtttatttgtcggacgtttttttcgtttattcgaattcgggagtttcgtaggagggatttttttcgtttttagtgattatagttcggattcgggttgcgttcggcgggtaaggttgggagtttttcgggtcggaggacggggcgtatgggtttcgggtttgtagaattcgcggttgcgggagttgggtttttttttttttaattcgggtcgcgtttcggttggtcggaggaggtagagtaggggtgcggtcgtgtgttcgagcgggagtggggcgtttattttcggggagaagggggatcgggaaaggcgtagcgcgtcgagtattcgtttatatttcgttcgtttttcgcgcgagtcgggtgcgtttttaatcgaatcggggcgggcgtcgggagagtcgggttttttcgagattcgcgtttttttttcgttttcggtttattcgggttttcgtaggattagcgcgaatagacggggcgattcgcggtcgagatttttatttacgcgcgcggcgcggttagatcggcgagcgttttcggttcgacgtttttttcgattttcggattttgggcgttgagcgggagggggaggtattagtttcgttcggtttcgagtcgttttcgtttttttggttcgaatagggggattttaaggtttttttcgattttttcgcgttcgcgcgtatcgcgtattcggagaagaagttgcgcgcggaattattagataggagttcgcgtttttcgttttatcgtttattgcggtttcggttttttcgtcgcggattttttattttcggttttacggcgcgtttaattttatttgcggtttagatttcgcgagtttcgggtttcgtttattcggtcggcggttttttcggggcggagcgcggcgtttttggagtcggtatttcggatttcggcgtcgtttcgcgtatcgttttcgttttagtttttagtggcgcggcgttttttcgcgatattcgcgggtttttaggagcgagtcgattttcggttgggtttggagtcggggttaagtttattcggagggagtacgg

SEQ ID NO: 7146 - DNA, 6036 bp, Artificial Sequence
  Description of Artificial Sequence: Synthetic polynucleotide
cggtgcggttttgggtattgattacgtttatatgtgatggttttcgtaacgtgtaggtttcgttggggagaggttagcgcgggttttaggttttagggtttcgggtttattgtcgggattttttttagttttttttttattggtttcgttcgtcgcggttgcgtcgggtcgatattgattttagcgatttttggggtcgttttagttggtagttagtattttttttgggatggggtttaaatgttagtcggttcggcgtttgtattagggttttatcgtacgtagttcgttgttttttcgtttttcgttaaggggtgcgataggtagggggattcgttggtttttgttttttttatttttatttttttgggtttcgtcggagcgtttgggtttcgggttttttgaatatcgtttgggcggggttttttgtcggggttcggttatatttttattcgtatttttatagttggggttgagaatgaaaataatttttgtaaagtttttattagcgaattatcggcggttgtagtgattataggtttcgtttttgcgcgtcgtaaaggtttttagttggtaggttcgtcgcggcgtcgtttttttttagtttcgttttatttgcggcgggcgtcgttatttttttagcgttgtttttgcgaagtagcggatttagatttagattcggattcggaggttatcgtttttttcgttcggggttaagtaacggttttcgataggggaagggtcgcgcgtttagggttgggttaggacgtttttgttagcgttttacggtcgggatttgaggtttagcggtcgtttcgtttttttttggattttcgcggtatagaggtaaggtttttcggtgaggcgcgaggtcgtcgtgcgttgggcgggggttttgagagtggtggggttcgggtgggtagaggttttggggcgatttatgggggacgtttatagcgtaggtttatggggtagttagatcgcgtcgtagggtcgggagagaacgttttagaaggtcggtttaggttattattttaggagggtggcggaggtagtggtcggggtttttttcgcggtcgagtcggtggtggttgcgattattatggggttgggtatatagttgaaggggggtattcgggtcgagcggttgggggagtcgtgtcggttggcggggaagttttttacggcgatttttaggttttcgtgtacgaagggtgcggagatgggagttttggcgaggttgggatcgtttacgtcgttgtcgaggagggagagttggtcgtcggcgggggtttcggggggttttttggtttttaggttcggggacgtgttggagttggttttgggggcggcgattttttcggtttggattacggcgtcgttggttttgcgcggcgggggttcggtcggggcgttttcgggcgtggagtttcgtagtggtagggtcgtggcgggaagcgtgttgcgtaggatgtggggtacgtttttatttcggatgcgtcgttaggtcgtgttcggcgcggttattttggggagcggtcggggtttttcgtcgttgttgcggcgcgcggcgtcggttgaggtaggggtcgcggggacggcgtcgtcgggtttgcgggttacgttgatgtgcggtagcgacgcgtagcgtttgatagttttcggtcgggcggcgggcgcgcgtataggtaggcgggacgggttttcggaggtggtgtgtcgggtagggcgttcgttagggttgggtcgggtcgcggggggtcgttgtcgggtcggggtcgggttttgtcggggtgtcgttcggagtttttcgtagcgcgaggagtagaggaagacggcgggtagcgcgggtcggtcgcggcggggcgaggcgttttggggggtagaggtcgcggattcggtcgaggatagttcggagcggcggcgtcgtaagttcggcgattttttgatgaaggttagttgtcgtcggaagttcgagcggtcggaggattcgttgtcgttggagagggttgaggttatacgtattaggtttaggcggttttcgcgcgttttcgggttcgtttcggttttcgttcggtttttggggttcggtttcgggattgttcgagttagcggtggcggtttacgtcgggtcggtttttgtatgaacgggattcgtacgggcgatttttgcgttttgtgttgtttcgttagaagggtgcgcgtcggcgttttgggtatcggggaggtttcggggtcgggtagggttttagtagtttgggtgatcggggggcgttttttgggtaggggttgggaggcgggcgaggtttgggaggagttggaggagggggttttggcgaggcgggcgggcggtgtggcgtttttggggggttggtttagcgtcgttagtttcgaggttttggtaggtcggtgtaggtttcgcgatcgttgttgttcggggttcgggattttggttggagtcgcgggttgtgttaggtaagggggcgttatttttcgcggtgtggcgcgggggtcgggggtttttttgggttgggtacggggtgtcgggttggggacgtagattattgttcgttttcggagtatagttggtatttcgggcgtggttttttgtgtgttacgtggtttttcggggtttgtaggggaacgggggttttcgttggttttgattgaggttgcgttttttttttttggtcgtcgggtattgtttattttttttttcgtttgtcgtttttttttgtgtttggggggttgtagggtggattttattgatagttcggatacgaaggataggatggagtcggattcggacgaggtttttcgcgtggtagttgttgtttggtgtagttacgtgataattgaattggcgtttttttggatggcgcgttattttacgttatttaggtcggaggttcggttcgagttcgttgttttttcgtcgcgttttcgggatttttttgcgggtcgtttatttagtcgggtggttcggggtttgcggcgtcgtaggttagatacggggggtcggcgtttgggtagggtcgagttgatgtatcgttgtagaagttttttcgcggttcgcgggttgggcgagttgtcgcgttcgttttttgggttcgggtttttggtgatcgcgggttttcggtttcgtggatggacggtcggcggtttcgagggttcgggttcgttgagggagttggcggaggagtttagggagtagtagggcggggtttcgttagtaatgaggttgggttgggttcgggcgggcggcggggtagttggtgtagttttggacggggtaggggttttttttcggttttgcggacgttttcgcgtaaaagcgcgagggatggtcgatgtgcgtcggtgggttggcgtgggcgcggtcgtcgggggtttttcgttcgagtcgttgtcgtagaagtagtatacggtttttttagtgggcgtcgtgaggtatagcgattggagcgtttcgttttcgcgggttcggtcgggttttgagtcgtttttgtttgcgggggcgttcgggggtcggtttaggggtagttttagttttgttttgtttttgttcgcgtttcgagattgtttcgcgttgcggtcggcgtttttcgttttgtgtcggtgttttatggtttgtttggtagaggtggggcggtcggtgggtttttgtttgttcgttggtttttcgggttggtttttggggggtttttgtagcgtttcgtcgttgagcgaggcggcgttagagaagttgatcggcgtgtttttcgcggagttagtgtaggagtcgtttttttgggtcggggtcggggcgggtattaatatgtagacgggtacggggagtgcgcggcgatttggtattagcgcggaggttattttgcgtagtcgggtaggtacggcggtttttaggtattttcgtagtagttttagtttttggttcgcggcgtcgcgagggcgagaattcgtgggcgtcggttttttttttcgtcgtcggtgttttgtaaagtggaggtcggcgttttcggcgttttcgtcgcgttcggggtaggtcgagggtagtagtcgtagttttacgttttgttgtacgtagtgttcgtgtaaggttagcgcgttgaggttggaggcgtacgagaagttttcgtttggtttttttacggtaaagcgtacgttgtttgcgtttagtttagatggtagtcggtagcgttttcggtagtcggcgatgtttaggaagcgttttacgtagtttttttattgtaggttgaattgggtggtttcggggggattttgtggcgcgggcgttagcggtggcgttttgtttcggttgggaggtatggtttgttcggggttgtcgggtagttcgttagggttgatggtgtcgttgttttgttcgttgtaaggtttattggggatggagttggcgatggacgggttttcgaagttgtttagcgagtttatagagttgtagcggtttagtataagcggtgttttttgtacgtagtttttcgacgagttggacggcgtggcgttttttatttttaggtttcggtttcggttacgtcggggagtcggaatggttacgggtagcgaggtggtttcgggcgttcgttacgtgttgtttagtttagtttcgttggggtcggttttttttagtttttttagggaggagttattgttatttaggttattattttcgttggggtttgggcggtcggtcgaggatagcgaggaaagggagttgtatcgggatagcgagagtggttttttttgcgtcgttagtttttgtagtgttttgttggttatagatagcggggtagtcgttagtttttcgggaattttgtttaggtggtttgtcggtagttaggtttgttttcgggtttttggagagattttaggtttcgcgaggggttttgtattcgtttttgaggtatttttaagtagtggtacgtgttgataggtaggcgatagtttgatggtgcgtacgcgggcgtcggcggaggtggtttcgcgggtcgggggttcggtttggtagtcgggtaggttaaggttaagtcggttgggtcgaggttgtttatatttggggttttcgcggcgcgaagttagtgcggttagcgggtagggtagtatatgttcgcgtgggtagtattcgtcgttggtattgtcgttgttgaggttgtcgttggagaggttggcgtgggtcgttttgagtcgtagtagcgggtgcgttcggttttttgtttttcgtcgttcgtttttcgggtcgcggtatggcgagtaggattgggcgcggttttttcgtggcgttttttgtttcgggtttttagagttgaggttgaagttatcgtcggacgaggtgtgtagggcggagatgttttttattagttggtcgatgcgcgttattgtaagcgttagtttggttttggttttggtcgttacggttgtttttttattggtgtttttttttgtttttttgtcgtttcggcgggtgggcggggtgcgagttagcgtttgtttttgtaggaaggggttgtttaggaagagggatagcgcggtagggttggttggtttttcggtggtcgcggtcgtagttagggatgacggtgtatcgtcgtcgttaaagtagttcgaatcggaagtatagttttgggttaggtcgtttaggtgtcgtaggggcggtagcggttttttagtggcggtttcggttgtcggcgggttttgtttttttaggtgttttagcgtttgcgcgaggtgtcgtgcgtttagttcggtttttagcgttcgttgtttgcgtacgtataggttgggtacgtagttgtttggggatacggcggtggcggtcgtttggtgtttggcgggtcgatgggttagtaggttgcgtagggcggcggcgttgtttatggcgattattttgtgtttggagtgtattagattacgtagtatgtttacggcgtttaggttttatagtagtttttggttacgggcgttgcgggtcgataggttttagagcgtgtcgtacgcgttgtttacgatggttaggttgtgcga

SEQ ID NO: 7147 - DNA, 3400 bp, Artificial Sequence
  Description of Artificial Sequence: Synthetic polynucleotide
cgtgtagttgcggggtattcggggttgggtttatttgcgttcggggtcgtataggtaggtagagagagtcgggtttagggtataggtttgttttttgttttttgcgttcggggaagggggcggtatagagttagtgattatagcgtagcgcgtatttgttttcgtaggttttcggagcgttttcgcgcgtaagaaggcgtagatcgcgtcgtttttgtagtcgtcgtcgtcgttttcggttttgagcgaggagttgttttggggagatttgtcgtttaataagtgtttggtgttcgtttcgttggtggcgttgttgggttcggttttttagttgtgtcgcggtgagcgtaggttttttagaggtggggcgaggttggggtttatttgtgcgtttatttttttaaggaaaggcgttgtgtcgttagggtggggtttgggagttttttttttagggttgggttttgtacgtttttaaagttggtttgtgtatttttttttaagtgacgggttttgcgcgttttttttattcggtgtggattttttgcggggtttatttttttcgtcgcgagtaggttttggttttcggatgaattttgtgtaattttttttgtttcgtagcgttttgtcgttttttttttgcgttttttttggggatcgtttagttcgtgagcgtttttcgggggtatttttgcgattttttttttgttaggggttttttatagttcgtggtcggggggaagaatgattaattgaaagagcgaggttcggagaaggggcgtcgcggtagcggagtttcggagtttttttttacggttcgggggtatttttagttttagtcgtatcgggggagttttattttaattgtttagggaggggggttttaggggtgagggagggatggatagtgtggatcgtgtttcggtttagttgattcgggtttcgattttgtcgttgtagacgtcgtttttggggaggtagtattttaagtacgtgtgttcgagttttgggtttcgttaagtttagtttcgagggagttatcgtcgtttttggtaagagtttttttttattgatcgcgggtattgggatttttatttttaaggaaagaaggagttcgggtcggggggaaggtgggcgtttattttaggattttattttgttttgtagtttaagttcgaggtttaggcgtttttattagcgtcgtttgcgtttcgggtcgaggtagaggttagatttaagattttcgggagtcgggaggttgtagagaacgacgaagaggagttcggcgaggttatcggagaggtcgttcgggaggatcgtgtgattttcgtagatcggggatttaaggagaggtttcggagagaggggaagtcgcggaaggagaagtcgcggaaggaggagagatttaagaaagagaggtcgcggaaagaggagaggttacgggtcgttagggagtttcgggaagttttattttagcgttgggagttacgcgaagggggttatcggtcgtgggtacgggattttagggacgtcgagtttaggaagaagtaggtttgggtgttttcgaggcgtttcgacgaggagtagcggtttgggagtcgttagaagtttcgcgtaggtaaggggcgggattgagtcggtttcgcgtcggagtttaggggttttttttggacgtttcgcgattttggcgaaataaagcgagtgttgcggtcgtagagttatttgtttttttacgtttggattcggtattaagttcggggtttgaaagacggtggtggggcgttttaggtaggggagagatagcgagcgttatagggcggattcgggtcgtgcgcgaggagagacggtaagggaggttttacgggttttttaatacgtacggatattttagtcggttgtttgttggtttttattggggcgatgtttggggttcgaataaatatgggaaggggcgcgagttggggcgcgttcggattttcggggtaggagttcgcgcggcgtaggggttatcggtagttatattcggtggttattatgttgggtacgtggtgcgcgttgatgcgttttttcgataggttgatgagtagtttgttcgcgtaggcggtgggtacgtagtagggtgggcgcgttagggcggttttacggatttgtatttttagtagtagtattacgtggttgtcgtagcgcgggttgcggtcggattgaggttagtcgtatacgttttggtaattgttggtttggtaggtttcggggatgagtacggagcgttcggcgcggaggtttacgttgagttcgcgtagcgcgtacggttcgtcggcggcggtggttttcgcgttgcgttgtgttcgattcggttcgcgcggatttcgttcgcgttattttacgcgtaggttttgtagcgtttttaggagtagtagcgttcgtaggggatcgtcgaggtcgtcggggttatttgggtagagcgcgagtaggcgcgttagtagcggggttgtggtcggaggtagattcgggaggtttcgtagttcggtagtcgtcgtttgtagtttagtagttacgcggcgcgttagggtcgtggtttacggcgtcgacgtggggtcgtgtaggggcgtaggattttcggtggtggtcgtagtgggttttagtagtagtagtagcggtttttcgtcgtcgagtaggcgttttagcgtcgcggggttcgataggttgattaggttttgcgggaagtcggttagcgcgttcggatttagggttaggcgcggcgcggaggttcgggtcggggggattcgtagcgttcgtattaggcgcgtgagcgtttttaggaaggggtttgcgttgggtggcgatttttcgagtttcgcggatggtttggaattcgtaattggaggagttgagagcggttacgaggttacgtcgttttcgttcgtttttgtttcgtgtttcggtgtttgcgcgtatttgggcggcgggaagggtacggtgtttagttggtcgtgcgtaggtagcggcgcgggttcggatcgcggtagtaggagtagggtcggggttattcgtgtgaagtagcggtggtcgtcgtcgaatagtagtgtttgtagtcgggcggtatttagtcgggagtttgcggtgggtgggtacgcggttggtttaggggttgggggttcgggggtagtcgattcggtttttcgtttttttttacgcggatttatttttttcgcggggttgtagggttaaggttagttcggagtcgcgttaggttttcgtagggcggtttatcgttaatattaggtagcgggtgtttcgggaggggtagaggttttgcggagattagggtttagttcggttggatggaggtttatttagtttcgttttatcggtttttttttttttatcgttattggttttacgt

SEQ ID NO: 7148 - DNA, 1143 bp, Artificial Sequence
  Description of Artificial Sequence: Synthetic polynucleotide
cgggtttggcgttttgtttattttttcggacgggtagtttatttttttttattttcggttttcgtcgcgcgtattggcggcgttcgttttacgttttaagaatttcgttttttagggtgggtggggggtgtacgttcgatagggttaggttagggttaggcgtggagttcgcgtgcgtttcgggatttcgttcggggcgcgcgggaggcgtcgggggtcgcggaggcggggcggggaggggtcggcggcggcggcggcgcgcggaggagatcgtagtgcggtcggcgttaggattcgcgggggttttttaggtcgcggcgtttttcgtttttttttatttttcgattttttttcgtttttaaaatgaggaaacggagtaattcgttttaagttgtgtagtcgggatcgtttcggggtgtgtagtcggttcgcggaggtttttttgggggcgggcgcggggcgcggttcgggggcgttttttgagtaggtgagtacgtcggcggggagacgtggagagatttcgaggtcggggtggggggaaatttcgagggttttaggcgggggtgggttcgggacgtgcgtaggaagggtcggtgtgtgcgcgagtgtgcgcgtttcgggcgcgtagcgggtgcgcggttggggcggagggtgtttagaggcgatcggatttcgcgtggtggtggttggggttttttgggtgcgggtgtgcgcggttacgagtttcgggcgtgtgtattcgcgcgtttacgtggagggttgtgcgcgtgtggtcgaaaagcgtgtgcgcggttttgcgtagcgttttgcgtgttcgagtggttcggcgttggcgtttaggtgttttagtgtggggcggttgtgtgtgtgtcgggggcgggggataggtgcgtacgtttttaggtgtggagcgtttgtgcgcgcggatgcgcggggacgtgtgcgtatatttgtttttacgtggacgtggttttttgtttgtttgcgcgtagttgtgttcgagttttgtgtgtttttgtgcgtgtgtatgtattcgtatgcgtgtgagtatacgtgggattggaggattttatgggaggcgtattttggaggggtcgagatttattttttagtatcgtttattttttagttattagcggtcgg

SEQ ID NO: 7149 - DNA, 220 bp, Artificial Sequence
  Description of Artificial Sequence: Synthetic polynucleotide
cgtggtaaattcgggtttcgacgatagaggtagcgtagaagttcgtttttaaatgagataattttattaaaattataattttttgtatttttatagcgtttttttagtggcggagattttaggtgttttacgttagggtttattagagaatcggggcgatcgtaagtttagtcgcgggataggcgaggttcgttagttttacgaagcgttatcggtacgt

SEQ ID NO: 7150 - DNA, 1860 bp, Artificial Sequence
  Description of Artificial Sequence: Synthetic polynucleotide
cgtacggaagtttttgtttagttgttagcgcgcgtcgttaggggttgtattgaagttgtggattcgggatggggaggaggttggcggttttcgaagtagggtttatagcgggggagggttagcgtcgtttggcggtggttgcgcgtggttagtgcggatttaggttcggttcggtcggcgttgtttgcgtgtggttcgggcggagcgagggtttttggagttcggttcgttttgggttttaggaagttcggcgtgtagcgttagaggtcgcgtgtgttgggggagggaggagtatagattgtgtttgggggtatttaggacgaatttatagaggggtggttttgttttatttagggggtgtcgtgggtaaaggttttggggttatttgtttggtgttttggagggcgtagggtaggagtcgtcgaggttcgcgggttattgtggggcgcggaattttagattaggtattcgcggtttaattttcgggttaggggattcgcgggggttttacgaatttgtttggtttatttgtgtaatagaaattcgttcgcgtttagtagcgttcggggtcgtttgcgtcggattcgtagtttagtatttttcgcgttttggatttcgaggaggttaggtagagagcggttcgcgcggttttcgtttgcgtttttagtttcgcgttgggtagcgggatatgtttggtttcggcgtcgttatttcggttttcgtttgtttttgagtgcggagttcggagtttttttcgcggtgcgttgggttttagagggttagaggttattagggggtcggtatcggcgggagtttagtcgggcgcgttttcggtttttttttatttacgtttttcgcggtcgttcgggtttaggggcgtagcggggaggagatttcggttagggtcggggagcgcgagggcggggcggggttcggcggggaggggcgcgggcgggcggggatcggggcgggggtcgggttcgggggcggcggcggcgcgggcgggaggaggaggagtttttcgcgcggggtaggggcggagcgagcggtcgcgtcgcggagttaagtgagttcgtttcggagtcgcgtcgtcgtcggtttagtatttcgggcgttcgtcgttttcgtcgtcgtcgttagcgcggggatgtaggatgtaggcgggcgttaggttttagcggcggcggcggtagttgtagtagtagtagtttcggcggcggtagttttttttttggtcgatggacgtagagtcgtcgtcgtcgtcgttttgggtttggatggtgtcgggttcggtcgggttgtttcggtttagcgcgggggtcgtggttttttcggtgttgttcgtttcggtttcgtcgttcgcggtttcgttgtttttcggttttttcggttggtcggtttcgagcgagtcggtgttttcgttgttgtcgttgttttttgcgttagatttcgtcgtcgtcgtcgtcgcgtatttttttttcgcgttttacgggtaggtaacgtgttttcgtttcgtttcggttcgggtcgtcgttttttttgtttttgggcgcgttttgttcggttcggttttggttttcggttcgcgcgttttttttttcggcggttttcgtcgttttaaatttttaggacggagttcggtagtcgtgtttcggcgagaaagttcgtgtttggacgttcggtcgtttattttcgtagttttggtaggtgttttcgggtgtttggacggagtcgtggagggattcgtcgtttaggttcgcgtggggatcgtagggaattcgcgttacgtcgggggttattgtttatcgcgaggtgttgaagtggtttcgtgatcgtcgcgggtcgtggttgatatcgcgg

SEQ ID NO: 7151 - DNA, 441 bp, Artificial Sequence
  Description of Artificial Sequence: Synthetic polynucleotide
cgtcggggtttcggttgttagcgcggtcgttatcgtatggttgaaggggattgaggtcgagttgggtaagaattttgggcgtagattgtgaagttgattgcggggaggtttgggtttcgttatagtcgttttttatcggttttaattagtttcgttttttttttcgggatgtcggatcggtatttttattatttttaggtttttagggggttttggcgttttagttgtggattttttaatattcgtaggtcgtagggttatataggttgggtttttacgtgtagaggatataaagtagatagacgaaaattggagtttcggcggtagcgagaaataaaggtcgcgttaaatttcggaagtcgttttgtttgttttagttgcgggtttgattggacggtttttcgtttagtgttttcgattggataacgtttaaggtttcgt

SEQ ID NO: 7152 - DNA, 5587 bp, Artificial Sequence
  Description of Artificial Sequence: Synthetic polynucleotide
cgcgggaagaaggttttggggggggcgttttcgatttaattaggaaggagtatgtatatgtaaatgcgtttagggggcgggttttgggttcggagtttttcggggcgtttcggcgtagttttagttttgcgttattttcgcgcgtgcgtttttttttcgcgattttttattcgagtcgtgtttttggcgtagtaggatcgtttgtttcgatggcggcgacgttgacgaggtagtagtagttgtcgcgattgtggtggtgggcgtgtgggtcgtcgaggttgtcgcggtttcggggattgcgggatcgatggcggcgggagggttttcgggcggcgggtttttgtcgtcgcggtcgggttcggaggtggtacggttcgcggcgttcgcgttgttggcgttggcggcgttggttgggtcgtggcgacgcgggtcgttgttttggatgtgggatacggtttcggcggtttgtatgttgggcggcgcgaagcgcgagagtacgcgtagtatcgtttgggttttgtgtttttgcgtgtcgtcgtcgttgtagttcgatacgcggtattcgtatacgttttcgttttgtagtcgtacggtagatagtcgaagtcggtgtgagatgttattgttttggacgcgtacggtttgtaagagagtagggttagaggtcgggttgggtagtttttaaatttatttttttggttattttggtcgtcgcgtttttttattcgcgtattttaatatttttcggattttggtttgtttattattacgattcggttttttttttattcgcgtttatttagtggtatagggtttttaattttgcgtggacgttaggtagttagttttttggattgtgtttttacgtttttattacgttaattaaacgtttattttgtatttgtttcgtttatataaattaatattgtttgttttttcgtagttggcgttttagaagggtagagtttatttttttttttttttttttgtatttttaggaaattttaggttggattttttgttttttaatttttttacgtttttttcgtttcgacgcgttttaatcgatagtttcgttttagtcggttttttttatttttcggagtacggagggtttgttcgaatcgttttttaaggaaagttattttgttatcggatttcgttttttatagttaatattgtgtttttttaagaaggtaagtaacgttgaggttgttgtttggttttttggttatttgttattaattcgttttttcgcgggatttttagaagttttttagcgaagtgttttttttttgcgtttcggtggggatttcgggaagtattgttttacggtttttaataaatatttagggagtttttatttttgaatcgagtttacgaggaggtttcgttatttttaggtttttttacgttttaggtgggaagtttgggcgtatttttttttagagttagtaattttatgattcgggtttttcgtagtttggtataattattttttatttcgttttttgtaagtttgtaatatttcgtatttagattcgtaatttaggcggaggataaagggttgtagcggagggcgtagagtagatgtttagggcggggtagagggggcgggaagttggcgttacggtcgcggcgagggcgagtagtcgcgcgttttcggtgttaggaggaatgttcgtagagcggaggttggtaggcgcgagaggttttaagcgcgtagttcgattaaggggagttttataggttagcgtcgagtcgaattaggggatttaagttttggatttttgatttatataaaagagaattcgattttgtaatcggcgatagatggcgttcggatacgtcgagtagttatcgatgtaaggttgcgatcgttgttttatttgcgcggttttatatgcgcggtcgtcgcggtttgttaagggagggagttgcgggattcgaggcggttagaaggggtttttcgcggttcgcgttgggttttatatttacgttgattttagttgtatttttatttgttatttaaaatgtaaagagggagagagagacgtgaggttcgcggttttttggttaggggaattcggattcgtttttaggtaagggtattttttttcggtaggttaggatcgaaatcgttcgggggatgggggttgagggtataaaggacgttcggttttttaagagttttttaggaggaagcgggttttggagttagtatggtgtttgattaacgggtggttgttttggtgtatatttgtcggttgaattggggagattggatggatattagggtgggaaggaaagtttttttttttttttttgggtatttttaggttttgtcgcgtggtttaaaatttttttttagtttattgggagtcgtgaagaattggagggagggtcgttgtgtttggatagtatttagcgggaggtttagtgggagtaattttgggtgggattttgggagaatgtaggtgtgtgtaggtgtaggtgtgtgtgtaggtgtgtgtgtacgcgagtatattagagtgtgtaagagagtgtgggttttgaggtagataggtagcgtgggtttgttttcggttatagagaagtggtttttttgtgtttttgagggttggaggttttgtcggtttttcggtattcggttttttggtggtttttggaacgtagtcgtgggagttttggggtttttaaagtggtagagggcggggagagtttgatgggattaagggggttttttttattatttagtatttattagagggtcgtagttagcgagtacgagtaagcgattaggttgaggtgtggttttttaggggttgggcgtgaatggagttttgggaggtggtgggaatagcgatgttgttaaaataattgataggtttgggggtaattattgttgattttgaagatgttttgggatgcgaaggtggaagatgggttgcgttatagggcggcgttttgcgcgagtgaagttcgttgtttttttttttgggttagttttcgtcgtttcgggcgcgagtcgggcgcgcgtcggtatcgcgtgggcggcgggttattttgtttcgggcgttcggtacgttgagcgttagttcgtgtagtagttttcggggtggttttttgaggtattattattgaatttttagcgaatacgaggtggtttcgttggttcggaacgcgtagggtatttcgatgtcgtttttttttcgtattgttatatttttggggatttttgtgaatgtagttgggggtggggagagagagagaggcgtgattagttgtaggtcgggggtttggggtaatttaaagcgaggtagtcggtttttggttggttggttttgtgttttttatttcgtagttgttttttggcgtacggtcggaggggttagtaaagttcggggaagcggttgtagggtcgaggtagggatcggttatcggttgtttattgttttttttcggatggggcggggcggtaggggcgattcgtgtttttttttcgtttttggtcgtatcgttagagtttggttggggcgcgtttattttcgtttttcgtaggtatttttttcgtagtcggggtttcggcgggattgggaacgattcgggcgcggcgttgttgttgcggcgatttttcgtcgttcgtttttttttattttttcgggtttaggttgtatagcgggattgttggagatcgcgaagtttttcggttcgtttttttttttttttttttcggtggcggttttagtaaagattttttcgagtttatagcggtagtaaagttttcgcgtttatcgtcggttacgaagagtagtagggtatgtagtagtagaggcggtaggtattcgagggtatcgagtcggtttcgttgttttatttttcgcggggggcgcggtggcggcgggggttcgggagcggagaggcggcggtcgcgtgggttcggatcggtttcggttcgggttaggacgttttcgagtttgttatggtttcgcgcggcgtttttttttttggtcgtcggcggtcgttaattagtttcgttttttcgtcggtttgttcggtgcggtttcggcggggggcgttgcgcggggtgtgtaggagacgcggttttatcgggaggttgttggcgatcggttagtgtttttttttgttcggtcgtttataggacggtggggattcgcggtttagtttttgttcggcgggtcgggtaggggttgggtcgcgtcgggatttatttttggtcgagggagtgcgtgttacggagtcgcgagtttttgtttttttgtttttttttggttttgttttcgattgttatttttttcggttttcgtagtcgttttcgtcggttttttcgcggtttttttcgtagggcgagtgggcgtttagtcgcggcgcgtagatttggcgttcgatttagcgtagcgcggggagagcgggttcggcgtggcggattcggagtcggagagaggcggggagagggggaggggaggggaagggagggggcggttagtggttgggcgttaagtcgtttttatcgttgtatcgttttcgttttttttttttttgttatagttcgtttcgttttcgttttagagcgtttttttttttttttcgggggtcgttcggagggattatcgtttttttggttggagtatagtttcgtttcgtattcgtttgggttgggagtttttttatttaaattttttttggtttttttttagtttgtacggttcgagacggtcgtttatttttgtttttcgtgtgtttttcggttttttttgtagtttttagtttttaattttttattttagtttgggtaattagttgtttcgttgtttggtttaggtttgggttatgacggatgggtgggcgttcggggtcgcgagaagggcggaacgttgtgtttagtcggagattacgttgggtggcggcggtagcgtcgggagtttgtagtgcgcgagggagaagtgagcgtatagcgtttagcgagtaggtgtttgcggcgcggagagcgtatacgttagttagttcgtagcggtcgtgagtgacggtaggggcggcgggggtggggtggggtggggagcgtcgggtacgatttagggttcgggaggttttcgggagggggcggggtttttgtttttggatcgcgggtttttgtgtttttacgcgtttttcgtcggtcgtggttttttttttgttcggtgtaaagcgagatgtcgaggcggtaggaagtcggaatttatttttcgtttgttttggcgtattcggtatttcggtattttttttagtttttattcggagtttgttttttttttagttatttgagggagcgcggtttggttttcgaaggtaaatgcggggtggatatgtggttcggacgtagcgcgtagttatagttataggggcgagttttaaggttcgttttgggttttttttatttttttttttcgggagtttttagttagtgcgtttcggtatttttgtttttatttcggtttttacgttttagttttgattttaggttggggtggggtagttcggtggatttacgtgtttgttttttcggttattagtttttcggaggtatcgt

SEQ ID NO: 7153 - DNA, 3643 bp, Artificial Sequence
  Description of Artificial Sequence: Synthetic polynucleotide
cggcgcggcgcgattagtagtcggtttcgttcgttcgtagttttgtttttagcggcggttattgggatcgattgttcgttttcgatttaggtaagatgtttaattgcgatcgcgcgttttttaagatcgtttttcgagtttcgttataggtatacgcgtggtttaaatattttatttggttcgaaaagttagtagacgggggaaaaaaaaaaagttgtgcgagtagttagtcgggtagtttcggagttcgcggaggtcgttttttcgtcgtttagtcgtttagtcgtttatacgcgaggtcggttcggggcggcgcgtagttcgcggtatttcgttttcggttttgcgcgtttatttcggggcgcgtcgaggttatcgtagggtatttatttggtatttgtttttgagtgtgtagatcgtcgcggtttttatttgggtttttaaataagttttagggagaaagaaggaggtaaaaaaaaaaaatttaattatgtaaatggatttcggattgggaggcgcgggatggatttgacgtcgttattgtacgagttttcggagtagtttcgggtcgggtagatttatgggggcgcgttacggttacgttaggtttcgtcgtcggagtatttcgaagttaattaaagcggtaatgtttatttttttggcgatttttcgtgcgtgggtttattattttattattaaattcgatttcggcgggggcgggggttttgtttttacgttttttttttttttttttggtcgtttttttttttttttttttttcgttttttattttttttttttttttttcgtttttttaagtcgtttgttttttatttagtgaataatgaataaagatgtgagtgatgggaaaagatcgtttttttttttaattttagtagagagtaaagtcggttttaaagtaaaaatttagttgttagtattaaattgggaaagaaaatagcgcgtttttagttttattattttttttatatatatatacgtacgtatatatatacgtacgtacgtatattttattttaagtttatttaagttttggttggagattggggcgttaaggttagggcgcgcggggttgtttaattcgtcggggatattagggttggggaacggcgcgtgttttggttaggcgtgtttttcgcgtttattttcgtcggtttttttcgtcggtttttttcgcgtttttatatcggtcgattaggttcggcggttcgttcgggttgttcggtcgtcggatgcgtttagtaaacgcggtttttgtcggatttttgttaaattgtatagcggcggcggcggcggcggcggttgtcgggagaaggcgtaggaggaatcggagggtcgtatcgcgcgttcgtttatttcgtttttttcgttcgtttttcgtttcggtttcgtcggtcgtcggtttttattcgcgtatacgatttagtttttaggacgtatcgggtgttcgagtttcgtaggtcgggatatttcgtagttgtcgtattttttgttaaagtgaaaacgaaggcggttgataaattacgttttcggcgaggtattcgttagatataataatatttggtaaataaaattcggtcgtcgttgttattcgtacgcggggttgagatttcgttttgttttttttcggtttttagtttttggttattgcgtttttaattttaacgtttttcgttttttaatattttaattttttatttaattcgggaacggtggatatgttttttaataggtatatagtaggaattatttataatatagaagtgaaaagggggggatttaattttttatttgtttttaaagaaagttttgtcggagtttatttcgtagagtgaagagtgagtaatataggtttttttttgtttagttttttttttttttttttttttaattttttcgcgtttcgatttttttttattttatatatattcgtttatatggagatatttatattttaaattatttgtaaaattgtaatagatgggcgcgtcgagatttggatatttttttatttattaaaggaaagtttttttttaattttaatttttttttttttgtttaaaatatatttcgagtttcgtttacgattgttttttttaatttattttcgaaaaataatgttttgaagtaaatagaaaaaggtttattagtaaagattatttttattttagttatgtatttgcgttggggggacgggaggcgtttttttagattgtattttttttagacgtcgcgtaagttttgttttttttttgttttttagagtttttacgttcgtattttttcgttttgattggttttatttttttagtttgggattggtcggtttttttttttttataatttgttatttatttatttatttattttttttttggttttcggttgggtttttaggtcgaggttcggttggggtaggtgttgcgggcgtcgtttgcgtttgtaggcgttacggttttttttggggtcgcgggttcggattttggtattttagttttgaaattaatttttcggttttagtttggttaggttttcggggtataggaggtcgatgtaattataaaatggtagattttagcggttttcggcgttcgtaagtttgatatattgtaagtattagttaattttaattgaaaaaaaaaaaaggttgtaaattattttttttttacgggcggaggggtcggaatttcgtagtgagcgcggattagagaaagagcgtaaggcgaattttcgttttaggtagaggagaaaatggggaaagttatttgagtagaagttttcgcggttttagtttatttttttttttttttattttttttattttttagatttttttgaaagtttttcggggtttgagagtggttcgcgggtcgttcgcgggtggggggcgtcggtcgggttttcggagttggacgcggggtttcgatcgcgcgtcgggcgttaggtttcgggatttttttttaaagtaacggtttcgggatcgcgggcggggaggcggcggtttaggcgtaggtttcgttcgtcgtcgaagttttttagcgttatacgatgttcggtcgtagtcgtcggttcggttttttttttttttttttttattttttattcgttgatagtttttttcgttaacgttatagttacggatatttaattagatcgtattttttaatcgcgatggggcgagaaggaatcgggcggtaggtttcgtcgagatggggagggggaggggacgggggggtcgcgttaagagtttaaatttattttgttatttttcggacgtcgaagttgtttttttattcgtcgtcgttttttcgcgtcgcgtttttcgtatcgcgtcgcgtttcgtgattttttttttatttttgttttttttattttaaatattgaaacgcgggcgttaggagtaaattcgggtacgtaaacggagcgttgtaaaagattgtgtttaatgaataatgaaatatgtttatacgattgatttgattatttttcggggttgaggggggacgggcgttttgttcgcgcgttttattcgtttattcggtagagttttgcgaattgtttttagtttagtcggggtagggcgggttcgatttttattagtttttttttagaatcgtttcgt

SEQ ID NO: 7154 - DNA, 808 bp, Artificial Sequence
  Description of Artificial Sequence: Synthetic polynucleotide
cgggattttttatatttcgggtcgtagcgtattgtgcgagtggagggggtgagttttttagtagaggcgtaaggagggtgtagggtgcgcggtgtggttgtgggttgcggataggggtcgggggcgcgttcgggtcggtgtcgcgtggtgggagtagtaggcgcgtaggtagcggggagttttcgcgtatttagttcgcgggtgattattatgcggcggtagttgttttcggcgcggtgacggcgtttttaattgattttattatttttttttcgtaaggtgaagtgcggtcgttcgcggggttcgggcgcgggtagggtcggttggtagtcgcgggtcggcgggggtagcgttcggtttcggggtggtattatcgtcgggcgtcgcgttaacgaacgtaggcggcgggaggttcggcggcggggttcgcgtttttgtatcgcgatcgcgttagaaaatatttcggggttgggcggcgtttcggagacgtatttttttgttatttttatcgtttttggtaacgattattaatgttattatgttttatttttttttattttttttcgtttttagagtcgcgttcgcgcgttcgatttttaggcgtttcgttttttttggaattaataataatgatttttaattaattttttgttagggttgtttgttcgtgaatggggcgttttttcggttcgcgggcggtaggcgttttagttcgggcggggggttagttttcgttttttcggtcggattcgcgggggttcgtaattcgttcgggcgtcggttgggggtggtttcgtagttttttcgg

SEQ ID NO: 7155 - DNA, 3415 bp, Artificial Sequence
  Description of Artificial Sequence: Synthetic polynucleotide
cgggggtttttttgcgtgtttcgatatggtagtatggttgttgcgtgtatttcgtatagttcgtgttgtgcgtggcgggttgtcgttgtaatgtgtagtttattgatattgatggatgcgttaatggttggacggatagatgttagggcggatcgtatagcgttcggcgtttgagcgggggagggttaggtagcgatttagcggcggcggtcggttacgcggagattcgagtttaggtcgcggttcgtagtgggagggggtcgaaggaatagaggtttgtaagaatagcgaggggatggaaaggaggagaaaagcgcgattagggagaattatacgttttcgtgtgcggcgtttcgcgttgtgtatacgtcgtatcgggcgcgtttaagtgggagtttcgaaggtgagttgggagtcggcgggagttgatttcgtgcggcgtaattcgtttttaggcgataggagtttagcgcggttattagaatggtgaggtcgtcggcggtgtcggttaatttatcgttttttcgtttgtaagaagcgttttacgttttacggtcgcgttttttcggtttggaggagtagcggttttggtttttgcggtcgcgggtatttaacgcgtacggcgttttagttttcgagttcgttagttcgagagtttcgtcgtagttcgtttcggattttttgtttcgtttggggttcgtattttataatttcgagcgtttttgcgcgcggaaaggcgttggaggcggttttatagtcggggaggttagcggcggcgtatttgtattttgggagacgtttggatttagtttaagttcgtaggttgggcgagcggagatttttgattttatcgtgtgggtgagattattgtttttcggtttaaaagaaaagaaagtatgttgtgaatttttgaaataaatttgtaaaaatagtcgtagagaaaaaataaaaaggatatagggtagaaaaagagggagaaagagattaaaaaaagaaaaagataaggggagggggaaggaaggaaggagagaaggaggaagaagtttggggtttgttgttttaggagcgtttaggtagtcggtgttggagcgcggggcgttcgttttcgtcgggattgtcggtttcggggtttgcgagagcgttagagttttagtcggcgcgttcgggcgtagggtcgtttcggggatagtgggttcggaggtcgttttcgcgttttagtagtcgtcgttcggtagcgttcggagtcggtttcggcgcggtcgttttattttcggtttgagagttggtttagggagacgtaatcgagttcgtagcgtatcgatgcgtcgtcgttcgcgtcgttcgggtttcggttttcgtttagtcgtcgtcgttcgggggtcgttcgtatgagtttcggtttattcgcgtttttatcgtcgttcgtaagtgagttcgcgtcgtttcgtcgtttacgtcgtttagttagtttttttttgtcgcggttagtcggtcgggtcggttcggagttttagcgatttcgattattaattaataattaatttttttagtttagtagtttcggtaggtcgggcgcgggatacggcgcggcggttttttaggttttcggggggagtttttggcgggggatgggtaggggagttcggtttttttttttcgttttcgtttcgttttaggatcggttcgcgtcgtggatggggggcgcggttcggttttcgggggcgaggggcggggtggagggattttgattattttaaagttaggagaggaaatttgaaggaatttttttttatatcgattttcgggacgggtttaggaaagtttgttcggggaaaaaaaattgggggaagtggttacggcgggttttgggggaggagttgggtggcgcggggtttgagggttgtttttattcgtttcggttcgcgttcgttttttttttggagggggtttgttcgtgggttttggttttttcgggggacgttagtttcggttcggggattacgttgggggtttcggagtcggcgggtggagaggagtgcgagtcgggtggggtagttggggggtggttggggacgaacgttgggtgggaataggggtggggggtaacgagcgtttcgggacgggttcggcggggttggcgtcgcgttttcgcgtgtgcgtacggggcggaggcggaggggcggtatttttttcgttggcggggcgggggttttacgcgggtttggggtcgggggcgggggcgcggcgttttcgcgggcgggcgattgatacgattattttttttttttttaagtttgtttgttgtcgacgtcgtcgttttagtcgcgttacgggtagaagattggatcgtcgagtttcgggtcgcggcggcggttgcgcgttttttcggatgtcgtgattttcggtttaggggcgggggtcggggtagtatcggttcgggtcgttttcgcgtttttttttttatcgttttgttcgtttttttttcgttttttagtttcgaatttcgcgtatttcgtttggggacggggcgggggggggtagggtcgtcgttttttttcgttttttttttttttggtttttggagcgatttgttaaattttttatttcgtcggtagcgcggttttttttttttttttttattttttttttttttgtttttttttttttttcgtgttttttttttttcgagtttttttcgttcgttttttttttttttttcgtacgttcggggttcgcggcggagcgcggcgcgggggggacgcggagagtttgggcgtagtagtattttgcgggcggtcgtttttcgggggggaggttgagagtaggttcgtttcgttttttcgcgggttcgtcgttttttttttttttgtttttagttcggtagcggcggcggcggcggtagtggtagtcgtcggagaagtattatgtcgaggaggaagtagtaggcgtttcggcgcgtagtaggtacgagtcgtttttttttttttttgtttttttttttttttttttttgttcgtttcgcgtttttagcgggcgcgatttcgtttttcgtttcgtttttttgttcgtattgagtaatttcgggcgtcgtttttttgtttgggtgcgtgcgttcgtttcgggtatcgggcgtttttcggacgtttcgtcgcgttttgtttttttttttttcgtatttatttggggagtcgttcgcggagcgcgttgagtcgcgttaggtttttatttttttagtttttcggttgtagagggaatgggaagtaatttcggtttggttttttttgtgggtggcgggcggggttatttgagtttttcgggatatttttcgcgtttttcgagcggtcgatcgtcgggggattgtttggtgttcgtcgagttagggagcgcgaacgagtgagcgagtcggttttttcgg

SEQ ID NO: 7156 - DNA, 3415 bp, Artificial Sequence; identical to SEQ ID NO: 7155
  Description of Artificial Sequence: Synthetic polynucleotide

SEQ ID NO: 7157 - DNA, 1592 bp, Artificial Sequence
  Description of Artificial Sequence: Synthetic polynucleotide
cgtgttttttttcgttgattcggtcgtttattcgaggtagtttcggaatttcggattttagttatgcgcgtagggaattgtcgggtcgagcgagtttatcgaagtagtttcgcgtcgtgcgcgtttcgagcgttcgttttagttttcgggtgagcgtttttagtcgtcgttcggtcgcgtttgggtcgttttttcggttagggggtagcgggagtgtaggtagcgggaagggagtcggtttcgtaggtttcggggagcgagcgggcgcggggtaggcgtcgggcgggaggaagttagcgtaggcgtcggtcgagtttcgggagtcgaggttggaaacgttggagcgggcgttgtttatcgaaggcggttcgggatcgggacgcgggttcgagcgatcggagcgcgggttgtcgtggcgttggtcgtagtttaggttgatgtcgttggatcgggcgttgtcgttatcgtcgtcgtcgtcggatttcgttaggttggttcgtgggttgttcgtaggttgcgcgttgagtttcggaatcgtcgcgcgtcggggatttcgtttttcgcggtttagttcgttcgtttcggtttcggggtcgtcgttgtttttttttttgcggtttagcgcgggcgtcgtttcgtttttaggtttaggtcgcggttttcgtcgttttcgatcgggagagtcgtattcgggttttagttttcgtagggttagttcggttaggagtagggtcgtttcgttcgcgttcgttttggagcgttgtatggttcggttcgtcggttttggcgcgttattttcgttttcgtttttcgtcgtcgtttcggtcgggtcgtcgtatcgttcgttcgaagttcggagttcgtttcgggatttttgggcgcggggcggggcggggtcggcgtcgggtcggggtcgtttcggcggttacgcgcgggtcgggggacgcggcgttttgttcggcggcgcgcgcggcggaggaatgtaagtttttaggcgtcgggtcgcgtttttttttcgtcgcggtttcgcgcggggcggagggatttttttgcgggggtaggaatgcgaggaaggagacggcgttgcggtttttggaatgtggggggagtggcggcggtcgcgttgcgtcgggatttcggaggggcgtggaggtcgggttaggacgtaggggcgggcggcggaggtatcgcggggagagtttagggtttgcggggcgttcgggtcgtcgggtcgttgggaagagttcggattttcgtaggttgagttggaggtagttggcgttattcgggtcggagagatttaagtagtcgatagttttttttatatttcgttttattttttttttttgcgtcgttttgtttttcggcgttgtagggtcgatttagtttagtttggaatttacggcgtttcgttcgtttcgcgtttaggaatattgtgcgtttagcgtagatgcgtttttacgattttttgtttggttcggggttatgtggtcgcgtatcggtttttgaagtttttatttgattgttggggaaggcgtttagaattaggagcgggttggttggggattggttttcgcgttgggtcgtttcgt

SEQ ID NO: 7158 - DNA, 903 bp, Artificial Sequence
  Description of Artificial Sequence: Synthetic polynucleotide
cgggttcggttggtttttagtaggtttgtcggggtttttgtattttgtgttcgggatttttaatttgcgaatagtttggggaggttgagcgcgagttaggagcggattcgggggtgggggtaagcgttacgtgcgcgttaggtttttggtgtgttcggtaggcggcgttgcgtggttgcggttggtttcgagggtgcggggggcggcgattcgggagggaaaatttttgttttttttcggggtttgttttgttcgttttttaaattcgttttatatttttttcgattttcgtttttgtaagcgttatttgtagttttatcggttttcgtaacggtggtggtggttggtggggggtttcgaagtttgtttttggttagtcggatttcggtgggagatggaggtagaaatttcggttttttaggagaagggcgtttgtttatttttttatttttcggggtttggggagggggttgggtaggggcggaagcgagttggagtcgtgtttgtcgcggcgttgcggagtggaatagatggttggggaggggagagggtgcgtggcggggaggaggaggggtgcgggggtcggaggatagggaacgaggaatttcgaagtttggagttttttaggagaagttttttttttcgtttttttttagaaaggggggtatatatgcgtttgtttttttttcggagagttttggtttttgttttgtggtagattttgtcgcgtaattttttgttttagggcgcgttttttatttttaaattttcgtcgcgggacggggtggcggggttaggatcgttaggagcggttcgggtcgcgagggttaatggggtcgtttttttaggggcgaggaggcggcgggaaacgggttcggggtggggaacgagttttgggatcgt

SEQ ID NO: 7159 - DNA, 1592 bp, Artificial Sequence; identical to SEQ ID NO: 7157
  Description of Artificial Sequence: Synthetic polynucleotide

SEQ ID NO: 7160 - DNA, 382 bp, Artificial Sequence
  Description of Artificial Sequence: Synthetic polynucleotide
cgttttttatttttaatcgcgagataatacgggttagaggttaggaaattatgttagtattaatgcgggcgtttacgagtgcggtggatcgatgtggaagggtcgggacgtagttcgagttttagttttcgtcgtagcgatggtcgattttttagtcgcggacgttgaaagcgaggattttacgtcgatgatttttcggcgtattatgttcggcgggcgtttggttaaatagtttaagattgcggaattatattcgttattgtgtatttggacgttatttgtagatttagcgtttgcggggatttcggaaacgggagagcgggttttcggaaacggtgattaatgggaaacgtgattagatgttattaggcgaatagttcgt

SEQ ID NO: 7161 - DNA, 665 bp, Artificial Sequence
  Description of Artificial Sequence: Synthetic polynucleotide
cggggaagtagggtcgcgaaggtttttgggaaatgtagttcggcgtaggaagtagcggaacgattcgattttttttagtattaagttgcgtttttaattttttagagttgggttcgcgggaggtcgttcgtgtaaaatttaggttgagtttttttgcgcggagttgtgagttttggaatatcgtggtttgttttttaggacgcgtaaatagtgaagttagtttcgttcgggtgagtcgcgggggtttttgggaagcgtcgtttttggtgtaacggatcgagatttgtggcgtttttagttatcgatagcgtcggttttagtgtcgtttttgttttagttcgcgtcggttttgttattttggtagcgttaagtgtggaatcggggtttgtgttcgcgggtttggtggtgagttttcgggaaatcgttagttttgagcgtcggattttttgtgttgggtgggagtgggggttcgcggttttggtgttttaatttttggaggaggacgtcgggcggggcgatgtttgtgtttgtggttttttgaggtagtgggagtggcgtgtgaaggattgtgagagtttggcgtgaagtgattgttatttgttagatattcgtttggttgagtgtggtttcgggatcgtgttcgtaagcggatttcgtggaggcgt

SEQ ID NO: 7162 - DNA, 764 bp, Artificial Sequence
  Description of Artificial Sequence: Synthetic polynucleotide
cgcgggtatcggtttaataaggtgtagcgaatagtcgttcgttttcgttttaatttatagttttatattttacggtgttattgattttttcgtatttagttatataggacgtggataggtatacggggtgatagtttcgtattgaacggtattaatttttattcgtatcggagttatatagatggtttgcgacgagttttcggagatttatacgttattttttagtttattttcgatttgtagaatagaattggtggaagattttttttttgtttcgaaggttcggggaatttgtattcgggttttatcgttatttttagttggatggaatttagtttttacgggttcggaaagaagcgttttagttgttttcgttttcggaggatataaaggggtcgtcggtttaattttcgcggggttcgttgggaaacgtagttcggagtagaaaaggtcgcggcgtcgtagtgtttggtagtagcggtgtagtttcgcgtagggtttgtaatacggttttttttttattaggtttttttatattggttttttttcggttttttagagagttcgaaagttcggattttttgtagtttcgagtttggttcggttatagggacggggtttagcgttatattatacgggttggtgtggaagtgcgtaggtataagcgttttgcgcgttttttttagtaattagggcggggagttgagaatcgtaggttggtcgtagggaaaaggtttgtgcgtgggaacgcgttagtggcgcgt

SEQ ID NO: 7163 - DNA, 1394 bp, Artificial Sequence
  Description of Artificial Sequence: Synthetic polynucleotide
cgatgttaggtacgttataaacgtagatataaatcgtaaagattttagagattcgttatagttagcgttagagttaggtattatcgcgtagttttttttgcggtattattttaatttttcgttagagaacggtatacgcgtacgtagtagtttcgtgtacggaaatattatttcgttagcggttaggtattcggtttaggtacgcgggggcgcggcggtcgttatttagtaaatattataggtagtacgcgtcgcgttttggtttaggttcgcgatattggggttttttttatttaatttacgttagggttacggttataggtttagatttgaatattttatttttatcgggattttgtagttaatttttatttttttttaaatttttcgatttttcggtaggtgcggttttatattttttttttgttttttgaagggttttagcgttcgtttttcgcgcgtttgcgtattcgaggtagaagtcgatttttaaaggtttcggtgaggcgtcgttgggggcggggcggggttcgtagttttcgtttgttttcgagtcgagaattaaatgaaaaataaaaaggcggaatattgtttttttaaattttggatcgtagtgtttataggggagtaggtttggattatttttaatggtattggttagttacggggcggttattataggtagaggtttgaggcgagggatattgcggtttttttggtttcgttttttcggttcgattattttcgtcgagattcggttttacgcgtttttttcggttcggagtagttgcgggatttgttttcgttttttcgcgcgttagcgtattcgcgacggagataggcgttttttcgtattttggcgtcgttgatttttagggttgggttattttttgagtcgggtgaggttggggttgggagtcgggcgttattgtggtcgttgtttttttgagggaaaagagcgcggagtgggttaggttttgtaggtcgggttaaggtggagaaaaggtttttgtggagttttaggtcggtgtgttttttttttcgggattgagtttttgtagttttgaggtttggaggttcgggcggtagtaattgtgtcggattaggttcgtgggtgcggtttgtggtgtagttggagatcgaggtttcgcgtattttcgttcgcgttttagttatttaggttcggtcgtagcgaaaaggtttaagagggaagttagaggtgaacgttttaggatgaaggttttttgtaaaacgttgggatttagatttggggtgggtgtttggggtttaggaggatacgttggatagtttcgaaaagatatagtgggtggtttcgggcgtgggtaatcgggtgcggaattatagcgtattcggagttgcgaatttagacgcgg

SEQ ID NO: 7164 - DNA, 949 bp, Artificial Sequence
  Description of Artificial Sequence: Synthetic polynucleotide
cgttttagcgttttcgagttatatttgtgcggtttatttaacgcgatgtttggacgtagtttttagagaggaggtcgggattggaatacgtagtcggggaatggttgtaggtggtttagttttcgttttcgtttcgttttcgtttgggtttcgtgcggtttcgggtgcgtaggtgaaagttcggttttagcggtttcggttttgttatggatttcgcgttcggcgttttagattttcgcgtcgcgtcgttcgcgtttttgggtatttcgtaagtcgaggtgttggaggacgtgttgcgggagtagttcgggtcgttgttttagttggtcgttgtttgtcggtttaagcggttgttttcgggcggttattcgtttattgaaaatttttagttggtgttggagcggcggcgtgtggttaacgttaaggagcgtgagcgggtgagggatttttagggtcgacgttcgttttttttttttttgttttattattaaatatttggttaatattcgggggttcgtttatcgtttattttcgttcgaggcgatttcgagttttcgaggttttttacgtttttagtttgttaggagaatggtagtggttttttttttttgtattttcgtgtagttgttcgttggcggtcgttgcggtggtcgtttcgttcgttaattttttaggatttgtgtaggattcgggtttgggaggggatagaggaggggttttgataattttaaaaatgtttttttgggtaggtgttttaaaagtttcgcgtttagggggtgcgtttttattttatatcgtaggcgttggtgggtgtttgggacgcgtagggatttttttcgttttttttttttgttttttgtatttcggtttcgaagtatatacgagggtgaggagaaaggggggtttgacggaagtgattttttttttttaaagtaacgaaatacgacgt

SEQ ID NO: 7165 - DNA, 1365 bp, Artificial Sequence
  Description of Artificial Sequence: Synthetic polynucleotide
cgtttaatagtatcgttcggagcgtttatttttttttatttcgtaaaaaaaaaaaatagggttattggttcgggtcgagagtcgttttgggaagcgtttttgttattaagcgttatttcggggtgtgcgagggagttaagggacgcggagatcgggagtagggttgggtttttttgtagttttagcgttggttttttgtttatcgtatttaggcgttgcgtcgtttttatatttatttttttttattttagtagcgtgcgggggaagtttcgcgtcggggttttttttagtaagattgtcgcggttttcggttttaattgtaaggtaaacggtggtagagtttttttttattttagtcgtgtgtgatttttatatttagtgtttttttttgtattggggcgtcggtagtggcgatttaggttttttagttttcgtttagtttttcgcgtgcgggcgtcgggatcgtagtatttgtgacgtcgaagtttagtaggtcgtagacgggagttacgcgcggttttggtatagggtaaaaatttacgtttaggtaggcgggtagttacgatgtcgggtaagtttagggtagattttcggtggcgtatagggaagtagcggtttagaaggtcgggtggacgtaggcggagttcgacggttgggaggtcgtcggcgcgtaggggtcgggtttcgttaggatggtttcgatcgagaaaggggattcgaagcgttcgggagcgcggggcgtgttcgggttagtaggggatttgggcgtcggagagcggttagagcgcggaggtcggattcgagagttcgagggagcgggtggcgggttgtttcgcggtttggggttaggtatgacgcggtcgttgttcggacggacgtaaggaagggagttcgggagaagtgagaagattttgtaaaaggtagcgagtaagatcggttgtttgggaattttttggcgttcggcgaaggtttttaaatttggcggggcggggtatggggcggtttttttttattgcggttcgggcggggtttttaaagtttgtgagcgttcgttttgtgcgaggtaaggtgggtatagtattaaagagtgtgtttttttttttttttcgtttttaaaaatgtttattttggggcggtcgtggggaggattttgagttcgttggtgattttgggcgaaatatttagttatcgggtttcgttttttttttttgtttattgaagaagggatgttcgttttttcggggttttgtagaggcggagttgtgatttggagagcggtagggtagtgtttgcggttttggttttagttgattcgcgtcgtttttgacgtagaagtttcggttagatttatttaggatcgcgcgg

SEQ ID NO: 7166 - DNA, 2638 bp, Artificial Sequence
  Description of Artificial Sequence: Synthetic polynucleotide
cgtcgatagcgaagtggtaggtaatgggaatttgggcgggaagtaaagaattattacgatttatatcgcgtttaagtagtagtacgcgggaatttggtatatagtaggtaggcgtttatttaatatttgttatcggatttagtatttgggtagggagtttaggggtggagtggcggtttgggggatataaaggtttcgttagtttttagttgcgtttttcgtaacgcggggggcgggagtttagagttagagagagggggcgaaggaattcgtttttatttgtacgtcgtttggggttcggttaatttgtttaattatcgttttaaatgttagcgggtagtatataatacgcgtttattaataggtttaaagtgtcgtagcgttcgttttaaatgagaaaagtaggcgataaaagggggaaaaagttaagttttttaatttgaagaatgttttgggtcgtttcgaaattatttacgcgagtttaaaattcggagttagtttcgtagaaaagttgaggtttcggtgcgagggttgggggtgggaacgggggttgtgaataattcgttacgaaaattgggttttttaggaattagtttgtagtcgtttagtgaattcggagtcggaggataacgtcgttaatttagttttttaggttttttgttttattgttagagaaagttgatcgatttttaagaaggaaagcgagatttttttaaagcgggtataaatttaagtttttttcggtgtaggcgaagaattttggaggttaaggaagattttagaggtggattttaaaattttaattcgtaagaggggaaaagttaaagtaattttatttttatttaggtattggttagcgtagtttcgcgttcggtcgttagagagtagtttaatttcgtaaataagttttgtttgggatcggcgtagaaggttttattttttattttatggttaagttcgggggcgtattttgcgggtcgcggttttttatttttttcggcgcgttcgacgggtatttacggtgcgcgttttttcgggagataggggttcgttggagaggtacgggttgtttaggttcgggattattaggaaggggtatttagggtacgggggttttttaaagaacgcgttgttttgaggtttttttattgcgaataagattaaggcgaggtgaggtttaggttttcgggattgatagcgtcgcggtagggggttcgaggcgggagttggggattttagcgttttttacgcgcgttttacgggggttgtcgttaataaaggcggagggtaagggtgcgtttatttaagtaagggggacggtgggtcgttcgggttgagtagcggagcgtagcgggaatcgagagtggggggttgttttagcgggtatatattttcggcgaaatagtttcgcggtttttggaaagtgtttcggacgggttgcgggcgttttttcgtttgcggaggagatataaaggtaagagcgggtgagcggacgtagggtcgggatttttcgggggtggtcgcggtgtttttttattttcgagttcgagttgttgttttggtttttcgattcgttgattagggacgatttgatttcgtttaggtttcgttgcgtcgaggcgttatcgttgttcggtttttgtttttcgtttttttcgttttggaaggggattagttcgtcgttcgtttcgaggtcgtttttttcgtcggtcgtttcggcgttggagtcgtcgtttttttcgttgtcgtcgtcgtcgtcgtcgttttcgtcgtcgagttggggtatggtggggtcgcgggtcggggtcgtcgttttcggagtttttagtcgttcgcgttttgttcggttcggttcggcgtttttttcgttcgtttgcgggttcgttgcgttagtcgtcgtaataaagtttgatagggcgtggtttcgcgggaagcgggttcggcgttgttcggtcggggcgtaggcggttcggttcgggttttttcggtagcgtcgagtttagggttttttaattcgttatcgtcgtcgtttgtttcgtcggggcgttttagtttttggttcgtcggggaggggcgagcggggagggagggaggagggatcgtcgggttgggtaggggggtcggagggaggagtttcggttgtaagttgatattcgcgcgtttcgcggaattcggagagttgcggtgcgcgcgtatatatatatatatatacgtatttatatttatatgtttatattcgtattttttaggggttgcgtttttttgtaacgtgtatcgtttttaatttttttttgcgttttatattgtattttcggcggttttttttacggtttttttggagttttggaagttttgcgtttattttttcgtattttttaatttttttttaaagaatttttagaatttcgcgtaggtttttatttttttttatcgtatcggcgcgcgggcgggcggtattgttttttgcgggaaagtttcggacgtatatattggtcgcggggttttttttttgtttagagttttttcgagtgcgcgagttgatgtacggattaggatattggggatatttatggaatttcggaaaatgttcggcggtttttcgcgttttttttttgtggggttttaacgcgattttcgg

SEQ ID NO: 7167 - DNA, 1531 bp, Artificial Sequence
  Description of Artificial Sequence: Synthetic polynucleotide
cgaaagttcgtataaatcgtatagaaaacgaataaatgtttttcgaatgtgagcgaatttatagtttggttagaaaaatttaatattgattttcgtttttttaattatagaattttcgaggagaaggggatacgttaagcgggtttgttaataatttttatcgtatattttaaagcgttgtaaattatatcgattattttcgattggaagtcgatcggttgagattggacgtgaatttcgcgattcgattataaaaggttaggaggaaagaggtagaaaagttaaaaggatgattaggtaggtggttcgagcggttattttaagttaattttttagaaattattcgtattgttcgggttattttttttttaatattcgtggttttatttattatgatgttaagaaacgtgggttaggaatggggtgttgttttttgttcgaaatttggaggcgtcggttttttagacgttttcgggttcgggtagaggggcggtaggggcggggcgggcgggtttcgggtttgggcgcgcgggtaggtggggcgtggcgggggcgtggagagtttaggttcgcggttatcgtttcgtttcgggtcggtttaggaggagtcgcgtcgggttcggttataagaggtcggttagtaggcgtttcgttagtattcgttcgatttcggttcggagtatcgggcgtttagcgcgggtgaaggcggagtcgtagggttggtttttaaagggatgttttcgttcgagcggcgagattagtttcgttcgtttttcgtcgcggtcgcgtcgtagtcgtttacggtcgtcgatatggttttttattgcggcgataatttcggagtgtattcgtagttcggtttgttttcgttcgtcgttatcgtcgtcgtttcgggcgttttttcggtagttagggcgttttacgggttggtcgattacgtcgcgtcgtcggtcgtcgtcgttaatttttatttgtggtttaacgggttcggcgtgggaggttcgtttttcgtcgtcgtcgtagtcgtcgtcgcgtatttgggcgtttcgtcgtcgtcgtcgtttttcggggtcgcggtcgggttttttttgtagttatcgtttgtcgtcggtatttcggttgtttttagcggtttttcgcgtagttcgcgttcgtcgcgttcgtttcgttcgtcgcgttcgcggggttcggggagttgggttggttgtttatggttagtcgcgaggatttgatgaagatggtgcggtcgttttattcgtattcggcgtttatcgttatggttatttagagcgcgttcgagcgtaaatttatttttagttatatttattagttcgtcgtcgatagtttttttttttattagcgtagtaaggtcggttggtagaattttattcgttataatttgtcgtttaacgattgttttaagaaggtgtttcgcgacgaggacgatttaggtgagggtcgttggtaggtgttttttagtcggggagggcggacgcgggtcgtaagggtcggcgtaggggtcggtgtgcgg

SEQ ID NO: 7168 - DNA, 2045 bp, Artificial Sequence
  Description of Artificial Sequence: Synthetic polynucleotide
cggcgttttcgttttgtttgtatttttttttattgtttttttacgtttggaatgttttcgtttttgtagtttgtagatagcggaaatcgcgggtgtaaatgtgtaggggtcgttgatatgatcggttgtagaagtttatttagggttattcgaataggttagcgttcgggattgtataagaggttaggcgatgttgtgggtttttaaatttgtatagttgcgatattttgcgacgtgttattttatttttagtggggtggggtgggggatttttttcgtagttcgttgaaagcgaggtaggaattattgtaatttttttgtttaggttgaggtcgttatcgtttcgcggatgtacgcgttgtaggggcgtttttcgtcgcgggtacggcgcgggaagggatggggtttggtgggagtgggtaggtggcgggagaggcgcgtgttcgtgtattagaggttttcgtgcgtgatataggtcgatgagtttttgcgggttgtatttacgcggagttatagatcgaaaaggttagtcggtggtcggtgtgttaatatatatagagagacgttcgttaggcgcgttgtaggttgggacgaggttaggagggtttaggttggaggagggttgaggagggttgcgggggcgggtttcggcgtagggcgttcggagcggagggggcgggttcgaggcggggcgggtcgcggcgttgacgggttgtcgtcgttgtattcgtttttagttcgcggtgtcgagcgtaggcggaggtatatggtttcgacgggaggcgcgcggcgagtattcggagttcggttttttgtttgagtacggtagtcgcgttttcgttcgcgcgttttcgttttttcggtcggtagttcgcggatatgatcgtgtagtttttttttgggttgggatttgtttgaagattttttttatggaagcgatgtttttttagtaggagattttagggggatagtcggggcgttttttttttttgataggagtgtttcggttcgcgggaggtagttgtattaagaaggtgaggacgttgagcgggggttcgtgtttttcgtcgtcgtagtttttattgtcggcgcgcgtttttcgcgttcgttatagtagcgcgttaggcggacgtcgcgggaatttgacgttcgaggttcgcggtttttaatgagagttttagaatatttttcgtttttgacggttagcggtagcgtcgtcgtttttcgtagagcgttcgttttttcgtttttagagttttagttttttttcgagcgatttcgtagtttttttttcgtttttattcgtcgtcggttttgtagttcggttttttttttagtttaggcgcgcgggttgtagtgggcgatcgttttttttcgatttttcgtcgtgtttttgggtttttcgaagtggtttgggcgagtattgattgttttttggcggtgttagttttaaagttagggtcggcgatgtttgttcgggagcggtagtcggcgttgaagaaggtaggtagcggggttgcggcgttggtgggttcggtttttttatttgttcgtcgaggcgcggttgttttatagtagttttcggggggtagatatggggagtattgttttttatattagggttttggatgatttcgggttttttaggtgggggttatagtttgaggggcgattgtggatgataacgttcgatattacggggatatgtaggttcggttgggtttagaatcgagtagggtgggggcgggtgggttgtggttgggggttttgagggttgaggtgggggattttttttttgtattggtttttggtttttgggattttggtcgggttggatagggattcgggtgtcggtgtgggcgtgggggtagcgcgtgttttttgttaaagttgggagagggatgtaggtgataatttgtagcgttttatttcgataaatacggtcgttgtgttgcgggaggatttcgattcgggttaggtttcgttggaacggttttttgagtaagtgtacgtgggtcgcgggttgtcggtttttgtcgtttcgt

SEQ ID NO: 7169 - DNA, 476 bp, Artificial Sequence
  Description of Artificial Sequence: Synthetic polynucleotide
cgggcgatacgttttgggagggcgggttggcggtttttttagttcggagcgcgtggaggttgcgcgtaggggttcgggacgcgggatagggatttcgcgtagtttaggcgtcggggaatcggggttggagtcggggatttgagtttagcggacgtttttttcgtttggaggttcggtacggatcgggatattagggcgttcgtggtcgtggttcggtttttggttgttgcgggtcgcggtttttagtgggtttttaggatttttttttacggcgggtatttatcgaggttgagaggttacgtcgtgttgttggggtttttcgtcgattatatttttgggcgttagttcgggtagagatcgcggggattggttaggtcgggttaggtcgggtcgggggagggtcgcgttttcgggtttttgattttcggcggcgagaggaagcggtatttgggttatatttttttcgcgcgggtcga

SEQ ID NO: 7170 - DNA, 455 bp, Artificial Sequence
  Description of Artificial Sequence: Synthetic polynucleotide
cgtttttgtttagcgaggatcgtgtagaagcgggaatcgggtattggagggcgcgcgcggtacgcgtatttcggttggtattttttggtttcgcggggtcggaaagaatttcgaatattcggttttaaaaggtttttagttatttcgttttttttattttttatagtatagatggggaaattgaggtttggagaataagcgtggtatatttagggttatcggaagagtaatgagttgaattagagaggaggaacgggaagcgagatttttaagtaatgcggggtggttttcgggttatcggaggaggtatggtcgggtacgtttttaagtttcggtattcgtggtggttgtgttagtcgatatgagtttttttttttttaggaaggcgtaggattcggggaagttttcgcggttaggtcgtttgtttattcgtagatttcgggcgtcgttcgcgt

SEQ ID NO: 7171 - DNA, 749 bp, Artificial Sequence
  Description of Artificial Sequence: Synthetic polynucleotide
cggggattcgagttttcgggttgaggatcgcgggggattttaggtcgggacggagttttttttggttcgttgtgcgcgtacgtttggaaaggcgggatttaaggtagcgatgttgcgggaggttttgtagtgttaacgagttttcgaacggtttcgttttattttttttttgtgtgtttcgtaagtttttgtttagtaaatcgttatagtttcggcgcgcgagagtggcgttggtacgtttaaatttcggggtttttggttaggttaggggggcgggcgtgcggcggggtcgggtcgggtcgggtgcgtttagcgggtttcgggtatacgttttttatttgggcgaggttcggtgcgtaggcgtttagcgcgggggtagcggtcgggcgtttaagttcggcgcgggtaagagttggatagtttaggggtcgcgtcgggtcgagttgtcgttcgcgttatttttatcgtcgtcgttgttatcgttatcgttatcgtttgggttgtagtagatcgcgggagaacgtttgcgcgaagtttcggtgtagttttggcgggatcgtagtaattatcggagcgtgagtaatagtttttcggttggaggagttattgttttacgcgttcgcggttcgcgcgtcgaggtaagttttgggcgtttagtttagatcggcgttttcggattgggcgttttttgtttgttcggttttcgttttttttcgtagagcgagtttgtatttgggcgcgtcgttcga

SEQ ID NO: 7172 - DNA, 1134 bp, Artificial Sequence
  Description of Artificial Sequence: Synthetic polynucleotide
cgaggagggcggggcgttcggtttttagtcgcgcggttatcgtttgtttagtttggttggatttgagttcggttcgtcgatcgttggtcgaggcgtagttgaagtagttttttagtcgcggcgtttttattttttaattttacggtttttgcggcgcgggcgcgatgtagttggttcggggtgaaggtaaggcgcggggcgcggggcgcggggtattgggagcgaggtattggcgcgggatgttcggcgtaaggtgtagggcgcgggtcgtttttttttcgcgtttttttatttcgttaaagtttttttacgatggtttttatttcggttgggttagtttcgtaattttcgtttgttttttgttttttttttttttttcgagtcgcggggttttcggggcgcgcggattttcgttaggggtcgtgtaggcgcggagttttagtcggtttgttttgggttcgaagaaagttgtggtttggagttagttttttttttacgatttttgggggcgtttttttttttttttgagttcgcgatgggaaggcgtttttattttattttcggggtttttgagattttttggcgaggtggggcggcgcggtaggtgtagggttggggagggtttgatagttttggagagtgttcgattttagttcgtcgtcgttttttaggcggattttttagaggtaggttttagttttcggcgcggggaggcggcgcgttttagaggggcgtagggtgcgcgggggtcgttggtttttcgggtattttttttttgcggttttttcgttttttttcggagttggtgtttgaggtcgttgggattttagtttggcgttttttttcgtttcgagcgaggtaggtgtcgtgggcggtttcggttatttttgtatttcgagcgtttattttgtatttagttttaagtcggagagttttggggatagtcgagagtgttagtggttttatagggagattgagggttttgttttatttcgggcgtcgtgtgggtttgggttgtttatagtatttttgcgttttagtgataggagaagttaagcgcgaggttttttaatagttgcgtgtattttattttttaggtatttggaatttcggcgtttagaacgtgtttttcgg

SEQ ID NO: 7173 - DNA, 1645 bp, Artificial Sequence
  Description of Artificial Sequence: Synthetic polynucleotide
cggcgtttttttttcggaaaggacgttggatttagggcgcgttagtacgcgtagtagcggttcgcgagtcggtaggtgggtagtttcggcgcgggaggaaggggaagttatttttttttcggaagagggcgttggtttttttattttgtttttataataaggttatcggaggagaggaagtagttagttgtcgtttgcgttttgtaaagtatgtagttaggggagtagtttttggtgagtttagtgaatttgtttggcgcgtatttttattcgttggagagtgcgcgaggcggtagcggcgggagcgttggttatttttttagcgcggttttttttttttagaagttggatttagataaagcgtttaagaagtttttcggtagttttttttgcgaggcggtgagcggggagttcgtagtcgttagcgtaggggttttcgcggttatgtttagtgatatcgacgtcggggacgtatttgttagcgttgcggtagtggttaagtcggggttttcggacggtcgtaagggttttttttgcggggaggaggagttgtttttcgtcgttgtagtcgtcgtcgtcgtcgtcgtcgcggttgcggttattgtgcgttattttatggatagtttgagtttcgagcggtattatttttagtttttcggtttttaggggtcggagttggttgcgttttgtttatttttttcgtattaggcggcggttggggcgttttacggatttgtgtattcggtttttaacggggcgcgttatttttacggttttatgttgtttttcggcggttttttcgcggttgtgtgtttattcgggagggcgtagttcggtttaggagtcggtgcgggtagtggcgcgggcggtagtagcggcgggggcggcggttcgggtatttattagtatagttagggggtttcgttttacgggtcgtattttggagtcgtagcggcgggattttgcggaggattggggggtttgggggttttaggttttggttttcgtgtttacgtttatttgtgtaatcggtttttgtggtttaaattttatcgttattaaattgagatgattattacgaaatagggtaggtgagcgtagcgtggaggggtttttgggttcggggataaagggtgacgtgtggttttggggaaggttcgggatgagggagttgaatttagttgtttcgcgcggtgtttagagtgttttatcgcgcgtaataaattttcgtagatatcgtatttttaatgcggtgtttttttgtgttagtgtttcggcggtttttgtagggtgttaatgttacggttgtatatcgttttttttttttattatttttatttgaatagatttggaggaggcggaaatggaaattagggtatgtttataagttggattcgttagatttttttgttcggcggtatgtttgtgtatgtttgtatgtcggtaaggagttacggatagggaaggtttaagagttggttatttgagcgtagtagatgggttttcgtagttttaggcgttagggtttttacggggcgttttcgggaggtgggtatgaaggttagagcgtcggtttcggaagttcggtcggagtaggtggttagatttgttttggagttagatttggttcgggttcggtgcgcga

SEQ ID NO: 7174 - DNA, 4698 bp, Artificial Sequence
  Description of Artificial Sequence: Synthetic polynucleotide
cgtacggattcgcgttcgtattcgaagattttatacgtttttcgtattgtttttatagtattttacgttcgcggtgtacgtttatttgtcggtagacgagttatacgtttcggcggtttagattttcgtgtcgattttcgtgggcgagtttacgcgttgggtgttcggcgcgtttttaggagtggttgggatcgcgggttggcgtcgggtagggcggtgggacgtttggagtcggcgggaggagtacgtttaggcgggttcgcgtcgagttcgagcgagcgggcgagtcgggcgggaggggttatttgtaatcgagtagacgttattatcgttttttattcgcggggggcgggggcgggcggttaggtgacggcggtttatttttcgtcgtcgagtcgggtggtttttgttcgggaggagttttttggcgcgttttgattggaattttcgtcgtagtggcgggggaggggggatacgtgatcgttcggttaggcggttcggcgcgttttattcgcgatgggtattttattttttttttggaaaagtcgggggatatagagaaggcggaggagtacgcggggtgtaggagagtttattagtttttttagtcgtagtgttggtgatttcggtcgttgaattcggagaggaaaggtttttacgcggttagtcggttttgattgttttttcgttttgtttttggtcgtagtatttttttttcggttgtagtaatcgttttttatatttttaggtaagggtacgtttagtgtagattattgttattttatagatgttagtgttatttaagagtggtgttgggtttttttttttttttttttttttttttgtatattagtatattgtattcgagagaaatttacggcggtgtattgtagatatcgtttagttttagggttcgaagatttttcgattaggtttcgggatgtttgaggttttttaggttattacgtggaggaatttaggtttgttttttgcgtaggaggaggaggcgtcgcgggagttgtagttttcgattttttttaggaagtcggtcgggtggaaggggagagggtcgttatcgtggtgcgaatttaattcgtagtttttgggagtacgttgttaataaaggttaaattaaaataattaagtggtgtcggtagggacgcgtcgtatggttaggagaagttcggttattaattatttataaggagtattgtttttttggtgtgggagaatggggttgtgcgatagtttttcggagttgcgttttgttttgaattttaagtttttttagagtaagtggattgcgtagtttattattttatttttttacggtttttttttggggcggtattattttagatggtaggaattcggagaaaatgcggtgttacgttcgtcgttatgttcgtatacgcgtttgcgttaattttagtaatacgtggggatcgtgaatttgggcgtttgttttttatttaggtggttatgtgggtatatttatatgattattgattaaaattaaattggacggagaagtttgtttttatattggatttttttaaatttttgtttaagggagttttgcgttcgatttgggcggggacgtagtttttagttaagatcgtcgtagcgtttagtagagttcggggatcggtggtggtggtggcgggatggggaggaatagaggtttttgattttttggtattttattttttttttttatttagattagtcgggtaatacgtttttcgtttaagatggtttttttaattggaacgtgatttagataatgtggaagttaggggtttttgatttatcgtatttgggtttcgttgggtataggataagggttgggtaggtttatttggaaagggagtttattcgtaaagtttcgggtataaacgttagatagcgaaattttgaggaagtttaaagtttatttattgtaaattggtggggggtgggggagtattttatgtaaaaaggaacggttttattaaattagtaagtattttattttcgtagtggacgttttgttgtttttggttttttttttttttattttatttttttaaattattaaggttggagaaattttataaataaagtataagttcgtggggggggggggggggggttatttggtgttttaaaaaaataataataataaacgatttttgtaataagaaaggtgggtacgtttttatttttaggttttaattttaacgttacggttacgttaaaattgaagttgattgagataagagaattttagagtatagtacgtagatagataattttataattaaaaaatatgtattttttttttttcgttttcgttattttttttttttttcgttattatttattttcgtttggattaggggttgggagaggaggaggatgtagttttttcgagtgtataagggaggcggcggggttatttgttgttgtatcgttagaagagttaatttcgagcggatttggtagggagttaaaattttttttttggatgcgacgttttagagatcgaggtagacggcgagaatagatttagcgtttcgagatgtgttttttaatttgaattttggattatttttgtttgaaatgttttgttttgtacgtttgggaattattttgtgcgattaaacgcgtgatatatatacgtatacgcggggtcgtttcgtaggggggagggtgcgtggtataggagtttcggatttttaggggttttgtatttggggagtggtgcgagggggatcgtttcggtgtggttgttgacgtgagataggtaattcggaaaggttttttttcggttgttttggtaatgggaagttgtgggtaaaggtgtaggggcggtttcggagcgtatacggcgtagttcgtagtgaagggtagtggtgtggtggggtagagagattagataagggtaggcgggttttgtcgatttcgagtttattcgtttacggggttacgttttgttgagaaaatgcgcgatattcggtagggagagagtgatattgattaagtgtttttggagggtcgagtcgtttgttttcgggagggggtcgcgaggttcgttagtattcggttttcgcggaagttgtgttagcgcggtagtttcgtcggcgtttggttttattagtttttgtttttagcgtttttcggtggtatcgttcgagatttgcggagtagaagtcgaggatacgagtaattcgttgtgggtttgaagtgattacgttttagggttgtgaaaagttgtttcgtggtgatttgggtacgaggaggttaataaagtgtagaattagttttgatttttatttaaaatgaagttggtagtattgagcgtttaaatgatttcgttaggattttggaggttgtgggagcggggtgggagagggtaaatgttaggtttaggataatataggatatgtttaatttaaggaagttttttttttcgggttacgttttttgtagttttatttaattggaatcgtttttgtattcggggttattttcggtattatgatatttagcgttgttttttaaattttaagttttcgcggttatattttttcgtgtttgttggtattagtaagagtttttgtttgtttttttttttttatatggatttttttttttttatttttagatcgtagtgcgattggtaggtattttttcgtttttttcgcgtttcgcgtcgacggtgggaatagtagcgatagcgcgatcgtagttttttagtgttttcgttttttttttcgcggttatattttatttattttattcgttaaatttcgtatttcgtcgtcgttttttttttgcgcgttttcggcgttaatttagttagaagcgggtggaagttcgggtttatgtgtaggtgtttttgtgcgggagtaggggagtttataggttagcgattcgcgattttattttgtttttagttcggggtttatttacgtggaattcgtcggttttcgcgggtatttaatattagtttttcgggttcggttgtcgttttttcgaagttttagggcgtttttacgggttaatgattattttagtttttttttaagttagggtttggttagttgggaaattttttcgttttttgtttatattttttggtattttcggataaagttattcggtttttcgtttcggtatcgggaaagatgcgcgtggagagcgtttttaggcgttgggttacggtttcggtttttggtcgtgtttgttgtgtgcggagttggggcggcgggtatcgtttgcgcggggtaggtattttattcgtcgtttttttagtacgggtattcgatcgtcgcggcgttgtaggaaggaggtttcgtcgcgtcggtttttttatatttacgtgtttttcgtgtgcgcgttttcggtttgtagatgttataaggttggcgtcgtttggattttcgggcggttttatttttcgcggtcgttacgtttcgttttttgtatttagtttttttggcgttttcgttgtagtatttaagattaggcgtcgtttttgttagtcgtgttgtttagtacgtttgagggtcgttgtcggtaggttttatttttcgttcgggttttttatttatttttttttttggacggtggggtttaagttttgtattggggttgttaagttatcgtttacgattttttgtagggtgtagcgggagggcgttttcgaggcgt

SEQ ID NO: 7175 - DNA, 462 bp, Artificial Sequence
  Description of Artificial Sequence: Synthetic polynucleotide
cggttcgtaaattgattatgaaatatacgatgttaattcggagttgtattttttagttgggtattttcgcgcgttggttttcggggtttcgttttttattttttgtttttttttttcgcgttttgtttttattttttatttttcgcgttggttatttcgtttttttggtagtttttggcggtagcgcgttttattcgttttcgtgtttttttcgtttatggaattaattttggttttatttgttgttcggtttaggttggggagaggacggagggtggtcgtagcgggtttttgagtgaattatttaggagggattgagtatagtattaattagaggggggttagggggtgcgggattcgagcgagtaggaaggaggtagcgtttggtattagggttttgatttaatagaattgagatacgtttgtaatcgttggcgtgtttcgcgtataggattttagcga

SEQ ID NO: 7176 - DNA, 300 bp, Artificial Sequence
  Description of Artificial Sequence: Synthetic polynucleotide
cgttgtaaaatagtcgtcgggtgtagtgggtcgggcgttcggttattttggttgcgattatcgtagttttttaaaggatgcgggtagatgtagacggttttggtttatttgtttttaaaggtttgggattgtgtttgcgtgtttcgggagggtattcgaaatttgggagtttttcggcgtttttagtttcgggtatttggggttttttgttttttaatagtattaattttgagaataacgcgtatcgaaggcggaggtttttgtgttttggataagttcgttacgggtaagttagttcga

SEQ ID NO: 7177 - DNA, 554 bp, Artificial Sequence
  Description of Artificial Sequence: Synthetic polynucleotide
cgtcggggcggggattattttgtagtaggagttcgtagatattgtagaagcggagaacggcgttgcgtttttaaattatggttttttttttaaagggttggggaaggaacgagggggtaagtagatgttggtgagcggggtacgagagtgtagggtttcgttggtgtttttttttcggcgttcgtcggatttatcgtttttatcgttgcggtgttcgaattcgcggattcggatcggcggtagtagaagcggtagcggtaaagtattcgtagaatggggtatcgcgaaatagttttttttttttttttttttgttggtggtgtagtcgcgatagttcgttttttaggtaggggtttggagtttgtttttttttcggcgcgtatagtaagttttagagttcgtcggggttgttcgagtaggtggtgtagggatgtcggggtgttggagaaggtgcgggcgagggttgtaaggagtgggtaggttacggaggggaagggttgggggagaggaggagtaagtaagtagtattgtcgttcgcgttcggggtgtttcgg

SEQ ID NO: 7178 - DNA, 1153 bp, Artificial Sequence
  Description of Artificial Sequence: Synthetic polynucleotide
cggcgtatataagttgaggattgtcgaggcgttttttgcgaggtaaatacgaagtcgtttggttagtgagaagaaattcgaggtggtttttggggtagatagagtaggatttgtttttgttttttgtttttttcgtttttttttttttagcggcggcgatcgtagtaatagcggtagtggcggttgttgttattgttttgtcgttgtcgagtcggttatttgggtattcgcggagtcgcgtcgttgttatcgtttcggcggtttttcggagtgcgcggagggggcggcggaggagcgagatatttatagtaatcgaggatgcgaggggcgtttagtagtagcgagtgtttgggagttaggaggaggttttcgcgcgtcggtaatttttagtgttaggcgttttgtagttttcgcgcgtcgcgtttgggttcgtatcgttttcgtagtgagggttcgttcgagcggtaagtttttttcggcggttaagtcgatatttttttttcgtttcgtcgtttatttcgggtagtagtcgcggaataatggagagcgtagttagtagttttggagacggcgttcgggggaggacgcgtcgtcgtcgtcgtcgttgtcgttagggtaggcgcgcgtcgcgtggagtcgggcgggtgcgagggcgcgcggcggggggtggggggtacgcgtcgcgcggggggcgggggtagtggggggcgcgcgcgcgggttcggggagttcgcggggagagttcggcgttcggcgtagcgcggcgcggttaagtttcgcgtttttttcgttttttttcggcgcgttcgttttcgtttcgtcgttcgtattcgttgggggcgtttagaaagatgtatagaggtaacggttaggggagcggaggtttaagttatatgtttgcgttttcgggggttagagttcgttagttttcgcggatttcggttcgcggttagttcgagcggttcgggtgagtagcggtatagcggttttttcgtttcgcggttttcgttcgtcgagacgtggttttaagaagtggtgtcgtagtcggggtagaggcggaggaagtcgagtcgggtaagtcgggaaggttgcggagacgttttgtcggggtaggtgttgtagttttagttagcggtttttacggagggggcgg

SEQ ID NO: 7179 - DNA, 1603 bp, Artificial Sequence
  Description of Artificial Sequence: Synthetic polynucleotide
cggttcgtagggggtgtttcggggcgttttttgcgcgaggtttcgggaatagggtacgagggtttaggttgtttagttgtaggtgtagttgtttcggaggaggacgttgtttgcggcgtcggggagtttttcgcggttggaggcgaggggaattgtatttattatagtgtttcgtttgcgcgaggattatttatttgggtcggagagagcgcgcgcgcgtaagagcgagttcgggttgtggtttgggggaggggagcgagggggcggggagcgttttatcgcgaggacgggggcggggacggattgttaggtggggcgggtagttggggcggttcgaggatttttttcgatttaagtgggtatttgcggagttaaaagtaggggaggcgttgtagttgtgaagaggcgtgggggtcgcgggaatttttttttggtcggtgcgatgaaagtcgggcggacgaggtggtttaacggggttgagagtggttcggtcgaggcgcgggttgagtttttagtatttggtttgagcggcgtgggtagtagtttgtatcgcggatatttttaattttgtcgcgtttgcgtcgtattttggtcgtggtagcgatttttcgggtatttttgaggtcgtttttagttttataagtatttagtcgtttattttagagtagcggcgtcgatcgttttaagaggagttagttttcgatatcgttttttatttatttttttatatttttatcgttggagggggtgagtgtcgtggataggcgttttcgttcggggatagtttagcggcggtagttagttcgattttttttcgcgcgggtcgtttaaatttgattagtagagcgagcggtttagcgtagtagtcgttttcgcggtttttagttgtagaaaagtaaagcgtcgggaggaagtagtagagggggggttatatgaggttggaaagtggcgggtgtacggcgttcgggatcgtcgaggtttttgcgtcgttttgcggaggtgatttcgcggtggaggttacgagtatcgtcgtagttttgacgttgggatttaggggttttcgagcgtttacggcgtggtggcgtcgggtcgcgtttttttagtagtttaagggtcgagtggcgcgtggttatatttatagtagcgtaggggcgtcgtgggttgacggtttttttcgcgcgagtcgttttttcgcggtatttatttttttttcgcgttcgggtttttcggaagtcgaggcgcgggttatttggtgggatttcgcggttttcgttttagggtcggggtaacgcggcgtgttgattgggaggattttcggcgttcgcggtttttattatttcgtttcgcggcggaggcgggcgtttagggtagggacggagttcggagcgttgtagagttcggttaagtttagttttttttcggtttggtagtcgcggttcggatgtcgttagttcggcgttagagggggttagtcgataataaaaatgtttgtatcgttcgtaggtggaggcggtttattaggttaggaatcgaaaggagggagggatgttgttaggttaaatttaacgttttggttaagggcgcgttaaggaaatcgtatcgt

SEQ ID NO: 7180 - DNA, 1411 bp, Artificial Sequence
  Description of Artificial Sequence: Synthetic polynucleotide
cggttttcgttattcgggtggattttgtttatcgcgagcggggaggcggttgtttttcgtgtaggattttcgttgagggtttataataagcggttttaagcgggggtatatttttcgttattttcgcggttttttaaataaataaagaagttaaagtcggttgttttaagattaatgtaagcgtttaggaagttttgaggcgtttgagggcgaggtaggttgtcgtgggtaggtgtgaatattttagttttcgcggcgggtttggagtcgtttagcgtaggaagagggtagaagtgggttcgcgtttatgcgggtattcgaaatgaaaaagagttgtaaacggtataaaagttcgggggttaggcgtaggaaaatagagtaagggagttgttttagtttttaaatattgtatatggatgggtgtttcgcggaagattattttagattttgtgaaagaagtttttattgggcgtcggttacggtattggggtgcgcgtttgttttgcgagaagggttttttaggtcgcgcgggggaacgtaggagacgtttgttttcgggggaattagcggaggattgttttattttaaagtgaaaatttgtaggttttgggaaacgatatttaaaaaagtatataatttttatatgtcgtttaatggaggatttttataatttatagcggtagataaggttagagggtgtaataaaaaatttgaagttttttttttttttttcgtcgttttttcggaattgtattttgggtagcggagtagaattcggaatgtgaatttttttcgatatatgtttttcgtagataagtaaataatttggacgtgaaatggaaatggtaattaatgtagtaatgttgttatatttcgagtgtgtaaattttattgattcgtcgcgttacggggggtgtcgggcgtacggggatcggtggcgtgcgtttaggttgtttattttttttttttttttttttttttttttaggttttcgggcggggcgtttagaaatttcgtagggatgtggacgggttgcgggaagtaaggagttgtttaagcggcgttcgggattttcggttttcggtttttggaggattgggcgggtgttttgcgtttgtttcgatagtcgtattttttatttatttttttcggttattatcgtcgcgttagcgttagtagggttttttcggggttcgagtgtagttcggttttgaagtatttaggagagtttgagttcgggcgatagaggtttggaggtagagggaatttttaaatttagtgcggcgggtggttttgagtgcggcggttaggttttttttttttttttgtttcggggttaagtgttgtcgggttgtttggcgagagtttttttgaagtttttttttattttcgtatcgaaagcgttgatcgt

SEQ ID NO: 7181 - DNA, 2629 bp, Artificial Sequence
  Description of Artificial Sequence: Synthetic polynucleotide
cggtagtaaacggtagagtaaaggagtcgtttttttttatttgaaagtcgcgaggaggtttggagcgttttttttcgttggggttcgagttttttgggttttggtcgggtgcgggtagattttatcggggttttcgttattttttagtttagttcgtagagcgagtatcggtagattttaagggcgcgtgagtttggttgtcggttgggtttttgaggttcgttgggcgggggtaggtcggtttaggttgtgcggggcgtttataaaaagtgatttggagatgaattcgttcgtgcgcggttggtcgtttcgttataggggcgaaggcgtttgacgtaagcggaattcggtggagtttatacgaattagaatagagcgaggtttttggcgtattagggattttaggaggtagtttcgttagagacgcgggtcgtgtttcgggaaatcggggggcggggggaggggaagagcgtagaaaagaaaatttattaaggcggggattggtttgagcggggaggggcggcgaggtcggagtttttttttgttgggcggattttttatggttagaggttgagttttattttcgtcggtcgttttttaggggaaggggaaggagaggggagagtagcgataggtttttagtaagtaagcgcgggcggtattcgtagtttttagaagtttgagatttggtcgtaagcggattcgtgcgttttaattttttgtcgcgttagcgtttggagcggagagtagaggcggttcggtcgcggcgcgtcggttttgttatgatggttagttatttcgagttcgaggacgcggcgggggttttgttggttttagagatcggtcgtatagttaaggagttagaagggtcgtcgtcgagtttaggtaagggcggtgggggtggcggcgggatagtttcggagaagtcggattcggcgtagaagttttcgtattcgtacgtggcgtttatcgttatggcgattcgcgagagcgcggagaagaggtttacgttgttcggtatttattagtatattatcgcgaagttttcgttttacgagaagaataagaagggttggtaaaatagtattcgttataattttagttttaacgagtgttttattaaggtgtcgcgcgagggcggcggcgagcgtaagggtaattattggacgttggattcggtttgcgaagatatgttcgagaagggtaattatcggcgtcgtcgtcgtatgaagaggttttttcggtcgtcgttcgcgtatttttagttcggtaaggggtttttcggggtcggaggcgtcgtaggcgggtgcggcgtggcgggcgtcggggtcgacggttacggttatttggcgttttttaagtatttgtagtttggtttttttaataattcgtggtcgttatcgtagttttttttatttatgttttatgttttttgttagatggcggtagtcgtagcggttgtagtagttgcggttgtagtcgcgggtttcggtagttttggcgcggtcgttgtggttaaggggttggcgggttcggtcgtttcgtacgggtcgtatatacgcgtgtagagtatggcgttgtttttcggcgtagtgaattcgtataatggtttgggaggttcgtcggtcgtattttcgttttcgtcgtatttttattcgtattcgtacgtatattatttgtacgcggtcgtcgtatcgtcgtttgttttatcgtattacggggtcgtcgcgtcgtcgtcgggttagtttagttttgttagtttagttatcgtcgcgttttcggcgttcgcgtttattagtgcgtcgggtttgtagttcgtttgtgttcggtagttcgagttcgttatgatgtattgtttttattgggattacgatagtaagatcggcgcgttgtattcgcgtttcgatttttgagagtttatcgtatgtcggtgtagacggatgcgaggatgtagggacgcgcgacgtcggtttcggtcgtagtcgacgacgtcgtcgttagtttgattttatattttttgggttcgtttttggagttagcgtttagggtttttttgtgttttttcgtttttttaagtttttgtcgtttttttttgtttttttagtttatgtttttttgtgtttatttttttgatttttgtgattttgtatttttttggtttgaagttgtttttttgcgcgttttttattgggttcgttttttttcggagttttagcgttttttgtttaaatttatcgcggaaagggttcggggcggaggtgcgatcgggcgtcggtagcgtagattttttggtttttttttataggtcggtgcgttcgtttttcgcgtttttcgttcgattgtcgtgtagtttatggttagacgcgtcggataggattgatggcgggatcgcgttgttcgagaaagggacggattaatacgtgtgtttgtttcgcgaatttttttgaagttgtttagaagtcgtttgtcgcggggtttattaggcggggcgggggttgggatttagcgggagtcggggtagtttggttttacggtttgtattcggtttatatcgcgggcgggcgcggagggaggttgcgtttttttcgttattagtttcgtcgtttcgggtattttcgggtttcggcgg

SEQ ID NO: 7182 - DNA, 1686 bp, Artificial Sequence
  Description of Artificial Sequence: Synthetic polynucleotide
cgacgtttttaggtagttgttaaagttcggggttcgtcggtttttaggttcgtttgatagagttaggcgttcgtttggatttagttttttttcgggcgggaggcgcggggaggttaagttttttaaaggaatagggtgggtaggggagtggtgttaggttaggtttttcggttttcggtagttagagcggagtaggaaaggtagcggggagttttatatttcgcgtttttttcggatttcgtcgtttattcggagggtatacgtttttcggggagttagagacgttttgggggagtttgaggagtgttagcggggttttttttggagtttataagtttttattttattttcgagttgggagataagttatagttcggttttttttttgaaagtatcgtcgttgattttttttttaggtaggagtagatatttgtttgtttttacggcgcgttagcgttttgttttagtcgtttttgggttagagttcgaaatttatttattgcgtttttatttcggtatagatagtttttaaagttgttcgtattttttagatttcgttttttgtttagttttcggatttcgtttaggggttgagttgacgttcgcgggtggatttttttggttcgttgcgtagggaattgatttcgggaatttagggcgtatagaggttaaagaagttgcggtaagggagggtgggtaaatttagtttgagtttaggtttttgtcgtttttatttttaagtttgttttgttttttttttgggagaagagtaaatttttttagtatttatttttagtcgcgaggaggcggcgttgtcggttgttttcgttatcgtcgttgtcgttttttacgtttagcgttagtaggagcggtatttagtatagtcgtttaggtagtattttcgtagtagtcgttaacgagttgtagtcgtcgtttattgttcgcgtcggttttcgtttttcggtgtttgtcgtatcgtgggtcgtttcgtcgtgttcgatgggtgcgtttttagcgttgtcgtcgcggcgttcggtttcgggttttcgtcgttgcgtcgttagttcgtcggtagtagtcgcgtttattggcgcggattcggagcggtttaggcgtttatttcgggacggttcgtgacgttacggagggagggaggtggttcgtgtatatttatgaacgcgggtatcggcgtcgggtttcgcgtttttcgttttaaggtttcgatttttaattttttttagtcgtttttacgtttcggggttttgtttaggtttttttgtttagtcgggatcgggtttttagaggattttggtgggcggtttcggagagttttttagtttcgcgtttttatttcgattttcggaaaagttgtcgtaagggatggagggtttttttagaaagtggttattcgaggtttgagggttatttggggtggcgcgagggattttgatttgttatgttttttgaattgatatttgggcggagaggattgacgggcgtcgttaagggttttgtttttggttgggtttttgggcgttttgcgtcgattggtttggggagggcgttaggcgtatattagagtagcgtttagtggtgttaggggttgtcgggtagagtagatagttttggatttggatggtaatggtagggtttcgcgttattttcgagaagtaggggtagtcgcgg

SEQ ID NO: 7183 - DNA, 1686 bp, Artificial Sequence; identical to SEQ ID NO: 7182
  Description of Artificial Sequence: Synthetic polynucleotide

SEQ ID NO: 7184 - DNA, 2132 bp, Artificial Sequence
  Description of Artificial Sequence: Synthetic polynucleotide
cggttcgaagagttggtgagcgcgattatagggtagtttgcggacggttttttcggataggataagggcgagggaaacggtagaatggtgacgtatttgagtgcgtttattagacgaaagaagattaattaagttttcgtgtagtgcgtagataggtcgatatatatatatatatatatatatatatattaatatatacgtaaagatagtgagggagcgagaggcgtatttttaggtagttgataatgatacggtttcgattcggacgcgggtttaaagtttttcgattttcggagtgttttttttttcggcgattttcggagattatcgttggcgtattttttcgttttgttcggtttcggcgttttttttttttttcgtagtcgtagtttttcgtttttcgcgaacgcggttttttagtgttttttagaacgttcgcgtggttgtcgggtttcgaattttagggtcgattttagtattcggcgcgcgcgtcgtcgcgtcgtcgattagtttgcggttttcgtattaattattaacggggcggttcgggttgcggcggttcgaggagggggatggtacggaattcgagataggggataattttatttttcgaagcggtcgcgaaattttagtttgggaggttttcgttttttttcggtgcgttcgttttttttttcgcgtttcggttcgtatatttttatttttcgtttcgggggcggcggcggcggaggtattcgtatcgcgcgatgtttagttatcgttgtcgcgttgtcgtcgtagttagtcgcgtcgtcgtcgttgtcgtagcgcgggcggtcgcgcgtcggtagtaggggtttggcgaggaagtcgttgagtttcgcgcgtttcgcgtttttggcggtcgtagcgttgtttattaattgatttttttattgatttatttaatttttaggagcggttgttcggaggtacgggtttttttttaaatttgtagcgacgttttcggcgtgggtataaaggtttcgacggcggtcggcgggggttgtttagcgttcgggagtcggcgttagaggtcgtttgcgcgcgttttagtcgagtttcgggtattatgtcgcggcgtttgtagtttcggggcgcgggtataaaaggtttttcggtttcggtttcggtagtttcgggggtcgttcggaatttttattttgtcgtttttcgggattttttagcgtttgttaagtcgttgttgcgttgggacgaggtgttcgacgatttcgtggagtgttttattttgtcgggttatcggcgtttgtcgtgtacggtttaggagtgtttagtttcggtgttgaagtttattaacgagacgtttaatttttggacgtattttatttcgttgttgttgtttttgagtaagttttgtcgtttgttttttttgagcggcggcgacgtgtttttttattattcgtggttgttatcgttgtggtgttacgcgtcgggagtgttgttgattttcgttatgagttgtacggcgtacgtgtttagttgtttgtcgttgcgtttgcgcgtcgtttttttttatttggattacgcgtttattagttattacggtttcggtagtacggtggtttattattattatttgttgttaggttttagtttgttggatgttagagttatgattttatatttgtagtagcgtttgggttggtacgtggattgtacgcgttttatcgtcgtttatcgcgttttggtgttgtttgtggttttcgtgttggcggtggtttgtattgtggtttgttgtaagagtcgtatcgattggtgtatttattcgttcgcgttgcgtattttcgttttcgttatgtcgtttagtatggtttgttttattatgttcgagagttggtttttcgatttgcgtggggagaattttatatttttcgtgtatttttatcgtcgttatttttggttggtggtggtcgttttttttaacgtgagtaagattttcgagcgtatttagtcgggttttttcgatattatcggttatagttattagtttttttatatttttattttttttagtatttacgattaggtgtattacgtagaagagggtttgcgttagtttttttaggcgtcgtttgtcgtatttattttttcgg

SEQ ID NO: 7185 - DNA, 2954 bp, Artificial Sequence
  Description of Artificial Sequence: Synthetic polynucleotide
cgtttagagcgtggtagtttgcggggtcgtttacgtttttttttttggcgttaagtttgtggttcgcggtttttaagaagggtatgcggtgagttcgcgggtttcggttgcgtattatttgtaggtttttacggatgaggtcgtggcgcgagcggattcgtgaattcgttatcgcgcggggattacgtattaagtggatgattttgaggtttagggtcgggtttcgtagtagtggcgttaagatcgttacgtcgaagacgcgtatattttttatgattagtgtgcggtatttgcggtattttttttcgaaacgcgttaggcgttgtggcgggtattttttgtatacgcggtcgtttattaattttacgatttttttgcggtaggcggggtagagtggtgacgagtatattattttgttggtggttgcgtcgaagatgtttagcgtggtgaggttgcgtttttcgttgttcgcggggttatataattggaagatagagaggtcgtagcggtaaagagcgtttagtatgtttcgcgttgttttttgtagggaaacggcgtttttcggatatagtttttgttatatatgttatattggttcgtagagaaagaatatttcgggattttggttgaatagttcgtcgaagaacgacgagttagagcgttacgtggtgaatacgtatattagttgtcgtttgttttcgacgttttcggtgtttcgagtgttattgtttggaggggtcgtaattttcgttatttttgtcgcggttgtaggagtcgtttcgacggcggtagcgggagggcggtaaggagtgcggaggtttaaacgggtatgagtacggggcggttcggtcggaggcggttttgggcgtttttagttgttttcggttgttttcgttgcggtatttagcggtttatcggggttgtattgttgtagcggttttttgtgttatttgtagtttaggaggttgagtatagtgagtattagtagtagtgtatagttcgcgtataatattagcgtttttttacggaatatttttatttcgagaggggacgcgggttagcggcgttttgggcgtcggggttattgcgggagtagggtacgcggcgcggttgtaggcgtagtttggagtagtcgagggagcgcgttcgggggtagagttcgttgcgggttgcggtttattataggtataattcgggtcggcggcgcggcggaggtagttttgtagttcgggaaggggacgtagcgggttggttgttggcgtcgggattcgggtcgcgatttcgaggcgggcgcggcggttggtttttagcgtttaaggttggtttttttatggtagcggtttcgggtaggatttgcgaggggaagcggagtgagcggatgcgttttaattttttttttagttttttttttttaagtaacgtttattttcggttttgttcggttttttcgtttatttggagtcgagggcgcgttcgggagcggtttcggattatcgttcggcggattgttcggttgttattcgtttttcgatttcgttttttttcgttttcgttgggggttttcgtattttcgaggggtttggggagtcggtcgatttatttttgggtagttttcgggtagcgggcgttttgcggttcgggaagaaaaatttttacgcggtttagagtttcgtttcgcgtttcgtcgaattcggcgtttttcggttttagcgacgtttttttcgttttttcgggatcgtagttttttgtttcgtttaggggaacgaagtcggttgggggcgatggttgggggcggtttatatgggatttagttttcggtatagcggcgtagtttttttcgttttcggttttcgtgcggcgaatttttttatttttttggtagcggtggatggggtatagcgcgatttcgtagcggcggcggcggttgtttttattatcgggaggatgttcgggcggatagcgtaggtaattttcgtcgtttcgtagttttcgattggattaaaggatttcgaatatatagttttaggtaaggaaatttaggtgtgtagtattgttcgattcgatttaattcgttttcggtattagcgtttttggttaacgaggtatttaagtaaagaaagatttcgtcgtagtcgtcgtcgtcgcgcgaaagcggcgtttaggaggatgttgttattcgattttttttacgtcgggcgttcgtaacgcgttcggattagtttttgcgcggtttttgttagtcggcgttcggttggtgcgcgtcgtcgtttgtcgtcgcggtttttttttttcgtcgcgtagtttttttttttcgtcggtttcgttttcgtttttaacgtcgagtcggtttttatcgtcgttgcgtttcgggggttggagacgcgattcgttttatcgcgacgcgcgggggttgtagtttacgggttcgaaggtttagttttgcgcgtaaagcgtcgggatgcgaacgcgggatttggagttcgtcggtgtcgagagttgttagagagttggattttgcgtgtagttgtcggattcggttttatgtttttgtttttagaaagagttggtgatgaagtttgggtagaaattttttgtcggtcgttcgttttacgtttttttcggggtcgatattgttaattttttcgggtattgaggatatttttgcgttttggagcggtgggaggacgcggagcgtcgttttttggttttcgatattttgttcgttttttttagtgggtttgtggttgcgttttttcgaaggaagtaataaatttttttgattttgggggttagaggagacgttttagtttttcggaggggtgtgcgggcgggatcgttttttcgttttattggatttttggtcggggttgtttttgttttattgtgttttatatgcggagtttcgatgtttttcgtattttcgttcgcggtgttgcgtttattgtgattgacgt

SEQ ID NO: 7186 - DNA, 2954 bp, Artificial Sequence; identical to SEQ ID NO: 7185
  Description of Artificial Sequence: Synthetic polynucleotide

SEQ ID NO: 7187 - DNA, 885 bp, Artificial Sequence
  Description of Artificial Sequence: Synthetic polynucleotide
cgttcgtcgtttttttgaggttacggcgtaggagagaaggagggcgcggaaacgtcggtatcggttgggaagtttcggtgtttcgggttttttttggcgagggcggagaagtcggcggtttttgtttagaattttgtgattgtagggatcgagatattaagggcgggggtgtagaggattataagttttttagcgcgttttatttgtatataaatgtgttttgttttttaattttgtttttgttatttgtgtatttgttttttattaaattaattaattattcgtggtttaggaagaaattagaattggggggattgtttttttaagggggatatagttgaacgtggtcggtagtttttggtttttcgggtttgggtttagacggatttcggcgttgtttttaagatcgatatcgggtatttggtcgtcggcgtatttaggagtacgattttatgcgtgtgtacgttttttgttcgggttaggagttttgttttagttttatttcgggttataaatttttggtttcgtttagcgtagtttcggttcggagggtagtttgttagttaggttttgggttagggatggtttacggtgcgcgcggggatcgttatattttttagcgttacgttggggtcgcgcgggtcggagtagggggagggggttcgatgacgttatggaatagttggaggatttagttcgggaattcgtcggggagcgggtttcggggtcggcgttttatttaggtcgatagcgtttcgggttcggttttatttttttagacggtacggttgttttttacgtttagagcgggtttggggttttgaaggaaattagtgtacgatcgcgaggttaggaattttggagaatgggtacgtaggcgtgcgt

SEQ ID NO: 7188 - DNA, 2174 bp, Artificial Sequence
  Description of Artificial Sequence: Synthetic polynucleotide
cgcgttgtgttttttagcgttttaggggttcggtttttagttcggttttatttgggcgttttttcgttttttcgtgggtcggcgggtcgtgcgggaggaattttggttgtcgcgggttttgcgttttatttgttatttcggtggttttcgttcgggtttcgagttttttgcggagttagtattttagttgagttagtcggaggggcggcggcggtttcgcgcgtttagagttttagtttatgaatgggattttattttgagcgttttttttcgggtttggggaggcggcggcgcggcggcggggggcgtttcgtaagttcgcggttttgagcggttattcgcgtagtaagttgggcgagttggtagtcgtttgtatttgttttttggtttcggtttttgatttcgttttcggttttaagcgttcgggttgcgttttcggttgtttcgcgaggtagttttaggaggtttaggggtttcgtttgcgtttttggcgttagattatggtgggtagtttcggttaggagttttagtcgtcgcgagttaatatcgtttgtagttagttttcgttttattcgagcggacgcgcgggtattcgtagcgcgcgggttattttttttttcggtcgggatgggcggcgcgggattgagtgatcggttttgcgttcggcgggtaatttttatttgatttgttgtttgtgagttgttgattgtcggggcgcgcgagtttagggggtacgggtagtagcgcggcgatgatttgatttcgagttcgttagggcgtttttttttttttttttttttttcgttttttttgagtttgtgcggagattagttcggtgcggcggtttcgggtggattatggcggggagttttagttaaaggcgtgtgggcgtcgagttggagaggatattttcggtatcgttgttttttgagggggtttatttaaattattgagttattttagatttaggattttttaaataattattaattgtgttcgtttcgtgtcggaaagtaagcggaaagagaaagagcgtttatttttgggatttcgtagatcgtttttcgttggttttttttcgaggggtgtttggttttcgaggatttttttttttttttcgcgtttttttttttttttcgttttttgttttttttgtagtgttgttggtcgggagttgtttttatcgtagttggaaatagttgttttcgtttcgcgtttttatttagatttcgggtaatcgtttttatttcgcgtttttcggaattttagaattcgggtggtcggtttttggaaagtcgtagtcggcgcgatgtattttgtagattttattttgttgggacggattttttaatttttagaatcgcgggtcgtagggagttaaattgttgtttttttttttttttttcgtgcggttggtggtttgttttttaaaggaacgttttatttattttttagtattttttatcgggggcgcgttattcgtttgggtttagattttgttttgtaaacgggttttttatgtatgtatgtgtaggtatattttggatattttataacgtttgcgtttttttaatagaggtacgttttgttattttgggtatcgtttttttttttttatttggtatttcgaacgtagtgtgattaaattttttattgttttttggacgtcgatcgttttggggtgtaagtttggggtgtaaacgtttatttcgtaagagggtttgggatcgtttcgtttcgtttttcggtcgttagaggttggggaagtttatatttggatttttatatattttgtcgttattgtttagattttgattaattttgtgagcgtcgggttttcgatattgtagtttttttaaattttagtattgttttttcgcgattgttttttttttggtcgtttaggttttgttttcgtttcggcggagcgtaagtcggagggcgtagtagaggttggggtttgaggttttcgttgagtagttatggttgcggcgatagttagttttttgattcggtagaagcggtaggcgagggagtttaatagcgatcgagtgtcggtttttaagcgtcgttttagttttagtaaagacgggcgttttttgtgcgagaggtacgttttcggggtgtttagtaaagtgcgtttttgtagcggtcgtaagaggtcggtgaggcgg

SEQ ID NO: 7189 - DNA, 873 bp, Artificial Sequence
  Description of Artificial Sequence: Synthetic polynucleotide
cggtcgggtttagcgatgcggttgagttgtttattcgcgtttgttgaatcggttaattagcggcgttttcggatttagcgggagcgtttttatgtcgatcgcggtaggcgtgcgtttttcggggtcgtatcgttatggcgatttgtttatttgattcgtttcgggtggattcgtcgcgatttttgggcgtttaggtttttgagggtttaacgggcgacggttttttagttttagttgtgcgttttcgttcgggcgaggtggggttgatcgcggtcgtttgtatacgttttttttggttcgcgttttcggtttgggagggcggattcgtttattttacgatggtttcggttttggaagggattgttttcgtgattcgtttttttaatagtcgttaataattttttttaacgttttttgcgcggttcgtttttgagaattttggttcgggagagcgacgcggggttttcggggttgcgtaggttgcggcgttttgtttacgttggttcgagggcgcggttcgtttcgggtcggtttatatatttacgttttttgtcgggaggcggttgggacgcggcggggttgttttaagtgtagtcgcggtagtgttgcgtttttatcgcgggggtttttgcgggtcgcgtttgtttcgttcggttttcggtgtatgtggtttgcgaggcggtagaggagatgtggggatttagggtcgtacgtcgtgttcgaggtttttacgagaggttttttttcgcgggtttttgcgtaattgcgtgaagtcggttcgggaaagttaagattgtggtttaggaagaggaaggaacgcgggcgatagagttggggtttgggacgttgagggggtcggtggtagtttttcgg

SEQ ID NO: 7190 - DNA, 2174 bp, Artificial Sequence; identical to SEQ ID NO: 7188
  Description of Artificial Sequence: Synthetic polynucleotide

SEQ ID NO: 7191 - DNA, 510 bp, Artificial Sequence
  Description of Artificial Sequence: Synthetic polynucleotide
cgcgtagtcggagaggagggggcggtattcgggatttggcgcggtttttgttttttgcgttagcgtgagttcggttagggtttttacggtcgtgtttttattttttagggaggcgtcggtgattcggttatagttttagttttcgtcgttttgtgatttgcgggtattggatgattcgtagttgagatttcgttatatttttgaagtggggaaatggtgagtgtgggggtagggcgttttaaggttggggaggttttattcgaatcggcgggaaatggcggcggcgggacggagtttgcgaacggagttttcgttgtcgtcgtttagtttttagtttttggtttttttcggtgagggattcgggtttatgtcggttttcgtaaggcggttttggtttagtttgtagttttatttgtgtagttttgcgttcgtagtttcgtattttttttgggttgtggggtgaggaggagtttatcgggaaaacgtttgcgtggcgtgcgaggtgttcgt

SEQ ID NO: 7192 - DNA, 511 bp, Artificial Sequence
  Description of Artificial Sequence: Synthetic polynucleotide
cgttttgattcggtttgggcgtaagtaaatttaggtttggtcgtcgggcgtttgggtcgcgttaattcgtttttttttttttacgttcgttcggtattttttggttcgttaagttttagatgcgggtgtttgttttagaaaattttcggcggcggttcgtattgagtatgttcggcggcggggcgggtttggggttcggaagttttagcgattcggcggtattcgtcgttttgaggtagcgggtttcgataggcgatggatttttcgggttttcgggggcgttttacgtgggtgttggtcgggggttttttggtagtggttttggcgttggggggtcgaggttgtttcggcgttagtttacgttttcgttggcgttttttcggcgcgtagttatttcgggatttttaggtggtttttaggtttgggttcggtttgaggattttttcggggcggagcggggcggggttcgagagtagtacgtaggtaaggagggttcgattttaggtttcgg

SEQ ID NO: 7193 - DNA, 417 bp, Artificial Sequence
  Description of Artificial Sequence: Synthetic polynucleotide
cgtcgttattttttttttggagtagaaggggaattcgacgtttaagcggttgcgtgcgaagtttttaattaggtttaaggagtcgtagagtcggggtttcgggttcgtaggatttagaagttacgcgtttcgcgtttttcgtttcgtcgttgtttgttcggtcgatttatttggtgtcgcgtgcgttggcggttcgcgcggtagttaagttaaaggtcgaggtcgaggtcgagcgcggcgtttagtagtacggcgggggttagtagggcgggcgtcggtcgtagcgcgtttcgttttagtagtagtcgcgcgtcgtttttgtaggtcgtttcgtcgcgggttattcggggcgtttaggttgtcgtttcgtcgtatttcgtcgtttgttgtatcgttttcgttagggcggcgacgcgg

SEQ ID NO: 7194 - DNA, 1748 bp, Artificial Sequence
  Description of Artificial Sequence: Synthetic polynucleotide
cgcgggtcggggagttgtattttttgtaggttcggttttcggtttcgttttttagcgtcggagttcgggagtcgcggttgtagtttatttttttaaatgatagttgaggttcgggttttagttcggggtttgacgttagtgttttttttcgtgttgttaggagtagttagcgttatcgtcggcgtttcggtttcgcggtacgtttgtaagttgtcggggcggcgagttttttttgtttcggttttttttttcgttttttttacggagagtcgagtagtagttttagagtttttcgtaagttttttttatattttttcgttttcgttttaaaggagtagtagtttttttttgtttttttattgtcgtcgtcgtatcggcggagtttttttttcgcgcgtttttttttcgatggagttcgggcgtcgtcgacgtcgtcgttgtttcgaattttgagcggggtcgtttcggtcggaggaacgcgtcgtttagttcgagggcgtagagcgttaggagtacgcggagggttggggcgcgggtttcgggaacgagaaagtgtagttttttcgggttattgggtcggcggcggggggattatggttttgaaggatacgggtagcggcggtagtattattttgtttattagcgagatggttttttcgtttagttcgttcggcgcgtcggtcgtcgtcgtttcggggttttgcgtattttcgtttttttttgaagtagtggagttgaacgtaggcggttaggtttatgtgattaagtattcgacgttgtttagcgtttcggatagtattttggttagtatgttttcgttttttagttttcgtggcggcgttcggcgtcggggcgagttgtttagggatagtcgggcgcgtttttttatcgatcgggacggttttttttttaggtacgtgttggattatttgcgggataagtaattcgcgttgtcggagtattttttcgagaaggagcggttgttgcgcgaggtcgagtatttttagtttatcgatttggttaagttgttgtcgtttaaggttattaagtagaatttttttaacgacgagggttgttagagcgatttggaggataacgtttcgtagggtagtagcgacgcgttgttgttgcgcggggcggcggtcgtcgtgttttcgggttcgggagcgtacggtggtggcggcggcggcggcgcgtaggataagcgttcgggtttttttacgttgggttatcggggtttttatattatcgtgcgcgataattaggtcgacgttaaatttcggcgtgtggcgcgtattatggtgtgcgggcgtatcgcgttggttaaggaggttttcggggatacgtttaacgagagtcgcgatttcgatcggtagtcggagaagtatacgtttcgtttttattttaagtttatttatttggagtaggtttttgatcgtttgttcgaggtcggtttttatatggtggcgtgtaatttttcgggtatcgtcgttttcgttaattagtatcgcgacgataagatttggagtagttatatcgagtatattttttttcgtaagttcgtagtttcggcgttttttagtatttttcgttttttgttgagtcgtcgttagtttgagtttcgttggaggtttcgcgggggtgttcggggtaggcgttggttaattttttatagagagcggttttttttgtacgatttttttatgtagtagatacgatttatattttatcgattcggatattttcgt

SEQ ID NO: 7195 - DNA, 1748 bp, Artificial Sequence; identical to SEQ ID NO: 7194
  Description of Artificial Sequence: Synthetic polynucleotide

SEQ ID NO: 7196 - DNA, 648 bp, Artificial Sequence
  Description of Artificial Sequence: Synthetic polynucleotide
cggttgtgtcgggagtaaaggttcgggttagtgtgcgtgcgggcgcgggtgattttatttttagggaagtcggcgtttaattatttaggtagtagtttcggttgatttttttttttttttttttttttttttttttttttttttttgcgtgttttttttgtatcggttttcgtcgcggagttaggcggtagtatcgacgtcgtcgtagtttttgttcgtatcgcgttaattcgcgttttcggtttatacgtagtcggagcgattgagtcggtagtttcgggtttacgttgcgtatcgtgtgtacggcggggttggttgagttgatttgcgttgggtttcggcgtcgtaggcggttggggagggcggcgtgggagaggacgttgagacgtaggggcggtcgcgtcgaggtgataagttgcgtatttggaaagttattcggttgtttggtgaggttcgtgggtcgggggttttgggcgtcggggtgtgagggcgcgcggggagggacggggtcggggtgcgcgcgtgtgtatgttgtgaatgcgttgcgcgatgtgcgtttttattttatatttagtcggttttttgtttgtgttgttcgagtgtggacgtgtgtacgcgttgtattcgttcggtgtggtagcgtttcgt

SEQ ID NO: 7197 - DNA, 863 bp, Artificial Sequence
  Description of Artificial Sequence: Synthetic polynucleotide
cgatttttaacgttgtaatttgtgatcgtgattaaattttagcgatgcgagggtaaagcgttttcggcggtgcggtgtgagttatttttcggcgttgtttgttttttttagtagttttttaagggataggttttgtttttggtggtcgatttttaggttttcggtttttttagggcgattttgacgaggggtagggggtggttttcgggaggatttagaggaaaggcggggataagaagggaggggaaggggaaagaggaagaggtattatttttagtttaatcgttttcgatttttataagagtgttcgtgattttaaatttaacgtgaggcgtaaaagcgtttttattttttcgttttgcgcggttaggtaggcggttggagttgatggtttatttcgcgttttttgttttatttttattcgagatagggacgaggagtacgttgtagggaaagtagcgagcgtcgggagaggggcgggtagaagcgttgataaattagcggtgggggcggagagttgaggagaaggagaaggaggaggattaggaggaggaggacggcgacgattagaaggggtttaagagagggggcgagcgatcgagcgtcgcgacgcggaagtgaggtgcgtgcgggttgtagcgtagatttcggttcggttttttcgagagcgttttgggcgtttttttacgttttgtttttaagttttttgtttttttattttcgtgagcggagaattgggagtggttattcgacgataggttagcgggtttgttttttatttttttagtttcgcgtcgtcggtttatagcggttttttttggggatagtttttttcgggtgtcgttttcgttttttttgtgcgt

SEQ ID NO: 7198 - DNA, 1288 bp, Artificial Sequence
  Description of Artificial Sequence: Synthetic polynucleotide
cgttttttgcgtagtcgatttcgtttcggtttcggtttaggttagagaggtggttttcggagatgttgaagttatttcgcgtagggggaggggtcgttaggtttttttttaattacggtggtcgttttagttatttgtatatattatgttaataatagattttttgtttcgtttttatttaagtttttcgttttttttgggggtttttcgggtcggttcgcgggttgggttaaggtgaatatattatgataataaggcgggtttttgttttgttttcggaaggggggcgcgtagtagcgggagcggtaggtcggacgtcgggcgtcgggagggggtcgggggagggacgtcgtgttcggagcgcgcgcgtatttatatatttatatatatatttacgcgagtatcgcgaagggtatttaaggatcgcgtacgcggggttgcggagatttttcgggtagtcgcgatttcggtttcgcgagtagtattggttttttgggtttatttcgttttttttttttttttttattttagtcgtttttttcgcgttgcgttgtagcgtgtttttatagtttttttgttttgaattgaatgtaggtgggaaataggtcggcgtgtcgaaagatatcgagtaggtagaaataaggtaaatttatagaggcgtaataggttcggtttttcgtggttagggcgagtcgcggtttcgcgtggcgtttcggtcgttgttttcggattttgagcggttattgttggggttttcgaaagaggtgtcggttttttgggagtcggaagagttgtttgggtgggtttcgttttgttttttattttatcgttatttagttttcggacggagggtgttttttatttttagttgggaggagagaagaaagcggggatggtgtacgtttgcgggtttggacgttgagtaaggtaggggttcgtattcgttcgtgggtttgattttattaattagttgtgtagttatagggattgaattttggaggaatcgatttttttttttttttttaggattatttgaggtgtagagggtgggaagcgaagtcgagacggtcgatttcgttacgatgttgttgaagaagtacgtagggaaaggagggggtcgggagtttagattcgaggattcgatttttgtcgaatagtattgtgttcggattatgttttcgtgtgtcgttttggcggtttttttgttagtggtggtcgtggtgttttgtttgtatttgggtgtgaaaattaacgatttttaggcgaggatcgtcgttttcgaattcgt

SEQ ID NO: 7199 - DNA, 1275 bp, Artificial Sequence
  Description of Artificial Sequence: Synthetic polynucleotide
cgtttatttcgttttgtttgttcgtttttattgtttttaagttcgtttcgttcgcggtaagtgcgtgtttaggcgtagttatcggcgagattaggagcgtagcgttcgtagtttgagggaatcggcgtagggtagtagcggttgtagttggattcgcgcgttttagcgtttagtggcggcggtcgggatattttgggtagtatttcgtatcgtagtattttagattacgagtaatcgtgttcgttttcgtcggggttggagggcgtagggtcgttattttgtaagttcgtgggttttcggttatttttatgagagaaggcgaagtcgggcgaaggagtaggacgttcggtagtaggattttttcgtaagtttcgcgggttttttgttttcgcgtttttcgggcgtttaagaagtaaaatgtaattatcgcgttatagttgagaggggaaggggttagcgttattcgttcgttcggaattcggttttcgcggcggttgcgcgtttcggtcgcggttttttcggttcgggagtgagtagtagtaggaggagaggtagcggttcggggttggtcggggttggggaggagggacgggacggagggagggcgcgggggcggggagggggtttcggcggataaagatggtaatgttttttatttaagcgtgttgtagtttggtttttttaatatggttgttttttttttgtttcgtgtatttgttttgtttggattttatcgtggtcgagaaggaggaatggtatatcgttttcgtgaatattatttacgtcgagttcgcgtcggatttcggggtcggggcggcgggcggcggcggcgcggagttgtatacggagaagacggagtgcgggcgttacggagagtattcgtttaagtaggacgttcgcggggaggtggttatggttagttcggtttacgatcgtttggtttgcgattttaatattaagttcgtcgtttcgattcgcggtaagaattggatagtttttatttttaagggtaattgtacgtatagggataagattcggaacgcgtttttgtagaacgttttagtcgtggttatttttaacgtgggttttaatattaacgagattattattatgttttacgcgggtgagtggtttagcgggcgcgggggaggggagtcggcggggacggaggtgtttagagggatttagcgtttgtttttaggttttttttgggaagttcgtgcggcgcggaagacgtgtttgggttttttggatcgattaagttttgtttcgcgt

SEQ ID NO: 7200 - DNA, 1071 bp, Artificial Sequence
  Description of Artificial Sequence: Synthetic polynucleotide
cggcgttgagttttgtttagcgcgattcggatcgacggacgcgtagagattttgtcgggattcgttttttagtcggcgttcggggagtcgtcggtcggttttatttttcgttcgggagtcgggtagggcgagaaggtagcgcgagtggcggtggcgattttcgtcggggtttttgcgacgagcggtgattagtagcgttcgtagtcgcggtttcgttttttattcggacgtggttaagcggcggcggttacgacgttcggtttttcgggatcgttcggttgcgttttgggcgtatttgcgcgtttggtttcgcgtttcgcggagagggcgatgggtttcggttaggattgagtttttttttttttttttttagtttcgtttggtatttttttttttgtttcgagggcgagttacggtttgcgtcgtcgttttttttttcggtgttttcggttcgtcgttttttcgcgtttttttttttcggattcgttttcggggttattatggtcgcggttatcgttagcggtttgattcgttagaagcggtaggcgcgggagtagtattgggatcggtcgtttgttagtaggaggcggagtagttttagtaagaatcgcgggttttgtaacggtaatttggtggatattttttttaaagtgcgtattttcggttttaagaagcgtaggttgcggcgttaaggtttgtgggggttatggtcgggagatgcgtttcgggtcgtttttttttcgtttaaacggagtttttttaggttttttttttttttcggttttttcggtttatttcggtttcggttttttttttgagtattttgggtgtcgtcgcggggattttggagttcgttgtcgggtaatttgtagtcgtcgagaagtgtagtcgttagagatggtaagttggttgtttttcgtcggcggtttttgtttttcgcgtttttgtaggttgggttttgggaaatttgttttttttgagtttcggtttttcgggaggatagggattggtattggttttggaacgcggggtatttttttttgttatattcggggtcgagttatcgttcgt

SEQ ID NO: 7201 - DNA, 694 bp, Artificial Sequence
  Description of Artificial Sequence: Synthetic polynucleotide
cgttagggttgtcggatagttcgatgattaggagttttcggttttcgaagttgcgttttatcgtgtaaattttgttgatggcggtgtattgtagttatacggatacgagcgtttcgcgtagttcggggtagcggtggtattcgaaggagatgtcgtttttttgttgtagtcgtcggcgtcgttttatgttcgtcgcgggcgtttcgggtttttgggtttcggcgtttaggagttattcgtaggtagttagtgtttcgtatagagttagtagcgcgttgttttttcgttcggttatcgttgcgtttcgtcgtcgtcggtcgtgtttttttacgcgggcggttttttttgtttgttcggttttgggtttagttcgtcggcgttgttgggggcggtaagtttcgtattagtttttattcgttttatttttttcggttgaatgagtgttagttcgcgtattggggttatttagaggagacgggtaaagtcgcggttttacgggttgtattattggtcgcggagtttaggggagttgtaggagaaattattgcgaggagggggtcggcggagagacgggtcggcgtggatttgggagggttgttggcgttatttgttggttcggaattacgttaatagttaaatggcgttcgggacgacgtaggtgaaatgatagttaaggttcggggttcgggaacgt

SEQ ID NO: 7202 - DNA, 694 bp, Artificial Sequence; identical to SEQ ID NO: 7201
  Description of Artificial Sequence: Synthetic polynucleotide

SEQ ID NO: 7203 - DNA, 1424 bp, Artificial Sequence
  Description of Artificial Sequence: Synthetic polynucleotide
cgagagttcgaggcgtcgtttttgtcgtttcgggattggcgtgaggagtttttgacgatatatattaattcgagcggttttaaagatgtagttgtatatggagattttgttgggaaaattcgtttgttttttttacgtcgtttagtttaggagaattatcgtcgttatttcggagttttttcggttatcgcgtagagtttttcgagagttcgagtcgcggttttcgagttttaaggtttatttagggttttagatttttgtttcgaaaggagaggatttgagaaaatggatgtattgagatttttttgaaaatttttcgagagagcgcgagaggagcgaggatacgttattcgtagttaaaattatatttaaggattaaaataataataattaaaaattttattaaaataataagcgtttaagaatttagatcgggttggtggggggaggggaagaggcgggaaggggagggtcgtacggaggtagttttgtagtgagtagtcgatttcgtcgtttttcggtatagttggatcggtttttttagtcgcggtttagattcgtttttggatttcgggttagtttcggtgttaggatcgcggttcgggtttggattttcgagatttcgcgtattagtttcgcgggagtttcggtatttttgtatgagtacgagaggattttgttttcgcgtagtagttcgggaagtaggagtcgaagcgcgggtcgtggagtaaggcgggaatcggaggcggcggcggcggcggttaggggcgtacggtgttaggattagttcgtcgcgttttatggggagtcggcggtcgtagcgttgttgaggcgggttcggttggttaggcggggggacggggttcgggttgtagtagttttttttgcggttgtcgggcgggttcgggcgttcgggggttggggggtggggggtgggggaggacgtcgagcgttgaggtaggggttcgggtcgagggcgcggcggggttgcgcgtacgttggggcgcgtggaggggcgcggagggcgaaatgagtttggtaggtggttttttttattattcggtggtgtattacgagggttattcgtttgtcgtcgtcgtcgtcgtagttgtcgtcgtcgtcgttagtcgttgtagttatgaggagaatttttatttttatggttggtttatcggttatttcgagatgtcgtttttcgattatagtatggttttgttttatagtttcgagtatgttagcggcgtcgtcggtttggattatttttattacgggggggtgtcgtcgggcgtcgggttttcgggtttgggggggtcgcgttcggtgaagcgtcgaggtatcgttaatcgtaaggagcggcgtaggatttagagtattaatagcgttttcgtcgaattgcgcgagtgtatttttaacgtattcgtcga

SEQ ID NO: 7204 - DNA, 1215 bp, Artificial Sequence
  Description of Artificial Sequence: Synthetic polynucleotide
cgtgcgggagggaggataagaattcgggagtggtcgaggataaagcgggggttttttttattttacggtgtttagttttttttcgttgtacgtggtttagggtggtcgtattatttttaaagtcggtttcgttaatcgttagtttcgggattgaatttgttttttcggtcgttcgtttttcgtaggggataggggcggggagggagagatttagaggggggtcgggggaggtggggtcgtcggggaggaggcgagggaaacggggagttttagggagacggttttcgagggagagtgagaggggagggtagttcgggttcggtacgttttttttttcggtcgtttttttttatataagcgtaggtagagggcgcgttagttatgttttgtttttgcgttcgtcgtcgtcgtcgtcgtcgtttagttcggcgcgttttggaggattttgcgtcgcggcgttttcgggtttcgtcgtcgttagtcgtttcgtcgtttttttttcgttttcggtatcgtcgttagcgttttcgtcgtagcgttcgcggttcggttttttttatttcggggaaggggagggaggagggggacgagggttttggcgggtttggaggggttgaatatcgcggggtgttttggtgtttttcgtttcgtttttttaaaaagttatatcgacgcggatcgcggcggcgttttttttcgttttcgttttatttcgcgggtttcgaatgcggggagttcggatgttcggttttttgtgaggtttttatttgatattcgtcgttttttttcggtattggttgggagggcgttttgtaaagttgggaacgcggagtttcggattcgttttcgtcgttttcggttcgtttagggggggtcgtcgggaggagttcgggggagagggattaggaggggttcgcggtttcgtaggggcgttcgcgtttttatttttgttttcgttagcggatcggttttttattttcggtttttttattatgtatttgttgggttttttttttgtggcgtgttttttgttcgtcgttgcgttgttttcgggttttcgcgaggcgttcgtcgtcgtcgtcgttttcgagttcggattcgatttttcggacgcggagttcgacgcgggcgaggttacggtaggtttgcgttagggtttgcggagaattcgagagtttgcgttagggtttgcggcggattcgagaatttgcgcgg

SEQ ID NO: 7205 - DNA, 1184 bp, Artificial Sequence
  Description of Artificial Sequence: Synthetic polynucleotide
cgaatgttgttttcgtatcgatttaaattcgcgtcgagtttttttttatttcgatattataagggagaagagcggagtcgtcgtcgtcgtcgtcgttattatcgttatcgttatcgtcgtggttttcggagcgagcgagcgattttgtcgcgcggggagttttatcgggagtcgcgtttcgttagttcgttttaggtcgtcgtcgtcgtcgtcgtttatttattttgtcgcggcgcgttttcgttgtggtcgtgaggaatcgagtttagcgttgttaagttgtttgggtttggagcgtatcgtgttatagcgtttggtttcgggttcgggttgcgcgcggcggttagatatgataggttgaggtttttttgtttatattcggtcgtcgagggggcggtgcgtcgtttaattttttcgcgtcgggtcgttatcgtcgtttttcgttagtttcgcgtttagcgtttcggttcggtcgtcgttttattttttcgttttattttttcgtttcgttttatatacgcgggtcggggtttgtgagtagtcgtgtttttagcgaagacgggggaattgtattgagaattcgttttcggtatttttcgaagatttcgcggggcggtatttttttttttatatacgtacgttcgcgagtcgtttcgggtagcggtcgtgtttttcggcggggtttcgtcggcggtttttgatttcgttttagagttgtttttcggtagcgttattttttcgtgtttataaaagtattttttttttaatttatgaacggatttcgatttttgttttgttattatttatgcgtttcgtattcgaggtgtcgtttttatttatacgttttacggtttcgcgaaattcggttttttagttcgcgggacgcgttgtttgttaggcgggttcggcggtatttcgggggcgggaggggtcggtcgtagggtttttagtttggcgttcgcggggcgttcgtagcgaaggggtgggtgtcgttcgtgaacgtagtagggattagtttagttcgcgttcgtttttgggtttcggttatcgttttttcgttattttttcggtttttgcgtggatcggttcgtggcgggggttgttttgcgttttcgttttcgtagtagtcgcggatttttattaacgttgacgagttagtgtcgcgattcggggagagaagacgg

SEQ ID NO: 7206 - DNA, 5820 bp, Artificial Sequence
  Description of Artificial Sequence: Synthetic polynucleotide
cggagggaaatcgggtcgacgataagggtggttattttcgggtttttcgcgttcggtttaagcgtttttgggtggggtagtttaaacggggagaggggtttcgtgggtcgagggttcgaggtcgtagcgagtttagcgtttggttaaatttggttcgcgcgtttttttattgttttgttagggttgtgtgatttttcggagttttacgttttcgtttaaatagtttttagcgtttttgttggtattcggggcgtttttattttagtttttgtattcggcgcgtcgcgcgtagatcggacggaggggaaagttggtaagagcgcggcgttcgcgggagaaagcgttaatgggcggtcgggtgggagtagcgcgttcgttcgtttacgttacgtcggtgcgggttcggttgacgatcgcggcgtttggggacgtcggcgcgtttcgttcgttaggtgtttcgtttggaaatgtttttattagttgtcgtcggtttttcgttggagcgcgcgcgtcgagttttcgcgcggagttttcgcgggttgtcgggagcggtttagcgttatcgtaggtaggtgaggtttttcgttttcgttttcgtttcggggtttcgagattttttttttttttcgaggaggcggaggtttcgcgcggtcgtcgaggggagcgggcggcggcggttgcggcgatttttcggtgcgtttcgggttgcgagttgtttttcgcggtttcggtagttatacggcgcgggcgggagtttttttagtttaggtagggagtgggtttcgtcgtataaattttgcgaggattgtttttgcgtttaaggggataaagtttgttattcgtcgttaggttttttagaggtcgttgcgtttgttgtaagttgcgggaagtagggtgcgcgggtcggcgcggggcggggggtggggggttcggagtggttaggtttgagttttggacgttcggacggcgtttcgtttagttttaggtcgtatttagggagtaagcggcgggggcgtagcgggagagaggagggagagggtcgcgggtttttatggagggcggttgggaatttagagatttatcgtttgtttttgtggtttttttttttattattggtttcgagggggtttcggggttgtgaggaaatgatttgttaatttcgaggttcgttagtgcggcgttagcgatcgtgaggttttttaaatttatattttagtcgggtgtttcgagcggtgggcgggtataggcgtttttaaggtttttggttttaggttttagaaagaaaggtttttgtttggtgtttcgggttttcggtttcgtttttggttggagttaatttttttgggttggaaggagtttttttcggacgagtttttggtgcggggaattggtggtttttagggtaatttttgaagtattagggttaggttggtcgaagaagggttagggttcggtttgttttttcggaggttttttatggtttcgacggttaacggtaatttcgttaaaataggcgattcgtttgcgtttcgcgttaggggttgattattttttgttttttttgcggtttgtttcggttttggtttttcgtttttcggagcgttttaggttagcgggagtattttattttttcgaagttgagtcggtgttgtgtatttcgggagtcggttgatttttggtttatttgtttacgggtgtatttagtatcgggggtttttagagggaggaaggtttagtatttcgagtttatgtagacgcgtttagttgatatttgagatgttgagcgttttatcgttggtgaaagggatattgggtgttttcgttttaggtttggttttttggtgaaggtatttggaaaatattttagtattatttatgggagaagggtggtttagtgagaattttcggtttgggtaggcgggtttaggttaggttatagggttttagtgagatgtttcggtggtcgttaatttataggttggattgattttgtgttttggaatgagtagtggggtttgggtgaggtcgggcgggttaggaggttttttgggtagttgcgagtttttcgaggtagggtgattgtgattgggttcggattttaggcgttggggtttgttggcgggtaggaagtggagcgtgtgtgtgcggcggtttgggaaagtcgatttagaggttaggtttttgggttacggagaaagggtcgttcgttggtggggattggagcgtcgatttatgtatataggttggaaaggtaaaagagaataggagaaggtggcggtggtggttaaaggaagttttcgaaagggtttttacgtattggttgttttgggaagtggaggttgttttttttagattttgtttagaagatgaatggtcgtttgttttggggtttcggttttagttaagtttcgtcgggtttggaaggaaggaaatgtattagttttaggtttgggtgggttgagttgttgtattagagtttagaggtgtagggtataggtggttgggtttttgggttttggtttttttttttagtcggcggagtgtttatagtcgtcgaggttaggttttcgagtataggtgaggaaaggataagttatagttgaatgttttttttttgggggtttttattttttattttagtttttggttcggttgggtttatattttttttttagtcgggttttattatttggagagagcgagtagtttgtaaataataaataatgggaagtagaaggatgttcgggaaaaattagaaaattgtaaggagtggggaggagggagggtgggagaggggaggaaggagggtgggggaggggaggagtaggaggagagggaaaggggttgagagatttatttttagcgagaaatttcggtggttagttttttattatttataggaaggtgatattagcgatttaggtgagaaagaaagaaacgcggtttgtcgcgaaattaatatagaatttagaaataattattaatgttatttgattcgtgttttttatatatttttcgcggttatcgacgttaaattgtttgaataatttgtatggagcggttatttattattttcgatggtttttttttgtaagtagttcggacgtggttcgtttcggtttaacgcgatcggagaattcgtatttttatttgtaaattaaagtaattacgtagtagatattatatgatgtgtattgtggtttttagatagttattaattatttttaatcgagttgttaaaagagtaggtagatttcgtttttgggaggtaggtttgtagttggggagagggcgaggacgttattattaattagagggtgattttggggcgatttataggtttgaatttaggaatttttttgagtaagtttgtataacgttgttttgtacggttttttttttaatttattacgggaggtcggtttagggggcgagggtaatcggggcgagtttcggtttcggagggcgatggcgtagaaggcggggaacgggttcgggatggttcgggcgtttttttgtcgtttttttgtcgtttgtttattggttttcgttttgaatttgggtaaggttttagggagggtattggtcgagggagttttggggtgggcgttcggttttttttttcgattgtttcgtgcgttttagatagaaagttgggtaaaatggataggggagggcgttttcgttaggtatttaacgttttttttttcgtagttagttttgcggggcgtcgggagggacgagtttagcgggaggggtcggggtttgggttgaggaatttgttttttcgagcgcgtagggtcgttcggtagttttcggtttagtcgcgaggggtagggggaagtcggcggagtacggtcggcggaaaggggatcggggaggaaagtcggggaggcgaggtgggggcggtgggttgagcgggaatttaaaagatcgcggtggagaagatggggcgtttttcgcgatattcggttgtttagaggtgtaaagtcggtgggcgtacgttcggggcggttttatagttttcgggtcgttagttttagggtgtcgggttttaattaaggtttcgaagtttttacgtatttgagggtattttgattagtttttgcgggttgttttgcggtcgtagtgggttttgaaagtttatttcggcgtagggtggaaatcggcgggaggcgttgttgattttcgattaaataatagtgacgagacgcgtgcggggcgtttgcgagtttttttttgttattcggagtagagcgcgttagcgcgaggtcgggtcggtcgtttgcgtagcgtcgggttaattttaattgttgattatatttttagcgtgtttttttataggttttatttgtaattgagacgaatgattatagtggggcgggaaggagtagttgtttattaattaatttttaattaaaagtgtttttcgttttcgggtgattaaagagaaatatcgttcgttgggcgatattgattcggatggaatttatttgttaacgttcggaggaatggttttttcgtttatcgcgcggtcgggattgttttggtttttttcggtttgagtcgtcggcgagtgatcggcgagtttgcggttaggtcgggttgcgcgaggtggggttgacgttagagtttttttcgttttaagtcgcgtatatttgatttgacgggttcgcgcgattcgtttttttttttttttttttcgtaaaatatgtatttttgtcgtcgttgcgaggtcgttcggttttagagttttttcgagttttcggaatgcgaagttaaaggaatcgcggcggttatcgttgtttattttgttattcggttagaaaagtttgcggagcgcggggatggattaatcggtttttttgtttcgtttttttagcgtttagaagtttgtagtttcggagtagtggtcgcgttacgtcggttttagcgcgtagaattttgtaggtttcgttcgttcgtttcgggtcgcgttcgttatgttttattcgtagtttggatatttttatttttcggttttttaggtaagcggagtttcgtttcgtttaggttatcgtaggtgtcggtagggcggatggggcggggacggggggtggggagtgttcgatttacgattgtttgcggttttcgagttagtaaggtttgggtcgcgcgttttttacgtttaatttttgttttttaaattttcggggaaaggtcgaggcgttaagaaaattcgacgggtcgggttcgggttttttgatgtttgaattataaggtttaggttgtgttttaggggagttttaggattttaaggaatttttggggaaggaggtttggcgcgtaaatggcgttagaggttttggaaatttttcggggaagggtgtaggtgttcggttgggttttacgtggcggaggaggttagacgcgtataagttagtggaaaggggcgagtattttggtgtggacggcgggaggttcgggggtattcggggtacgttttcgtgggcggcgcgcgggattggtaaggtttagggttttagtttttagttcggtttttcgttagttttcgcggtttttttttgtagtttttgatggttattaattttttgagtacgtgttgcgagttcggaggtcgtacgttggcggatttcgggttcgtcgtttcggtttaggcgtcggtttattgttcggtttacgagagtcggttgttggttatcgcgcgttacgagtttaattcggtcgcggcgttgggcgtttatgggggtttttatggcggatcgtagggttatggtaattacgtgatttacggttcggaggcgttcgttttttattcgt

SEQ ID NO: 7207 - DNA, 1233 bp, Artificial Sequence
  Description of Artificial Sequence: Synthetic polynucleotide
cgtcggttgcgtagtttagtataggttataggtcggggggtgggttcgggttttgcggagtgggcgggtttgagcgggttggaacgtttcgtcggttttatcgtaggtcggtattttagttttaggttttatagcgggtttttcgtttttattttcgcgggttttgtagggttggggttgtttttgagtttttggtaaggttttcgggagttttagttttgcggagattaaagtttttatattttcggtagagttcgggcgagtgtttcgcgggtggcggcggttgtggggtcgtttgggatttttcgtagtattgattttgtaattttttgtgtttgcgtttcgtggtgaggggcggcgggatgcgcgcgatttttttttgatttagttaaacggaaaagttcgcgcgtttcggttggaaggtggaggttaggtaggattcggtaaaggtatattttaaacgaagtagattttattttttatttgtagagggaaggcggtgtggacggatagaaacggtttttatagttatagaattatcgcggttatagtagcgcggcgttcggtagggagcggatcgtggtggaggtttttgagtcgagtaggttacgtagattcgggaggcgttgaagcgggcgtagttgcgttttggagtaggtagattaggttacggcggagggagaggttcggggacgcggcgtagtttttgcggagaggtacgggggcggcggggacgtttttttattggttgaaatgttagggatcggtttgggcgtggagtagtcggggcgagttcgtttttaggtatcgtcggttgttttaggtagggtttgtaggagtggttcggagtcgggtatcgaggtatcgaggcggggatttggaggggtaggggtcggggtagggtttgttaattaagtttacgggggtcgtcgggtggtggaggtgggatgggggaaggaggttgagtattagtttcgggcgatttaagattttttcggtttaattttaggagggaggtagcgttggcgggtgaagtcgttattttttttcgggaggtcgtttagtagttgtttttttacgtttcggggttattgcgtcgggttttggttattatttgggttttggtttacgtttagacgaggggtagcgcgattttttcgtagttttattttagcggttgtcgtcgtagagtatgaagaggtttggtttttgtagaaacgtagtttagcgcga

SEQ ID NO: 7208 - DNA, 2865 bp, Artificial Sequence
  Description of Artificial Sequence: Synthetic polynucleotide
cgttttttgttttattcgggtggatgttcgcggttttggggttttttttatgttttgattttggggagtttcggttggtattggttcgcgaaggtgatttgcggatagattagttagagattacgttggttggtcgcggcgcgggttataaagtttagcggaggtggggtaggggattaagttgtttcggcgagggaagaaattgttgtttttaaattattgcggttggaggagtcgatttgcgttttagcgtgttaggataagggcggcgcgaggggtttaggggttaaatggggcgttgggtaggaggggttgttttttgtaggggaggaggaatggttttttgttagggatttggggaaaggtaatagttaggaggggatcgggtcgtaagaagtttattttggattgtagtacgggtagttagcgcgaatttagttaggaggtttacggggatcggtaaacgagaaggggatgcggtgaggacgtcggattggcgtttttgtcgcgttgatatttcgattgtttttttttcgtatcgcgttttttagtttgagacggggaagttatttagggtatcgcgtttttaaatagcggggaaaaggcgttttgggcggcggttgagtgatcgagggatcggttcggagttaggagttgggaggcgcggggatgtggtggggaggaggggagtgggggtagtgagggggtttaaattttgcggggacgttcgtttattttgtcgttgcggttagttttttgcgttttttcgacgtttatttcgcgtcgtattagcgttcgtagtagttttacgttgttggcgtaggcggcgcgtaggagggtcgtcgttttcgggacgtttttcgggacgtttttcgggacgtttttcgcgttttcgacgtcgtgttttttttcgttttcgaaagggtagaaagagtcgttcgaggcgatgttgcgggtgtttggtagattcgagaagtttttaaatttttcgtagttagcggggtttttttcgatttgcgcgtttcggggtggggacggcggtggtggggttatgtagcgcgtttcgtcgtttttcggttcggtttcggttagtagtattatgtcggcggtcggggcgcgggtcgggggtcggggcgcgggtaggaagagcgggacgcggggcgcgcgtcgaggttttcgtttttcgtttttgcgtttttagagaagtcgtggttcgcgcgttttagttcggcggaaatcggtattaggcggttgcgtttaaagaaaaaagttttcggaggttgagcgagtttttggggtgggcgggatcgcgggggtttttcgaggcggggcggggcggggcgcggggatacgttttttttcggggtttttttttcgcgtttttttttggttagagtttagagttaggtaggcgttttttcgagcgcggggattgggtatttggtagcgttgttttagagttggggatagttggcgcgggagaagtagaagtaattattaaagaagtcgaattcgagtcgcgggcggtaagcggtttcgttttttttttcgtcggttcgcgggatgggggcggaggtggcggcggggggacgtcggggcggagtcggtttttagtttcgggaatttcggatttttggagtcggttttcgtcgagggcgtcgggttttcggatttgggtggggtcggtttttttcgtcgttttagaggagtagagcgggtttttttttttcgggggatttcgggtttcggggttgattttattcggtcgcggtcgtttggaggtcggggaattttcggggcgtttggcgggtagaggagtcgggcgcgggagcggagtcgtttatttgggatttgtgttcggggagcgttgcgggtcgggttattttgaattgggggcggtcggttgttgtgggggagttttagttcggaagggaggataatttttagagtttttcgtttcgcggaatcggggtcggtcgtggtttgagggttggttagattttgggatggggggcggggtgtttcggaattttagggagtatttgagtgggaacggacgacgaggaatttttcgtttttatgtttggtttgtgttacgtgcggggatttgcggatttattttcggaggttgcgattgggcgttgattttacgtttggttgtttaaaagagtagggtcgcgggcgatagtcgtagtttaggtttatagtttttttggttcggttttgtttttttttcgttagttttggcgtcggggatgggcggggaggaggagggcgtgtgaggatttgttatagggagtttttgatttcggggtaggaggcgtcgtgagttaattttgggggaaggtttttgcgtaaaggcgcggaggtgcgttcgcgttcgtcgtaggttaaagattgcggaggttattagttttgtgtttttttagttttttttttttttttttttttttcgattttgatagcgtgtttattagttgttagtcggtgggaggttttcgcggttttaaggtgaatatagttaggttggcgtagtcgttggggattaggtttgaggtttacgtgtcgttgggtaagttgaggggtacgagggtatcgaattcgaaatagtcgtgggaggtgtaggatgaggatacgtttaaattgcgaagtcgttcgagttttcgtgttatatcgtattggttcgattcgttgttttggtcgtttggttttttagtgtttttagtaggagttaaagggtttgttggcggttttcgattcggtatttgtagggtttcggagggtggggcgcgcgggagtatcgatttttggtgaagacgttttcgtatttgggcggttttgagcgagtagcgaattgagattcgt

SEQ ID NO: 7209 - DNA, 1154 bp, Artificial Sequence
  Description of Artificial Sequence: Synthetic polynucleotide
cgtgcgtttttaaggatgttcggtttttttttaattcgcggtttttttttttttttttcgcggttgtcgttgttgtcgcgaaaattaggagaagtggaacgcgcgcggcgaagcgtcgttttcgcggcggtattgggtatgtttcgtattcggggtcggtttcggcggcggggcggacgtttttttattagtcgggcgttcgggtcggtcgtcgaggtttaggtggaggttgaggttgtcgcgcgtcgcgggaggagtttcgttttcggcggttgaggcggcggcggtataggtggcgcgggtcgcgcgcggggcgtagttcgggagcgttcggcgtcgggcgtcgcggcggttttaggttcgcgttcgcggcgatagtcggttgagcggagttgcgggcgcggcggttgtttttttagttcggtcggttggcggcggcgttcggagtttcgaggagttcgtaggagttcgtggagttcgcggagttgggtagggggcgttgcgttcgtcgagttcggaggggtcgtcgggtcgggcgttgcgtattcgcgtcgggagtcgtttttcgttcgcggcgttcgtttttgtcgttcgttagtattttttgtttcgcggtcgcgtttagataataaaagcggaagatgttgtagttgggtaaggttaggattttgttttgaagtcgggcggcgtcgcgtacgttttttttcggattgaggagttgtcgtcggcggagggtgtatgtttgcgaggaagtcgtcgggcgtcgcgtttttgggtgagttgcggggttgggcggtcggggtcgggcgtagttttttttcggcgtcgtttttttttttttgtcgttggtgggggtggttttgggttttcggtcggtaggcggcggcggcggttgttgcggggtttttgtttgtttcggggaggatcgcgatcgcgttaggtttttttcggaagtcgttgtgtttggaagggggttcggggttagtgttttttttggagcggttattaagtggttgttttgcgtgttttttttttttgttatttattttttcgggaggaagcgtatttagggtaatatcgataatgttgtttttcgttattttgagaatatattcggtgtatttatgacgtttttaatatacgggaggagacgg

SEQ ID NO: 7210 - DNA, 1154 bp, Artificial Sequence; identical to SEQ ID NO: 7209
  Description of Artificial Sequence: Synthetic polynucleotide

SEQ ID NO: 7211 - DNA, 396 bp, Artificial Sequence
  Description of Artificial Sequence: Synthetic polynucleotide
cggcggtttttcgttttttttttatttttttcgtttttatttttattttttggtcgttcgaattttcgatcgggagtttagagttttgttagcgtcgtattgtgcgtcgcgtaagtcgttcgatttttttagcggtatcggttttaagtagtaaatatttgtgcgtttttgagttagggacgcgcgtggggggtgggcgtgtacgcgggtgggttagcgtagagtgggagtttgtgggtgtttttcgtcgggatttttaatttagttgttttcgagagtttaagttgagcgtcgtacgtgttcgtgttatttgttgtattggacgtagtttaatagcgtagagaggtttttattcggtatttagttcgatgtgggtcgtttttttttttttagcgg

SEQ ID NO: 7212 - DNA, 438 bp, Artificial Sequence
  Description of Artificial Sequence: Synthetic polynucleotide
cgaggagtaggggttgcgggtcgggtttttgttgttcgcggttttcgggggtcgcgtcgcgtcgggttacgtgggggttttcgtttttcgagcgggcgtcggtgggaaatttgcgcggcgagagatagggggatggggcgtttttgacgcgattgtggggtgcgggtagttttggaggaggatgttcggttaagtttattttgtttaggtgtcggatttttagtttaggttgcggtttgttttgggttcgtgaggcgaggtcgtagcgtttcgacgtcgggtgggcgtgtgggtggagtggagatttgggtttttcggcgtatgggagtttcgtcgtttgcggtagggaatcgttttttatttttggttcggttcgggtcgggagtcgtgtttcgcgttgattcggtgtaattttttagtttatttttttttacgcga

SEQ ID NO: 7213 - DNA, 438 bp, Artificial Sequence; identical to SEQ ID NO: 7212
  Description of Artificial Sequence: Synthetic polynucleotide

SEQ ID NO: 7214 - DNA, 411 bp, Artificial Sequence
  Description of Artificial Sequence: Synthetic polynucleotide
cgcgtttcggttttcggggagtcgttttttagatttgtttattcgggagtttttttttcgcgtattttttagattttttttgagattcgagagcgttggtttttttttattcgcgatagttttgggatgatagtgcgggtttttttattcgtagtttttattatttggcggttaggggttcgcggttcgggcgggcggcgttagtgttttttggagttgggcggggagggcggggcgggcggagcgggtatggtggggtgtcgggggtcgtaggcgtagcgttttcgttttggttatggagcggtcggcgttcggcgaggtggttatgagttaagttatttagtcggcgtacgttattgcgcgcggcgagttgagcgcggggtagttgtttaagtggatcgatattatcgt

SEQ ID NO: 7215 - DNA, 1137 bp, Artificial Sequence
  Description of Artificial Sequence: Synthetic polynucleotide
cgcgtttgttaggtttagatttatacgtacgtcgtttttgtttgtatatagtgcgttttcggcggttcgttcgtttttttttagtttacgttttattgttttttaagttagaagtttcgtagtcgtcgcgcggagaatagcgatagtcgagcgttcggttcgtttgtttgtcggtgggtttgtttgttcgcgtagtagattcggggcggtcgcgggagttcgcgtttcgttcgtcgcgtttttgtcgggatttattcgtagcggagggttgagttcgtcggcggtttttcggagtttatttattttcgcgcgtcggagcgtaggtaaaaggggaggaaaggtttttttttttagttattattttcgttttttttaagaatttgtttaataaagcgttgaggaaagagaacgtttttttgaattttttagtaggggcggagtttgttgttgttttgcgttgttatttcggttatattgtttttcgcgacgatttttgattagtcggggttacgttcgggagacgggattatgaagcgttcggtagtcgtttggtttttggtcgggtttagtttcggtgttttttagttcggtaaaggtaaggcgtcgggattcggatagttgggtgagggatgggttgggagttttttgagaaacgtcgcgtagggggtcggaggcggttttttcggcgtgttaagggtggcgagcgtcgttggcggcgcggaggaggcgtcgagttttgggtgtttcgagaaagtgtttgtaaagtttgagtagagtgcgcggggtcgagcggggagaagggtgcggggtatcggggtgagatataggaaagaggaggacggtggggagcggtagaagatagcgtttttaggattagcgattttgtggtttattcggttattgggtttcggcgtaaattttttttaggtagtgcgggcgatgttgattgtagacgtcgggtagggttttcgtgcgggcgggagcgggggaagttagtgcgttcgggcgttagttagttgatgcgggaagaggttggggagttgtagggtcgttcgttttcgggtgcggtgttttggcgtagggtttgggttgagtcgttcgtaaatttagattcggcgttgggcgttttggtcgcgg

SEQ ID NO: 7216 - DNA, 2383 bp, Artificial Sequence
  Description of Artificial Sequence: Synthetic polynucleotide
cggattttttaggatcgcggcgtcggttggttgtttcggtttttcgcggtcgcgtgagtttttttttggtggtggagggcgtattttaatttggaaatttttagtttttaatttggtttcgtagattgacgtcgttttcggtggggcggtgggggtaggagggtaaaggggaggtttttttttttttggattgaggttgtaattaatagtttcgtgagtttttatttttggttgattgcgaatttttttattttaggttaggggtcgggattttatagaaagattcgtttttatttttaattttgcggtttttgttcggcggggaagtttagttgcgggttagtttagttgcgggttcggttaagtttggcgcgtttaggtattttagtttttggttcgcggtcgggcgaggacggagggggaggggaaggggttgttgtttttttttttaaattcggtttttaatcgttttatttttcgtcgtttattcgttttgtataggtagttaaaatagagttagcggttaattgacggggacgggaagtaaagtcgtttagcgtttcgttttttttagtcggtttttcgggttttttttttcggcgttcggattttggttttttttttttttttttatttttttttttgttttaatttcgtttttatttttcgtttattttttttcgtattcgggttcgttaatttttttttttaagttttttttttagttcggtttttttttcgggttcgttttttttttttttaattttcgttttttttttttttttcgtttttttttttttttttttttttttttttatttaattttggtttttttcgttttttagtttcgattttttttttattttgttttcgtttattttgcgtcggttttttagttcgggttgagttttacgtgtggacggtcgcgtttttattgatagtcgtcgttcgtcggttcgtttcgcgtttcgtcgggtttttaaaattttcgcgtcgcgttttttatcgtcgtattttttttagcgtttagtttttcgtttttttttttgttggtcgtacgtttcggtttcgcgtattttcgttcggtttcgtagtcgttattcgcgtttcgttgttttgtgggatttcgagcgagttcggagggaatttttttttttttttgggggcgatttttgtttgtttgtttgtttttttttggtgatttttgtagttttttaatattcgttttcggagcgtacgggaattcgtcgagttttgcgtgtaggttttttttttttttgaggtttatattttttgaaattttacgttagggtttttgtaattttttttttcgttcgttgacggttttggagtcgttcggggttttaggtcggttatgtaacgtgtatcgttcggggttgtcggttgtattttcgtcgcgtttcgtcgtttattgcgttagattcggcgtttcgcgtttcgtttcgtgggtagttagggggtcggcgttttgtcgaggtttttagttagagtagggagttcgagttcgagggagttttcggagtcgacgaagggtttattagattttgatttttttttgaggcgcgtagattttgtttttgattatttttttttcgcgggtttacggtcgcgcgttttcggcgtcggcgatggggagaagacggaggttgtgtttttagttttattttttgtggttgggttgtgtggtgttttgggcgtagggtacggtcggttagttttagtttttttcgtttaagtcgtttcggttttagtcgtcgtcgtaataggttcggttcgttatagtaggttttgaaggcgggtttttagcgttcgagtatcgcgaggagggtgtcgtagtggttagtcgcgttcgtcggcgaggatagtaggacgtgtttcgagggtaagtgggtaagcggtttcgtatttagggtttcggtttgggggaggggggaatttttagtttggcggttttttggtttatttcgttttagattttttagttggagtttagagttgtagttttttttgttagaatatttaaagatttttaggagcgcgtttttttttttttttttaatttcgtagtttagcgggcggaaagtttttttttcgggggttgggcggcgggtggttagggggtttaggggtgtcgatcgtagagcgtgtgtagagttcgcgttgcgggaataggttttgaatgttcggcggtaggcgggtttgggttcgtttgttgtaggggttagagaagtttgtttgttttttacgtcggggtcgtcgttcgtgagttttttgtttgaggacgtgtgtagggtttatagtttatttttttatcgttaattcgagcgttttattttgcgacgcgttttttttgatacgtcgg

SEQ ID NO: 7217 - DNA, 2367 bp, Artificial Sequence
  Description of Artificial Sequence: Synthetic polynucleotide
cgggtcggtttttcgtttcggaggttggggagggggtcgtgggtttttgcgtttttaggttaagcggttttggaggtacggattagtaggacgtcgaggtggcgcgggtcgcggtttttttcgtagtagttgtcggcgagaattaggtagggaggcgtcgttgttgattgtattttatgaaagatttaggttcggttgtcgcgttgttatttttcggtattttgcgtcggaaacggtcgttttggagttcgtggtcgtcggcgggtaggtttagtcgttttagtttttgagaaaggtaggttatagttcgatttgttttgtggttttattttataattttaatagtaagtaggtttaggttgggtatttcggggtattaggagtaggttcggttaattggtttttattatgaggtttcgcgtatagggttatttggttacgaggtaacgttggggagttttgtggtttgagggtgggtaaaggataggtttttagtttttttgcgtttagttcgttttttagcggtagttagttaggaacggtttgcggggttataggggtggaggcgttatcgttcgtaggttcgtagtaggatggtcgttgggggatgtgtaggtataggggttggataaggggttttagaagtgtttgttttgaggggttggtgtgttttttttttattagtttagtttttgaggagagggaagaaggtaatttttttaattagggtaggtcgggcggttgttttattttaatattttttatttttaaatatagaaaatttggggtttgtttttaaatttttttggttgttacgttttgggtagcggattttttttgttaatacgtaagattagttttttttcgtaggttgagtagaaagaagaaaggtttaattttaaaattttaaattcgattattagttttcgtttaaacggaagtagggttagttttttacgagttaggtgggaaattgggtttagggagagaaagtgttttagggttaggttgggattcgttttggtttcgttcgtatgcggtagggtttttttacggaggttttagggcgcgtttttcggtttcgaggttcggtcgttagtcgcgcggattttagtttacgtttcgagggaggttaggatttttagtcggcgggattgcgcgtcgttttttttttcgtaggtttcggcgaatatttagttttttttttttttatttttttcgtttttcggttagtgttttcgtttttttcgcgggcgacgggcggcggcggcgggaggagcgggtcgagtcgaggaagtttcggtttcgcgcgttgggatgtagcgaattagtaggggtcgaagaatcgtgtagtgttagagttagagttggattcggggttttagtcggagtcgaaatttgagttagagttcgcggcgggcgagttcggagtttacgagtcgtagacgtagcgttgtttaggtggggtaagagacgttgggttaggggcgtagggttttcgcggtggaggggcgtagggaggtggcggtcgagttttgcgtagtttgtttttggcgtgtgtgggtttattcggcggcgcgggatagcgtaaggcgcggaaggttaggagttttcgaggtagcgcgaggagttcgtttttgcgtttagggtatagttatagtcgtcgttatcgggtgttattttatttaatcggcgggattaattttttgttttggtttcgggtattttaagagggtagtagtttcgggggtacgggttacggtttcgcgaagggtataatttgagaagttcgtggtagtttttcgtagcgtcgggtgatatagggtttttttatttttaggagaagtgggtaggagagagggtcgttcgttgtttttcgttgcgtttagggatggagggttttattatttatggaattgttggtttttttgcgtggttcgggattttagtcgtggtttcgcgttaagagggtattttttttaaacgaaatcgtttcgttcgttcgttcgttcgttcgttcgggtagtaatgtcgtagaaaagtagtagacgtcggttcgcgttttggtttttttcgtttcggatttcgacgtttcgtcgtagcgttcggaggtgtttttagtttaaggtagtttgttttcgtcggtataggtcgggttttttttttttaggagagaaattttaatttttttcgtaacgtttaataaagatattttcgcggttttttttaggtttggttgttgacgtagggtttcggagtacgtagtcgttttttaagaatcgggtttcggatttttgaaattgattagtttcgtaaattggagtttattttttcgcggtaaaggtagggttttaaagtcgggatcgt

SEQ ID NO: 7218 - DNA, 1235 bp, Artificial Sequence
  Description of Artificial Sequence: Synthetic polynucleotide
cgaagtttagtcgatttttgattgttagtatttcggttataaggtttaaggcgaatagttgtcgtacgtcggcgcggttgtggttgtcgaaggagtaaataattttatcgttggggtttttatttagattcgttgtaaggatttgtattacgcgcgtgtcggagggtgtattttttaggacgcgcgttcggtataaggattggttgaagataggcgtattgttattcgcgtttagtattttgatgtgaataggtaggttggcggagagagttggggttttttcgtttaacgtcgttagtattaattggagattaggttttcgttttcggtttagggcgcgttttaatattagtttcgcgtatttggtgttgttttttcgcgtttgtacgcgaagcgtaaagtatttatttcggtttagtttataggtttgtaaagagttgttttttatatcgggatcgtgcgcgttttcgagcggaaagcgcgttttcggagttacggtttcgttaatttttaattttattttttgggtagggaaagtaggattgttgtcgttgatgttttggattattatttttacgttgaatagttttagcgggttttttattattaattttagagttatagtgtaagagggtagtgttttatatagtttttttcgatttagacggtcgtttataaatattttttcggtttttcggtttattttaaagaattttcggttagttttagatattattcggaatttgcgggttgagaggttatcgagatttaaattaaggttcgcgattacgttgtttatagcgaaatttttttttttttttttcgggattttatagtgaatgatcgtggaagttttgtttaaggtattaagtagaagtaaaatttttattattttttcggtgtttattagttcgtttttttaggtttttgggattattttatttaaaagtagttttttttagcggggtttagatcgtttttgagatttcgttgagaaatttttagcgggttagcgtttgggcgttgggcgtcgagttcgatatggttttttggatgtcgttgatttgttcgtcggttgtttagtttttgttttatttcggggcgtagaaaggggacgggtaggggttcgatttttagcgtttttattggtcgatagcggtatatagagttttagttaataattgtacgaagaatgagttagcgtcgggttttttgagtaggatacgcgttagcgt

SEQ ID NO: 7219 - DNA, 3043 bp, Artificial Sequence
  Description of Artificial Sequence: Synthetic polynucleotide
cgatttaggagagttcgatacgtcggatagttgcggttagtcgtggttattttggtttttcgttttcgttttttttattttcgcgtgtagtcgggatacgggaaaggaaagttttggaagttaagcgtcggttaaaagatgatttgttcgcgtgttttttcgtttttttttttagtcgtgttatatggcggttttaattaggcgggtagtgcgtttcgtcgcggagatttagggtcgcgtcgtttgggtagtgggtgatgaaattttttaggcgtattatcgtagagggcgcgggcggggcgcggggcgggggtgggggatcgagagttggtatcggggtttatttgttttttaggaggagggtggggacggggggaggggcgagtgcgcgttaacgtcgggtgcgtgttttggggcgtttgggcgcggcgttcgtgttttcgtttttttttagttttgcgagtttttcgagttgcgtcgtggggtgacgggatcgagagtagtttttgttttcggtttcggcgcgggggagacgtgagcgtgtatacgtatatatatagtaggggaagaggcgttttaagcggcgtttaattttttttttttttttacgggtcgggtgagaaagtagtcgggggttatttcgattcggcggtttttggggagggggtcgaataagaaaagggaggagatggagataattttttcggatttagtttttttgtttttgtttttgtttttattatttttatcggatgattggagagtaaaagggaattcggagcggggtggcgagtagcgttttgagaaaatgtaggagtgtgtttggagacgcgtaaagttgttttttaagttttggttttcgggtacgcgatgtttcgcggcgggttgatttagggttgttttgggtttttttgttatttttttggaaatgatgtaagttttgattgttatttggatttttgtagtttagtttggaatgcgtttggattaggggaaagacgagaaacgatattttaggtgttgtacggtttattaaagcgggaagatagggtagttgtttagattaaatattgtatttagtgtttttgtttttatttttaatcgtggggttttttttaatgtaaagtgttataaggttaggaatttttatgtgtgtttagttggtttatagtattattgtgtttaggaaattgttttaatttattaagttttttgggttgggaattttattgaattttaaacggcggaaagaggaaatttttttaattcgatgtgggtgtgacgcgagttaggggttttagggatattgttttagagtatatcgtttttttttaatagtaattggagtttggattcgtttttatattgtatagttttttcgattattgttttggagtattcgtatacgcgtacgtattttcggtcgcgtttatatatatttatatatacgtacgtaaacgcgtggtcgtcgttaggtcggtaattttgttcggcgtttttagcggcgttcggtttttttttgtagtagttgagcgtaggtttcgtttttcggtcgtgttgttaaaagggtcggggtttcggattggtttagtcgtcgggataatatttgttcgatttttttatttaagtgatattagagtttttagggatatttgaggtattatttttgttattgtcgggtattcgcggcgttgttaacggtttggttatatgtttttcggagagttacgggagggcgttgggtaatttttattcgagtcgcggtcgcgaggaggagggaaaaggcgagtaaaaaggaagagtgggaggaggaggggaagcggcgaaggaggaagaggaggaggaggaagaggggagtataaaggatttaggtttttcgacgggaggttaatattaagaattatgtgtgtcgagcggttgggttagtttatgattttggttttggtgttggttatttttgattcggcgcgggggatcgacgttattaatttattcgagggtttttaagataggagtttttagtagaaaggtcgtttgtttttgtagaatataggtaagtgtatgtgttttcgtagtcgggagttattgggagaggatatcgtgtatttacgcggcgcgttttaggcgtttcgtcgggagttaggcgtttatttagggttacgtaaatttttgggatggtacgggacgtgtaaagggaagcgcgaggtaaggcgaggttcgcgtcgggtttcgagggttcggaatttgtacgtgttagtagggtgatgaaatggttggggtaggatttgttgttgttttttttagggtcgaggggaaatgaagtagcgtttgacgttgttagcgttagttttcgttttcgaatttcgggttcggtgtaaagcgcgttttatttcggtcggtacgcgggaggtttagagggttttcggagttgggttgcgttttgcgttcggagaatttttttttttggtttgtcggttttagtaagggtgtcgcgttttttttttttttaaaagatgttcgatattttagaattttgtcggcgagataaatggtattgcgaattttttttttgggggtattgttttcggaagggagcgtgagggtagcgtaaagcgtattttcgcggtgttgtcgttatttttagtttttggttaggttagtaagttaagaaatggtgatacgattcgaatcgtgcgttttttttgttttatcggtttttggtttatcggtaagttgtaaagtagagttaggcgtgtagggtacggggttggttttttttttagttcggaaagagaaagaaaatttgtttatagttttttcgttttacgatttttttttcgattttggggggtcgtgtgaacgcggtagcggcggcgtgcgtgcgtttatcgtacgagttggaatgtacgagtgtttattagggacgttttaagtgagtgaatggcggttttgtgcggttttgtttcggcggcgcgtggggttttacggattttgtcgtttttatatgttggggtcggtatttttattatttcgagattttcgt

SEQ ID NO: 7220 - DNA, 864 bp, Artificial Sequence
  Description of Artificial Sequence: Synthetic polynucleotide
cgcgatttaatttttaattcgcgatttaatttttaattcgtgatttaatttaaaattttcgatttaaattttaattcgcgatattaagtttgcgatttagtttagaattcgcgatttcgtttggtttattttttagtagcgatattggcggttttcgattttttagatttagtgagtttcgtaaagtcgttcggttttcggaagtcgtaggtgtaggcgtcgttgggttcgcgggtttttttggttggttcgggttgttttaggattacggacggaaaatcgtaggcgcgcggtttatttcgttttaaggggagggttcgtttggtcgtgtagttcgtttcgttttttttttcgaagagagatttggtgttggtatgggtatttcgcggttatcggagtggtttttcggatgagtttggtttcggcgttgacgttttggttttgggggttgtttggttggtgttaggtagcggaagacgtttggagagttattcgtttttttttttattcgtttttatcgttgttcgtgttaggacgcgtagtttgtagttgtagtttaggtattggcgcgggatggcggagttttttttggatggcgttagggttatcgagtgtatagtttatttggtttgagggtttgttttttttggatattttttcggattttgatttttggcgttgggtaatttataggatgagatttatcggttgttggcgaagtcgatcgtttgattttgttgtttgggcggttggtttcgggattcgcgttgttggggacgcgggtttggtttgcggtgtttagttatttgttgcgggcgcgttacgtttaggttggtggttgtagtcgtagtttcgcgtttgcgg

SEQ ID NO: 7221 - DNA, 2071 bp, Artificial Sequence
  Description of Artificial Sequence: Synthetic polynucleotide
cgttcggtcggcgtcgtttttcggaggttgtgtttttggggtggttggcggcggggttttttcggttcggttcgcggcgtttttttgtcgtcgtttcggggtgtttttgtttcgttgcgagttcggtatcgcggcgacggcggcgcgaagagggaagcgggcggcggcggcggtcgcgttaagatgcgtcgggttatcgtaggttgaggcgttcgtcgttttcgttttttttttcgttcgtttttttttttttcgtttgtttttttcgttcgttcgtttttttttttttttcgttttttttttgcgttttttcgttcgttttttcgcgtttcgtttttttcgtttcgcgttttgcggtgttgtagttgcgggcggttttagttgtttttagatgtgggttgggcggttcgcggggaattttcgcgtcggttgcgagtgcggggtttcggttgtagttcggttgttatggattcgtcggcgggagtcgttcgtcgtttgttttgtttcgtgttgttgttgttgttgttgttgttgtcgtcgtcgtttttgtcgtcgtcgtcgtcgttcgcgaacgttaggttcgtcgtcgtcgtcgattttttaggtaggtgcggttcggtttttatttttcgggattttcgtcggtttggttttgtttcgcgtgtttcgtcgttttttttttaggcgtcgtttagtttgatttgggtaaatttcgcgcgtttcgttcggggttaagttggttaatttcggggtcgggttggtcgcgtagggggcgtttcgtatcgttttcgagcgttttgggtcgggggagtttcggagtattggcggtttttgagtcgcggagggtggggacggagggtcgggaaaagtttcgcggttaagagcgtagagttagttttagcgggttcgaggggggagttagggcgaggcggcgtcggggttcgcgttcggggacgtttcggaggagtcggttgtcgagcgcgtagttttgggttttaaggattggttggggcgtttcgtagggaattttcggagatcggagggattttgttttattttttttagttttcgggcgttcggggagacggggtcggtagcgggttgagcgggagttggataggtaggataggtcgttcgtgttcggggaagtcgagatttcgtcgtttcggaggttggcggtgagggtattcgggcggtaggggttcgtcgaggggtcgtggtatacgggtaagggggttaattcggaatggttttcgagtagttttacgttttgttaaggacggtaggtgtaagggtcgggggattttttgacggggtcgttttttcgggtacggggaggtttttatcgagttttaattttgaacggggtagggggtagagtttttggtaggtaaggttttcggaggagggaacggttggggagtggcggagtttcggagtggtggttttgttaacgttttttttcggttgtaggaaagtcggggaggtgtaggttggtttttggggtcgtttggcggaatgtttttttttttcgtagtggggcggggtttgggggggcgtggtttgtcggcgggtttttgaggtattggggtttcgtggttttcgtcgatttaacgttttttttcgttgtaggcgggtttttggggtacggagcggagcgtattttggcggtgttcgtgcgtattgacgtttagggtcgtttggtgttttacgtggtgtcggtagttacgtttagagtaggggtacgagttcgtagggtcgtttcggttcggatttcgagttttttcggaggtaacgaggaggagtttggtagttattttttttataatgttacggtttttggtcgagatttgtatttgcggttgcggtttaacgttcgtttcgtggcgttcggggttattatggagtggtagggcgagaagggtattattcgcgtggagtttttgttcgggagttgtttttacgtcggagacgtggtcggtttagtcgaagttttttttgtggcgtttagtaattgcgatgggttggtgagtacgtatttttttagttttttttttttcgttgttttcgt

SEQ ID NO: 7222 - DNA, 1170 bp, Artificial Sequence
  Description of Artificial Sequence: Synthetic polynucleotide
cgagttcgcgttaagagttacgtcgagacgcgtcgtcggtggggttacgcgagatgtaatcggagagtttaaaattagtttaggattaattttttagggattcgtttaatttttttcgtagaagagtttaagtggggtagtggtcgttataggttgaggatgattttcggacgcgttttaggcgcgatcgtattattcgtttttagtttaaagtttgagtgatttggtattatttttttaattgttttttatttttttcgtatttttgttgtgtttatcgtttttacgtatttgagagtttaaattatgttaagacgatttggagaaacgttcgatttgttttttaagttacgtaaggatttatttagacgtacgttcgcgcggagacgtacgttggtatacgcgtttatatacgcgagtatatatacgcgtatattattcggttcgtgcgcgcgggtcgttgtttttgttgtattatgtaaaggtggttgggaaagcgcgttgatttatatttatatagtttattttttttttatagtatgtgattaatacgtatttcggggaggagggagcgcggttgggggtgttaatcggaagggaatagatagtgagtgttattttgttgggaggttttagaagtaaagcgttaacgacgatagtagcggtggttttagttttattagtaattgtcgttggtaggagtattatacgttttaggagtttttcgggtattaagtatgggtttagttcgttttagttattttttttttttatggttttattttcgttgttagtatttcgattttagtttgtaattttgattttgggtttgattataaatgacgaaagatcgcggtagtttttaaagtgcgggagcgagtttcgtattggttagcgcggcggagggatttttttaggaggttttaagtttttaagtttgtggagagatttggtaatagttggtaaggtttgttttagttattttcgttggttttttgtttttgtatttagcgtttgagggcgttattcgttttttttttgcgttttacgtaagcggtttaaggaatttattcgattcggatttcgtttcgtatgttttttaagttttcgttattttcgtaggcgttttagaaaggcgtgatggttttagtttagtgttcgttagttcga

SEQ ID NO: 7223 - DNA, 2168 bp, Artificial Sequence
  Description of Artificial Sequence: Synthetic polynucleotide
cgcgttataaacggggatttaatttattgttcgatttttgttagaggcgatttatttgcgtttttgttatcgtattttcgttcgcgtttttgcgttttaggtttttcgttgttttttcgttttttgtagcgcgggagcgttgtttcgtttggtttgttggttttttttagattttggttatttttttcgtggtaggaagggttatatgtattgatagatttttcgttggtggtggttgggtggtggcgaggcgtgttttcgggcgcgtttaaaatttagtagttttttttaagtagtagttttttttatttcgtttttaggattgaggatttagttttcgatgtttttttattttttttcgttttatttcgttattattttttaatttttttagtatatttttaagttttatacgggcgtttgttttttttttgtattttttagttttcgggcgtttcgttcggttgaagtttacgtattttgggatttaattgtttttaattattcgcgtagtttaagtttcgcgtttgtttggttttcgtttcgggagtttgaagttatcgggtagtttattgggtgttttcggggaaaaggtttaagttgtagagatgagagaagtggggttgggggaggggagaggttttagaaggaagattacgaatacgtgcgaagaaataaaagttattacgtgtgtacgcgcgcgggggtttaagggcgcgagcgcggagtacgttttagggggttagggatagtggttttttgtagcgggtatagtagggggcgcgggtatttatacgaaagcgtggtagatgaacgtttagtcgcggggtttttttagtacgttgtataggtagttttgtattcgtcggtatttgacgttgcgtcggtagttttggttattcgtgtaagagagcggtttttttagtaggtttattcgggttttttgtttgtttcggcggtttttttttaggttatcgtcgtcgttatcgagcgtggtcgcgcgggtgtttagtagtagtaggtcgtcgtttttggcggttgtcgagtttagtagtattttgtttcggtcggattttatattttttatgtcgttgtttaagcgtttttcgttcgtcgtcgtcgtcgttgcgtcgttttttatttagagttcggcggcgtcgttttttttttttttcgcgtggtggcggggtatggtattattacgggtatcgcgagggggtcgttagcgtttgcggcgggggtagcggttttatgtgcgtcggcgggttttaaggaggaagtcggcggtcgacggggcgttcgttagttagagatttttgagtcgggggcggggaagtaggtagttagtaaatcgttcgggtttcggggcgggaaaggaggggttgtagaggaggtcgaggagttttaatttttaatagtttttagtttcgaattttaaattcggatttgtttggggcgttattttgagagggttttttttgtttttttattttcgcgattattatttttttttttttaaattgttttcggggatagagtgggggagtgcggggcgtttcgaggcgcgtttttacgcgcgtatatttagttttaggtttttttttttttttttttattttttacgttttgtagcgaaacggttttagaagttttttttcgaggcgcgagttcggtttggttttggtaggggttttgtagttgttcggaaggtgaagttagttttgtgttttgaggagaaattggagatgtaggtcgttgtgttttttcgttgttacgtcgttgcgtcggattttgttattttttcgtaaggggtgagagcgggaatagttttgttttgttttttaggtattatttagtttggaggttggagcgtaaggtaacgtttcgggaagtggtattcgggttttcgtatacgggcgagtttttagtagtttagtggatagattcgtaggacgcggttgttaagttcgcgaggtaaggattaggtattttttcgcgttttattttagtttgcggattgtgattttttattttagtattagataagttcgcgagtaattgaatattttttttagtttatgggtggggtgtggaaagggcgtaaaattttaaagtggttttttcgcggtgagcgagttgtttcggggttttgtttgattgtagcgcga

SEQ ID NO: 7224 - DNA, 2053 bp, Artificial Sequence
  Description of Artificial Sequence: Synthetic polynucleotide
cgggaagatttggaggtcggtaaaacggagcggtgcgggatgatgtttgggaatatcggtaaggtgttataaaatgaacgttaaggcggttataagaggacggtcgggaatcgaatttagcgtttagtacggggtttttgtggtcgacgtgacgtggtttcgttaggtggaaatcgtgcgattttttttcgatttaatttacgagagataaagatgtttaaataattacgatcgtcgtcgtatattttgtagggtttcgggggcggaggggaggggagcgttttttcggtagaagcggcggtttaggtttgtttggaggttcgtaatttattatgataaatgtaaagattaattaaggtttgattcgtgtatataggaggtagacggcggttgatagtggaaataattaacgagtatgttttttaatttttgtcgcggttgttgagtatatcgcggttttttaggcgttcgtcgttgtcgttttcgagttttagagtttttagttcggttttggagtggggcgtttttttttagcgaaaaggtgcgaggagcggggtttcgggtggtcggggagggggcgcgtcgggtcgggaggcgcggagttagtcgtttacggagtttaattgtttgtatcggggatcggcgggcggggcgcgttcgagtggtttcgtcgggaaagggcggcgggcgttggagaaggcgtttggcgcgaagttgggcggcgtttcgagggcggaggataggtggtcgcgcgatcgtagttaggtagcgaacggttcgggggttgcgtagcgcggttttaaagtttagttcggtttcgggtttagttcgttgtcgtttgttacgggagcggttttgcgcggagggagggggcgcgagatcgtattttcgggttcggcgcgtttcggtttttgggttttcgtttttttttttttttcggtttagttcgttgttttagacgtgattttcgcggaaggtgttggcgatgcgcgttgttcgggagcgtgtgattaatggtttcgaggtcgtgggcggcgtatgtattagtttttttttggtttggttagggtgtgagggtattcgggagtatagcgaggttatggtagcgggggttttcgggagcgcggcggtggaggaggaggaggaagaggagaagtaggtgacgcgggtcgaagaggtttgttttttttggttttagggttggcgtcgcggcgggtttttcgttttaagtaaagtttggggttacgggcgttgcgtttaggttttttttcgcgtagttttttcggcggggtttgtgtcgtcgtcgttgttagggtaggataaaggtttattaatacgtgatgggatcgcgttttataaatgggattggagcgagagggagttagagatagcgcgagcggagggagcggtagggattgcgcgagcgggacgaggcgacgggcgttcgggttggcggagacgggcggttttacgtcgggttaggcggggttcgcgggaggatttagtgaagagtttgggaaggggcgaggttcgtcggcggtcggagtagcggggcgttagtttcggtcgttgtcgcgggcgggcgttggagatcgggacgtcggcgttcggacggattgatttgttgatcgttcgtcggaggtatattttattttattttatttcgtttcgttagtagttcggcgtcggcgtcgtttttcgtacgttattttttttgttattttttttttttttatttttttttcgttttcgtttttttttgtttttcgcggcgttagcgtttttttttggttcgggcgggggtttcggttttttgtagagtttttcgtagttagtgggggatatttcgttttagcggataattagtttttgagttgggcgagaggtgttaagggagtttttgtttcgaggattaggggatgcgaagggtaagatttggtagagttgcgtttggaaatatttttttcgtttttcgttttttcgggtacgattagtgtggtttttaagtgtttttcgtggagtttttatttcgtgtgagcgaatcgtgcgtcgg

SEQ ID NO: 7225 - DNA, 1679 bp, Artificial Sequence
  Description of Artificial Sequence: Synthetic polynucleotide
cgttttttttcgggaagattcgttataagtcgcgtttttcgtcgtttttaatttcggggtcgttttggtcgtttgtgaagtagacgtttacgttattgtcgtcgtttttgggatttttaggtttcgggggatagtcgggttcggtattcgggtcgtcgttcgttttggcgagtagattttggttagggtggcgggatttgatatgtcgttttaggtttcggcggcgtataagtattttgtcgtagaattcgtagcggtagggcgtattgttttcggcgtgtagtcggatgtgtttgttgagattgttggggtcgtcgaagggtcgtagatagattttgtatttgagtggtttgtagttcgtgtgcgttcgtatgtggattttgagtttatatttgcgcgagtatagtttgttatagtagaggtataggtggtcggttttgggtttatttgcgtcgttgttttcgttgtcgtcgttttcggtgtttttcgtcgtcgcgacggtcggtggtaacgttttcgagtttaggcgttcgcgatttttttcggtagttatttcggatagttgttgattgtgtatggcgatttttcggtcgatgttggttagcgattttagttcggcggggtttagggcggtcgttgtaggttcgttgaagtaggagatggatttcggatattttagtagttcgtcgaagtgtaatttgagcgggtaataagcggtggtggtcggtgagtcgtagagtagtttttcgttgtagattgtaaaggtcggtatgacggcgggtaggtggttgtatttattattcggataggttttgagatcgttcgggtcgaggggcggtagcgcgtagcgttcgaggggtaatttcggcgtagggggtagttgcgtataacgcgtttttggtagcgcggcggttgcgggcggggcgcgttttacgtgtttgaaggcggacgtttttttcggggggacggagagtagagggaagtcgcgtagggttttagagtagggtaggttaggcggcggcggcggcggcgggtttttagcgagtaggtatttgggatggtggtggtggtgcgcgtggtggtgatggtggtgattcgcgtcgttcgtcgtcgagtttttttcgttttcggggcgttcgtacgttcggttttcgtttagtagtttgtttaaagcgaggtcggttttttgtttgttgttgtttttttttcggtaggggtcgtcgtgagcggtcgtcgtcgttttcgttaggtcggcgggtttgaaagttgagcgtacgtcggggtagaaagttaggttgtcgattttcgtcgaggagtcgtttacgatgtcgaggaagtgtttttgttttcgggcggtttcgtttatgtttagggtacggtttagttgttttttgttttttttgggttgtttttatttgtttggggtcggcgaggtggtcgagggcgcggaagaggtttcgcgtttgatgttttttcgcgtatcgtaggtttgaattggtggcgggtttagggggtggggtcgtaaagtttttgtttgggaaggcgcggcgaaatcgggcgtcgggggttttggggagagatcgaggttattagtcgttgggacggcgttttggcgagtcgcgtgttcgtggtgtaggaaggcgtcgtttttatcgtcgttgaatacgtagtggaaacgt

SEQ ID NO: 7226 - DNA, 1474 bp, Artificial Sequence
  Description of Artificial Sequence: Synthetic polynucleotide
cgcgtgttagaagtttttttcgcgcggtttttttttttttttttttcgtagtaggaggtttgattttcgcgttttgtattcgtgtggattaaacgtttagtttttttcgttataatcggacgggaattcgcgcgtttttcgggttattttttgtttgtgttgagttatgggcgaattttttaaaaaggagatatacgagtgggtcgtttaattttgaggggaaacgaggatttttttttttatttttttttttgatttttttttttattcggatcgtatttttcgaattattttcgtaaggaggaacgacgaatgtcgtcggttttacgagattgtcgttttttatttatgtttaaataaggatagaattttgtagcgaggcgataagaaaataaataagcgggcgttttaaatcgagttttcgggtgtgtagattcgtagcggagtcgcgggagcgaggtgggaaattttggtcgcggcgtcgggtttcgttcgtcggggggcgcggggcggcgggcgtatgcgcgtgcgcggtgcggttttagttttggttgtcgtcgtttgtcgtcgtcgtcgcgatgtttattttagttaaagcggttgcgggtttggggattcggttcgggtagcggagttttcggattcgtcgattcgtcgaggagcgcgcgtcgggttttcgtcgagtagttgagttcgtgtgtttcgcgtttcgcgtttcgaagttgtcgtttcgaattttggtcggcgttgtttaggtttttcgttagggattagtcgggtaaggatgggaggcgtagttgtagtcggtttttttttcgcgtcgggttgtgtgcggtttcgcgtttttttggttaaatcgggaagcgaaagttggattttagtttttcggggagtaattttgtcggttttggcggtagttgtttgttttacgcgttcgggtagtcgggggcgtcgttttttgttttttttcgttggtcgcgttttcgaggggttttcggtttttggaggtcgttttttttttcgggtttgggcgttgcggttatagagatttttaacggttagcggtcgtcgtttaggttaggtagttttagcgttttcgggttttcggttttatcgagtgtcggttttcgcgttttgcggcggtaagttttttggtgagtttcgtttttgtttttttcgtcgagttttcggggttttttttcgttttttgtagggtcgtttcgagtcgcgtagagtttgcgtgtagtcgggcgcgcggtgtcgtttatttcgttttcgttcggagagtagggtgggttacggcgtttattttttattttcgcgtttcgagagcgtttggtcgaggaggatcgttgttacggattttttttttttaaggagcgaggttagagggtttcgggagagcgtcgatggttggggattcgaggttcgcgttatttattcgtaattttttttttcgagtttttgggaacgg

SEQ ID NO: 7227 - DNA, 675 bp, Artificial Sequence
  Description of Artificial Sequence: Synthetic polynucleotide
cggtttcggtaattttcgtatttcggttgcgtcggtcgtggtcggacgttcgagacgcgcggaggtatagtagattttggcgtataggttatgtcgtcgtaaacggggggcgcgtatttttttttaaagtttttagaggagatacgtatttggtggtagggggtgtaggcggttgcgaagtagggttgcggaggattatagatttggtatataatatttagatagtttatgatttttcgtagcggagacggttaagtgtttttttattaatttttttttttcggagtttaggggtgttgtatgggcggcgtttggattcgcgttttggagttattaggcggagtaaagttagcgcgtttcgcggttcggaatttagttggttcgttatttttttatttttgcgattttattttcgatcgcgttttagggtagaagcgtttgagttttcgttagtgggtatttaaagtttatgttcggcgggcgtgttgacgttattcgggggttgcggagcgggagggggcggtggggggcggggatcggggggttaatggggagcgagggacgtttgttggaggggtagcgagtgtgtttttcggggtttatttttgataagtatgcggttaagggtgtcggagattatgcggtttttagcggattcgaggtttcgtatcgcga

SEQ ID NO: 7228 - DNA, 1133 bp, Artificial Sequence
  Description of Artificial Sequence: Synthetic polynucleotide
cgtcggttatcgtcgagtttttattttatttaattagatcgcggggaaggatacgtaaatttgtcgagggttcgggggtttcgggttgttgttgttgttagcgttttgggaagtgataggtattaggatttgttggtgcggcggcggcggcggcggtagttttagtcgcgttcgttatatatatttttattcgttcggtgtatacgtcgcgtcgcgggtagtgtcgtttgcggaggcgcgttcggggttcgtaggggtagtagcggtagtttggtagcgtcgtcgcgttttcgggtatttggttcgcgaagtttcgtttttgtcgtttttcgcgtcgttcgttttacgttttttagcgcggtcgtcgttcgacgcgcgttcgttttgcgttcgtcgcgcgtcggtttcgggggcggtagaagcgcgcgagggtcgttgttcgtttttttgcgtagttcgcggtttttaggtattttgcgttgttgggttcggcgggcgggggtggggcggggagcggggcgcgggtcgagcgggggcgtttcggtttcgcggttttcggcggttgttgtagcggttgttgcgcgtaatgatgcgggttcgcgtcgcgttttagtagcggcgttgttttttttttcgtttagatgtgtgaattttttttttataataaattttttattttgttttttgtcgtttttttttagggggttaattttgaggatcgtaggggttgtcgtttaggcggtcgtaggcggcggtgtttaggcggaaaggagcggcgcgaaagcggcggcggcggggatcggggtttcggggcgaggagtttgggcggtatgatcgcggtttgttgagttgaagtcggtcgtgtttttagagttatttcgcgggagcgaatcgagtgtgtgtgtgcgcgcgcgttcgggggagaagggattaagaggagggttagggaaggaagttggggttatggaataggggtgtaatcgaggtatttagagcggtcggaaagttcgagtggcggagaggttagaggtggcgagaaggggcgcggcggtatcggacgtatcgtttagtatttggtttttttgggttttcgaggatttgaagggtcggagcgcggagagttacggagtcga

SEQ ID NO: 7229 - DNA, 1808 bp, Artificial Sequence
  Description of Artificial Sequence: Synthetic polynucleotide
cgggcgggggacgttcggtagttttgtaaacgcgtagatacgcgaattttatcgtttcgcgcgttttttggtttcgttggtgcgtgtcggggatgcggtcgcgtaggcgttcgttttttggttttttggtcgggtagcgggcgttcggttatcggagtttagtttaagggtttagtcgaggttttttcgcgcgaggcggttgcgttaggtgagcgggtatcgcggtcgcgttttttttgttatttatttagcggttagaggtattttgcgtttgggagttttaagtgttttcggttgggtgtttttgttcgatttttaaaaggaaagtataaatttcgggtgcgagtttaatttaggatcgaattttttcgcgaatttgaagttattatggggcgggagttattttagcgtcgcgttcgttcgtttttcgtatcggttaggatgttgcggaaggtaggggcgtcgagaggtaagggtgaaagacgtcgtttatatttttaaagttcgaatttgtattttttttgcgaggcgtagggcgggaggatcgttgtagttgggagtcggtttcggataggtaaagcgattcgataggtgaacgcggcgggagggagtaaacgcgtaaaaaattttgtatttattttttcgttggcgtttttttcgggaggcgttttggttgtcgatgtattttataaagtttaaaatgataaaaagttaagaaattagtcgtaagtgtatagtaatttagtaatgtttttttttttttttttttttttttttgattgttaattatatttaatgtttttaaaatatatgtaggtgttaggcgtatatagatagtgttcgagtagcgggatttttttttttatattcgataggcgtgttgtgatggtaagcgaagtggggcgggtggatagggaaattaattattgtatttttaaattatttaagtattgaattgcggcggtttcgttggggtggttggtatcgtcgcgaatcggggttttaggagtcgtcggggcggtcgtaggtagtatgttgtgcggtaattgtcgtaggcgggattcgggcgggcgagcggcggcggcggcggttgtagcggcggttttttgggtttagaagttgcggcggttgcggttgtagcggcgggggtttttggagcgtaggggagcgggcgtcgtcggtatagcggttatggttaaggggcggcggagagatttcgagttgtttttggcgtgcgcgagtaggagacgttttagtgttgggttgggttttcgggagtattatataggggaggaggaggaggagggtagggaggggggagggagaggagggtagggagggggagaggaggggggatggttgtggggggcgggggggagttcgggggcggggaaggaaattgttggagtaataattttgagcgattttaataatttttaattttaagagggaaagagggagttggaaaagtataggcgttgcgttttggtagagggacgggaagaggcgtttaaggggtttcgggtttatagcgtagtatttttggatattgtagtgacggtcggagaattttagttagaagaatggggaaagtagtgcgtgcgaagagtttttttagaagggtagttttggcggggagatttgggcgtattggggttggtaggtagtgttgaggtcgaagattttttatttattttagttcggttttttttcgcggttttaagttaggcgtattcggttgtcggtggtcgtgcgtttttgcgtttttgtgttttagcgtttttattttatttttagcgtcggcgcgt

SEQ ID NO: 7230 - DNA, 1323 bp, Artificial Sequence
  Description of Artificial Sequence: Synthetic polynucleotide
cggtttcggttgcggtggtcgtttatttatttttttattttcgttagtattttttttttttttttatttgttttgagtatcgggttttgggggtcgggtcgtttttttttgtttttagttttggttttattttaggagttgtcgggacgtcgggcgtttttggaggcggacgaagaaggcggtagggtcgggggcgttagcgggaatttcggtcgtcgcgggtagtcgcggtttttttttttattttagggttcgggcggttatcgcgggcggatgagttaggcgagggggcgggtggtaaggggtgtaagcggacggagggtgggggcgtttttatgttcgcgtcgggggggtatcggaggtttcggggtaggggatgcgtcgttgtcggtgtttatagagggtcgtcgttattcgggcgtagagtttaggcgcgtttgttttcggagggtatcgggcgtagtaagtcgggtaggggagagggagtcgtcgtttaggcggcgtcgttatcgcgtttaagaaagataaaagggatcgggaacgggaggggaaaagttttttgttcggttttagatggattttagttttaaattttacgttataaagtttcgaagaggcgggttgggggcgggggtcggggcggatttttaggggcgtggttgcgcgtttgcgatttcggatcgtgttaatttcgtcgtcgttttaaaatttgtgggaaattttagttttgttatttattttttttggaggacgtagataggatttgttttgtaggagtttaggtcggtcgattcgcgtttcggttataaagttgtatttcgagagtttaaattattcgtagataaaatttatttttgggaataaagtattcgtttgtaggcgtttttttcgggttggaaggttggcgtgcggaaacggatatatttattcgtggggttcgtttttagttatcgcgggattatcggttatcgagttagggattcggtttttttagtttttcggagcggttggggagttttagtcgattcgtagtattttcggagtaggtatcgtaggattttggttttacgtttttcggacgttttttttttagatgtcgttcggcgggtcggggtttttttggcgggttgcgcgggcgttgcgcgagttaaattaaatttggtcggaaaagacgcggttaaggttcgttcggtttacgtttttcgtcggttcggtaaggggtttcggagaacggtttgggggggcgagaattatgggcgggggaaatggaagatagagggaattgaagtacgggggttttcgatgagtagtgcggatgttcga

SEQ ID NO: 7231 - DNA, 1501 bp, Artificial Sequence
  Description of Artificial Sequence: Synthetic polynucleotide
cgttattcgagttaatgaacgcgattgttttgataaggcgtttttaattttatcgattttggtaaattgtaggagatatttagtttacgttatataaaaattattaaagtgggatcgtcgtagttgaaaagttcgattagtgtttggagattagaacgcgagtttttaaagtatatacgtattcggtatcgggaaagtttaggcgtttgtgatttttcgaaggattttgggttagtattttcgcgtttggattatttagggggttattagaaagtaatatacgttataagaaagatgtgggggagatttcgatgttcgcgtttttgttaggtggaggcggggtgtaggtagaagtcgcgcgttggattgttggatgaatttcgttacgcgtaggtttcgcgtcgatttcggaagggataggtaggttcggaagggatttttggggtttggggacgttttttagggtagagagtatcgttgcggttcgagcggttcgggtttttaggcgtggggtattcggtttttaagcgtttttcggggacgtaggcgtttacgtatcgtttagttgcgcgtttttagtatttagcgttcggcgttttcggcggagtttcgcgtattttttcggaaagtttgggggtttttttaatttaggttttttcgggagttttggggcgggggttggaagaaggggttatttatttcgtcgttcggttcgtttcgggttttcgaagtgtttgttttagtcgcggtttagtgcgttcgtaattaagtatttattttcgttttttttagtgtcgaagtttttttttcgcgttgtgtttttggtgaaaataggatatttttttcggttattttataataaatagcgtatataagcgggggagaagcggggcggagggagaagtcggtttcgagggggaggaggaaaggagaggagttaaaatttcggattgcgataggggggaaaggagaagaaaagaaaatgagagagcgcgtttagtcgtcgtagtcgttatttttcggtttttttcgtagttttttttttttttttaaggtagcgataattttacgtggataggatggaagttttgcgcggaagtcgggaacggtcggagcgtgcgtcgcgttgtcggtagtttcgtatttgcgtagggaggtggggcgggggcgacgtcgttatcggttattgcgggttcgtgaggtcgtcgggggtttcgggggaggtcgttagggacgcggggggcggcggcgcgcgggggatttatttcgtttttatttgatttcgggtgattgtttattgttatggtttgcgatttcgcgtggggatcgtttagggtttcggggttttggatgtttcgggtggcgtcgtcgtaattttcgtgtttttcgcgtcgtttttatttcgtttttattcgggtcgattcgagcggttgtagtttttaggttgaggggagggattcgcgatcgcgtttttttttttgggtcggagagttattgtcga

SEQ ID NO: 7232 - DNA, 1744 bp, Artificial Sequence
  Description of Artificial Sequence: Synthetic polynucleotide
cgttttcgcggttgttttttttttagggtcgtcggtggtttaggatttggttatcggggaggggcgtggttttgtcgaagtcgatgagttatacgtcggcgcgatggtagtgatcgtgtataaagaggagcgagttgtcgattatttgcgagtttcgtatcgttaggtcgcggttttgtttagagacgtttttgtcgggttttcgttttagttttcgcggttcgggtattcgggtagtcgtcgtttatttcgtgttttttgaagaattcggatatttttagggtgtttcggatttgttgtaggcggtttagatatcgtttttgtagagggtggggtgggagaggagggtaaattaattaaacgttaaatgagtttttgttaacgatgaggagtcgggatttacgttgtgtttggtaaatgtcgttaggaggaggatttagggtttcgtttagcgtggtttagaagggaaggagcgtagagtagttgcgagttagcgcggtgagggttatggtggggatatagtcgagggtattgggttagatgataggggtagttttcggttttaggttttttaatattttagggtttgggatttcgtttttattagtatttttttatttttttgtataaattttttaaagacgcgaagtatttgttttcggtttcgcgtagttttgaagtcggtgttgtaggagtcgttcgttttttggatgtgggataggagtgttaggggtttcgggttcgttagtggggaagaggatagcgtagagtagcggtattttttagttgtaggggacggcgaggcggtgggagagggcggaggggtaggcggggcgggagcgggggatcgggaaagatagcgcgtagtggggttgcggcggtgttagcgaagcgcgtttgttttattttgatgttttcgatgcggaagtcgagggtggtgttggagttgatgttttttcgttattgtatgtagcgcggtttggtgacggcgcgttgcgcgtgtttttttttcgtgggagttttaggatttatcgttagtatttttttgtatatgttttttcgtagtttgggtcgtttacgggttttggttagttttttttttaggtaagttttgtgggggcgtaggtagcggttagggtatgagggggcgtatacggagattttttcgagtattcgtttcgggttttttttaagtagttgtttcggtttcggatttttatttgatttttttaatcgatttggtagggtacgtatatttgacgtttattttgtagtcgagtatataaggttcgtcgaagttatcgagtaggttttgtagttgtaggtagttttcgtcgtcgcgttttattacgtcgtggaaggtaggtacgtagtcgcgtagcgcgttagttattagtcgcgttaggtagtagcgtttcggtttcgagtagcgttttaggattagttcgttggtgttcgtcgttttaaaattttttgaggatcggtattcgttagcgtcgtttagttttttttcgtcgcgggtattcgtttattcgttttattgtttattagtgtgttttgttagttgtatttaggcgtagcgttttttgaaagggtttatgatcggtagattgattatggttcggattttttgttagtggtttttttgaaagcgatagggttaaggtttgataatcggcgtttcggtaatgtataagttttttttttattgaaatagggtttcgttacgttttcgatttatcgg

SEQ ID NO: 7233 - DNA, 1801 bp, Artificial Sequence
  Description of Artificial Sequence: Synthetic polynucleotide
cgcgtagtttaggatagtagcgcgcgggttacgggcgagtggagttgtaggggttcgggcggagagtcgttgttatttagggaagttttcgggatttcgggtttttcgcgaagtttcggacgggcgttatcgaagtcgagagtttcggtcgagttttttcgtacggtgggcgtcgcgtttaggcgagcgcgcgaggtcgggcggggtcgggggtcgttcggggagggggcggggtcgggattttcgcggtcgcgcgtaggggttgggaagttgttttttcggtcgcgtcgggcgaggggttgcgtcggttcgcgaggcgtatgcgcgttgtcgagcggttttcgtttttttttcgtttatcgttttttttttttttttttttttttttgtattttcgtcgtttttttttttttttcgtttgttgggtgttgaagttgggcggatggtagtaaatcggtttcgttagaggatcgagtcgtttagtttcgttttttcggatttatcggcgcgttgtttatatttttaggcgatcgggtaagacgttgtttttaaaataagcggtgttaagtaaatgatattaaaatgtttgttttgtattaatggatggattttttttaaggtaggggggaggtgaaggaaggagggggcggagagcgcgatcgtttatgtttcggcgggggcggttgcgcggcgttggggttttagttgtggtcgcggcgttttgagcgggagcgggggtcgcgtcgcgggttcgggaagttgaatttcgcgtcgttgtttggacgcggttcgttcgtcgtttttagttgttgtagggaatcgggcgagtgttttgttcgtcggggaacgttcggttaggttttagagttttcgcggagagcggggcgtttgttgggggcggtcgggagggtcgggttaggggcgcgggagatttcgcggggacgcgaggtgttgcgggttttgtgcggttggttgggaacgaggagaatgtgttattaatagtgtttaatcgattgattattttgggtgttgtgtttttttttttatttttttttatttttgggaaaatgtattgtttaggtggggaaggtgttcgaagaagaggttgcgaaaatgaattttttgattagtagtaaaatatcggaggggtgtgtgtgtgtgtgtgtgtgtgtgtatgtgtatgtatgtatagggggtggggggttttttttgtttttttttttttttttagttaaaggaaagggagttttggcgtgtgcggcgcggggtggattttatagttatcgagggggcgaggacgaggaacgtttattaatcgcgagtcgttgttcgggtgggcgtatcggagttttttttgttgtaggtgatggtggttttttcgtgatcgatggaattatagtttaatttttgttttttcgttagtttttttgttgttttttatcgagtgttgcggtagaggttgggtgtagatacggtcgttttttttttttttttttgtttttttgtttttttgaataaatgtcggaggattaggggatggcggagggatagagttggattcggaagtcgcgggtgggagttgtttttcgcgagttcgaggttgttggtattttgtcgcgggtagttcgcgttagtttcgggagtttttgggtttcgggagagcgagtcggggtcgtttggttataaagatgttcgcgcgttcgttttgcgtacgggattcgttttgcgttttgagttttgcgtttcgttcggagttcgggacgtcggtttacgtgggagaatttttgtcgttcggggacga

SEQ ID NO: 7234 - DNA, 1801 bp, Artificial Sequence; identical to SEQ ID NO: 7233
  Description of Artificial Sequence: Synthetic polynucleotide

SEQ ID NO: 7235 - DNA, 1684 bp, Artificial Sequence
  Description of Artificial Sequence: Synthetic polynucleotide
cgtttttttcgggcgcgcgggttttttgtcgtttggagtcgagttggtattggagcgttttttttttggagcgtagaggtattcgacgttttgcggtagttcgtagttttttttttacgattttttagaatagttttgttttgttttttttcggtttttcgagtgcgttcgttattttgtttcgcgagaggtgaacgcggagaaagtaggatgattatttacgttttcgagaaattttgggtaaagaaaggtattattttagttcgtacgttgaaagtcgtttttttttttttttttttttcgttgtgtttgaatttttcgggatatttagacggttggagtttttcgattttaaggcgggcgacggtaaagttaaacgttagcgcgttgcggttttcgggtatcgaggcgttttcgttttcgttatttatatagggcgttaagtgtttcgattcgcgagtgacgaggacgtataggttagtgatacgattcgtagttagtattgagcgggacgacggggttcgagcgtaggagggtgcgcggggagttgaggagcgtcgggggttcgggcgcggcgcgtatttgaggtcgtcgtcgaggaggcgacggggagtagcgcggttaagagtagtagcgtcgtttaggatagtcggcgcggcgcgcgtagggtcgtttcggtttcgggggttatcgagagttcggggtgggtcggggttgggtgtttgcggttggtaggggggcgttggtcggagtttggggagtgtcgaggcgtcgtcgtcgggttttcgtcgtcgttcgtttgttttgcgcgttttgcgcggtgttcgtcgcgtttttgtttcgcggcgatcgttttcggtcgtatatcggtagtcgcgtttcgttattgaggtcgtcgatttttcgtcgagttttttagttgcgttcgggcgttttttgtcggtgtgcggggtcggggttagggtcggcgggggcgattcgggcgataggggcgacgggggcggcggggttcgggttggaggcgggcggggcgcgggacgaaggggtcggagcgtttcggattgatttagcggttttgaatttggggcggtcgttgtgtcgggttaagtggttgaggaagttttttttttcgtttaatttttttattttttggttggggaagtcgtttatcgcgtcgaggagtgttttttgtttttttatagaaatatttttgcgttttaagtggggattcgggtcgggattttttattcggttcgtagcgttgtagtttttgtggttagtttagtttttttacgtttttattcgtattcggcgcgtttacgttaggggtttttagcgtttttagattttgtttcgtttggttgttatttttagggcgcgtacgatgcgggtcgaaaaggaatttagtttttagtgtgttttgttgtttaggttaaggatttagcggatttcgttttttttttttttgtaattgtaatattgttttaggtttttttatttttttttttttttatttttttttttagtttggaagtttcgcggttttttagatggattcggagcgtttttggaggttatagtgatttaagttttaggaaggtcgggttttggacgtcgcgtgttgttgttcgtcgtcgatcggtgttttcgtagagataatttggttgaatttatcgtttagcgt

SEQ ID NO: 7236 - DNA, 6657 bp, Artificial Sequence
  Description of Artificial Sequence: Synthetic polynucleotide
cgtgcgtgattggacggttttcgcgcggagcgaggaggttcgtagcgtcggggggagggcggtttagtagggagggcgatgcgagtttggggaggggttagcgattcggttaggaggtgaggatagttttttaattttcgggaagggaagggtagggggtcgcgtttggggggcgtcgggtagggtgcggacggcgaagggggacggaagggagagaggcgttggggaagggatttttcggaggtacggggtagcgtgcgggttgcggtagcgatttcgattcgggttttcgggttttgtcgggttgagtttgcgttcgtttcgtcgtcgttaagtttttttaattttgttcgttgcgttcggatcgcgcgttaggtttgggggcgtagtaggggttgggggcgtacgttgcgtattcggggacgttcggggttcgaggtggcggggggtttggtcgcgtcgtttttcgggggtggttcgggttttaagttttttaggtttagcgttcggtcgcgttcgtcgtttatttgttcgttcggtttcggtttcggggttgcgttcgtagtcgtcgtcgttttttaagttttaatttcgttttcgggattgaaatttttttttagtttcgtttatcgatttgcgcgcgcggtttcgtttttcgtcgcgcggtcgggggggaatttaagttcgttttgttttttttcgttttttttttttttttttttttttttttttttttttttttcgtttttttgttcgtttgcgcgtttttttttatttttttttttttcgtcgcgagttcggttcggagtttttggttttttttttttttttttggtttttcgagttttttgtttttttcggtttttcgcggtaattcgttttttttttttttcggcgacgcgtaggggttggggaaggaggggaggttttagaaagcgtagggggcgttttcgcggttcgttttcggtttttttcgtttatatttaaaaggtggagggggtgggtgggtgggtggggggagtgggggcgatagttgttggttgaataagttattcgcgatttttattattttaagtaaagttaaggcgtttttaggttttttcgtcggttcgttttttattcgggagggtagggatttaggggcggagaacgtagggcgtaggtcgggttttttttgtttagttttggtttcgttttttttttttatttattttaatttttgtgaggattttagggggttttggagtatttttcggtttagttttattttgataatttgtttgtgcggaagttttcgttcgtatgttataggaagggaaattgagttaagagaggtttagaatttggttttatatagcgcgtcgaaggtagagttttaggggtagtttggattttcggtaggagtttcgggattttacgtttgggtcgggtaggtttcggcggtgtttggataagttcgcgttcgtagaacggtcggcgtttggggattttttttagttttcgcgtagttcgcgcgttttcgtcggcgtttttttttcgttttttgtttttcgttcgtttttggttttcggttttagtattttcggtacgtttttcgttcgtcgttagtagttgggtaatttaacgagtatataaaagagttgatttaatttaaaggtagtaaattaagataaattttatagtgtgtggggatcggagagggaatgtgaatgaacgtttacgacgtcgtttagttttgtatggatcggtttagttcggttgtagggtttgatacgttcgggttttagggttttttaggagttagaatcggagagtgggttttgagttgttttggtttttaggtttttagtattggttcgaatttagtaatttagagtttgtggtttttttcggttggttgggtggggttttcgtgataggggtgtagagttttgaaggggagtgttaggacgaaagttagtgcgtttttacgattttatgtaaatattggggggtaggggttttggaaatttagtatagttttaggggtcggtaggaagggtatcggtggtttggaatatttaagttgtggtttttttttttttgtttcgatttggattacggttagagttaggtcgtaggttaagagtaggtttttgtttatttattagatagatattgtaagtttgggatgtgttaggtttgggtttgtggaacgaggtcggcggtgagcggggtatttttttttttttgtttgtttgtgaggtttttttagttgtagttttattagggagaagttggtcggtttttagagtttttttggttacgtttggaaggttttagtaagttattttttagtttttggtttggttagttttgtgtagaagatgattatcgggtttcgggttttagtttatttatttcgtttgttaaatataaattttaagagaggtattggatttttatttttagtaggtttttttaggtttgtgttggttaagtgtagtcgaagttttggaatgagttttttttgttttcgtaggtgtttttcgtgtgttttgcgttgtgttgggcgtttgttcggaggagtcgcgttaggacgttttgttattttttaggagtaggtatgatgagtttattttttcggggtgtaaattgaggtcgagggtttttttagagcgtttttgatcggtattgtttgattttagaggttagttttgcggttattcggggtttgagatttacggagaattttagaggttaatttgaggggcgggtaggggtacgcgcgcggggtcgtgggaggcgagatttcgtaatttgaggagttaggattttagtagagagcgaaatttggagttgggggaggggacggtagaggattggaggtcgggttgtacggtaggggtcgagttttcgcggtcgttttttttttttatttcgagcggaggttgcgtcgttcggttgcgatcgagttttcggagtttcggtcgggtcgtttttttttcgtggtcgcgtcgattggcggtttgttgttattcggacgtcggcgtcgtcgtcgcgaggatatttgttcggggtttaacgtcgcgttttacgttttttgttttttttttagatttagaatcggggagaggacgcggcggtgaagttgggaggttggaatttggagggcggcggagtttcggagttaacggggcggggggcggggtcggcgttggttttggggataaagatttttacgttgtttgagggttgggttttgtagatatcgaggtaggaagaaggatttcgtatttttcgttttttagatttttaaatttatttaggtttagatttgagtgtttaggtggggtgggggagatcgaatttttttgggttttcgaggcgcgcgaaggcgacgttgaaggggggacgtcgggacgttgttttttttttgtatacgtcgttcgagttgtatttttaaacgttttaggagtttcgcgggttttttttgttttttataattttcgaagttgtttttagcgattttttttcgtttttagatggggtcgtaggggcgggcgaatgtgttgcgttcgtcgtgggttgggaggaagggcgcggattgtaggaagtttttgtttttttttgggtagtttggtttcggggattcgcgtttagttcgcggcggaggattcggtcgggaatggtgttgagattgcgcgggtacggtttagggtcgtgatcgggtggttatcgtgtagtttgggaagagaaaaagttcgggggggggtcgatatttcgagatcgaagagggaaaatgggaggaaagtaggcggtagggagggaagagcggcggaagagggattaggagagttgggggttcgttttgggtttcggggtttcgttttattcggtagtttagtttagtttagtttcgttgcgttagtttttcggatcgggagaggttagggttatcgacgtttattaatagtcgcgagcgggtttttttcgggagtttcgtagcggtcggtagagtttagttatcggttggggtgggggcgggggtttcgtaatatttttttcggaggtttaagcggcgcggggcggggcgttgcgtttttttacgtcggttttgcgaagtcgaggtatttatagtttattttttttttattttcgatttcgagattaggttttagatgaagaggggttcgtttgtggtttaatttggggcgtcgcggttattttagcgtattcgaaggcgcgtttagttttttttttttttttttgtttagtcggttttttgtttttagcgcgtttcggaaagtttcggggttttcgcggcgtttttttagttttaggggttcggagttttggtttttttagtcgcggcgtcggggagggaagtttgttcggtttaggttcggcggtcgttaatttcgggtgcgttcgttttcgaatttgggtgggtggatggggacgttcgggagtcgcgggtttcgagcgtcgtatttagagtttcgcgggcggggagattcggttttggcgcggacgtcgaggttagggtattagggatggggtggttcgggttgcgagagtcgttggggattttgcgttgtttttcgtcgttttttttagagagtatttttttttttgttttttttaggggcggggatttttcgatttcgtagcggcgatagaggggtttttcggtttcggatagttttttgttttttaggtttttttttatttgggtcggggtgcgggtttcgggttggaggtattgtcgcgggcgagtagagcgcgcgtatttcggtttttcgagtgcggcggcggcggcggcggtttttttttttttttttttttttttttttttcgggttcgttggttttagatagtttttttttttttttcgttttgtcggtttttttcggagttcgttcggttggattcggtttgcgattcggagtttagcggagtcggcgggagttaggttgcggcgtttattgcgttaagcgcggggcgagcgcggggcggcggcggcggggatcgcgcgttcggagttcggggttggtcgggtaggcgggggagcggcggtttcggtttcgattcgggttcgggcgcgggcgtagtggtggcggtcgcggtagcgtcgaggttgtagtatattttttttgagcgtgatggaaggttttatgtgggagagcgcgcggggagggatggggagggggcgggggtcgcggcgggggcgatcggaggggcggggggcggggtcgttgttcgtacgtcggtgggttggggggtggtcggaggggggtttcggaggggaagttggagttagtcgcgggggcggcgtgggaagtcgagtggcggtttcgttttttttttttggttcgtttcgttcgttttttgttttcgttttaggttatttagaggtttttaggtttcggtttggaagagaagcgttcgaaggtttgggggtcgggattttggtggcgttgggaggtgggtttttgggtggggatacggttgtgtttataggcgttcggtaatttcgtggaagttgattttaagttagattttttgtgagcgcgcgcgttcgcgagggttaaagtatagttcgtaggacgcgcgtttgcggggcggggggagagcggggtatttgggggcggggaggtggagcgagagggtcgtcgggtttttggcggtttcgcgtttttagagattcgtttttttttaaggtcgtcgatttttttttttttttttttttcgttgcgcgtcgtttttcgtttttcggtcgggaggagggggaggcgtgggagcggttcggcgtttttcgattttcggaaggttcggtttagcggatttttttttttttttatgtgttttcggaattttagcggattcgaaatcgcgttttcgggttttgagtcgaggggtttttcgtcgttttttggtggtttcgagttttcgtcgagcggttttacggttttttagggcgtttttcgtttttattcgttttttttttagtttgcggttttcgtgtgggttaaaaattttaaattaggtttaagagcgttttcgttcggttaagttttcgcgcgtcgttttataaatcggtcgcgtgcggagttgcggagttcgggatttttagcgcgcgttgggcgcgatattttggatttcgttgttagcgtcgcgttttttcggtcggggagttttatatcgttaagagggtagggagaggggaggggaggggattattggaggggagggggttgtttttcgggtgtttttttcggaggaggtttcgggataggggtgggggtggcgcgggaggtcgtagatagcgcgtttcgaggatggtcgggtcggggatgggcgcgcggggtttttgttcggacgtgggtttaacggttttttcgtagtttagaaatttcgtttagttcgcgggacggtcgttcgtttttcgatttcgagtttttattatatttgtttttgtaggacggggttggggggattgagatcgtgattgaggtcggggtatggaggaagtgtcgtcgtttgttttcgggattgttggatacgaagggtggaggttaaggacggagtttttgtttgcggttgtttagtttttagtttttgcgcgggggcgtttagatttttagggaatagggagatagagcgggtcgagttcgg

SEQ ID NO: 7237 - DNA, 546 bp, Artificial Sequence
  Description of Artificial Sequence: Synthetic polynucleotide
cggaggcggcggggtcgcgggagggagggggtcgggtttaggcgattggtagcgcgagttcgggagttttttcgtgttttcgttcgtttcgttttcgttattatttgttcgggatttggcgtcggcggtttcgggcgtttttagtttcggttcgggtttcggtttcggtttcgggcgtcgattaggtttttttggttttcgtcgcgcgttttttaatttgttgttgtcgtcgtcgcgttttttaggttttgttagttattcgcgttttgagttcggggttagatttttatggaagcgtcgcgatgttcgtttttcggttgttggatttttagaagacgaaatacgcgaggtgagcggcggtcgcggaggttcgcggggagggagggaggggcgcgcggcggcgggggtcgcggaggttattttggttttcgggtttcgtcgttcggagcgttagaggggatcggcggatttttgattttcgttcgagaaaattaggatttaggtagtttcgttttttcgttgggatggagtaatcggggcgttcgc

SEQ ID NO: 7238 - DNA, 288 bp, Artificial Sequence
  Description of Artificial Sequence: Synthetic polynucleotide
cgcgcggcgtattgcgggtcgggaacgtgttgcgcgttgatatcgggttagttttttgtgatgggattttttttttaaaaacgtaggcgttttttcgggtcgtagtcgtagtcgggagattgagggttagggcgcggtcgcggggttttttgggtcggggcgcggtttacgttttaggtttttgcggttttgattagaagtcgttgcgtttttggtcgttttttattcgtttcgttttcgtaattttaggtttagggttatagcggtttagttttttttttttcgcga

SEQ ID NO: 7239 - DNA, 947 bp, Artificial Sequence
  Description of Artificial Sequence: Synthetic polynucleotide
cgtgaggtcgcggtgttagtttatattttattgtgggtggcgggttcggtttcgcgaggaggcgtcgtttttaaattttacggtttcgcgtagcgaagaggcgaggcggtcgcggaaggtaggcgtagtttatttttttcgagaggtttcgatatttttcgggtgagtttcgaaaagcgcgcggggatttcggttgagcgttgggtcgttagtaattcggtttttagagagttatacgaaggaggggaagcggttttttttggggtttttgggaggtttggttcgggtttttttcgtagttttcggcggttagtttcgcggttttggggcgttcggatcgagtaaaggtttcggcgggcgggtttttttttcgttttttttaagcgttcgtttttcgtcggtttagcgtaggttttttcgatttcgttagcgtagggggcgcggttgtcggggatttagtagcgggcgcgcgggtaagtgcgcggcgggcgcgggttgcgggattcgtttcgggttttatttcggattttttttggtttgtttgggtgtttcgggtcgggggtagtcgaggtcgcgcggcgttttttttttgggttatttttttttcgtttttttttaggggagacgaatcgattggttgttcggtcgtcggaacggtaggtttcgtcgtttttttcgtttttcgtattttcggttcggtttttttttattatcgcgtttcgttttaattcgtagttagtattttttttttatttttttttcgttttcgttgttatttttttttttggatgttggaagcgtagttggtattttcgtttttttaattttttaaattttttttttttattcgtttattttttgtgtttcggttttttttttgggtgttgcggaggttttttcggttcgggggcgtgtgtgtagggaggcggatcgcggaatagatacgg

SEQ ID NO: 7240 - DNA, 1313 bp, Artificial Sequence
  Description of Artificial Sequence: Synthetic polynucleotide
cgagaatttgtcgtagggggagatttcgtcgttaggttttgggaattgtttgggcgtcgttaaagttcgagtcggagttgttatttggggtagcggtcgggaagaggtaacgatgttagtaagaaagtagcggaggtaggaggcggtcggaggagtggattggagcggacggagtttcgtcgttttttagttcggagcgtttggagcgaaagttaagcgtttttcgagggcgatttttttttttcgggcgcgcgtttattcgttgtagtcggtagttcggcgggagaggtggtagttgtagtttcgtatcggggagagcgagttttttgcgcgcgcgtttattcgttttttaggtgattcggcgttttcgtcgcgttcgttggaagtttgtaaatttttttcgggggtttcgtcgttacgttgggaagttggggacgcggggggaggtttttggttcgtcgttttcgttgtcgtttgatcgtatttttggagggtttcgtattttgttaggtttttggaggtaaatatatattttcgatttataattggttttcgcgttaggggattcgcgcgtttttatatacgtacgtacgtcgggcggattcggcgtcggttttacgttagtatttttttaggcgcgcggcgcggcggttatcgagcgtttcggtatttacgcggcgcggggtttttagggtggttttaggatatagtcgaattttatagtttattagtattcggggtcggatttttttttggttcgttaaaatgtttataaatatagattattttttagaaaaaaatgtatcgtattttttttattttttgttttgtgatttgtttattggattaagtaatttcgcggttgttgtcgagaattaatttttgtaaataagtatattttcgagatggtttttgcggtaagtgtaataaaagtggttaaatgtaaaagttttagaagtggtcgagtcgtatttttaggaatttattaaataagtgtggagaaggtaagagcggagttcgggtgaagggattacgttggattgagtaaagattataatatattttatttagagtgtattatattattttttcggtgacgttacgtgggatttttgaatttttaaattattgcggttcgttggggagggacggagcgaggggcggggtcggcgcgtcgagggggtaggtttcgtttcggtttcgtttcgatttcgtttcgtttgcgcggattttggtgtattcgttcgggagcggtagcggcgggggcgattgcgtaagtaatagtttgtagagtttagcgtcgtgtgatacgg

SEQ ID NO: 7241 - DNA, 848 bp, Artificial Sequence
  Description of Artificial Sequence: Synthetic polynucleotide
cgcgaagtttcgcggtttttgcgtgttttggtttcgggaggataaggatttttttttttttttatttgcgcgcggagtcgagtttttgttgaggtgagggtttcggaagtttacgtagtttcgtaggtcggtggtggtcgcggttgttttgcgggggtgagtgtgttcggtcggggtcggagtttagcgtgtgttcggtagacggcggtgttcgcgcgttttttttttcgcgttcgcggtgatagtttagatattagttcgggcgttgatagacgattttttttatttgttagttttttcgtttgttagtagagttgttggtaagtgagagaaaatagaggggcgcgaaggtaggcgcggttagggagtgagcggggcgttgggcgcggggcggagtcgggtgcgcggcgttcgggttaggttttatcgttcgcgtcggttttcgttttgtttagtcgtcgtttttttttttttttttatttttttttttttttatttagtttttttttttatttttaaattttttagttgcgcgttgatcgtttttgtggttttgtttgggggtagggggagaatacgaatagattcgaggtgtttttttttggagttggagtttaattttaatttttatttttatttttatttttgtgtttatttttgggtattagttcgggattatggttggttttcgtagttgttttcggagcgtatttggggttatggtttgtcgcgatcggagttcgttttaagtcggagtttgggggcgtagaagggggagcgcgtcgagaaagtgtcgggtaaacgcgcgtcgcgtttggttgggtatcgcgagttgggcgaggagacgg

SEQ ID NO: 7242 - DNA, 2406 bp, Artificial Sequence
  Description of Artificial Sequence: Synthetic polynucleotide
cgggggaggggtatacgtagttttcgtgcggaaagatggtgttttttttttatagggttgcgcgggtatttattttcgttgtaaagcgttcgggttaggcgcggtttgtttcgggtcggggcgagttcgttgttttttgcggtagatagcgatgcgcgtttttcgttttagttttcggttcgttcggcggttcgcgcgttttttcggtgtagtatgcgggcgttgtgacgttttcggataaatgtcgtgtaattgtgtaggcgaatgagagttaaaaataagaacggaaaatttattattaaggtattattgcgttagcgtagttatttgaaggtttttatggttttcggcgtttgcgtttgaagttcgtttttaggttttggggggtatttgtagaaaatttttagtagcggttcgttaattagattttagggtgtacggggggtggcgtcggtaattatggtaatttttaaaataaaataatataaaataaagtaattaacgtttattaattattattttattttattttttgtattgtttttaggtagttggggaagtcgtcgggagtgtagtcggatgttggaatttaatgtgattcggttgattatgtaaagattaggattggacgtttttgtagttttatttcgttatttatttttttttttttatttcgtattagaaataaagtggggggggggggcgagtttttggaggagaaaatgataattggtatttaattttaggtttatagtgcgtcgcggtggggcgtaaagacgtaaattttcgggatggcgagttttcggggttttattgggttaaacgaaaattgatttgatttgttttttaatattcgagggagagaaggggagatgaggggagggagggtagggtttgagtgtgtgcgtgtgcgtgtgcgtgtgtgtgtgtttggggagggggaggaggtattaagttgtagtttgcgcgcggttttgcgtttcggcggggttgcgtgcgtgtgtttttgttcgcgttgttgaaacgggtttttcgagggatcggcgttatatgatttcgtttgtttttcgttagcgcgtagatcgttagttttttagtttgttcggtatcggaggagggtcgggcggtatttttcgggtattggggttttgcggagcggagaagaggttttagcggggaatggtatatttggatttaagaagtcgcggttcggcgttagattttggagtgtagatatttggggggaggggagagttagagggagcgagcgagcgagcgttagagagaggtagcgcgtagcgcgtacggacggggggttgttgcgcggagaagatgtaagcgcgtggggtttcgttggtttttgagtattatgtagaaggggattcggttgaatgatggttacgtcgcgtttttgggattgttggcgcgtaaggacggtacgcgtaaaggttatttgagtaagcggagttcggataatataaaatggtaaattaagtggttcgcgttgttgtagaatttgtttttttatttcgagagcgattcgagttcgcggttttcggggttttatttgttggagggttgcgtttgcgatcgcgcgtttttttttaagtcggcgttgtcggttaaggagtcgttggagaaataggtgaggcgagcgtcgcgttttgatttttttgcgtttcggtcgcggttttgggggtttagggttttcggttggttgatggcgtttgaattttggtttttttatttttggcgttttaggcgttttttgtatttttagcgagaggggaggtttgtttttagttaggcgagtgattgcggcgggtagagggggtagggattgagggcggggagtagatgtgggttgcggttgtttttcgtcggacgagtttcgtgggaggcgggtatagaggggtcgatatttggagatgtagaggaagatggggttttaaggattagagacgatgagtttggatatacgtttagttaaaaatggtgtttttaatttttatttttatcgtttagttttaatagtttcgatcgtttgttttatatcgggaacgtgtaatttttcgcgtttaggtatgggaagggtaagacggaggcgttcgagcgttgttagtttttgtttcgtcgtagttgagggcggagagcggtttgcgttagtttttcggagttgggttggggttatggggttatacgggtcggttcggtattatcgagcggtggtgggtttttagttggcggtcgtcggagtaataagtttaaagatttttaaggatcgttttgatgcgtcggggttagggttagggttgttgcggaggtagcgggacgaagtgggcgttttttttttttttcgttttttgcgtcgtcgtcgtcgtcgtagtcgcggttatagcgttgcgt

SEQ ID NO: 7243 - DNA, 1218 bp, Artificial Sequence
  Description of Artificial Sequence: Synthetic polynucleotide
cggatttacgtcggttttgttacgtgttgttcgtagttttcgttcgtttttttcgcgttggtaacgggtattgattgttcgatattttagcgatcgtagagatttttttaatgtcgggcgtattatcggcgggttagcggtttcgttggtttttttgatatattttttatagttattttttttagttgagatttttttttttaatatttcgttaattaacgtgtaattttttggttaaaatgttagagttaagattaaatttgaagaaaagaatgaaattataggaagttttttagatttagtcgttagtaaggttatggttcgaagcggtgtaggggcggcgcgtcgggaagttattggtagagttgtgcgtattggggggtgttgtaagcgttggggagagtgtggagaggttgcgtggagttgcgcgttcggggtgggagttgtatttttaatgaagcgcgtgaagggtaagcggtgatgggttttgcgttagtggggttgggagcgtgttgggggttgtacgtggggttgcgcgtaaggtgagaattgcgtatgtgggtttggggattgcgcgtatcgaaggttgtaggcgttggggagggtgttgggggttgtgcgtggggttgtttttatcggaagttgtacgttcggggaagcgtagaggcggggtgttgcgcgcgttggggagtacgtggggggatacgtagggggatacgtagggattgttcgcgcgaatggtttcgaacgtatgcgttttattttatattttatagtcgttatgacgatcgggaggttcgttcgttaacggttagttaacggttgcggggataagttcgttgaggttgttaggcgagttaggtttttttggatttcgtttgattcggatgggttgtgtttgaaattgatttagttttattagggattatgaagaaataaggagtaaatttaaagtcgttgtaattttttcgttttagttcgtttaagcggtcgtacggggtttttttcgttcgggagttggaggtggaaaagtcggttttaggcggcgggaaattgttagggggcgttaggaggtttttttcggggaggattttaaatttgaaaaagcgaaaaggtttggagttaaaggtggtggttaagatttttttcgattttttttagttcgttcgtaattttttggcgtagtttcgggaagaggtgtacgaattgtaggcgcgg

SEQ ID NO: 7244 - DNA, 1848 bp, Artificial Sequence
  Description of Artificial Sequence: Synthetic polynucleotide
cgtagtacgagtgttagggcgcgtatttggggggtgttttggcggtgtggagagagaagagagagggcgcgggtgatattacgttcgggttttttttttttcgtcgggtgggtggggtttcggcgcgtcgggagggcgcggggttaagtagggggaagaggaggagtaggtatgaatgtgtttgtgtgaagatcggggaggggtggaggaggaggaggaggaggagaaggaggaggaggaggaggaggcggcggcggcggcggcggcggcggcggagggcggggagggagcgcgcgcgtggttcgcggcgttcgggtttttttttagttttcgatttcggttcgcgacgcgtcgttttttagtcgtcgtcgttcgtttcgtagttgggatttatttcgggtttggggattcggcgggcgggagaagcgggggttttcggcgcggtttggaaggagcgagaaagtaaaagtaaggcgagtagtattttaagtttttttaatttcgttttttgcggcggtaggcgttttgttgtttagcgcgtttttttcgagttcgagagtggttgaaagaaaagggattgggcgggggtcggggcggaggaagagagagtgcgagggagcgaggagagttcggtaatatttgttaaaatttgggggaggaggagcgcggggaggaggaggaagaggaggagagaagggaaggagggagcgcgcgggaggggagcgcggagtcgagggataatttttttatttcgtgagtagtgtaggcggtgttaggtcggggcggggggtttttttatttagtacggggtattaggtcgggatgggatttttttttagaaagtcgattggatgttaggagaggcgtacggttgggggttttttttttttttttttttttttttttcgcggttgaattaaattagaattgttatttagggtttgtgagttagaagggatcggattatacgattttcgaaattgatgtcggagttgtacgagcgggagggagcgggtaggggtagcgttatcggcgcgttcgtatattcgtattcgcgtatattcgtcgtttttatttattcgcgtcgttttttcgtttttttcgcgcgtttcgcggtcgttcgcgtcgtattatgttcgcggcgggcgtatttcgcgtttagttcggtcgttcgtggtagtcgtagtcgttcgcggtcgcgcggagcggggagtcgttagtttgcgtttcgttcgcgggtttatgggaagttcggggatttgatagtcgttgtcgtcgtaggtacgtttcgttcgaagttttttgtttcgcggatttcgtagttcgtttttgcggtcgcgttcgcgttttcggggttagaggtggtttttagcgtggggacgggatggagtgaaaatggttgttaaaaggcgtttagatttagagagtcgtcggtgaggcgttcgagtaaggtttgtattcgttttttttttttggaaggtttttttcgaagagttcgattcgcggatcggtcggagacggattggagaattttatttttcggaggggggacgaagtttgtcgtagtggtggcggcgtttttcgttttcgtttttatttaaagggtttagaagaatttcgcgagtttcgtacgcgtttggtttttttttttgcgcggtggcgttttacggttcgggtttcgggcgcgtacggcgttcgggatgggcggaaggaggcgggaggtatggtgggtgcgcgcggggattttcgtcgcgggggtcgtcgtcgttggggtttttttagttcgggttatgtttcggagggcgggggtgtggtgtgagcggatggagagaggcgcgttttcgtcgt

SEQ ID NO: 7245 - DNA, 2119 bp, Artificial Sequence
  Description of Artificial Sequence: Synthetic polynucleotide
cgcgggaggtagatagcgttttcgtttttgtaattatttcgttcgttcgattgggaagatagtgataaagttcgggcgtagaaaaggtagggttagggtaatcgtcgagtggtagcggtagggattagattgtgtttgattttggtaaattttattttttttgggtcggaggtatgtttatagaagggtggttagtaaggttggaagagtcgaagtttttttttattatttatatattattttcgggttcgtagggttgggaggcgagtttagtacgcgttttaggtgcgtaggggaagagtttagcgttgcgcgtagagtcggttttggagtttgttttgggggtttgtttttttcgtttatttttagtttttttgtggggatgggtgcggtaaaagatcggcggatttttttggtcgtcgtttggtcgtttattagttttttgattttggttaaatttttttttttttatatttgttttttttttttatattttacgttaggggcgtttcgtggattgtaattttgaagagagttttggtcggagggtgttagtttcgattgcgtttttaattcgtaggagtgattttgaatatatttttattcggagttttagtgtttttattcgtcgtataggaaaaagcgcgttcgatttcgggtatttttagtatcgttttagtaagtgtgttcgagattagatgaggggtgcgcggttgtatttatcgttttttagagacgtgggcgtttggcggggattaaggtggttgtgattagtaagtgcgacgtagttattacgagtttaaagtttatggttagtaggttgcgtacgggtagtaaggtataggatacgaaggtgattaaaaggagttgttaaattttttgttcggcggtcgttggttttttagcggtttcggcggaatttcgggcggggtcgtttagcgcgaaaggatagtagagtagcgcgaaggtgaggttgaagagtagcgttagttggtcgatttgttgtagttggggtatttgtagggatcggacgttggttattacgagtagcgttaggaagaggacgtagtgtatcgggtgtgagtttttggttaggtcgggcgcgggtttcggcgcgtttagtagttcggttagcgttagcgcgttcgttagtaggttgagaacggttagcgtttttagcgtggtcgtttgttttagtcgtagcgtgtagtcgcggaatagcgtttttagttttgggtaagcgaatttttcgtcgtacgttcggagttcgcgtcggcggtttgtttcggtcgttcgttcggcgttttcgggttcgttcgcgtcgttttcgtcgtcgttttcgtcgcgcggcgttttcgttattttagcgttatgtagcggtcgcggtcgcgggcgcgtttttcgtcggttcggggcgtcggggcgcgggcggcggcgtcggggcgggcgggcggcgggcggcgaggcgtcggggcgcggggcgcggggcgggcggagttggggcgtcggttgtttcgcgcgcgcgttcggagcgcgttttttttcgttcgtcgcgtttgcgtattggagttcgttcgcgtttcgatcgtggttttcggcggcgatcgcgttgcgatagtcgagtttcgggagtcgcgaatttgggcgcgtatagttcgcgttttaatttcgcgttttgcgttttcgttcgtcggaggagtcgcgtgatttcgagtattttttttgtttttttcgagttttagtttttttatcgtgtatagtggaatttatttttttggcgttatttggggagtcgaaaatattgaaattttgcgaaattttttgttgcggggtagttaattttggaaaatatgtgtttttttttatttaataaaattaggttattagatttgagaggggttcgcgtttgattgcgaatttagggttttcgtttttacgagacggagaatcgacgtttaagaattttcggggttaggaggaaggtggaggtttggggcgtacgttttttttatgcgtatgagggatttttcgtttttcggtaatttttttttaagttttagggtcgcggagattttgtgggcgggtgcgggttgcgggagttgtgttggggaggcggcgg

SEQ ID NO: 7246 - DNA, 562 bp, Artificial Sequence
  Description of Artificial Sequence: Synthetic polynucleotide
cgggtcgttaggagggggagggggacgcgcgtcgtcgggttcgttattttgtattcggggtcgttggtcggtcggggtatttttacgttcgtttcgttggcgagattggagggattcgggatatcgtaaagtattttttttagtgtttgggagcgttcgttgtacgtttagttttacgtttttggaattggggttttttggttttcgggtttaggtttcggttttaggatgcgagtgtttattcgagggggtgggaaaagttgatttttcgtaagggaggggaaggtgtaatttatttttttagataattaatggaatatttttcgtttttttttttttttatttgtttacggtagaagttaggatggcgttttttatgttggtttgggtgtatatataagtgcgtgcggaagggtggttgtaggcggaggtgatagcgaagtaatttcgtagttcgttcgacggttttttgcgttttagatttttttttggcgtgtaagatatcgtgtgttttcgtaaaacgggaatgttatatttgatagcgtattttttcgttttacgg

SEQ ID NO: 7247 - DNA, 1404 bp, Artificial Sequence
  Description of Artificial Sequence: Synthetic polynucleotide
cgtttgttttagcgcggttttcgggggaggtagtagcgttttttgtttttcggtttggtttttgcggtcgtagtttttcggttttgttagggttgtcggcggtttcgtttgtttagttagggttgcggtttagaggaacgcgcgtcggtgtttcgggttgtcgcgtcgttggattttagtttgtatttcgtttttttttttttgaaaaggtattaggaaaagagagagggagagaagagtttatagtaggtaagtttggtttgggttatttgttattttagtgggagggtgtgttggagatcgcggtgttaagcggggatagtcgggatttgggggtggttgtgggttcgaagtggaggacgagtatggtttgggagataaggaatcgttttgagatagagaaggttttcgggagcggatagagagtgggcgaaatcggtgcgtagtaatcgcggcgttagttttagcgcggtttttggggcgtagttttatttcgttttagtagttgcggagttttttgacgagttttcgtttggtagtattgtataaagttttttttttgagacgcgtttaggaattttgttttttttttggttttttggtttttttattattttttttggtttgggtagtagagagcgtttatgaatgtgttttcggttttcgtaggttgtaggtttatttggagacgttttagtcgggaatattcggggagtatttgattaaagggtatttgcgttttcgttcgtttttttttttgttggtttgggagaagggaaaggggtaaggaagaaggaagggaagcgtggtggtttttgttgtagcgttttggaagaggaatgggcgacgttttttttttcgtcggggaatcgcgacgtttcgtttgatggaagtgtgtatttttttagatttagagggaaagttggagttaaatagtagttataaagttggttgtttgaaatgtggttaaggtaaaatattcgggggatttttttgtagtagtgggtttggttcgttttggaaaggtcggatttgattcgtgttgggtatttaattaggagtgcggtttttagggtgttttttttcggtttttgtttaacgagtttggagttaatgcgttaatgggttattttggtagcgtacgggtcgttttcggtattgtttttttttttttgatgattcgagtttaattttttgggttgagttgttttgttttcgttatagtgtaaggagggaagttgataggaggaggagacgtcgcgttgtggtagggagttttgggatttaggggattggaagagagtcgcgcgttagtagttggggtcgttggtgttcgggatttcgagttatggggataggagttaaatagtcgaatttttagcgatttcgtttcgagcgaagcgg

SEQ ID NO: 7248 - DNA, 819 bp, Artificial Sequence
  Description of Artificial Sequence: Synthetic polynucleotide
cgcgggggcggcggggtgatagttttcgtgtatgaattagttattttttaggtttcgtttcggcgggggtcggtcggacgttcgtttcgtataaagcgggtattcgggtcgtttggagtagaaagtcgcgtattttttttcgttaggcgttttttcggacgttttgtttagcgggtcgttcgattttttgtattatggatttcgttcgttttttggggttgtcgattttgttgttttttttgacggaggttgtattgggcgatgttgtttaggagttaataggtatttggtcgttttaggagtttttttttttaatcggcggagagggcgtagcgggttatggggtttcgtgtaggcgttttttaagtttcgttttttttaggtttttgtcgcgcgtttcgttggtaggggggattcgtttttaagtttgtattttttttgtagaggttttttcgttcggaaggggatagaatttttcgggatgttttttttttttaggagttacgtttgattatttttttttttttttgttttttttttgttttttttttaggaaataacgcggagatttgttttttgtttttagattacggattttgtcgggttttattttttcgttattattacgataggtatacgtagagttgtcgttagtttttgtacgggggttgcgagggtaacgttaataatttttatatttgggaggtttgcgacgatgtttgttggaggatagaaagtaagtgttttgcgcgtatttaggattttcgcgttttttgcgtcggcggttggtagtagtttcgttagttttttacgtttcgt

SEQ ID NO: 7249 - DNA, 1128 bp, Artificial Sequence
  Description of Artificial Sequence: Synthetic polynucleotide
cgcgagggtttttagcggttcgcggtttcgggcggatttttagaacgagtgcgggtcgttcggattggtagattgcgagtttcgaggggcgcgggacgtagtcggtttagataaagaaatcggcgttagcggtcgtttttgtcgttttttttttttttttacgtatttttttaggaaaaatagggtatattgacggttaaaggggttggtttttttttttagatagttggacgggaggtgttttttgcggggttttgacgtttttcgtagaagagtcgcgggtttagcggttttcgatagcgttttcgtttcgtttttcggcgggcgtttttttttgttttttcgggtgcgaatcgggcgttggtcggggatttcggggacgcgtgcgtttttcgtcgcgcgaggtgtcgtcgagttagttcgagagggcggggggcgggcggggcggcgcgcgggggcgggggagcggtcgggatacgtgtggcggcggcgggggggacgcggcgttcggggttttaagaaggtgtggagcggggcgggcgtttttttaggtttggtcgaggggcgtcgcgtagaggcggcggcggcgtacggaggcggtagacgacgcgttttcggcgttcgtagtttcggtttcgcgttttcgcggtttaaagtaattttgggagtcgtcgtttttcgcggaatttttcggcgggggttcgtttttaggttcgttttcgagttcgtttcgttttcgttcgtttttttttcgtttttttttcgcgtggttttttcgtttcggcgtttttaaaattgaatgagcgagcggcgcgtagggcgcgcggcggcggcggcggcggcggcggtatggagcgtagtggttgggttcggtagattttttttttagcgttgttgttgggggcgacgttgagggcgcgcgcggcggttggttattattttcgtttttcgttttttttttttttgtgtatttattacggggagttggaaggggatggggagtagggcgaggtgtttatttttttgtatattgcgggtaattttatttattacgtttcgggataagaatattatggtaggtatcgtagtattttcgcgttcgtcgtcgtcgggtgcgttcgttagcgt

SEQ ID NO: 7250 - DNA, 1128 bp, Artificial Sequence; identical to SEQ ID NO: 7249
  Description of Artificial Sequence: Synthetic polynucleotide

SEQ ID NO: 7251 - DNA, 1128 bp, Artificial Sequence; identical to SEQ ID NO: 7249
  Description of Artificial Sequence: Synthetic polynucleotide

SEQ ID NO: 7252 - DNA, 1921 bp, Artificial Sequence
  Description of Artificial Sequence: Synthetic polynucleotide
cgggcgttgttttttgcggtttttttcgtcgaggtttgtgcgtggcggggtttttaggagcggtagttcgtgcggtttgggggcggtttttttttcgtatcgtagcggggcgtgtaaagcgtttgcggttgtagtgtgggcgtttattttacgtgttcggcggcgtgcgaggagtagtaatattttttgtgggcgatgaaggtggataggttgttgaatttgatgttgtaaagacggtagtatcggtggttgtcgttgggtagcggcgtcggcgtgtttttgttgggagtttggacgtttttgttcgagtaggaggggggcgtcggcgggggcggtacggtttcgggcgcggcggtcggggacgggggcgggtcgggcggcggtttttggggtttcgggtcgaggtcgtttcgggggttacgggattcgggttgcggggaggcggcgggggcgggagcgggcgaggggtcgcggtcggtcggcgttcgggtttcgattttcgggtcggttaggggcgcgtcgagtagtaggtcgtgcgttaggcggaaatgttttagtaggttttcgcgtatcgggtcgttcggggggtagtaggggtaggcggcggcgggtaggtcgagcgcgtcgggcggtggcgtagcggggtacgagtattttttgtgcgttaggtaggtttcgaggttgtggaagtttacgcggtaggtcgtgtattcgtggtagtcggttagcgtcggtgtcggggtttcggggagcgggcgtcgcggttttttgtttaggtcgatggggtcgtcggtcgcggggtcgggcgagcgcgtaggggcgaggtcggggtcgttttcgttttcgttttcgggtcgcggcgattcgggcgcgggggcgtggtcgggcggcggggggggcggggcgtcggtcgcgtgtagttcgtagagtttgcggcgtttgcgcgtgcgtataggcgcggcgggagagggggtcgggggcgcggtcggtttagggggtttcgggggcgcggtcggtcggcgcggcggcgggtcgtggcgcgaggcgtagtagtatcgtttgtgtacggtgtaggtttcgtggcggttgaagcggatgttgtaggtttcgtatagcgtgcggttggggtcgtttttcgcgtcgtttacggagttattcgggttttggttgttttcgttgtttcggtcgttcgcgtcgttttcgggcgtggtcgcgtttttagtttttttttcgcgcgtttcggggttcggggacgagcgcggcgcgtcgggttcggcgggttggtcggggggcgcgcgggtcgggtcggggggcgttttgggtttgcgcgcggtaggcgcgttttcgggcgtacggcggtttgaatagtagaggcgtttgtgtacgtagtagttgttgacgttgttgaaggtgatttcgtattcgaagtacgtagcgtttttgggggtttcggggaagagttcggtttgcgcgtcgtcggcgttcgcgttcgcgttttgttgtagtcggttgtgtattagttcggatattttggttaggattttcgaggcggggggcgtcgcgtcgggttcgaatacgtattgcggaaggaatagggtttcggttaggtttagttcgtcgggtatcgggttggagttcggcgtggggttggatagttcggttttgattttggtcggggcggggttgcgcggcgacggcgttcgcgacggggtttggggtttaggtttttcggggtttaggatgggggtcgttttcggtttttttatcgtttttattttgatgtttttgggggtcgtcgggggttcgttgttgtttttattttgggttagaggtttcgttttggttttttcgttggtggtttcggttagggtttttttgtttagttttggcgatggggtgggcgttaggtttaggttcgcgg

SEQ ID NO: 7253 - DNA, 2872 bp, Artificial Sequence
  Description of Artificial Sequence: Synthetic polynucleotide
cgggtgttagggcgcgttgcggtttcgcgggtgggtagaggcgcgtagaaaacgcgcgggtggcgcgcgcggttatttagtgggtttcgttcgcgtcgtcggcgtcgtcgtcgtcgtcgtacgtgcgtcgtcgtgagcgcgaagggcgttcggattcgcgttttgttcgttcgtttgttcgtcggggttattgtggatttttaggtaatagttaagtgagaagttttttttattatcgaaaggtgtttgcgttttttttacgtttttttattaagtgtcgcgaggtgcgattttattttaaatttatttataaatagttaggcgatttttttaaagcggaataaaagtaaaattaggttagatatcgggggaagtcggtcgtgttaacgcgtggatagggaaaggaacgcgattaaggtagtagttatttttgtgtacggttatttcgaagcgttagtagggtttaggagttttttgattttagaaataggagtgttttttttttattttttttttttttggagaagtatttttgagatgaacgttgaagtgtttaatttagacgcgagaagcgtgtatttgtttaattgagtaaataaaggttagtagttggattaataaagtgtgtgtttttaatcgttagatgtttttattgttgttttttttttcgaggttgggggtgggggtgcggggaggaaggggaaaagataataaataattaaaaagaagagagtaaataaatatatatttggtgtttcgatatatatttttttttagtcgaggttttttcggacgaagtaatattttgtattatttaaattaaaaattattcgtgagttaatagtaaattttttttttttattttttttttttttattataaagtaaaatgaaagagaataataagtggtgatgttgggttcggaatgcgattttaacgtcgagtttaaatttgatatatgttatattcgtttcggtaagtagggcgttgtttttggggcgaaattttgtcgttatcgcgggaggagcgcggagtagagtaaagtcgtagttcggtttagcgtggaggtggttgggatagggtggggtgcggaggtgtagcgcgttagagtgagggttaagaaatttatcgcgatcggggacgtcgtgggtagcgtttcgggaggtggtattcgcggcggcgaggtagaagtttttaaataatatatttacgcgcgagttcgggtagttgttgtcgcgagtggggggcgcgttcggggagggggggggtcgaggaagtcgtagttagcggacgcggtcgtcgtataaataatcggggcgggcgttcgcgggcgggttgcgggtggcgcggggttagagttagggcgaagcggcggtcgcggagttgtacgcgtcggcgtgtttcgcgttttttcggaggttcgcgttgtttcgcgtagtcgttttttttattcggatttgtgtgtgtgtgtgtgtgtgtgtgtgtgtttgtgtgtttgtgtgtgtgaatgtgcgttggtaggcgcgcgtattcggtcgcgcgcgcgtgttgttggtaatgcgaattgtatatatattgttcgcggggttgttttttttcggaggggcggggtgggggataggacgtcgtagaggattttgaagtatcgtcggattatttgtttgttttgttttattttgtgttgttattgtcgttgttgttgttgataggtttggaattagttggttaggatgtttttttttttcgtttatttattttttttcgttttttaatttttttaaggagggggaaacgcggggaagaatattgttcggatttgtagcggagttttttggttgacgttaggtttatttgttatgtaaataattcgttggagaatttgtttgtgttacgttagatttttttttatttttatttttttttttattttttgtttcgttttttttagttcgttttagacggcgagttagggaagggggtggggagggaggcgagaataaaatcgtatgttgtattggtaaagtcgagttgtgtttgttgttttttggtagtttttaaagtacgtttttttagtagacggagttgttggtaaatgaaataggggattttatttgaagtgtagaaagtttcgaagggatttaaagttttcggtggtagggagttaaaagtatatggtagtcggaaagggagattcgagcgtgcgttaaagcgttgattggtttttttttttacggtgtgcgtttttgcggtttggggtggagagaggtcgagtgtttttttttttattgttgttttggtttttgttttatttgggttaaggagttttcgggttttttcgtggtcgcgtagtttaggttatcggggcgcggtttggaaggaaggggtcgttaagttgggatttagagagtttgaggttttcgggaagggttttattagtgattgaggggagtaaaagtaatcggaaagaaaggaaagaagaaacggttagagtttgtttcgcgcgtattttaaagtcgaggcgttcgcgtgggggatgtacgggtttagtcgttagttttgggtttcggtttttatttatcgggtgtgattcggttgggcggtttgtttgggatttagggcggtgataggggaaaggtcgagggaggagagagcgggtttcggaggggacgtacgatcggaattttggcgaggggtttttttcggagttttagtttagaggggggttagcgtttttttttcgtcgttttttttcggttttttttttgttcgcgggtcgggcgatttttcgtcggtcgtttttttcgcgcgtcgtagattgagttcgttgttttgttcgtaagttagtcgtaaagcgtggcgtttcgagaggcgt

SEQ ID NO: 7254 - DNA, 2906 bp, Artificial Sequence
  Description of Artificial Sequence: Synthetic polynucleotide
cgcgtttcgttttttttggttcgttcgggtttagggcgtcgtttgtagttgcgcgcggtcgtttttagatggaatttttttattaacgtaaggttcggtcggagtagttattcgggagttgggcggcgaggggttatttttttttatttcggcgggtgtaggatcggggggtttgggtagtaattagtggggaggagcgttggattgtgtacgtcgagttcggtaggttttcgtatgcggtatgcgaagggaatttcgaggtttttttgtagaattcgagtacggttttttcggagttttttgtttcgcgtttgcggttttttgaattattttaataaaatgatcgtttcggtagttatttatgtttttttttgcgtagtgttcgtagcggatcgcgttgtgtggtatttcgagttttggggattttgttgtacgcgttttttagattttcgggggcggggagtggggagataatcgttagagtcgcggggcgggataaatggcggaatcgtcgcgcggcgttaggtaaattttgtaagggaatcgcgcggtttgtcggttttattttaagtattttcgaaaagaaagtatgtggcgggatatttgttatttattatgtgttattttcggtgacgttttttggagttgtgtttatcggggattcgggttcgcgggtgttgttcgttgtgttcgggcgggcgtcgcgttttttcgcgtcggtttcgggttcgttaggtagtcggagtcgttgggtttttttataattatatttttttttttatcgttttcgtttttttttatttttttattttgtagttgggttttttttttttttttgggggcggggaaggggggatgatttttaaaaattagaattattgatatttttggttttttcgtcgttttaggttgaagagcggagggggattcgcgggtcgagggtttttttttttgttcgcgttagggtcgttgggtgatatcgaaatttagaggttttcgtttttcgggggttttttttttcgtttttcgaggtgattggttggcgcgaagcgattggcgatttcgggcgcgattttggtcgcggtttttcgcgtcgcgtcgggtgaatggtcgcgggcggaggatcgggaggcgtcgggcgtagattaatcgcggtcgtcggtgggagtatttgttatttatatggaagagatttggcgtttgttaggttagtttagtttttttagtttagagattagttataagtgcggtcgttgtgttcgttttatgcggcggcggcggcggcggcggcggcgttgatatggagttgcgggttttcggcgggtttttttatcgcgttttttgcggggagtagggtaagattcgtcgttcggtagtagaaagcggtttcgaggaaagtaagtgtcgaattacgggataaaaagtttttggtttttaaatttttttaaaacgttttgtttgttggaaaaggagaattttttcgttttattttttttttcgtttttttttttaaaattttttagcggatagttaggtgtattatttttttttatattattttagtgatttgttttttttgagtataagtagatggttttgtatgttcgtagtttgtgagagaaatagcgggcggaggtgacgggaatggggggagaaggagagtgggtattagggggcgaggggttggtcgggtattggagtttgattgggtgtttgttgattttacgttgtaaagaataaggtagttattttttttgtttgtttatgattatattatagtaaagaggtttagaaaagagggagattttattcggaatttttaaggtttggagatgtgattttttaaaagtttagtcggcgaatgggagattgaagggtgacgggaagggggtaggcgcgttcggcgttttgattgggcgtgcggcggtaggattttaaagcgttttgtttcggatcgtttgttttgggtgatttttcggatttgttttggtggaattcggatttgtttcgtcgagatgacgaggtattttcgtttcgcgaatttaataggagggatttttgaagttagcggttttcgggatgagtcggggtaattttcgttttttgagcgtgggttggatggatgtttaattaggatttagggaggatgggggtcgcgggggaagtcgggcgtttcggggttttcgatatttatattttcgtacggcgtacgttttgtttcgagtttgcgtttttcgagttagtacggcgagtttgggattttcgtgttttttttttgtggttttcgagaaacgtcggagtttcgtgttttgttgggggttggggggatggagaaaaggtttcggggattttgtttaaaaagtaaaggtaaacgtattttaatagtttttcggtagttttcgcggttggcgcggttttagtttcgggcggtttcgcgcggggcgtgggcgcgggcgttcgggcggttaggtgcggcgggggcggaggttgtatttttagcgcgtcggaatgtttcggggcgcgggaaaggtaaaagtagtttggcgttttttttacggttttagtttttatttatttagaattcggttttaatagtttaaggaattgagaagaaaaaggaatttgcgttgggaaataggggtttttggcgggttgagtggtcgttgttatggtagagatagaaacggagaggtagagatggatcgtttagttatgttaagcgcgaagtttattcgtttagttagaaagttcggatattttttgagtttcgtatagttggtgaaaaaataatagaattattaaaaaagaaaaaaaaatttttttcgtttgatacgcgtttttttggtgtaaatgaaatgcggagggatacgcgagttatttagttgcgtaaaatcgtattttcgcgg

SEQ ID NO: 7255 - DNA, 2906 bp, Artificial Sequence; identical to SEQ ID NO: 7254
  Description of Artificial Sequence: Synthetic polynucleotide

SEQ ID NO: 7256 - DNA, 1696 bp, Artificial Sequence
  Description of Artificial Sequence: Synthetic polynucleotide
cgaaggaggggttggcggtagtgtagtagcgaagttcgggttttcggttttgggagtttcgtggtttcggtcgtcgtttttcgagtttttattacgtagtttcgaatttcgaacgcgagttcgcgtttcgttagtagttagcgggggtgaggatgacgcgggtcgggcgagaggtaggttaaatgtagtagtttcgtcgcgggtcgtcgggtttttgagtttcgttttttagagttagggggtttcgggtgcgggtcggagggcgggggtcggcgcgggttttttcgtcgtagtttcgcgtcgttttagtttattagcggttatttaattgtttttttcgatcggtttaaaatagttgcgaacgtttgcgatttgcgcgcggttttttatttgacgtttatttcggttcgttcgttcgttcgttttggtttcgtttcgttcgtttagagggggcggggaggaagcggttcggggaggggggaggggggagggggagagaggaagagaggaggaaggaaggaggaaagaggaagacgggcggtcggaggcgcggggttgcgcggcgtcggtcggcgcggcgttggaaggcgtcggcgttaatttcgcgaggtaggcgacggagggggagcggcgttaatatataagagtattgtattacgttaatttttttttagaatagtatgcgttagtagtatatttacgttttgattgaaggataaaaggatgagagagtagtttgcgtggttgtcgtttgtaatatcgcgagttcggcgcgaggaggagacggtgggcgtcgcgcgtaggggtttcgttgttgttgttgtcgtcgttagttagcggggattatgtttttgggtttcggagcgtttttcgtagtcgcgattttcgttgtttacgtcgttgtagtagttcgttggcggcgcggttattgagggcgtcgggagtcgaagtcgcgaattcgtttttttcgtataaagtcggagtcggcggcgcgtcgggggtcgggtagcggcgggcggcgacgggcggttgcgcgtcgtcgggggttgcggtcgtcgtcgtcgtcggattcgcgttcgttttcggattttttgaaggggtttgcggtgcgggcgcgatcgcgggcgtcgcgcgttttttcggtcggcggatcgggttcgagcgtagtcgttacgtcgttggttttcgggggtcggacggagcgtcgtttcgcgtgtcggtagtcggcggattggagaattgatttttcgtttttgttttttttatttttcgagaagaggcgaggagaaagggggtgtgtgtttggggagggcgaaggcgtcgcgaatatttttttttaattttcgtcgtttcgcgagtttacgatcgtaattagttgtcgtcggttcggagcggtcgacgtcgggagagggagcgtagtatttagcgagtgcggtttgggcggtttcggggcgttttcgtatttttttcggcggcggttcgtagagcgggtcggggtcgtcggagcgtattttggcgatgaagcgttttttttcgcggttggagcgagtcggtgttagggtttaaggataaagtcgggaagcgttggtggcgtcgttttttgggcggaggggggggtatgtatttgtatagttcgtcgggttttggtttttttaggcgcgttttaatttcgcggtttcgtcggtttcggtttcgg

SEQ ID NO: 7257 - DNA, 2054 bp, Artificial Sequence
  Description of Artificial Sequence: Synthetic polynucleotide
cgacggttagcgtttagagttgtaaatttcgaggcggttgagcgtttttttttgagcgcgcgtcgtgcgtttcggttatttatgtatgttttttttttcgttttatatcgttatcgttagggtagtttcgtgcgggtcgaggggatttaggggggtgtcggtaaacgttggtgcggaggagagtcggtaagtcgggcggcggcgggtgggagtatgtagggaggcgttttttgttttttttgtcggtcgttttttttcgttttagatgttagtcgcgagtttcgagttagcgagagcgagttagagagggagcggcggcgggcggcgggcggtagggaggagaggaggcgaggcgagggagggaggaagggaagtagggagggcgggagggaggagaggaggatttagagagcgttaggtagttggagtttttgtagcgtttggtcgggttttaatgtatagtagtagcgagtcgcggcggtagtaggtagttcgggagtttcggcggcggtcgagttagcggcggtttcgttttttgttttttgtaaattttgcgagtagttcgttcggggggtcgggggcgcgttcgggaggttcggttcggttcgcggtcgagtttttcgtcgtcgtagcgttagtcgtcgtagttattatcgtcgtagtttcgtgttttttcggggagtagtcggcggttttcgcggttttttagtttcggttttagggtattgttcggcgagtgtttcggtaagggtgggggttgtcgcggcgcggtcggtcgcgggttgtcggggggcggtcgtcgttatttagagaggcgcgtagaggcgtcgagagcgtttttcggcgggtttttcgcgtattcgtcgcgttcgggtagcggttcgatcgggcgagtatgggcggcgcggagtgacgtcgttgtgttcgtttggtattaaggatatttagttcgcgggggtggggacgaaggggggtagttcggcgtcgttatcgtagttttcgagagtcgtcgtcgttgttcgggtttcggggttgggtggaggaaaggggtgttcggaatcgatttttatttttcgatttttttgttggatattacgtttattttggacgtcgtaagagaagttgttaagtttcgtaggttttgattcggcgtttttcgcgtttttcggttgttttcggtttttttgtgtttcggtggagtatttgcgttcggggttggggttggaggaggtagttatacgcgcgtatacgtatacgtttagaggagggcgagaggtagcggtataggttttatttgtagtgttaatgcggcgttttcgttgaaggagggaaacgcggcgcgtttaggtaaggagtcggttcgtcggggagtggggtcgggcgggcggcgagggtagtaaggtcggatagatttgggtcgattcgggagtttttagtgtttcggagttagttcgcggtatacgtatacgtatatacgtaggtatatatatagatttatatcggtatatacggcgttcgcgtatttgtttacgttttatttggacgttcgcggaggtgtagcggtcggagtagggatttttcgggtgtgttttttttttacgtttttggatttagatttttttttttcgggattttcggggtgggattttgtgtattttcggttttgttttttattcggggaggttgagggagtaattttttagtttttagtttttttcgtttttagttgggttttaaaatgggagaagttttgagaggttttcggagatttatttagtgttatcgcggtttcgtggtttttggatattttgggattttaacgggagatagatttatagatattcggacgtatatttggagagagtggtggtttagcgttcggggaggaggttagataggcggttggggttgtagttttgtagggcggcgtatatgaaatagatattgcgtttttttagtaagaggtagtataaacgtttttttgaagcgtggtattgttttttcgggaatgcgtcgagattttaggtagaaagcggtttaaagtatcgtcgcgt

SEQ ID NO: 7258 - DNA, 1258 bp, Artificial Sequence
  Description of Artificial Sequence: Synthetic polynucleotide
cgaataacgtagcggcgttaggcgttagggtttttatttttgttttttggatttttttcgtttttttgttttatcgagggttttgtgattcgattttatcgaattaatcgttgtttatcgagggtttgttgcgtttaaggaaggtatcgggcgacgagtaaggcggggacgtagtttggggacgtaggggttcgggttttagtttagagataggaggtcggcgtttcgatttggtattcgtcgacgaatttattttaaggtttttattggcggagtttttgttatttttttttttttttaaatgtagttttcgttattttttcgcgtttaggggttgttgtttgagtttagttttgtttattggagggcggcggtggagagggtgttggtttagcgtcggtagttgggtttaggattaaggtgggcgttcgtcggttttggtttttttagttttacggtgtaggatttagggcgcggttattcgagtttttcggacgtttttttttttgatgttcgttgtttttgttttggcgtttttagttcggggtcgtagtttgttttttttttttttttttttcgtcgtagttcgtcgttttcgggtagagtttatgtttagtttgggttttcgttcgggatttaggaagaggttggcggggttggagggtgcgggtcggcgcgggagggcgcgggaggcggggagcggcggtttttgattggtcggggcgggggagtgagcggagttttttataatgtttcggtgcggtgtagtcgcggatggatgttgcgggaaggggttgttatttgttgtttttgttagcggcgcgcggatttgttcgcgtttttgtagtcgtcgtcgtcgtcgtcgttagttcgttcggtttttgtagcggcgtcgtttgcgtttttttcgcggtcgtcggagcgggcgttatgaattttagtttttcggcgggagaggagaaaggggcgacgggcggtagtagtagtagcggaagcggcgtcgggagttgttgtttgggcgtcgagggcggcgcggattcgcggggcgtagggttagtcgcggcggcgggggtcgttgttttggacgagttcgcggtcgtcggttagaaggagaaggacgaagcgttggaggagaagttgaggaatttaatttttcggaagtaggtttcgtataggtaggtgcggggagtcggtagtcgagataggtgcgtcgcggcgggagatttatttttttatttagtaaggggcgttttcgcgg

SEQ ID NO: 7259 - DNA, 628 bp, Artificial Sequence
  Description of Artificial Sequence: Synthetic polynucleotide
cgcggtggttttcggtttttttttattttattttacgaatcggcgtttggtcgttttgaaatgaatgatttcgtcgcgtttcggcgtcgcgtttttagcgttttttttcgggatagcggttaaggtgattttgatcgttttcgggtcgcgggtcgggtttgggtaggggtttttgggttaggagagggaggtcgtttcgcgtttattttttaaggtcgttttttagttggtgttgttttcgtagttcgattcggatcgtcgtagtagtttttcggggtcgcgggttttagtttttgcgggcgaacgcggtttgggggcggcgggggcgggcgcggggcgcgcggcgaggggcggcggcggtcgggttcgcgaggggggttttcgggtcggttttatgcggggcgtttcgtcgcgtcgcgttcgcgtttttgtatcggggtgcggggtttagttcgacgcgtattcggcgtttcgcgcgttttgcgggttttttaggtcggtttcgggtgggttaggatcgcggcgttggtaggtcggggttgagttcggtttttcgcgttggagtttttgcgtcgggtgtcgtcgcggtgcgtttagcgtttgtttcgtcgagtcgtagtttttacgt

SEQ ID NO: 7260 - DNA, 1075 bp, Artificial Sequence
  Description of Artificial Sequence: Synthetic polynucleotide
cggaggttcgttttcgttaggggtttcgggggtgcgtgattatgaattttagagggttgggttttgatttgagtgtcgattcgttaatgaggacgggaggataaggttgtcgacgtagcggaaggtaggggggaagcgattcgaggatttgacgattatttttaggtaggggttttttaagtaggtacggaaattaattttattaaatcgcggagtggggattgggttcgggcggtgtttagtagggtaggggtagggttagttggcgcgtaggtatttgtagggtggagtagaataatcgtggggattcgtttttttggaggggtattgtttattttttatatgagttttaggatattttcgtggggcggagtttcggagacgttttaggttacgttttcgtcgttttatttttgtttgcggggggtcgagtagggagggaggtttagcgcgcgttgtgtgttcgtagtgtttacgggtagcggggacgtttgcgttcgggttttcgacgcgtagtttggagagttgcggagggtgtttcggggttatatatttattattaattgtatttaggtaggtttttttgtttttttcggggtcgtcgttcgtgggagggaaggtgtttcgtttcgatttatttacgcgggtagcggtgtttttttcgtttatcgcgttatcggtgacgttcgtttttgcgttcgtaggtgtacggttaggtgttttatatcgtttcgtacgacggcgttttgcgtttttgggacgtgcgcgggtttcgaggtgtttcgcggtttttttcgtttatgcgtagtttttcgcggttttttagtaataaggtgggttgcgtcgtcgcgtttttgtagtcggtttgatttcgcggggtttttgtagacgttagtttagatatttagcggtttttagagcgtttcgttttgttattcgcggtggtggcgttcgatggtcggcgaggggcgaggagcgaggaagttcgggcgggaggagagttcgtcgtaggcgtttggtttttttttggtggttaggaggcgttgggagcgggagtgttcgttttggggatcgt

SEQ ID NO: 7261 - DNA, 5566 bp, Artificial Sequence
  Description of Artificial Sequence: Synthetic polynucleotide
cgaattagttttgtcgttggatttttggtcgttgttcgggtcggcgttagttttatataatgtcgcgtgagtttttgtgcgtgtgcgcgggggaggttcgagatgtttttttttcggtaagttttcgcgttagtatcgttttttagtttcgcgggttttttcgcggcgagtcgggacgcgtggttttcgcgggtttatttgaagaaggtcggttcgagtagcgcgtatagtagatttacgtcggttagagtatgggttgcgcgtttaggttggcgtcggtttgcgagttgttcgagttcgagtttatcgataggtcgtcgtcgtttaagtcgcgggttttgagcgattcgtttagggggtcgtcggggtcgtcgttttttttggcgttatcgtgtagcgagagcgttttggagtcgtttttttcgttattcggagagtcgttgtcggcggttgggagcggttcgttcgcgtcgggcgtatatggcgggttttgtcggggttttcgggagttcgagtttaagagttgtttcgagtcgttcgcgtcgtcgttttttttcgtatcgttcgcgtcgttttcgtcgtcggtttcgtcgttttttttttttttcgcgttcgtatagtaggttttcgcgttttttcgtcggtcgaattcgggtcgtaggatgttgtcgatgaagaagttggtgatgcggtgcgggtgttggtggttgtcgggcgtttgtaggatcgcgggtagtattagagttcgtcggcgttcggtgttcgtttcgttcgggttgttatcgtcgtcgtcgttcgagtcgtcgtcggggttggatttcggttgtcgttgtttttttatcgtcgtcgttgtttcgttaggtttggggttatttttttttatgttgtttatagtaaattttatattggtttttcggggacgtttttttaaattagttttcggttttttcgcggcgtatacggagattttcgcgtttttatttcgtcgagtttttcgagggcgtgcgcggcggtcgcggttagggttgaggttttataagtcgtcggtcgcgttcggcgcggagttatttttgaatttacgaattgggttagaaatattacgagtcgtttcgttcgtttagacgatgagagatttaatagagttaagttttcgatttcgtcgcgtagtcggggtttagatagtcgtagtggttcggcggggacgcgggtcgtttttcgggtttttcgttttttttcgcgttcggtcgtttcgggtttcggcgtcgtcgtttgggtcgttcggggcgagagttgcgcgtatgtaggtagcgcgtttttcggcgtttacgttcgttcgggtcggtttcggtcgtcgtcgtcgttcggtcgttttcgttcgtacgttttagtcggttttcgagggtgtcgggcgttcgcggttagcgcgttcgttatcgttcgtacgtatatggaggtttttttttcgcggtcgtcgtttcgttgcgggtcggggcgttttatcggcgtgcggtcgcgttttcgtcgagtttcgtagagtttcgcggttcgagtcgtatgggtgagagacgcgaggttagggttcggtcgggtcgggttgggtcgttcgcgtttttcggtcgttcgtcgttttcgtcgtttcggttttcgcgcgggttcggaaatttttaggttattcggcgtaatttgagatatttttattttggatttttgtttttatttttaatagagttttttcgagtgacgtcgtaggtcggttttttggatacgtgtttcgggttaatggtcgcggcgtcgcgcgtttacgtgacgtttcggtcgtcgttgggtgataggagtagttcgtcgttttttttttttttaaagcggtcgcgtttttcgtttcgggtgcgggagtttaggaattcggagagattttcgatcgcgttttttgcgttcgttcgcgttttttttgtcgtttcgcggtttaggggtgtgagttattcggcgatagtttcgttaggttatttcggggcgcgtaggtggatacgtataggaagatcgttatttttaagatttttatattgtttatcgtggggcgaaattttataattttttgtataaaatgtataaataatattaaatgagttgtcgagatataaagggatttttgtggttcgttttttttgttgatggagaggaatagtgttatttttatttgattcggtaattcggtagttttttgttttaaacgtagagttggcgcgtaggatattttttttgtagatatttattgtaagtgtgcgtgtgtgtgcgtgtgtagggaggcgcgtgtatacggtcgtattttattcggggatagcgatttttatgaaatatgtttagcgattcgaaagagcgggggaatgtagtatgcggttttatttgcgaagggagaaatttaggagtttcggaggttttaaaggaattttttttgttaaggagaggaggggtgattgtttagttaagattttaaaattaagtcgttcgtttttttttaatttttttattttgattgaggagtttttagatcggttatttcgttttttttgttttaaaattttttaaattaattttgtcggagagtagggtttatttgaaacgagaattaggaatttaacggtaagggtgggagttttagttggtttttttttttttttttttttattttttttagattttttttttagttgttgttagaatgtttaattggaagttttgtttttttttttttttttttttttttttcgggtttttttttatttgtttttgtttatttattaaatattcgttgttattttaggttcgtttgtttattatttaaaatgtatttttatggaaatgtgtgaatttttggaaatattcgatagggtagttttgggggtgcgggagtatttgtacgttatgagtatttttagtgcgggggaggcggggaggtcgtagtttggtacggatattttagggttgattggttttgggtagttgtatcgtgtttagtaatttagattttcgtagaggtagttagtaggttgttgttaggttttgagtgaatttggggagtttggtaagtattttcgaggtagcgtggtttgttaggttatttggggtttgaaggttgtattttggttttgcgaagttttttttttagtgtttattttacgtgttgttttttttttgtaggttttagagtgttggttgggttgggatgagaaacgatagtttttatagttgtttttaggaaaattatttttttatttaggacgggaatggtgggggaggaggtgttgggttggttttttggttattggacgtggttttggttagagtgtgttttttgttcggtgtgtttagggtagggtggggaagttttttttcgttggggttggatttttttattttttttttattggaggagtttttattaaatgttttggttaggtatatatttgttaggggtttttttcgagttttaaaaaattaaattttatagtttatttgtttttcgggaaaatagggttggtgagagtttgtgggaagttttattgacgtttatttggttttttggggggagaattttttgtaattttggaaattttgatgattattagttaggaaagggagggtttaacgattttgggttttttgaatatgatattggggggaggaggggttttgagttttttggtttttgtaaaattattttaggttaatggttttatttgttttatgaaagttaattaggcggttttttgagaagtattttttgaatttttgggattttttgtttttgattgttttagtataaatggttttaagacgttgggttttagttttgtgtttttttgcgatttagattttaattcgtggttgtaatagagattttgggaagtagagcgttatttttagggcgtttggcgggtcggtgggtagagatttgttttcgtagggtttgcgggttgggttttggggttggttggaggaagaggaattcgtgggtcgtttttttggaaaggaggaaggtgagaggtggagggaggaataggagaaagagaaataaatgaagagagagataattagagggtatcgggttttttagagtggatttaaatacgaaataattttgggaaagcggtaagaggggttatcgtttaaagggtcggggaagttgggatggggttgtagaaagttgagttgtttaggggttgggcggtgttgagttttatatatacggaatttcgtaaggtgttttaggaagtttcgagaagcgcgtatgaggatcggtttcggtcgtttgttttagttgggacggcgtttcgcgttttttggggatgcggggtagtggcgtgttttttttttgcgatgttagtttcggttgtcgcgttttcgcgagtttagagttttcgttttttttttcgaacgatcgtcgtttttaaggtcggtttttttgtgcggattagacgagtttttttcggatattagtttttttcgggatggaaagtggggtattgattcgggaatttcgttttttttttagttttatttaggaatcggagagcgttcgcgattattcgtttgcggaggacggttttttatattttttaggttcgttgtataaagaggggtttcggagagggcgagtaggaaagtagtttttagacgtcgtgcgttttaggatacggacgttagttttgtaaataaaattttagtgaagcgtttcggagatatcgggcgttcggatgtcgagttaggttttcgtttttatttgaaaacgaggttagagaagggtgattttttcggtttttttgcgttttttttattcgtttcgtttttttagtttgacgtggtgatatttggaaaaatggatttaatgaaagtcgttcgttcgcggcggtttcgttattcgcggggtagagacgtttaataatttttgagagcgagatttttattttagttaaagtaggtttggttagttttgcgttttcggttgggagtcgagtttcgtagttaagttttaggcgtcgggcggggaattggggtcgataggagagtaatatttttttcggggcgagtagagagttatcgtcggtttttggggttgacgtttcgattcggtttgtagataaaggtcgaaacgaaggggcgcggggagtaggggtggggcgggcggggttaacgggcggatattgcgtgtttgcgtttttttttgggcgaaggaggatcggtttataggtttatcgggcgagttcggggacggggtttgggaggttgggtttagggtttgagatttttttagaataattttcggaaggagggggttaaatgcggtagcggcgggtttgaaaagggttaggagcgtcgtaggaattggggtgtataggttttcgcgtgtttagcgtttcgttttttttcgttttaggtttgttaggggcgcgcgtggcgcgggtagagtttggtgggtgggttggcgcggatagaagttttgtcggggagcggggaggggggggtagtcgtattgtacgttttggttttgtttcgatcgttggagaagcgt

SEQ ID NO: 7262 - DNA, 5566 bp, Artificial Sequence; identical to SEQ ID NO: 7261
  Description of Artificial Sequence: Synthetic polynucleotide

SEQ ID NO: 7263 - DNA, 1164 bp, Artificial Sequence
  Description of Artificial Sequence: Synthetic polynucleotide
cgaacgtttggattttagcgagcgggcggttttttggcggcggtgattatcgttgtgttcgttgtttttacgcggcgttcgttaattttacgtgttcgtagtcgcgcggcggggtcgggcgttcggagttgattttagtttttaggatagaaagggtggttaaacgtagatttggtaatttttcgagtcggcgattatagattgttggtggttgcgttacggtttcgggagggttagtttttcgttgggtttttagggtattaagaaaagaggggtatgcgagtttggaagttggagagagttcggggttttttagagcgggtgggacgtcgcgtttttaggatttcgcgttacgcgtattttttttatttcgatatttattgttatttttatagcggagcgaggggtttcgtcgagggcgagcgtatttcgtgcggttgagatgttcggaacgttttttcgcgtttcggtttttttagaaggggttatagtcggttcgcgagttttcgggcgggggttgagtcgtagtgttaattaaggcgaggttattttggttcgcgcgttttttattttagggttttttcggtagagaggtgattgtaggttatcgttagtcgggtttttatttttcgttttcgtcgtttcggtttttatatttcggaattttttcggcggagtttgcgagttcgggaacgcggttttagttagagtggaagggatagcgcgggaattcggtagagagaaaaagcgggaattgggcgtcgtcgttttacgatcgggaggagattttttttcggttttttttggattttatttcggggatcgtttcggggttagagtttaggttgggagagtttttgggcgtatttatcgttttttttaatttttttttttttatttttagttcgggtggtagtggttattcgtcgggtttgtaggtggaggggagtttgcgcgtaaaatttacggtcggcggcggttattttttcgcgggaggcggttagattttggagttatacggttagagttagtacgagtagggttttgttttttatttcggggcgcgtttttttggaggagttgtaaggcgcggatcgattgatgagtcggttgagtcggaggttggagagggttggagtcgcggtttggcgttgagtaagtcgt

SEQ ID NO: 7264 - DNA, 1495 bp, Artificial Sequence
  Description of Artificial Sequence: Synthetic polynucleotide
cggcgcgtattttatatcgtttgttttgtgttttaaaacgtcgaagttaattttttacgcggttttttgttcgattatttatttttgcgttgttaggtatatcgaggggatcggttttttttttaggcggtttattttagcgtttttcgttagagggtatacggttttcgtgtaaagcgtttatggcgcggggtacgcgcgtacgtagtttcgatttttatagtttaggttttattttcgggttgggtttagtcgttaaggcgttggggaggggtcgtgttagggagcgaagcgttttcgggattttgggagggtgcggtcgggattgttgttttttgttttgagttttgggcgtaggcgttcggtaggattcggcgtttaggtgagcggcggtttttaggaggggaagtatcgcgcgatttaacgggcgtttagagcgtagggcgaagaggatgggcgagggagagggggagggagaggttacggtatttgaggaggaggaggagtaggaggagtaggaggaggatcgtggggttcgggtcgcgttgcgtatttatttgggttttggttgttcgtcgcggatttcggttttttgtcggagtttcgttttttttttttgtttttttttttgtttttgttttttttgcgttcggatatttcgtcggagacggagcgttttacgcggacggttttcggcgtaggcgagtttggtttaagggttcggatcgggtttgggaaaagtttgtttttcgagggggagagcgagcggtcgcgttgaggcgttcgcgttgcgcgggggcgtttttcgttgtttgtagggagcgcggcgcggacgcggcgggcggttcggttatttggaacgggcgttcgttttggttttcggggttgtttttgtcgtttcgggaagtcgtcgatgggttttatcgttggcggttcgcgttttggtttttgttcggcgttttcgtaattcgatcggggagaggttattatcgttttgtttacgtttttatcgttcggtagtcgtcgtcgtttagtttttggttttcgcgcgagttcggagttttaataagtttcggggaatttttcgtcggtttttttttaattgtttcgtagttatttatttttcgttcgtaggttggaggtaggcgtttttttcgtatttttttttggtttcgtttttttttttttttttattatatttttattttgaggcgcggatacgttatcgggaggagtttgggttcggcgttttcgggcgtagtttttttttttttcgcgttggtcgggcggggggtggcggcgcggttgtcgggaattttcgataggggtcgttggacgttgcgcggagatcgaggttagcgtttcggagattcgggaatttaggcggagattcgaggttttcgttgttcgttttttttcgtagttaggtagcgtttgggagggttgtttcgttttattttacgcggaaaaggacggcgtagagaaaagtttgcga

SEQ ID NO: 7265 - DNA, 352 bp, Artificial Sequence
  Description of Artificial Sequence: Synthetic polynucleotide
cgtcgtcgttggtgggtggcggcggttcgggtgttttttggattgcgtagtaaagaggtattttgggagatggggttaaggttttagggggtgttattcgcgaacggtttattcgttagattaggggggttttttggttgtgcgtttggttagaattggttttgacgatggaagtttttggaattaaagcgttgtttttttttttttgtgttatagttggagttgcgggagcgtttgttttgttcggagttcgcggttttttttcggttgtttcgcggtggcgttacgcgtttttttcggagtaagttcggtgcgtagggtcgggggcgtgggcggttgttgttagaggcgt

SEQ ID NO: 7266 - DNA, 1141 bp, Artificial Sequence
  Description of Artificial Sequence: Synthetic polynucleotide
cggggattaggcggtgtgtcgttcgggtagttagtgggtcgggcgagtttgcggggttggaggggacgcggggttgggaggttggggagttgggggttgatttcgggcgggcggggcggggtagggatttgtcggtttggggcgggcgtattagacgagtttttcgttcgtaggtttttagcgtttagtcgcgtttcggttgcgtttcgtcggtttcgtttcgtttcgtttcgtagagtcgtcgttagtagtgggagacgtgcgttgagaggcgggggttgcgttcggcggaatagtagttttcgggcggagagcggggtcggggttcgagagtaggtgatgttaagagttgagcgggattcgtgagcgcgcggtttagtatttattagggcgtttcgtaaaaaatttcgttttcgtttgtttttgggaattataggtaagttttgggttttcgaggtgtagttttaggtagagtttcgtgttgggaggtgggaagggggtttgattttggggatttaggtagtttggggatagttttattaggggtcggtgtttagaattggtgagggaggtattttaggggttgggggagaaggagcgagcgtttttcgtttttttttggtatttagcggcgcgtttgttggtcggaaaggtagcgagaagttcgttttttttgttttgttttcggcgatttgcggttcgggtgggagttcgtaggtttcgggtttttagcgtcgttggttagggcgcgggtaaagtttgttttttcgcgtttagtcggttttttcgttttcgtagcgtcgtaggtgtcgtttgttttcgtttttttgttgtaatcgttttattatggatttttcgatttagatttttcgcggggagtcgggttttatttgcgtttcgagcgtttgtttgttttttaatagtagcgtttggtttttcggttgggtcgagttcgatagtaacggtagcgtcggttcggaggacgcgtagttggagttcgcgtatattttttcggttatttcggttattattacggcggtttatttcgtagtgttcgtcgtgggtttggtgggtaattcgttggttatgttcgtgattattcggtgagcgcggggatagcgtagcgttgggggttgggcgg

SEQ ID NO: 7267 - DNA, 3297 bp, Artificial Sequence
  Description of Artificial Sequence: Synthetic polynucleotide
cgagacggataggaatcgaggagatttttttgtagcgttttttatttttcggatagaaattttgtagattacgtttatttttttatttcgtgtatcgttcgtggttcgtgggtagtagttgtttttttgggatttttttcgtttgttcgcgagttttcgtacggtcgcgtttttgttgttggggtcgttcgttggttttggttgttcgttaggatttttttttgatgttgttaagttcgggaagtttacgatgtattttagtgttcgcgcgtcgttttttttaaagttttttttttatttatttttttataagcgtggagggagatggggtaggtcgcggcgtttatagattttttttcggcgtttatttttttttttttatttttttagtagcggtagggtcgtagcgtacgtaaatttttttttaaaacgtttattttatttttagttagtcgttttttttagggttttttcgttcgagttgggtgtggggatcgtcgcgtatatagagacgggaaagttatttcggtttcggagcgtcgtttttttagaggtttttggttcgttcgtttttttagcgttggaggatagtcgcgtatatagatttttttttttaacgtttatcgcggtttttagttgtagtttgtatttttatttttcgtttttagtttttcgtttttcgttttttgttttttagttttcgtagttcgggcgtttagatttgtttcgattttttagggtagtttcgagggtgcggaagattaagtgttcgggtttgttttaggaaaatttcggcggcgtttgtacgttaattgttttggcgtaggcgaagggtggagggtatttttttgtttattcggtttttaagagcgtgaatagaggtttcgagtgaacgtttatatttagtcggttttttagggtttacgcgtggggcgtttatttttttattttgtttttcggtgtttttgttttggttgtattttttttaaaaggaggcgttacgattttaggaggttttgtttttttattttttttagcggcgtttaaattattagtttcgggcgtttaattttttttttgttttttttttatttcgtgagaaagtcgacgtttttattcgtttggttttttcgaaatacgtttcgggtggttaatgcgatttttagggtttaaagattagattttcgcgttttttattaagatatcgacgcgaagtcgtagaggtggaatcgcggacgttttggtaggttcgggatatattgattttggtggcgcgatgttttttttcgtacgcggacgtattcgtagttttatttttttaaattcgtattgcgggaaggaattttcgattcgtatcggttttcgtttcgtagtaacggcgatattttgaggttcggacgagcggcgcgttttttttagtttcggttattttttagtacgaagttttagggcgagttcgagacgaagaaagagagttcgaggaattgggatatttacgagtttatcgtttattttgtcggtcggggaggaagtttcggtcggttcgttttcgttcgtcgtgcgtatgcgtttcgcgggtgtttttttaatattgtagcgcggagggttgttttttttacgtcggcgattgtttatcgcgtttttcgttttttttcggttttcggtttttgttttagtttttttttttcggtttttttttttttttgttttgtttttttttcgtttttttattttttttattcggtcgggtaattttacgtttcgtttttttttagcggcggcgtattttatcgtcgcgggtgttaggggtattttcgaggttttacgcggggcgcgatttttatttcggtcgtagttttattgttttagtttcgtattagtaagttttaagagtgtggatgcgaagttaggcgcgcgtagagggcgttcgcgaagttttttgtgttatcgttttttttcggcgcgcggggtcgagcgagattagagtgtgttggattgcgtgttcggatttcgtgaatgaagggagcgggaggaaggagcgggggtgggcggtaggtatggagggggcgtttggtttttagagtttcgcgtttgtggattgcgcgtttttggagggtagttttttatttttttttcggttcggggcgtttttttgagttttgttttcgttttatttcggcgtagtttaggttttcggttttttcgttttggaaagcggttttcgtttttttttagttagttagagcgcggaggttttatttagtaatcgagcgggggataagggggggaattaatttttgattttagatttcgttgagattttcggtagtcgtttttcgcgtttttttttttagggatttcggagttcggggaaaggagtagattagggggtagcgggagggggaatttagtcgtttagtttttcggattcgtagtatcgcgtgttttcgtagttcgtagcgttttttcgggagtgggattcggtggggtcgcggggttagttttttggagttcggagggttaagttgaagttggaaattgatttgatataaaaataatattacgttatttttttttttgtttgtcgagagggtaggggagtgggagagcgagcgttgggagtaggcggaggcgcgtttgggggaggttcggagtaggcggaggagagcgatacgttgagagtttgaaaggtagtttcggggaagagcgagggttttttttcgtttttttggattatggaaaggaaatggtttaggaaaaagtagtttggagtgttttttcgcggggaggggcggtgtttcgggagtcgttaatgtttcgttttaggatttgtttagttacgtttcggttttttcgattttgttattttttttattgttagttttagcggagcgggttagttggggttaggaagaatcgggagaggttggtgttttggggaggttgggtgtggggcgtagtggagattacggtatttatcggtataggcgagttttgtttagcggtggcgtttttttttttgggtttggttatcggatgggggggttttagcggacgatttttcgagggtcggtcgggtagtgttagcgtcgtttcgagtaggagcgagaggcggttcggtagtttttcgtgttttttcgagagtcgggcggtcggtagggcgggaagtaggggggagaagtttaggcgttttcggggagtttcgggagggggtcgtcggagaaggtgagagaagaattttgcgaggttggaaagcgggttagaaaggaggtcgaatagtttcggggcggcgggcga

SEQ ID NO: 7268 - DNA, 2213 bp, Artificial Sequence
  Description of Artificial Sequence: Synthetic polynucleotide
cgaaggcgacgggtttaggatttgtagaaatcgttgcggtttggggcggtcggggatttacggttttttggggcggttttgaataggttttggggcgtagcgttcgttttttaaagaagtttgggatcgggttttgtttcgttgtaagttacgtttttcgtgagtttataagtgtaaaattagaaaagaatgtttcgtttaaataattaaagagcggtggttttcgcgggggtagcggaggcggttagtagggttttcgttttcggggagaagtgtttacgatttaagggttgtttgttttaggaattttttaaagaattatagatattgagagtattcggggtttggtaggaagtgtagtgtattttttagttttagggtaattaggatagtatgaattttttattttgtggtagaataaacggttagcgtttcgatgtggcgcgttcgatttttttttatagagtttaaaagttacgtttaattaaattgtagcgttttcgttttagttgggtatcggtttggaagcggtttggaattagattggattcgaggaggtaagatttcggtagcgcgaggttaattataggttttattcgcggtttttagttcggttttatcgtagtcggcggtagatattttaaattttttatacgtcgtttttagcgaggcgtttcggggaaagtagcgtgaggtagtgagtcgaggggcggggttaggaggacgtttcgttttcgagttcgtttcgtcggagggtttgattaatgattttttaagtcgttttagttttcggcgtagttttttcggtgggttaggtttttcgttcgatttgttttagtcggtcggagtatatacgtttggtcgcggggcgttcgtataaaagttatagttagcggaggttggaaatagtcgtcgatttgggtatcggtcggacgaggatggagtgattagcgcggttttggttatataggttttgttttacgtttttcgttcgtttttacgacggagcggagttttatttagtcgttttaggaaaggtgaggggttcgttagacgcgtattgcgtagttttcgggttcggaacggtggcgggtgtcgtatttcgaggtgaggttaagggtttttcgtttttcgggtagaaattttttttggcgtgaaaggtcgagggcggttggtgagtcgtggtttttcgcggcgtcggcgagaaggagtcgcgttatttttcgtgcgtgtcgggttggataaagttatttaagcgcgaacgagtgttgattttgagttgtgttttcgagattttttttttcgggtagagtagattttttgtttaatttgtttttgaaaagtaaagtcggtattgcgtttttttttatttttttaggaagtttaagaatttcggagtttcgtaattttttttagacgttcggaagtaaatcgcgttttaggtaaaacgagttcgtttgagagcgtttttagtttcgttgggttgttggtgggcgtacggggagaattagggggttgcgtttttcgggttaagttcgatcgtttttcggttttatcgtattttcggttttttgtagcgcgcgcggcgcgggaagttgttatggatcgcggtcgtttagcgggtagtttttttagcgttagcgtcgagttcgcgtttttggtcgtcgttattcgcgattcgcgtttcgggcggatcgggtcggggtcggcgggttttgggggcggttcgcgtttcgggagcgggcggtcggcggcggcgaatgcggcgcgggagcgtagtcgggtgtagattttgcggtacgtttttttggagttgtagcgtacgttgtcgttcgtgtcgttcgatattaagttgtttaagttggacgtgttgttgttggttattatttatatcgcgtattttattcgtagtttgtaggacgacgtcgaggcgtcggcggacgtcgggttgggcgttttgcgcggcgatggttatttgtattcggttaaggtaagcgggcggggcgtatcgcggggttggggtcgagattaggatattttgatttgttttgttagttatcgttttgggtagatgttttaattttttttcgggtgaggcgggaagtcgatcgggagaacgatttcggttcgcgagggtattggtggtaaggttttcgtcgcgaaagtcggttttttcgcggtttataggtggttggagaggcgtttaaagtcgg

SEQ ID NO: 7269 - DNA, 363 bp, Artificial Sequence
  Description of Artificial Sequence: Synthetic polynucleotide
cgcgggggttatcgcgttcgcgaacgtagagtttatacgtggattttcgcgtttgtgatgtttcgattcgtttcgggttttcgtatagataatgtcgcgcgtttttttcgtagttatttcgggattcgcgtttcgcgtcgttcggacgtttttttgcgtttgtcggggatatttatcgatattaggaattttagcgtgtttatatagtttcgttcggttttttggagttcgttgagtacgtatacgcgtaggcgaagttgtttttttaggtttttggcgttttcggcgcggttgttttcgcggttgttttcgtttatggtcggcggcggtgcgtagcgcggcgttgttcgtcgtgttgagcgt

SEQ ID NO: 7270 - DNA, 960 bp, Artificial Sequence
  Description of Artificial Sequence: Synthetic polynucleotide
cgtagaaaacgttgtaggggttaggcgttcgagatatttcgcggggtagtgggtattaggtttaggtttcggttgtagagcggaggggcgtcgggtttaggaaaggggttgtgggtgggggtacgggggagattcgaggggtgttgggaagagggtttttttttttagcgttagttttggtgtcgttgtgtattcggagtcgcgcgaagggcgtttttcgattcggaggtataggagcgtttagagaggaaagaaagaaaaagttatcgttggttcgaatttttggaagtcggagtcgggttttttgttttaaatatcgaggtagaattttttttagcgttgtttcggtttttttgttatttattttcggtttgtttttggaagaatcggttttttagtttttcgtcgtcgtagttgtgatataagtaagtgtagtcgcgttgttcggggttcgttagggtttttcgcgttcgttttttatcgtggttcgcggcggtcgcgttttcgtttcgtttcgttcggtcgtttcgtcggtttttgtttttagttgggttgtcgtgacgaggagacgttgttgtgaaattaaatttgattttgagtttttaggcggcggtcgagagttcgcggttgttgatgtttttgggttttatttcggggtaggagggcggcgatcggcgttcgggaagcggttgaggggcgtcgcgatttttagcgagcgtcgttcgagttttagttcgttcgggtagttttcgaggtttagggcgtcgtcgttaggtacgcgaaagttatttggaagggagttgggtgcgcgtaataatggggttttgagtcgtggtcggtaggggagaggtgtagtcgtttaaggttcgtggcgtcgggcgttgtacgtggagggatgtgttaagggtcggtttgttttttttcggggaggtggtaattgattgggacgtcgggggacgg

SEQ ID NO: 7271 - DNA, 1404 bp, Artificial Sequence
  Description of Artificial Sequence: Synthetic polynucleotide
cgttcgttttttttaggttcggtgggattagattcgaagttaattttcgttaggcgttaggtgtagattttaggttaggttagagtagtttttgggttttcggatcgggatgttcgttttgtttttttttttggtttcgttcggtttgttatagggggaggtttcggtttcgtatttcgggtagcgaatttcgtcggtcgaggttagtttcgtgcgggggtttttcgcgggatcgatcgttaagcggtattgttcgtttcgggcgttcgttcggttttagacgtaggttttgcggtcgtttcgtgataagtatattgacgggttattgttttttgacgagtgttaaaaagttcgtttgttttgaacgttaatttttaagtgatttttacgaggttttttttttcggttttttcgttgttgtttcgttcgtattcggtttttagtaggtgtttaagaaacgtttagtaaacggtagcgtaggcgagtttgttttgcgcgttggcgcgttttattgtttacggatggcgggcgattttacgggattttcggttcgtaggattttcgttttcgaggttgtttttgggtcgggaggggttattttagaggggcgtttattttcgacggcgggggtcggggcgtcgcgggtaggggagggcgtagtttttaagtagttttagtttggtttagatttcgcgtttagcgagtcggtcggttaggtttatattttttatttgtcgttcgttttaggggaagggttttttcgacgacgttcgagtttttttttttttcggagggtcggaggtcggcgtttattggtcggttttgggcgacgtttcgttttttcgacgttacgggttaatgagcgcgcgttgttagtttattagtcgggttggttgggcggttcgggagttcgagcggtggcggagcggcgagtagcgagtagcgtttgcgggagcggtcggtcggtcgggttttcgcgtttcgtacgttcgtacgtttagcggggttcgtattgagtatgggcgcggcggtcgtgcgttggtatttgtgcgtgttgttggttttgggtatacgcgggcggttggtcgggggtagcgggtttttaggtaagttttcgatcgaggtggggggcggcgggcgcggggggttcgggcggtcgaggcgcggtttcggagggtttttttttcgcggatttcgagttcgtttcgcgcggtttcgcgttttttgtttttttgtaaagtaatttttagggtcggttcggggcgtttttttttcgtagttcgggcggtcggggtttttgagttcggcggggtcgtattaggggtgggtgggtcggggtttcgggaggggaagcgcgagcgcgggagcgaggaagaaaggcggcggttttcggggatttcgcgt

SEQ ID NO: 7272 - DNA, 1247 bp, Artificial Sequence
  Description of Artificial Sequence: Synthetic polynucleotide
cggggggtaggtcgcgagagggagaggatttcgggagtagacgaagaagtggagtagttaaagtttgcgttagaagaggttggggattgcgagaggagaggttggggtttgtaggggagcgtagtagtttttagtatcgatttaaattttaaagattcgtggtttttgtttgatttcgagggtcgggaatagacgtttgtttttgtggagagcgatatttaatcgagaaaatggggttgtttcgagttgggttttgcgtttggtttagggcgaggtttttttggtttcgggttggtttttgaggggcgtaaacggtaggtttggcggttggggtcgaggagggagggtattatcgtttcgaggtagtacgtagtttgtagtagaggcgtttgttttaagttgttttttgggggcgtcgtcgtcgtttttttttttcggggtcgttcgtttttaggaaagtggaggcggttggcgaggatcgagagtcggggtcgcgttgcggagggattatattttcgggagttcgagggggattttggcgcggcgggttagtttttgtttttcggttacgggtcggtagcgttcgttttttttcggttagcgtttgcggttcgcgtcgcgcgtatcgttcggtaatttcgcgcgcgtttcgcgggggcgttgcgtttttttgttatatcggcgtatcgcggttttttttttttatattttcggttcgtattattcggttttttttttattttttttattttttttttgttttttttttttatttttttttttttggcgaggggcgggagggggcgtggcggggtcggggtttgtgtggttgggattcggtttttcgtatttcgagttcgttcgaggagtcgggtttcggtcgttgtttagtcgtttcgtgtttcgcgcgttttgcgtcgtcgttatcgttttttggggagacgtagttatttgttcgttatggatatttttagggttttgttttcggtcgttttttttattagttttttgtgggatttgttcggtttttagtaggtttttattttatttttttcgtcgttcgtcgagttgggttttattaagggtatgcgaagtcgtaaggaaggtaagatgtagcgggcgtcgcgcgatagtgacgcgggtcgggagggttaggaattatagtcgcggttttaggacgaatttcgggtttagtagtttcgggcgtaggagtcgttaggtaggggttcgcgcgtggtgttttacga

SEQ ID NO: 7273 - DNA, 1861 bp, Artificial Sequence
  Description of Artificial Sequence: Synthetic polynucleotide
cgtttattgggcgacgtggggaaataagttttagttttcgaagcgcgattaaaaggagaaattaagtttttatcgttagggcgggggagggaagttgggtgtcggtaggcgtttcgtcggagacgagatttttttcggttttagaagcgtttcgttagggttagagagggcgagcgtggcgggagggaagtttttgttttttagcggttaggcgattcgaagtcgagcgtcgtgttatacgtatttcgtttcgttttgtttgcggtattttcgtgtaatttttatgaaaatgttttttcgtttttgacgtttcgcggtgtaatttttattttttaacgaggagggggtcgtcgtaggattgggaatttagtggtcggcgttttagtattttcggacgcgtttcgtgttttttttagtatttttttgagggatcgtttattgcgattttacgtagtgtcggttatttcgttttagtcgtagggagtattaaataaaagaatttttgtaaatttttttttttggatattcgcgggttttttaaatttggtttttatttttttagaatttgtatgtagttaaataggaaagttggcgcgggggggatggtgtgcggaggaagggatttcgaagtttttaggttatttttggtttcgaggagcgcgcggagtggagtcgttttttcgcgggttcgatttaggttttttttttttgttattttttttttttcgttttttttagattacgtagtaagattcgtcgagggcgaagaagttgggagtgattttaggggtttttgcggttagattaaatcgtaattttcggtgtttttattttcgcggatcgcggggtaacgttagcgagtagcgtttttttgaggaagggaagagggggaaagggtgatcggacgagcgtatttgttttagcggattttcggtgtatatttggggattgggggttttttaggtggcgtttttttattttttgcgggtttttttcgtagttttaaatattttaaacggcgcgcgtatttttcgtttggtttatttatcgatttcgtcgatacgtaggttattaagtttaaggtgagtaggatttacgcgcgtcgtatattttttagggatcggttgtttttagtcgttgtttgtaattagggtaaaacgaagttttttgtttagcgttcggcgtagttcgcgtatacgaattcggagtagagtatcgtagcgattgcggtttaggttcggggattcgggttcggggttcgggggcgttcgttttttttttttgcgtttgttttcgtcgttcgtagttgcgtttcgggaacgcggcgtttttttatttgttggtttttgtattttcgatacggagttggtgtttcgggaaggttgttttttgaagttttttttgttttgttgtggttttgttttttcgcggatttttttttcgtgtcgaggtttagtttttggttttaaggaataaattcgttggtttgaaagggagttacggtagaagtttaggggtagagcggcgggagcgcgcgattcgcgcggttggagtttcgggggtatttggagagtagcgcgtttaagcggggttattggtttcgcggttgcgtttttttttttttcgcgtcgcgttttttttttcgggttttttttttttttttttttttttttttttttggtttttttttttttgagtttgtttttttgggtttttttgggcgattggggagaggaggcggtagtgtgatttttagataaattcgggagaaatttttataggattatacgtcgattggtagtttcgaggattagtgggcgtcgcggtttcgcgttgtggttgcgtcggttttgtttatcgg

SEQ ID NO: 7274 - DNA, 3044 bp, Artificial Sequence
  Description of Artificial Sequence: Synthetic polynucleotide
cgtcgagggggaggggttggaagatggcggcggacgtatatttattcgatcgcgatagagtttaggtttttagttcgcgtcgtcgttcgttgttcgtagttattgtgggtagttttgttttgtttcgcgttgttggtagagtcgtttcgcggaggcgtgggattagggtggcgttcgtattttttgttagcgcgttttcgttcgggttcgtttagggagtatttgtgtacggttatattggattttgtgttttagttattgttttagcgcggcgggaaaggagagggtacgtatagagtttgggtttagttttagtttcgttggggtttcggagttaagatgattagcgaggaaattcggaaaggcgttaaggaaaattatatcgtttaaggttcgttatttttattttagtcggttttggcgtttttttttttcgatatatatttttgtttttagatatttttaaaatagttcgggcggtcggcgttggtcgtagttttcgtggtttgggcgtcgttagcgggagggagggcggcgaattggggcgcgtaggcggtcgtagggtagtgggcgagggggcggagggtagggagagaggcgggaatatggagttaggtttttatttgagtacggattgtttttttttttttttttttttttgtttatttatgacggttaggatgattttttttttttttttcgtgaggtggttgaggttaggtatttcgggttgtagaggcggttgagaggtcgtcgggatgggagttaggcggtttcggggttcgataggagtcgatatgtttggtggagtcgaattattttagggaagcggggaggtaattttattggtagcggcggtatcggcgcggcggttggggtagtttttagcgttgggataaatatatataaattaatggtttttaatttaaggcgatagttttttttttttaagaaaagtagggggaggggagggcgagcgcgtggggaaggagggttgaggagtgcgtttcgggaaatgtttttttttttcgggggcgaagggttgtgaagtgagcggtttaagggaaaggggaattggaggtcgggacgcggagtgcgcggagaggcgggggagggtggtggagtaaggtggcggggatagttaagggtggggtgattggagggagtaggcgggagggcgataggcggatcggggcgcgagtgtgttcggtcgcggttagggtcgggagcgcgcgcgtcgtttcggaggggaaggggtgtttgcgaataagttttcggggaattcgtttcgagcgttcggaggcggagtattgtcggttcgaggggtatttaggcgggagtcgagagggtcgtgaggaagcgaggacggtttttcggagaagtaatttattcgtttcgtcggttgacgtattatagggttttcgcgcgttatagagggagaatttttttaggtatattcgggagcgggtcgcggggtcggaaattttcgcggagattttaattttatttattttattttcggttagagtggagaagcgaaagcggagaagatatgacgggggttagcggcggagagtttcggggttagggtttttcggttgttaacgttcggatttaggcgagtttcgacgtgtagcggggtttggcgtcggtttttttttattacgcgttcggtttagggtcgtttagtcgtcgttatcgtcgtcgttttttgggtcgatggagtcggcgcggaaggttcgcgcgttttgcgtcgtcgtcgtttagtgtcgtcgttagtatttttttcgttttttcgtttttcgggtttatttcgcgggggcggcgttattttttcgttgtttaggttcgggtatcgcgggcgtttcgcgggcggtagtcgtttttttcgagcgcgatttttaggttgggttcggggtcgggcggggagggaggagagattgagcgtgaagggagagggcgttcgagttttcggggacggaagtgtggagaataggagcgtgtgagggggcgttcgaggtgtcgggggcgggggaagagtatgagtaggggtgggggtaggggtgttaggtgtagtaggtagggaggtagaggcggcgagtgggggcgttcgagggatcggggcggggcggggagcgtaagggtggtaaggcgttcgagagttagggttggagttgaaggtgggtgatagggagggggcgtttaggtgttaggatttgaggagaaagagtgcgcgtagcgggagggtttcgaagtgtcggggcgggattttggaaggagggagaacgtgaggagggaggaagggtttttggggtgttagggatgggggttaggaaaggggtagagagttggaggtttataagtggggatagcgggggagggaggttggagcgagtggggaacgtaggtggtgtcgagggcggggatagggcgaggggagcggggcgtgaggaagttgtgggaaatcgcgttggacgttgagaatgtgcggaaggattttgaggggaggacgcgagatagcgcgaggagagacgaggagagttagggttggtcgggagggtgcgaagatgaagcgattattggaggttgtgagggtgaaaggagtaagaatcgtttagagacgggttgggtcggtgttggggttaaaggtttttgtttgttaggttttttttggcgtttattttagaaagaagaggcggagacgcgaagagatcgggttagagttagattttcgaagtacggagatgggtttaatgaaaggacgaggaaagacgagaaattagcggtcggagaacggaggtggtcgtcgtcgttttttgttttgttcggggttgggcgtcgttcggagagttttttcggagggggcggggcggggtcgggtgaatagagttgggcgggttcgttagtttttttaggcgttttgggtaagtaatgtgggtgattgagttcgggtgtgtgtgtttgtgtgtgtgtgtgtgtgtgtgtgtgtgtacgtatataagtgagcgtgtgtgcgtattttatttagttttttatacgcgcgt

SEQ ID NO: 7275 - DNA, 1603 bp, Artificial Sequence
  Description of Artificial Sequence: Synthetic polynucleotide
cgatttgatttttgcgagcgtgtttgtttcggaaggtgttttttgattcgtcgtgttttttaagtattatcgggattttcgggtattcgggggtttagggttatgtatttttttgcgcgtttatcgttttgaatttatagttttcgcgttgggaagtgattggcggttttttttagggaggatttcgcgcgttattagggttagatattattcgaattttcgttcggttgagcgttttggcggcgtgagtcggattcgttcgaagttttaggatacgatttgttagttattagttcgcgttcgtagggtagagacgtacggtcgttcgtcgtagaggcgcgaatttttatatttattttttgtttcgtttcgggtttggtgtggttttggtatcgtttaggatcgggattttgacgttttgattttttatcgcgtggggaagttatttttttcgtttcgaggtttcgatcgtttagtttttttgagaagtttttattttggttattaaaagtggtttttaagagtagttttacgttaatcgtataaagtaatgataataataataataagcgtttaaaggagcgggattgttttttcggttggacgatagcgtcggggattcgtagcgtgcgcgggtcggaattaaaaaagtagttcgggagcgcgagggttgagcggggtaagtatgggttgtttttcgtagttttttttttgttcgaggttcgggttggtcgtttgtttgtttatgattgtttagttgttttttcgattgtttaggtaaagtttgagatatttaggggatcgggagcggattttttttagtttcgttatttatttatcgttttttcgtttcgcgtatttcgtttttgggtaataattttattaattttcggtttcgcgcgtaaatttacgtttgatttgtcggggtttgttttgttttcgtcgggatatttcggcggcggttgttgtcgttggggttttcgcggtgttcgcggtcgcggttgtcgttttttcggttttcgtcgtcgtcgtcgtcgtcgtcgtcgttggttaggttcggttcgtcgtcggtcggattttaggtgtttcgggcgttgggttttttcgggagtcgcggatttacgttcggagatgagtaagtaaatgagagaagagagacgggggtatagagagtgtgatagtgaggaggggagggggagaggagagcgacggggggagaatgggaatgtataagcgaacggttagggagagagaaaaggggaaagagaagagaaaaataatacggaaagaaggaagagaaggagggagggacgggagagcgagtagcgaggagagggggagcgcgggggcgtagggcgcgggaggaggagcgcgttcgttcgtttttcgtttcggcgtgcgggacggatatttcggcgtcgtcgtcgtcgtttcgggtcgcgtagtttttgttttgcggcgggaggcggcgaggcgcgcgagggaggggcgcgtcggggttgtggggaggggagattattttattagttaaaggaggattggttgtatttaaatttagttcggatgtaaattacggtttcggttttggtcgggcgaagtgcgg

SEQ ID NO: 7276 - DNA, 1365 bp, Artificial Sequence
  Description of Artificial Sequence: Synthetic polynucleotide
cggtttgtatttttatcggaaagtgcgtttgttatattttttcggattatttcgttttttcgagagcgttttgttttttatagttcggaaagaaagaaattttagttgtgaagtgatcgtggagaaagcgtaggaagcgatataattggttagggaggtagagagtgtgagcgggcgtattttttgtttggggatcgcgttcgcgggcggggacggagtattttagtggttgtattcgtcgtttcgcgtttttgtttggcgtcgttaatttcgcggcggtcgttggaattttagagttgttaggcgtttttagtcggtttcggtaaatttttttttagtttacgtgttaattaagcggttcgtttttcgagttcgggatggagtatcgcgtttagggaggtcgcgtcgttcgagacgtgcgtacggtaggtaatttatattaaggtagtcgtagttgcggcgtttgggtatatcgtcgtggattttaaatggtttaagagcgtttttttagttttgcgtttttagtgtttttagagttttttttttttttcggagcgtcggtataacgtattatgtcgttgggtcggagtttagggttcggtagaggttgttaatttattgattataattatttttttttttaattcgttcgtagttgttcgttttggattaagtcgtttcgcggttcgtgttaggtagtgggttcgtttttttttttttttttttttttaaattgggacgtgcgaaggcgtagttgttttttcggggttttttttattttttatatattttgttttcgttttttgttttttaggttcgtggcggagagatgttgatcgcgttgaattgatcggtgcggttcgggggtgagtggcgagtttttttttgagttttttttagtagcgcggtcggcgtcggttttttgggcgaattttttagtttttagattttgagaggcgtttttttttcgttcgatcgtttagatgtagtttcgtttttttttttttgtttttattattttgaattgtatggattatagttattgttaaggtaatcgatggagacgtagtaagcgaggtgggtttttttttgttaaaggtgcgtggtgggttttaggggtggcgtgtggaggcgtttatttacgttttggtttcgggggtttagatggttagggttgtgttttttattttagtttttgcgggtttttagtttttatttttaggattttggagttttataaaatattttgttttttgtattttggaggcgcggggagtcggagcgagacgcgttgggagttcggcgagtcgggcgttaatcgggcgtttagggttaagtcgtgcggttcgtatttatgttcgtcgt

SEQ ID NO: 7277 - DNA, 419 bp, Artificial Sequence
  Description of Artificial Sequence: Synthetic polynucleotide
cgtggcgggcgttgtttattcggcggagtcgagcggcgtgtagaggttataagtgtcgtagttggtgattgggggatttttttcgggaatcgtgtcgggagagcgcgcggtgttggagtcgtatcgggtggtcgaagtagaaggtgagtggcggggagtgggatggggtggaggttttgaatgtaagggtgagagttttggagtttagtagagttggagcgtatattttcgttttttttttttcgttttcgagtattaggcggatatattcgtatttcgaatgttttagtgggcgtagagtttattagaaatggatagtcggatttttcggcgtttgttgggggtatcgttgttaggtgtttggggttcgttttttcggttttgttcgtatagggcgtatttagaggtcgttttttcga

SEQ ID NO: 7278 - DNA, 3675 bp, Artificial Sequence
  Description of Artificial Sequence: Synthetic polynucleotide
cgtagcgaggtcggttgcgcggtcgtcgcgtgggtcggagtttagtgttttttggtggcgtcgaggcgggtaggcggttttcggatcgcgcggaggttcgacggttgtgatttaggggtggcgtcgttgttagggcggcgggaggtttgattggggtttcgtcgtgggttgagttacggcgtaattaattattagttgttgggaatttttgtcgttcgttcgcggtgatttattcggtagttaggtttatttgtcgagcgcgggggttttggtttttaaaatgaatttggggagagtgtttgttcggggtagggtttttcgttttttcgttttagggcgttcgtagatttagcgaggatttgacggtttagacgtagtttatagcgcgggttttttttttttggtgggtattcgtgatttttgaaagtggggtgtagagcgttttagttgggaggtttcggtgaattattggggttttagattttttgggttcggggtttttgaggttagggagttcgagtatcgttttagggggcgatttatagaagggattggttttttggagttcgcgagttgttcgagggttaggtttgattttttagttattttttggttagttgttagtttgtcgttaggtaatttttttttatttttattttttttttggttggggttaggagaggaagaggagtttaggggtttttgaggtttgggtttgtttttttggagttttagggttttaggcgggatttaggaagtcgaaggttaaggaaaagtttttcgatagtttaaagggagagggcggggagggggaggaggtaaaggaggttaaaatgggaaggagataaagtttggagagggtttatttggaagtagggaataggtgcgttttagttcgagtttcgtgtttttattttaggtggtttcgagggggttatcgcgtggtttagggttgtatttacggcgtattttgcgtttagttgtggggaattaaagagtgattatatatattaaagagtgattatatatatatatatatatatatatatgtgtgtgtgtgtgtgtgtgtgtgtgtgtgtgtgtgtgtgtgtgtatttttttttttttttttagtaaagtaatagagaggttattgggtcgggggattgcgatgttttttttcgttgttttgattttaaaagtggcggtttatgttgtttttagcgttttttagggaaacgattcgggtttgtaggtgttggtttaagcgggttgtgtcgttgggaggcgagggggtcgaggtagttttcgggattttattattttacgaggttatgtttttggttaatgatacgttttcgcgtcgggtggttaggtggggggtggggggtggggaagatttcgtgaatcgttgttgtcgtttttttgtgtgtttatggttttttttttttttgttttttattttttgtttaatttgtttgaagttgttagtttgttatttttggttgaatttcgttttttttttttaatttcgagttttttaaattttttattcgttagggttgtttgcgtttttggggagcggggttagaaggatttaagaagtcgcgtttatttttttatttttcgttaaaattcgtcggcggtttcgttttcgttttttttttggcggtttaggtcgtttttttcgggtttttttcgcgtgcgttttgcgtcgcgttgggtttgtagcgggagttgttatagtagtttcgttagttggttggggattaggcgggaggtggcgcgttttggaggttgtgggagggagggagggagggaggttcggtttcggcgtagttcggttttcgtttttcgaggttttttcgtcggagcggggttgttaagcgtatatatatatatatatatatacgtatatatatacgcgtatatatatattcgggtttttaacggcgcgtacgtacgtagcgttcggggtagattagcgcggcggtcgtttttcgggacgttcggacgtcggagggtttcgattttcgcgcggtttatgcgttcgcgttcgtttcgttgtttcgcgaggttcgcgggatttttttcgtcgtcgtcgtcgcgttcgtcgttttcggaggagcgggttggtcgatcgttatcgcgtcgtttttcggtcgttttcgaagtcgttttatcgcggtttttgtcgttttggggtcgcgtttcgttttcgcgttttgggggttgagtcgagtaaatttcgcgtatcggtcgacgttcggcggggatttcgttgcgtattcgcgcgttcgggtgggcgttgggcgcgcggatttttggggagcgggttgtttttttcgttgtatttgttcggtttttttttcgtttgtaggggattttagagatatcgttatttcgtaaattttttttttttattatcgagagggggcgaggaggggtaaaaggggaagtaggtttcgttgggcgcgcggatttgtaggttttttgttgggtatcgttattcgcgagttggatttataggggtatcgggtttcgcggtcgtttttcggtcgttttttggtttcggttttcgtttttgcgtttttcgcgggagcggggggcggggtgcggagggtagtaaggttcgcgcggtatttagcggggtcgttttgtatggttttgcgtagtggggcgggttgtttcggtcgggtttggcgtagggtgtcggggttttcggacgtttggtttcggcgttcgagtagttttttgtgtttgttcgttttttcggttgagttcgggttcgcgtcgtttttgtttcgttagtcgtttcgcggtggcggtggttgtggcggttttagcggagggggttttttttagttttttcgtttttcgtttttttgttgttgttgttgttgttgtcgtcgtcgtttataatttggaggcggcggcggcggcggcggaggaggaggcggcggcggtcgtcgggcgttgtagtgggacgcgcgcggttgtgagtttgcgggatatgtttttcgcgtcggttttttgttggcggttatgaagaggtagaacgtgcggattttgttttttatcgtttgtatttttatttatttgttggtgggcgtcgtcgtgttcgacgttttcgagtcggattacgagatgcgcgaggaggagaaatttaaagtcgaggagattcggattaaggggaagtataatattagtagcgaggattatcggtagttggagttggtgattttgtagtcggaatcgtatcgcgtcggcgtttagtggaaattcgtcggttttttttattttgcgattacggttattattattataggtaagggttgggcgcgtcgttgggttttcgcgtttcgggaggagttcggggaggcggttgagcgcgtcgcgtcgggttgggtgtagggcgtcgagggttaaacgtagttttttttgggggttttttcgtagcgtttttttttttttagggagtttttttttcgcggcgttttcgagttttatttttcggggattttattcggtgttttttatcgcgttggtgtttgggtcgggcgtgcgagtttcgagcgagtgtgtttgagtcgggagggcggaggcgttatttttgcgaagagagtggagcgttaagaataattttatagtagatatttatttatttatcgtttcggcgcgggttgggttgcgcgg

SEQ ID NO: 7279 - DNA, 3675 bp, Artificial Sequence; identical to SEQ ID NO: 7278
  Description of Artificial Sequence: Synthetic polynucleotide

SEQ ID NO: 7280 - DNA, 3378 bp, Artificial Sequence
  Description of Artificial Sequence: Synthetic polynucleotide
cgggtcgggtcggcgaggggggtttcggtcgagacgcgaggcgcgttacgggattcggcggcgggagcggatggcgagcgagcgagcgagcgggcgggcgggcgggcgggagggaggtggcggtcggggttgtttaagatggggtcggagtcgcgggttaggcgcggaggagacggaaggggcgggtagggtcgcgcgggcgcggtgcgggcgttttttttcggtagttagcggtagcgcgtcggtttttcgtttttcgttattgcggtttcgcgtcggtcgtttgggtttggagtttcgcggcgttttcggaggacgggtttcgcgttttacgatttattttcggaggcggggtcgggtcgatcgggggcggaggacgtcgtaggaggttgttcggatttcgggcgtttgttaggttttttttggggttttttatgttaggtttcgcggttgtgttcgtaagcgtagatggtttcgggattcgggttattttgacgtcgtagatttagtacgttgcggatcgggtacgttggatttcgggataagtgcggagggtcgggggttggaagggattcgagagtagagttcgcgtttttattttacggacgcggttatcgaggttcgagaggggtcggagtttgcgggagagggaagggttttcgagggttttataatttggttgcgttttttttttagttcgggattcggatgagtgttgtttgaggtcgaggcgacgaatcgttttttattcgtttttgcgcgggatttcggtaggaataagcgttcgtttttgggatcggaggcggtaaattttaggttcgagttttttagcgtagcgtttattcgcggagtcgcgcgtttttttggcgtatttttgggtttcgcggttcggtttttagtcgtcgggtttttcgggttagttttttgttttttagatcgaggcgtaataagtttgaaagtagcgttaaggagtagttagcgagtcgaagggagggcgtggggcgtcgggcgtttcgggattttcgaacgcgcgtaacgttcgttttcggggatcgggcgcgggcggtaggcgagcgggattgattcggcgggttgcgtatatttttttttaaggtttcgattgtgcgcggacgggggcgcgtttaggaattttcgttttttttttcgtttgtttgattttgttgggtatttaaagtcggattcggcggtatttcggcgtgcgggcgtagagtttcgttgtcgtttacgggagggagcggttcgatttttttcgttgttttttcggtagtcggggtcgtagacgagtggaaggtatgagggttttaggagacgtgatagtcgtttttttagattttatatatcgtatattattttttttttagatagaaaagggatttagtttttttttttttcgttttcgttcgcgcggtttttgttgttttttcgcggcggttttcgtttcgagggggcgtgtgtttgtgtttgtggggagagtatcgagggttttcgtgggtttttaggatggagcgggagagtagattttttagttttttttttaatataaacgataagcggtttttttggggcgggagtgtaggttttttattcgtttatacgtttttttgttttttaattatttcggagttgtagtttaggaatttgcgttttagattcggaggaagaacggggaggtcgcggcggggacgggtgttgaaagagggttggtttagggtttttcgggttttagtttaggcgtttgcgttttaagaaatttagaagtttaaaataaaagtggaaaggggtaaggtgtttagcggtttggggttggggtgttagattaggcgttttttttaggttgtcggggagtggttaagtaggagtcgtcgcggttaggaggagggacgcgggttcggagtcgtagttttcgttaagttttttcggtcgtatcgtttcgcggtgatttttagtttcgtcgttttttttcgaggtcggaggagttttttatttcgtttagggggtcgcggggatttagggagagggtttttggtcgggtttagagtttttagtttttttaggagggggcgggggtcgtgttcgtttttcgaggtagtttcgcgcggttttaagttagcgcggcgacggtggagggtcggcggtttttgtttatcggcgacgcggattcgggagtgttcggcgttcgggagtgttcggcgtttggagcggagacggtatagggtcggtttaaagttgagagcggtttattcgcgcggtttgttcgatttagtggaaaggtagataaggagggaagagttaggcgttcgcgtgggggtggggggcgtaaaaatagtttttcgttcgaagtgggggagagtatttttagggagtttttattgttaatgttaggtttataggcgagggtttttacgagcgagggtttcgagaaggagtttggggtttttttttgtttgtttcgagttttgtgcgtggggggaggacgtttcgggtttttataatgtttgtagggggttttggacgtgattagtaggagggggatacgttcgggggtttttcggagtttgttgcgtttatgtgtggttgttgggggttatggggggtttttttagattttcgttagcgtttgtgtgtgttgggggtatagcgggaacgttttttttagtttgttttgtgtatgtgatgaagaggggtgttaggttgtggtgtgtggatggggaggaggcggcggcgtcgaggagttttttttgcgtttagggtcgttttttttttagtttgtttaatgcgggttcgcggggatttgttatattttatcgttatcgttggagaaggtagggggttgagggggtagggggtgggggtttaaatttttgagttttgagcgtaaaatttcggagttgcgaagttttaaacggcgaagttaggaagtttgggcgttcgtttttttttcgatttttttttattttcgttgcgtttttattcgtcgcgtttttagtttttcgttggagttttttttattttttttagtagtagcggtttcgtcggcgaggattcgattcggcgagttgtaaattttcgcgagcgtttcgcgtcgtcggcggttgagtcgggcgttcgatcggaggtggggggggtttttttagtcgtcgtcgttttcggttcgttttgggtttcgtcgggacgttttttggagagtattcgtcggcgtacgtaggttttttttcgttttttcgcgtttgttggagtttttcgggcgttcggagggttcggatgttcgcgttgcggacgatgttggcgcgcgggttcgggtcgggttaggacgcggcgcggtcgtttgtgttttcggtttttcggtttcgcgttcgt

SEQ ID NO: 7281 - DNA, 1108 bp, Artificial Sequence
  Description of Artificial Sequence: Synthetic polynucleotide
cgggggtttcgattttttttaggttcgtttttaattttatattgttattcgttcggcgtttatttattttttttagaggcgtatggatttcgtcggtcgggttaggttacggcggttgcgggttatagcgattttttcgggataggacgggtgcgggttttttttattcgtaggttcgtcggtagttttcgttcgcgtttttgttcggcgtttttttcgtcggttcggtcggggttttatcgcgtcggcgttgagttgggttaagatggcgaaggtggagagtcggttatagaggtagcgcgttcggagggcgtcgaggggtatcgtgcggtagtcgcgttacgattagggttcgagttgcgggggggcggaggaggagggtttgggggcgggcgggatacgggagggagataggcggagcgttagcggcggcggggacgcgggcgtttcggttttcgagcggcggtttcgcgtttcggtttcggtttcggttcgtcgtttcgtatttgcgttcgtagtcgcgcgttcgttcgttcgtcgtcgttaggtttcgcggttcgggcgtttatgtcgcgttttgcgttcgtcgtcgtcgtcgttgagagtcgcggagcgtagttcgagggagcgtcgggcgggggagtcgagcgatcgggggcggggcggggggcgagagttggttcggggttcggtagtcgttcgtttcgcgttttcgtcgtttttagttttttcggggttcgcgttttcggttcgcgcgggaaggagggggaggttcggaggggcgcgtgggcgtacgtggagcggggagggtgcgagtcgggtgtggtttgggggcgcggggcgggttcggagcgcggcgagggttcgtttcggagtttttcggtttcgcggtttagggcgtcggttggagttgacgattttgggatcgttttattttttatatttatttttttcgggttttattatttttggtgtttgcggtttattttttgggatagatatagtttttttcgcggggaggtttgtcgttggaaatttttttttgcggtttgatttagtcgttcgttgtttacgggtcgcgattgtttcgttttttatttgagtacgt

SEQ ID NO: 7282 - DNA, 1700 bp, Artificial Sequence
  Description of Artificial Sequence: Synthetic polynucleotide
cgaatatttatacgtatatatatattcgggagcgtacggacgagttgttttttttaaggttatttaaacgttttaattattttcgggcgcgtaagtttaagcgcgggagttaggatttatcgttaagacgttttgggcgaggaattttacggttattgtttttagtagtagttatttgtatgggaaagggaggaagagagacgtgaacgtgcgggttcggtttgttagttttcgagagttatatcgaagggtttatgcgcgcgtgatttacggggattaggtagaaagtcgtttatcgtcgtagggtagggtcggttatcgcgcgttggtttttttttatgttggcggttcgtttattttgggtttcggttagttttatttagtttagaggcgatagataaagcgagtttagcgtaggatgagggaggtagtttatttttatcgtcggtttcggttcgcgagacgcggggatagcgcggtgcgcggttcgtatgtaggggtgatcggagggtcgttttttttacgattcggaaagaaggagagtttttcgttaggtttttgtgggtgttttttggtcgaggagttcggttttcgtttttttattttttttttttttatttttaagtaggagagcgtgtagttttagtttgtataaggcgttttaagtcggtgttttcgggttagggtttgggcgtcgttcgggggtcgtttttatttcgggttcggttttaggggttgttgttcgaacgtattggtttttttagaagtattcgtcggcggtatatcggtagggcggtcggttttgttgggttttttgggcgtcggtttcgggggttcgggcggtttttttcggttttcggtttggattcgcgaacgcgcgggcgcgaggggttgggacgcgggagttttttgagtgcggagcgcggagttttggtgtttcggcgtattgtagttatattttcgggtcgcgcgttttcgtcgttttttattcgcgtcgtagggtttttttttttgaggcgtcgttcgcgtatcgtcgggggggagggggtagcgttaataaattggggagttcggttcgtcgcgtttaggttttcgtttggagtcgtcgtattcgggacggtgcgtagcgttggaagttcggtttttcgagagttagttgttcgtcgcggttttcgtacgtcgggtagtcgtttttcgtcgtttcgggcgcgttattatggggtttcggtttagcgtttggttgttgttgttgttcgtcgtttttttgttttacgaggagtatagtcgggtcgttgcgaaggtgagttttcggttagtttcgttttcggcgtttcgtttcgagtttgggcgtttcgagaggtttttttgttcgcgtttggattcgttcgtttgtttttcgggggtcgcgcgtggtacggttaggtgtattttttgggtcggggttcgttgggggtttttgtaggttacgatcgcgtattggtggatcgagttttttttgttatggtatgggtattggagagttaaggaattttttcggggaagggaggagaaatagttcgcgttgtggcggggtgagggtgtttgggagtcggcgggatttgaattcgcgtcgcgggtatgttcggtagttgggcgtttttattcgtttcgggtgcgcgagggagttgggggttggagggtcgggagcgtttatttcgcgt

SEQ ID NO: 7283 - DNA, 692 bp, Artificial Sequence
  Description of Artificial Sequence: Synthetic polynucleotide
cgattcgcgatcgtatattttgtagagattcggtttcgtttttgtatttttcgtagatttcgttttgtgattatatttttcgttttttataggtattggttcgcggtcgtgtacgtttcgtttttattggtttcgtttcgtgattacgttttcgtaattttgatagattttattttcgaggattttttttaggagtatagtgatttcgtttttatagggttcgtttcgttatattgattttttcgtgtcgttcgcgggattttatttttgttcgtttgtttcggtgtttatggggaagtttggtgttaggggttattagttagtttaatttatcgttcgattggtgggataaggataggttagcgggttataggtcggaagtgagattcgttcggtcgttttgggacgcgggaagatcgaggtttcggtggtttttttttttttcgtttggtttttttaggagaaggagcggttaaggtaggattcgatatcgcggtcgtattcgtttttttttttgttttagagtatagtttgggatttttaggggggagattgaatgagtgttgtcgaggatcggcgagagtttggaacgttcgcgttttcgtaggagaacgaggaggtgacggatagggaacggggagcggtcgttgggtgggacgtttgagattttcgggaaatggtcgggtcgtcga

SEQ ID NO: 7284 - DNA, 1924 bp, Artificial Sequence
  Description of Artificial Sequence: Synthetic polynucleotide
cggcggagtaaattgaacgttatttttcgattaaataggagtttcgggtttatttgtttggaagtttttaggcggtttggaggggttcggttttcgggcgcgattcgtaggggttgttttgttcggttcgcggaacggacgtttattcgtcgtagttacgaatttattaacgatattaagtattggtcgggtagattaggcgtcgtggaggcgttttagttttttagtttttcgtaacgacgcgttttaggggtgcgtagtgtttggcgcggtgatcggattcggtcgttttttcgatcgcgtagagcgagaggttatattttggattttaggtcgggtttttgcggttttgggagggaggtttcggacgttttttagatttcgggtttttgtaatttcgaggtcgggttttaaaattacggttttttcgagttatacggagagttcgtggttaagggttaagggcggttttcgattttcgggatcgtttttttgagaaatggttgagagttaagtttagagttgcgtagggaagggagttaaagagttggcgtcgagcgcgaagggtcgggaggcgcggggaggttttttattcgttttattgttttgttcgttaatgacgtcgatgatagcgatagcgtcggtcgagtgttttttttgtttcgggtcgtttaggtatcgggtttttttttagtattcgtagtacgtattgaagaagacgttacggaagttttcgttttttagattcgggggaattaggaaacgcgttcggcgattttcgggtagtagtatcgggttaggtttgttttcggaatcgttgacgttattcgtcgtttttttcgtttgggtttttcgcgggtcgtaggggtggaagttcgatttgggttagggttcggatttttttttttcggtttttgcgtcgtcgttttcggtgttaggacgcgttttgttttcgtcgagatttagacgcgtcgaaagtttcgcgcgggtagtttttcgttttacgtttcgggttgcgcgttttttcgcgaagtttttgtcgagtgcgcgcgacggcgtcgtcggattttttcggatcgcgttttcgcgtacgtttgatcggagtatttcgttttacgggggcgttttgcgcgtttttttttttcggtgcgattttcgtttttttttttttcgcggtttttaggagtttaggtatttttcgacgtcgttgtcggcggaatcgggaatttttttcggggttttttgcgggttcgaagtcgttttttcgaggcggcggagttgggtagtttcgggtttcgcgtcgtttcgcgtcgtttcgcggagtcggagttttttttcggagtttggatatagtttttcgtttcgtcgtcgcgtattggatttcggtagcgtggagtttgttcgggaagttgggttgcgtcggtttggggcgaaggtttaaggggcgcgggggtcgggacgcggggttgtggcgacgatcggttttttgcgaacgtttaggtcggcgggttcggggttataggttgggagtggagttggcggttattggggagtagagaggacgtttaggaataggtgtattagggtttcggcggttgggtcgagggtcgtaagtagaggggatcggcggttgttagtaagttttaagtagatgttttcggcggggtagtcgtattttatagcgtttatttcgcgtatatcgagtatttaaaacgagtaaaatcggtttatacgttggaatgtagtttatgattttaaaattttatttttaggttgtttagattatacggtttcgttttatttatttttattgaataacggtcgttggataatttagagaagtagtagaaattacgagaaaaatagtggagttaaacggcggtaaggatcgataaggttggcggggatattgagtaaacggcgg

SEQ ID NO: 7285 - DNA, 1991 bp, Artificial Sequence
  Description of Artificial Sequence: Synthetic polynucleotide
cgtttagtttttatttacggagggcgaagataaaaagcgttttaggcgcgtagggaaatcgcgtaacgttgtgtttattgtagcgatttttttagaaaaataaataaggtttttcgataggttattcgcgtaagtagtagtcggtcgagtttttttttttcgttaatttagtagttagcgttgtcgttttttaagattttttttaatttaagtgtaatttagtaaggagggagagttagagattttggggacgttcgaggaaatcgaatttcgaaattttttgtttttaaggcgcggtcggagatttttgggattttaaagcggagagaattttttaattttttgttagaagagcggggttagagatttttgggatttttttggagtcgaatttttttttttagttttatttcggagggcgggagcgaagattttgaagatttttttagcgtaataaatttttttaattttgttggaacgcgggttttgggatcgcggggaagtttagaggggcgaatttcggaattttttgttttgagagcgggattagggattttagggattcgggagtagagggaattttcgtaatttcgtcgaaatatagggtgagagatcgtggggaatttcgagtcgagcgaagttcgtaattttgttcggcgggcgggattagacgcgttttcggcgtttttagatcggcgatgtagcgtggtcgggagtttaggattttaagcgtcgtcgttgtcggtaagtatcgtcgtatttttttataatttaggattcgtatggtaacggttatgttggggggattttatttaagaaattcgggttttgtcgggagcggtggtttacgtttgtaattttagtattttgggaggtcgaggcgggtggattatttgaggttaggagttcgagatcggtttgattaatatggtgaaattttcgtttttattaaaaatataaaaattagtcgggtatggtggtgtgcgtttgtagttttagttatttgggaggttgaggtaggagaattgtttgaattcgggaagcggaggttgtagtgagttaagatcgcgttattatattgtagtttgggtaatcgagcgagattttatttaaaaaaaaaaaaaaaaaaaaaaattaaggttgaattcgggttttcgtacgttcgtatttatttgcgcggttattacgcgttgtttttcggcgattaggttgtattttttgtattggtagtcgcgttatatgtagaagcgtttgtggtttttgagcggcgaggcgtagtcgtggtttttgtagcgtgcgtatttgggtagtcgcggggattttttgttttcggtatttaggttcgacgtttcggagtcggagtcgttttttttgttgttgttttcggcgttcgagtcgttggtcgtttttattagcgttttagacgttttgttaaagttttcggttttgttttgcggcggtatttcgggggcgtgaggggttttcgacggtgtagagggtttgttgaatgtttcgtcgttgggtatggtgtttttaggagaagtgcgagtattttggttttttttttcgtttggagattgttgcgagggatgaattcgacggatagcgacgtttcggaggaggaggcgtaggagacgtgtgcgttgtagtcggaggcgtagttggagtggcgaggtttgggtacgttacgttcggagtggtggggggttgtgtttttttttttggcgcgcgcgcgatttagaattttcggatattttttagaatattttcgggattgtttgggagggagcgtggttacgtttatcgtttttcgattttagttatcgttttttagttgtttgtaaatttgtatcggttgtaagtatttagggttttgttgtagggtttttgtaagcgtatcgagagatatagagcggtttgggaatcgcgtggtatttttcgtttcgttttcggaggcgttaagattcggttgttaaagtacggtgtatcga

SEQ ID NO: 7286 - DNA, 1667 bp, Artificial Sequence
  Description of Artificial Sequence: Synthetic polynucleotide
cgattttatcgtagtgagtgtgcgtacgtgggttttaattttgttttgttttaatttcgttgtttttttgtttaatttgatacgtttcgaattttttaatttgggaaggtatttggcgatattgacgtatagtttcgtcgtttggttgttcggaggcgttttttttgcgggcgcgagtgttattcgcgttgggtttagatttagtcggtttttttcgggagaggaagtttcggtttggcggagagtaggaaggaaagtttcgataggtttacgttttaaaattttgtttttagtttttttaagtggagttgtagttggtatttcgaagttgttttcgcgttcggttaaattttcgtattttagacgtttttatttggtttggcgagttgcgtttgtagagtttcgggttgcggttcggtagtttaacgtagtgcggcggtcgcggttaattcggtagtagggcgcggcggttgcggttgcgacggttgagaggttggcggcggttgcggggcggcgacggcgtttttcggcggcgggggttttggtagagcgcgtagcgagtcggggatgaggttttttaagttttcgttggtttgttgtcggcgtagcgttatttgcgtagttatgattcgttgtcgttcgatgatgaggatgtatttttcgtaggtgtagtttttgaagcggtagtaacgtttgtggtttttgagttaggataggacgttatggttgcggtagcgcgcgtatttgggcgtgcgttgtaggggcgttcgtggcggttgcgatatcgggtcgtttatgtataggtagggggagtcgtagtcgtttatgtttcgggttttcgaatgagttggtagtttggttgcgggagagggttagggagcgttggacggcggggttgcgaggttcgtttaggggcggttttcgggcgacgcggtttttggtttcgtagtttcggtggtcgtgtgtgtttcggggcggtcggaggtgtcgtagtcgtttttttagtttttttcgcgtttatagttcggttttttagtttacgtttagttaacgtcgacgcgggtttttgttttgggcgcgtagtcgggtcggtacgttttttttcgcggaggcgttgcggcggttgtaaggagtcggcgatagttttgattaaggtttgagttagtttttttgtagttttttcgtgagtcggtcggatttaatattttcgtcgtttttttttaatttttttttttttttatcgttattttcgtttttggggtttttgtttttttgtatttttcgttttacgtttttttttttttttgcgtttttcgggtgtttgtattttattttttttgttatttgtagttaggttattttcgcgggggcgttcgcggtttttttttttaagtttttttcgttattttagttcgcggttggagattgcggcgttttagaacgcggcggtgttcgcggggcggagaaggggaggattagcgggagtgagggtgggggtgtttgtaagcgagtgaggtggtcgtttcgtttttttttttttttttttttttagtttagatttggtcgcgttttttcgagtttaaggtcgtttttatttcgatatttggtcgtagaagtttagtttcgggagaattcgaatttacgggagtgttgcggttgtatttcgg

SEQ ID NO: 7287 - DNA, 433 bp, Artificial Sequence
  Description of Artificial Sequence: Synthetic polynucleotide
cggttttttgtagtttcgggcgttttattttgttgaggtcgttttcggttttttttgatttaggttgggcgggaaaggtcgggtcgttttcgtttggtttagatcgttggtttattcggcgggcgcgcgtagttgtatttagcgtagcgttattggttttagtttgtagattgcgtttttttttttagtattgttcgtttaggtttcggagttttacgttttttgattggtcggttgttaggcggtgtgaatattgattggtcgaggtacgttggtagggagtttttcgtttttcgcggtttatatttttttttttgaagcgtttcgttagagttcgtttatcgggttttcggtgtagtcggttcgtttgtttagaatttaaattcgaggtatgacggtgtttgtaagagagaagttattatttatttcgcgg

SEQ ID NO: 7288 - DNA, 896 bp, Artificial Sequence
  Description of Artificial Sequence: Synthetic polynucleotide
cggttttatattttggcgggcggcgtacggagcgtttcggttttcggtattagttagcgtcggagtgggtaggattggagatggtagttttcggtttaggggaagcgggattttacggaagggttgggaagagggtaggaagagggggcgggggcgggaattgtttcgttttttttttttttgtttatttttattggttaagggttttttggttttaatttatttttcgtttttagggcgtcgtttaaagtgtgcggagtaggtgttttgggtggagttataattttgcgcgagtgttttggttgagcgtagcgtttatttattgttcgcgagcgtttatttatttgttcggtcgattgtttagcgaaaggggttttaggtcgggcgtagtcgttattcgggggatcgaggttaggagaggggttaagagcgcggttgatttttgcgggtcggggtaggggacggtggtcgcggttatgtagttttgtgttagggcgtgggggttgcgtttgggtcgcggggtcgggggcggtcgtcgtttggttgggggatcggggtcgtgttgggcgtcgcggagtcgggatagtagtagtggcggcggggatagcgtcgcggttggggtttcgcgttttttggagcgttttttgtttagatacgacgatttcgttcggaggtatatcggttttggggataaagattagagagagatgttgtagattttggggttggcggtaaggatttttattcggtttttcgcggtttttttttcgttttgttcgggttttgtttgcgcggtttttcggtttttattttgagttttgttgcgtttcgcgtggttttcgtattttgggtttcgggtcgtggcgtggaagtaaattcgtgtttttggttttcgt

SEQ ID NO: 7289 - DNA, 1494 bp, Artificial Sequence
  Description of Artificial Sequence: Synthetic polynucleotide
cgagcggtttaggagcgagtttaaaatttcgtataggtttgttcggtcgcgttttttgattggttaaggcgcgttcgtcgtttcgtcggtcgtaggcgttacggtagttttagtagtttgggtttcgttatcgttttcgcggtagtttcggtcggcgtaagtgcggcgcgcgttgggggagggggcgcggcggagcgttaggttggcgtcgggttatcgcgggattaagttttttagttacgcgtgagtgtttgtgcgttttgattcgaagtttttcgtcgggtcgttattttagaagagaagatagtgagcgtgggcgaggcgaggtatttagaggtttcggcgatttttgttttttagtttttcgttttttcgcgtcgcggttttgggcgggcgtcgcgagtcgggtaagcggcgtttgagtttcggtttagaggtcgaggcgcgttttcgcgttttgcgcgcgcgtcggcggggaaggtgcgcgggcgttttgggttcggcgtttgggggtgggggtgggggcggggatgggggtgggggtgggggtgggggtaggggtggcggcgggtcgtggggcggtggggcggtgcgtttgttttatttcgcgcggttcggcgtttcgcggaagtcgttgttgtggtttttttaaaaggatggggtttagaagttttttttgttattcgtaagtttttattttttttagtttcgcggtggataattttagattttttagtattttcgttattttttttttttgttttcgttgattaagaggtttaaaagtttttttttttttttgatttagaggggtatagttttggtgtcggggggttgggggtggggtgttagtttgggggttcggagcgtagattaggtttttagggcgcgggagtttgttgtttttttttgtaggggtcgttttcggacgttttattcgtcgttacgtggtttcgggatgtgcgggttgcggtagagagtgggtagtaatgtttttggttttgcgttttcgttttagtcgcggggatttcgaggcgagtcgttaattggtatcggtgtttcgttttttatttttggtatcggcgtttttttaatcgtcgttttcgttggtgggagtacgttggttttgttttttttttagtttttttatttttcgcgttgatgggcgtttttgtttgcgatttggtagttttaggatgtcggatgttattagggaagcgatgtttgggagacgttttgtgttttgcggagttgcgcgtttgttgggtggtgatggtgtatatttttgtttgcgttttttgtagaggtataaaggttgggttatttttgtttgtagttatatggaaattaagcggagattgcgggggaggagaagtggttaggcgtcggcgggaggtagaggtcgtttcgtagttattgggggcgagtgggggtttttggagatttttattgcgcggtgcggtttttgaggtgtttcgtttgggaagatttcgg

SEQ ID NO: 7290 - DNA, 828 bp, Artificial Sequence
  Description of Artificial Sequence: Synthetic polynucleotide
cggaggttacgagttattagttcggacggtgaaatttattttttttttgcgttttacgttcggatgggagaattttagttttttacggcgtatcggggaataattttagagtagtacgcgagtagagtttttagcgtttttacgtttacgtttacgattttttttttaatcgcgcggtataaggaggtatttacgcggagttaatttgatagttttcgtcggggtggaaattcgcggttttttcgtatcggtatttcggatataggtttcgcgtaggcgcgtagtttcggatttcgtttttgtttttgtttttgtttttattttttttgggtattatcggatagtgttttgattcgtagtttaatcgtcggggtgtcgattcgcggggatttatttttttgttttttttttcgcggcggcggcggcgttagttcgttttcgattcgagcgtggcgttttcgcgttggtcgttcggttcgggaaattgttaaattggtcgttattatttacgcgtttgtcggggaagggttcgtcggcgtcgcgttttcgaggtttttgcggcgaatcgcgttacgcgcgatttttggtcgggggcgggaggcggcggcggcggtaggagaagtttaaggttcgagcggttcgtagtttttacgtttgtatttttttattttcgttagttcgatggttcgtttcgcggcgtgtattggagtaagtaggtttcgtttcgagcgcgcgcgttttgggaagtgttgtaagtttggagatttggagtgagtttcgggcgttgttggttcgattgttcgcggtgttttttcggtgaggtcgcgg

SEQ ID NO: 7291 - DNA, 2705 bp, Artificial Sequence
  Description of Artificial Sequence: Synthetic polynucleotide
cggggttgttcgtttatttaaatatttttcgttttagtaaaggttgagattcgttagttttgttcggtttgattagggcgtttttttttcgtcgggtggtttgggcggtttcgggttcggcgttttttatttcgttggtttttttacgttcgtcgggttttttaggagtgtattagtatcgagtgtaaggagtcgtttttgttttcggtcgaggtaggggttgtgggttttagtagagaggtaacgggcgaggtcgcggtcgcggagtatacggtggatggcgtcggaggttgttgcgaagtcgcggggatagtgagtttcggttgtagcgcggatacgggcggtagcgtaggcgtgggtttgatgggtatcggtatggtaggtaggttttggtttgtcgagtggtatagggatttgatcgggatttcgaaggttttatatttcgggtttatagggatttcggttgcggttgcggcggtcgcggcggcggttatcgaatttatgacgttaacgtgcggttatacggagttgacgacgttgttaagttggtcgggtacggggtagtttaggtggtgtatgacggacgttaagggtagttttttagtttgtagtacgtttttgtagtttcggttaataatgtttttaatggtaaaggggtgtttgaagtttgacgtggacgttgcggtcgcggcggtagcggcggcggtcgagtttagttcgtagggtgggaattgagataggcgttttacgttgtttatcgcggttgtcgcggtcgtcgtcgtcgtcgtcgttacggtcgtcgttttttgtattttgtcggggtgagacggttgttgaggttgcgattgttggggcggttgttgcgggggttgtgacgggaggtgcggaggcggttgcggagtagtaggcggttgttgatggaaatagtgtattatgtgcggcggcggcgggggcggcggcggcggcggttggggtgggtggtggtgatggtggtggtgtgcggtagcgtggtgatgatggtggtggtgggggtggtggtggtgatgggggtgaaggtgttttttcggatcggcgttcggcgcgtttttggtgtttttcgcgtgtaagtgagtatggtcggcgcgtagtattttgaagcgtttgcgacgtcgtaggaagttgtcgttttcgaatatgttttcgtagtcggggtgtagcgtttagaagttatttttgttaggttggtcgggttttcgcggaattttgatgaagtagtcgttgaaggagaggttgtggcgtaggttgttttgttagcgttgtgtgtgttcgcggtagtaggggaagcgttttatgatgaatttgtagatgtcgtttagcggtagtattttttcggtcgagtgttggattgttatggcggttagcgagatgtaagagtagggcggtttttggtcgttgtacgagttttttttcggtcgcggtatcgttttcggtttttttatcgtttttcggttcgtattggattatagaattttttcgtatttcgtttttggggtttggttgtttttattaatttttattcggtttttttagtttcgttattttgttttttcgttttttaggttttttttgttttttttttttgtttttttcgaattgtttggtgttttcgattttggtttttcgggtttatttagttttcggaagttggtaatttttggtttcgacggttgtcgattggcgcgtatagtcgcgggcggagtgtattaggtttatcgtcgttttttttgcgttttttttcgggtggttaaagattgagtgttggagttggttgtagaggagagtggtaaggggtcgtgttttttttcggtttttttgttttttttaggttcgagggaaatttagattaagatggttgggaggaaggtttgggtagtagagattttggttttttaaatttgagtttgcgtttgttgttttggaggttagtgatagtaggatttttagtgttttggacgtaggtttttggttaggtatttagttagatcgcgttggagtttttttttttttggagtgaaaaattagggtaaggagagagaagattggtttttagggcgtttttttttttttcgaggttcgtagcgtcgtcggggttagaagagacgcgtagttttaggttgtcgttgaggagaaaaaattttggtggtttttgaagcggtagcgttcgtaggttttgttgaggagtgtggggcgtaggattttgggagcgagcggcgggttggagagggcgtttgcgaatgttgggtgagtgttggtcggggaggtttagtcgttcgcgtcgtagttgtcgtttttttttcgggtttgttttgaggaggagaggcgacggtagtggtagcgacgcgtttttttggttgcgttttgtaatggttttcgagacgtcgagattttcgtagttagcgtttcgagattattatatgatcgaggttgagggatttagtcgtcgtcgtcgcgtttgtagttgaagaaggggtaagaaggcgtcgtgtttcgttttcgtttttttttttatttcgtttcgggcgttttttatttatcgcgtttattattcgttcggtagtttttagttatttttcggtgcggcgggtggcgtaggttgttcgtcgggagggggtatagtttcgggtgtatttttcgtagttgcgttttattcgggttattaagtacgg

SEQ ID NO: 7292 - DNA, 704 bp, Artificial Sequence
  Description of Artificial Sequence: Synthetic polynucleotide
cggtaggggtcgtggaagggtagcgttagttaggcgttatgtagttcgcgtatgaagtttagtattttttgggagttgtcgtcggttgatacgaagattatttcgaagggcgcgggtcgtcgcgtttcggttattagcgtcgtatagaagtcgtagagtagcggcgtgaagtcgcggttcggcgcgtatcgggtcgtcgcgaagtatagtgttattattttgttttgtagcgtcgtttcggtttttatcgtcgcgtttttataggttattaggtgtcgttcgtttagaatgttaattatggcgtagatacgtagttatttgagattcgaggatatttgtaggaggatgattatttgcggggaggcggcggcgagcgtcgcggtgtttcgtttttgttcgtattatcgggcgttggattttttaagatttgttttagatgcgtttatattttggttaggtttcgtttgtggttggagtaattgtgttcgcgtcgataatgagatatttagatattagagattttagatatttgggcgatagcgcggtattcgtttttgggagcggggttagttaggtaattttaagtttttaggtttttgtatttttttttaattgcgtttcgtttatatttttgcgtttttttattattgcgtttcgtttatatttttcgtaagttttttaattgcgtttcgtttatatttcgt

SEQ ID NO: 7293 - DNA, 950 bp, Artificial Sequence
  Description of Artificial Sequence: Synthetic polynucleotide
cgtgtaattttaagtagcggtttttcgggtcggggttgcgcggtcgtcgttgtgttggtttttaacggtgggagggtattatttttttgttttgttttcgttttttagaaggttgtttcggggtttttatttttcgtttcgtttcggggatagtggttcgtttgttatgcgcggtagttcgcgtcggggtcggtattagtagcgttcgggcggatgtagcgagtttacggaggggtatgtttttacgtattaagtataatcgttttaggaatgattcggtgatatcggtcgatgattttttttatagtttgtcggtgagcggcggcggaggtaaggtttcggcggcgcgcgcgatttcggcggcggttttttatttggtgttcggcgaggcgttgcgtaaggcgttcgacgatgggttcggtagtttgggttatttgttttataaggtgttttatttgaaattttttagttcgggttttcgcggtttgtcgtcggtcgttcgggagcgggcgggcgcgcggttttcgggtagttgtagcgcgtttagtttggtcgtttcggacggtagtgcgttttcggcgtttcgcgtttcggttatgagcgtcgttaggaagggtcggttcggcgacgagtcgttgtttaggttttttcggggggcgtcgtacgttagcgattaggtgttggggttcggagttatttacgtggttaaggtgggtgcgggcgcgggtcgttttgggggttgggggttttggggttagttcggggtagatttttttattttttgaagttcggggtgcggggcgttttcgcgattgttacgttagaggtaagtaaatgcgtattttttagtaattagttcgtttgatagcggtgaggagggaattataaatgcgtttttttcgtatttattgggaaaaggtttattattcgggtggttcgtttcgtttcgg

SEQ ID NO: 7294 - DNA, 4861 bp, Artificial Sequence
  Description of Artificial Sequence: Synthetic polynucleotide
cgcggtttttgtttttttttttttcgattttttcggggttatttaaaagtcgattaagtcgtcggttttttagttgtttttatttttttatcgttttttttttttgtttcgtttgtttttgtgtttttcgttacgttatagttcgttggtttttacgttttttttggtttttttgcgtatatttcggtggcgtttttggtgtttttatattattgtttggaattttgtttggtttacgtcgtttgtttttgtttttttttttatttgtgtcgtttgattttttcgattttcgtttttgggggttttgtttttcgaatttttcggttttttttttttagggcgtgcgtttcgtttagtttttttcggtttcggtcggtcggttttttttacgtggtttttttttttttggtttttttttcgttttttttttttttgggttttttttttcggtttagtttaggggttgggggtggcggcgcggggcggggcggggcggggcggtgacgcggggttggtcgggtaagaggcgcggcggcgtggggagggggcgtagtttcgggttcgatcggtcgagtttcgcgcgtttcgttcgcgttttgcgttttcgttcggtcggtcggcgggggagggggtatgagtcggcgttcgcgcgtcgtttcgagttgcgggtcggtttagagtttcgcgcgggtttcgcgtcggagttaagtcgtcgtcgtcgtcgtcgttaaatcgcgggcgtagtagtgggcgtcgcgatgtagcggtcgggggagtcgggcgtcgcgcgtttcggttcgttcgagggttgcgcggattatcggtcgtatcgttatcgtagttttatgattgaggagatttttacggagttattcgggtttaagggcgtcgcgttcgtagtcgtcgttgtcgcggcgggcgagttgttgaagttcggcgtgtaggcgttgttggcggcgcggtttttttatagttatttgggtacgtgtggcggtcgcggggtcgcgggtcgggtttggcgggagatagcgagttgaatcgcgggggcgtttcgagtttttttcggtatcgaagtagtttcgggaagttgttttgggagcgtaggttttgggatcgtttttcggagttttttaggcgggaggcggagggtgtaagttttaggttttatagaaattaggtttcgtgttcgcgggtcgttcggggagggtgttcgtttttttttttattgttttttttcggtttttagttcggggatttcgagtgagtatttttagtgtaggcgtattgttaggttacggattttcgtgggtggaagcgattttaggttacgggcgtttgggtttcgtcgtagagggatggtcgggagtggtcgcggttgtttaatttagggaagtcggatttttggggaggaggtttgcgttttcgagggttgggtgttgacgcgggtttaagtcggttcggagttttcgggagttttagcgggcgaggaacgcggttttggtcgtagtgcggatttgtttcggttttgttttggggttagaggtttgattgtgagtagttgtttggttgttttttttggttttaggtcggttgggtttttgtagggtttgaacggtttgcgtagatttttttagtttttgtttttttttttaatttggcggggtttgttttgttttgatggtgttgtttttatcgtattttattttcgttttgtttttttttatttcgttttttaatcgtttgtcggtcggtttttttcgttttttttattggggtcggtttgttttttattttttattttttttttacgggttttttgttttatatttatttgcgttttgttttgtttttttcgattttagttaggttaggattcgtattttagtgataggtttgtcggggaagggaggtttttacgttgtagtcgggattttagttttttaagtcgttttttttgtatttttttattttttagtcggtgttttttagtttggagacggtagggttagcgcgttttttttaagtttagttgggattcggttattcggttatttttcgtttttatttgttttgttgttattaattcgtttgaagcgggtatataattattttaggattgaagaaaatggaaatatttgtatggggaagcgtttgaaaatagaaaacgtgaataataatttttaggtttttagggtattttggaattttcgggaagtatttaatttcggtttagatgatttttggttatcgtatggttgttgtgttacgtacggaagagtaaatgtgtacgtttcgtgtatgttttttttttaacgtagtaaggttgatttggttggagtaaacgttatttttttaggattagttgtcgttttttttttggtttttatttttttcgaaagataagatatatttcgagtttttcgtagttgtaaatatgtttattaggaatttcgagattttagaggtagttgaggtttggggaattttaggatagaatacggatagggtcgaggagatatttttttttaaatttggggaacggtaacgttgaggagggtttttatttgcgttatcggcgtcgatcggtagggcgtggaggttttgcgttgggaggtattggttaagcgcgagtattttcgcggtacgtggtgcggtagtttttggggtagaggagcgcggtcgtagtttattcgggtttttatttttttttttcgtagtcgtgttgaaggtcgagtaggcggcggtgtttaagtttttattggcgtcgttgggttgtttagggttgagttttgcgttgttggcggtagggttcgggttgttcggcgtcgcgggtgcgttatatttgtcgttcgagttgtagtttcgcgggaagttggaggcggtaggttttggggagttaggtattaaagttaagaaggggcgtcggagtcgtattgtgtttatcgagttgtagttgatgggtttggagaaacgtttcgagaagtagaagtatttttttacgtcggataggtagggcggtataaggttggggttagcgggttgtgggagtgtggttatttgttttgttgagggtgcgttttgttttttttagaatagattttgttgagtttttgggtttgagttagttgtaggtgaagacgtggtattagaatcggaggatgaagtggaagaaaatagtgagtgtgtttggtggttttttattttttagttttttgggttatgtttcggtgtatgtagagttgtttttttttttttttttattgagattttgtttaatttttcgattttttcggtgtttggtacgtatcggaatttttttagttttttttgttttttgggtaagttaatatttcgttttttttcgcggtatttttaggttttttggtagttttatgttttttaggtcgggtcgttttttaggcggtatttggataaatggtcgttatttttcgggatatttttttattatttttttatatggattttgtattttttagttttatttgggtttaagttttttcgggggtttttagtttacgtgttggtttatttaggtgttggcggtttttcgtgtaggtgttgtagggcggcggtttggagttttttattaagtttaaggggcggtttaagaagaatttaattttaacgagcgagtagtttattgagtaggagcgcgttaaggatgtagagaaatcggcggaggtgtcgggcgagtttagcgataggagtcgcgaggattgagggcggtatacggtgcggggtttgggatgttcgcgttattcgtagtttttttattcggcggaaattcgcgagtcggttttttcgcgtttaagaagtttattttttaagtttttttattatgattttgaatgcggataattggggttaaacgaggaaggatatagatttaaaagttagatttaggttttagcgcgtttttgggttttaatttgggagattcgtatttagttcggcggaagttatagtttttattttgagtttcgtggcgtagagcgttttacgcgtatttacgtttcgtttttcgtttgtatttttatttcgtttggggtttgttttttcggtcggggagtttttaggtatatattcgtttttggacgtcggggatttagcggttgggtttaggttataacggtttgagattgtttcggggtaattcgtcggttcggtttggaggtcgggttttcgatgtcgttggggtttttatttttttttgcgaagacggtgattttttttttaataaaatattttatgatataatcgggttcggtggagtagtttttgaattcgtagggggtgagggtgggggtgggggtgggttcggtaagataagcggaacgcgggtagttgttttttaaattttttttttttcggttttgtcgaaggtagttgtgttttttattattaagttcgggttaggtacggcgggcggttcggtggttgtaggattttaggaatcgtttttattttgggcgtgaggggttagtttgaattttatttttttttttttgttagttagagagtcgttggtaggagcggtttggtcgtatcgcgggtgtttaaaggagcgggagttagaggttcgtcgtagagttcgtttcggaagtggttcggatagagagtcgtttcggttgttgtttcggttttttgggatttgaaggattagttcgtgcggtttttgagatggtttttattaattttttatgaggcggatgggaagtcgaggacgtaaggtttggatagagtttttttattagcgcggtagttcgttcgcgggtttttgtagtagtaatggttttttagagtttttatatttttcgtaggatatttagggcggcggcgt

SEQ ID NO: 7295 - DNA, 999 bp, Artificial Sequence
  Description of Artificial Sequence: Synthetic polynucleotide
cgttgggagtcggggcgcgtttttgtttttcgcgttaggagaattattttcgttttcggagggagttcgttttcgtgagggtcgtttttagtttcggttcgtcgtttgaagatagtagtttcgggaatcgcgacgatagtatcgaattggagattaggaagttttggtggaaaaggttaaggagtggtgtgtacgcggagttcgggattcgggcggggatagagcgggagcgcgggcgtagttcgttagcgtcggcggtagagttttagttagaggttgcgaggggtttaataggtcgttaaaggtgtttttggttagagatgttatagcgcgtatttaggtaggaggtataggggattttttataggggttgcgggagttggcgttttttcgttttaggtcgggagttgagaggggttttagcgtttaggtcgattgcgttttgatcgggagttattgcgtttagcgtagttcgagggcgttgagttcggaggatgcggcgcggggcgggggtttcgggagtaatagagattgggattcgagggttcggttcgcgttgttgtttacgtagcgtttttattttggaaagagtgtttttcgcgcggcgggtcggtttttttagcgcgtatttggggttgtttttgtagggttattttcgtttttagggaggtttacgttcgtcggcgaggaaggatggtgagttttggtttagcgggaaggttggaggaacgtaggttcggaggaaaaagttttttagatttgggttattaacgaaggtttttatagggattattaggatcgggacgtcgtgggtagaggcgttatgttttttgcgttatttttttggggatcgcgcgttagttcgtggtgtagggtcgagttttggggttgtgagcgcgcgtttcgttttcgtgcgttggtggaaagcggggtgttcgtgcgtgcgtttgcgagcgtgtgtcggttgtaatcgtagggagcgtaaataggtcgttacgt

SEQ ID NO: 7296 - DNA, 1750 bp, Artificial Sequence
  Description of Artificial Sequence: Synthetic polynucleotide
cgcgtacgtattttagaggttatttagattatgtttcgtcgtttgggcgtttaagttgtagtcgttttttgtgtgtaggtagtagttgtttggtaattttcgagttcgttcgcgtttttagtatcgtagaattagggttaggtgttttagtggttgtagttaagttaggtattttgtttagcggcggttgtataggagtagaatcgagaattcgtcgtttaattttatacggggtgattgtcgagtgtttatgttagcggttttaattttttttaggtggaggagtgggcgggaggtacgatttgggggtttttaggttgggcgcgttggcgatttcgaggtcgattaggttatgtatttttagttcgtttgggtatttaagttgtagtcgttttttgtgtgtaggtagtagtttttaggtaattttcgagttcgttcgtattttttatattttagaattagggttagatgtttttgtggttgcggttaagttaggcggtttgttttgtagtagttgtataggggcgggaatcggtttttagttttattttcggtggttgtagagggtttttggttagaggtttcgagttttggtagaggaggagtcgggtgggggtagggtttggcgggtttttaggttaggggtattcgcgatttagaggtcgtttaggttatgttttattatttgggcgtttagttataggcgttaggtaatttttaagttggttggcgcgtttagtttcgtagaatcggggttagatgtcgttgtggttgcggttaagttaggcggtttgttcgcggcggttgtatcggggtaggaatcgatttttagttttattttcggtggttgcggagagtttttgttagcggttttattttttttcggaggaggagaggagcgggagttacggttaggcgggtttttaggcgggaagggatgcgcgtttgcgatttcgggatgttttgcgcgagtttaggagaattcgtaagttagcggcgtttgcgttcgagttgtagtcgttttttgtcgtttacgcgagttcgagagcggttttcggagttcgggttagcgtcgagttgtaggcgcgcgtttaatcgttttgttgggtttacgcggtttgagaggtcggagcgtttaattgttggtacgcgagtaacggtttagttaagtttattcggtttgagaggtcggaggttgcgagtgtcgttgttgaaggttgtggtggatcgggttggatcgcggattttgagttatatcgcggggttgggggtggattttgggtttgggggtggattgttggtttggtggtggattttggatttaggggtggatagcggggtggggagggggatcgcggatttggaatttggtcggggtggaaaggttacgaggagtcgcggcggtttagtagcgggtggttggcgtttgagaagtcgttattatgaggaaattttttagtttcgggagacgtttgggttaggcgtttttgagttttatggattaagagtacgcgggtcgggggtattatatcggggattgggaattgcggaagatttatagggtggttattaagggcgacgtcgcggaggtggagcgttgtttgattcgtaggtttcgggatttggatgttcgcgatagaaaggataggtagcgggggtttagttcgcggtgggagggggtttttaggttttgtttgttcgtagcgtttgaggcgggggttttggaggtcgtcgggttttggagtcgcga

SEQ ID NO: 7297 - DNA, 391 bp, Artificial Sequence
  Description of Artificial Sequence: Synthetic polynucleotide
cggtgttggagcgaggatgcgtagatcgaggtagggaggcgggggtgcgggaggtttcgcggttgcgcgggcgcgtgttggtggtttcggcggaggtttagtttcggttcgcgttcgcggcgttttcgttgcggttcgagcggtttggttgcgggatttgtgcgtacggatggcgcggtcgtttcggtagtattcgggggtttgggcgtcgttgtttttgttgttattgacggggttcgtcgtttgcgtagttagtttcgcggacgacggtgcgggttcggggggtcggggatttcggggacgcgcgcggggggatacgggcgtcgacgaggcggtgtcgcgttacgattttttttacggtattttcgcgggggagttttacgatttgcgt

SEQ ID NO: 7298 - DNA, 817 bp, Artificial Sequence
  Description of Artificial Sequence: Synthetic polynucleotide
cgcgcgtcgtttttttcggagttttcgagttgttgaggagtttggattgtgtttgtttttagtgttagatgaaagggcgttgaggtttttggtcgttgtttcgcgtttagtttcgcgtacgtttttttgcgagttcggtcgtttagcgttttttttcgttcgagtcgtcgtttgcgtttcggggtagtcgttttgtttttagcgcgatgtggtttcgtttggttttttgttgttggggtttggcgttcgtttcgggttgggcgattttttagtagatgttttcgtcgcgtaattttagttttcgtttttttttcgagatcgcgttcggggttttcgggagtattttcgcgtcgttcgtttttggcgacgaagcggcggggagtagagtggagcggttgggttaggcgtttcggcgacgcgtgcggttgttgcgggagtttagcgagcgtttggagtttgtttttttggtggatgattcgtttagcgtgggcgaagttaattttcgtagcgagtttatgttcgttcgtaagttgttgttcgattttttcgtggtgtttacggttacgcgcgtggttatcgtgattttttcgtttaagaattacgtggtgtcgcgcgtcgattatatttttattcgtcgcgcgcgttagtataagtgcgcgttgtttttttaagagatttttgttattttttatcgaggtggcggtatttatattaagggcgttttttagtaagtcgcggtaaggcgttcgtttttttcgattcgggttttagttttcgggtttttcgatttatcgttgtttgttcgtttttatttcgg

SEQ ID NO: 7299 - DNA, 814 bp, Artificial Sequence
  Description of Artificial Sequence: Synthetic polynucleotide
cggagtacgggttacgtgttttaggtttcgggaattagtttttattggtcgagggttcgcggggtcgttaggagggttttttaggttttttttagggatggagtagttacgtttttcgagtgtgtttattttatcgatggagtaaagtgaggtttttagttcgttcggatgtttttgcgtcgttcgcggggtagttttcgtatagatacgttcgtaagttttcgattcgttcgttattcgcgtttagatattcgcgagtttttggggtcgtagggacggtgtagcgttcgtcgaggcgtttttatttatttgtgattattgtcggagatttttggttttttttcgttcgtagttatatttgtagcgtgaacgcgtttcggggtagttcgaggtcggttcggaggcgtagttgttcgtttcgttcgttgaaatagagcgttcggttcggcgggttcggtttttcggtggcgtttttcgtttttcgttgttgtcgtcgtcgggggacgcgtacggttttttaggtatcgttcggcggcggcggcggcggcggcgaggcgcggcggtcgcgggtcgttcgggtggcgtaggtggtcgggtcggcggcggggcgcgggggtcggtcggttcgcgggttttttcgggttcggcggggacgttcggttagttcgtagtttagcgcggcgtttagtagttttaggtgtagtatttaattttagagtcgtatgttcgacggtttttttcgtttttttttcgtttttgtatcgttattcggagttgttagttttgggagtttcggcgtttcgatttttttcgt

SEQ ID NO: 7300 - DNA, 1429 bp, Artificial Sequence
  Description of Artificial Sequence: Synthetic polynucleotide
cgcgagggaaggattattaaatttaaagacgcgcgtgttcgtgtgtttatatagacgtgtgtttcggcgtttgtatacggtcggcgcgtaggtatgcggacgtttatacgaatatataggtatgttttattgacgtatttggggtatttttttttaaagaaagtaaggaatgaaaatttaatttgagagttattagggtttatttggaggtcgtttaaggggtagaaaaaatttgtaatgacgttagagtgtttgtttttggtgtaattttattttcgggagggttggatataatacgtttggaaagttcgaggggttgttttaggatttgggggcggggggtggggtatttagtaatttttgtcgcgggttgtttaagaaacgtggaaatatattttgcgattttttatttttttatatatataggtacgcgatttcgtcgttatttttcggattagtagtttacgtttaacgttgggtcgattttagatatataggtagtcgggattttcgttcggtgcgtttgtttatttatttttttgcgttaggttgggacgcgtttcgtttgtaaaaggtttaaacgtatttttcgtcgcggggcgggatttaggggtttaggtttcggggtttagaggcgggtaattttgttaattttttttagcggcggggaacgtcgcgtaatcgttgagttttgttcgtcgagattaaataagtagaggaataggttgtaaatatatattttgatacgtgagtgatatttacgcggtgcgagaagttgtagttaagggaaaggtaaggggtggggggagcgggtatcgataggtacggaattttcgtaggcgtcggaaacggcggtttttcgattttttttttttttagaaagtggtaacgaatgtttaagtttttcgaatttgttttttgtgggaggtgataggtgaacggaatttaggtttggttattttcgtcgttgtttatttttttattatttgttttttcgtagataagtagattcggcgtataatgaggtagtagtttttagtcggttatcgtgattaatttagaataaaagcgttttttttacgttttttttaataaaggggttattagtttcggcgtttttcgaaggttgcggggttttcggttgtcggttgcggagttgtcgcgcgtaaatttttcggggttttcggggttgtcggcgttacggagtcggggtcgcggagggaggaagcgtaagtcgttcggagaaagtgaggttagattcggcgggggagaggggagggagtcgggcggtcgcggaaggagggtgattgattagtgcgcggtgttcggcgttttgtttcgttattagaggcggttaaagtagggttacgtaataattttagaatcgttaattaattgacgttgtaggtaattattttattgtgcgcgt

SEQ ID NO: 7301 - DNA, 7708 bp, Artificial Sequence
  Description of Artificial Sequence: Synthetic polynucleotide
cggaggggaaagcgagtttcggaaataggcgtagtttgtggcgagggttcggtggtcgagttgaatttcggggtttcgggagattcggtttttgcgggggaggtttttttcgaagtcgttattggcgggggagtagagaaaaggggaaagaaggggagtggagaaaaagggaaaggagtcggttttaagtagcgaggtcgaggtcggttagaggtaagggtagggggcggcggcgggggaggtagtcgtggggtttaggtttggtcggcgtttcgaatttttttattttcgtttttagtgttcgggggcgggtcgagattttttaggatcggattcggggaggagcgaggggtcgaggggagggggaggattcgggttttttttttttttttttttttttttttttttaattaggtcgatttaatggagttaaagagttcgtaaaattatgaataatttattcgtgatttgttattaatttatcgggtttcgagtttttgtcgttgggattgaatttgtaattaaatttgatttcgttttattttattaaagacgagattgtaggtttaattgtttaaataatggattggaattaaattagtaattacgtcgttaggtatatatatataaaaagttggggttgggggaggtcgggcgttcggtcggttcgcgcgggattttcgcggtcgcggcgcgtaaatttaggcgtaaagtgcgcggttcgggtttttcgttcgtttttgtcgtcgttttcgtatttttagttcgttggtagtttttttcggggtagggggaggttttcgttttatcggggttcgggttcgaggggttgcgggaagaggtcgttgcggtttcgtttcggaaggatttttcgatttcgcggttcgcggttttgttgtaagtttagcgttcggcgtttcgacggcgttttttttttattcggtttttagttcgtcgttttttagtaaggtgtcgtcgcgtttcggagggattgtttttagagtaagaggttttgtaaggggtcgtcgtggttgggttataggatgtgggatattgttataaataagttcgtgttttcgtggtcggaattttgtacgtatacgtatacgattcgcgttcgtatatttcgttcgcgatcgtattttttagggttttcgttttttagttttagttgtttcgcggtttatattgcggttattttttttttgttagtgcgggaggggagggaagggcggacgttagatttaggaagattgggttgggtttcgagaggtcggggagatgttttttttttttaatttagtttcgggagtttcgaaagagttagtcgtatagttatcgtcggcgtatcgaacgtcgttttttttaggattaggagtttcggttaaggtcggagaggagggtacgggaataaatacgatatatatagagatagagatagagagaaaggacggagagaacggaaaggaaaaaaagagagagggaggttagagagaaagtgagatggttgaatggagggtgttttttgtagaggttaaataaggtttgaaatttagtttttagtttatttcgttggggtaaacggcggttgaatagtaaaaagtagaaataaatttttgtattttttattttttttttgtataattttaaaatcggcgtcgaattttcgtgtttaggaaaataatatagttttttagttattaggtgttttggagtcgagtttcgcgaggtgttttcgagtggaagttgatttatttgataaatagaagcggtttggtgttgggggagtcggtttgaattcggttttgtttttttttggggggtggtaggagaggagggatggaagttttagagagttatatttgtggtagtgtttttagtaaattttaaattcgcgttatcgatcggtttatcgttgttttattatttattaaattgggggttgcgttttttttttagtttcgtatatagggatatacgttttatgattttttaagcgatttcgttggagcgaatattcgttttttatttttttttttatttaatttagattttttaagatgaaaataattgattttttttcgtcgtagtattttttgtatagttttgggtttgtttttgtttttgtttttttttgtttgtgtattagattaaagggaaaaggaagaagaatataaaatttttaaatttaattttgttgtaaacgaaagaaagaaaataattgtatataaattttagttcggaagttcggagagttataaattttttcgggttttgtagatttcgggtagatgttgacggtttatttgtcggaatttagaatttttgtagttgttttgagtagggaggggcgcgggagggggtagagttttttcgggaatggtttggggtttaaagatgtcggaaattcgaattaagttttttattttattttattttattttattttggcgcgaggttaggtttgtttcggtttcgttttcgttcggggggttcgttttcgagggttacggtttttattttagtaggcgttaggaaattcggaggaaaaagttcgggaaaattgagatttgtttttaaaggaggatcgggtcgagtaaaaggaatcgtagtttttgtttttttgagttttttaagttcgagttttttaagtttgtcgtttttgggatattttacgaggttaggtcgtattttaggtcgagttcggcgtttcgggttatagttagtttttttttttgggattttcgtcgttttgtttcgttttttcgttgttttagttttcggtttttagtcgcgttaatttaaaatttgtttggcgttagcgtcgttttgttttttttatttttgttattttttgtttagtaaagtggggtaaaggtttaaattaaaaagttatttttaaaaaaataatttattagagataaggttttgtattcggagtagtaagggattattgtatttttttttttcgttttagtcgaggacgtatagtttggaagtttagggggttaatgttttttttgcgaggtcgttcggtgtttaaggttcgttatttgtttagtatatagagatttaatttagttttcggtcgtcgaggtcgtatatttttttttaattttatgggggcgtttcgtgcgtcgcgtatttattagcgttgtaggtcgttagattcgtatcggggttcgggtttttacgttttttcggtcgttttttttgtatagtgtttacgttattgtagtagggaagatttagagggttggtttttgttgcgtttagtttcgcgtttttggtcgtcgcggttgtagcggtcgtcgttgttacgtcggtatggttgaagtgtgcggggtattcgttttgtagtagcgtttcgaagtgtaagcggtagtagattaggttgttttttatgtcgaagtggtcgttcgtggttagtattttgttatacgtggtgtacgtgaagtagttgaggtgataaattaagtttcgagcgcgtattattattttcgaggtcgagatgtttaggtggtagcgggcgtagcgttgtatagagaagcgtttgtagggattatggagggaggggttgtgggaatatacggttgggtattttttttttttttttttaggtgtcgttgttgttgcggggggtaattttttttttaagacgaataattcggtttttatttggaggatgggggggagagagaattagattttgatttaggtttggttttgttttaaaatagttttttttaatatatttatgtttatagagatttttattttatttagagttttcgtaagttttaggaaagtttttatttgggagtggagggagatatttattatttattttttttttaatttttatttttttttttaaattagcgtttgggaattttattgatttttataatttggaagaaatatagagatagggaaagagagagagatatagacgtagagatagagatagagagaatatatatagattttaattttaaaattggggagaaggagaaatagagaatttggagtttattagtgattttggttttttgattttggttattttttatttttatttttttaaaagatttggaaatgtatttatttttatagttttttttttagttgtgttttattttagtttgggttgtttaggtttgggggtgtttgtttttataatttcggattaatttaagaaattttaaagagagaggggagtaaggattttaatttaagtttttttgtggtttaagtttcgagtaggagggtagtttttgttttttttttggtttttttatttcgtagatttttttaagagttttttaaattgttgttttaaaaggttattatttaatttgtggtggtttggagaatttggggggggagcgggggagttttgagtagtgaatttttttttgggattaaacggaaaggagagggttaaattgtaagattgtgtttgagattggggggaggggttttgaggggtagttgggtgggggggttatttgtagtagttttttttgtagtagatgttatcgtttttgttgaaataggtgagtttcgattttaggttgagtttgtattcgtagtatttgaggtagcgtatgtgttattgtttgtttatcgttagtaggtagtagcggttcgagattttgttttcgtagtcggcgtatagcgcggcgcggttattgttgatggacggtatggtttgcgaagggagggaggcggaagatagtagcgtttgcgttagttagcggttttttcgtcgtcgggaaatcggtatttataattttttttgtggttttggttattttgaacgcggagggggttgttaggatatgcggcgcgtttttttttattttaaaaggtttatttttatttttgggcggtttagaatttaggtttgtttgcgtagttttcgttagttacgggtttaggtcgggtttttggtttaaatggttttggtgtttattttttttttttttagttttttttgtttttttttttaaaatgttcgggttgtgtttagggattaggatagttattttagttaagttttttaagagttttttttaaattgttttttaaatgagttattcgggggataaggtgattattaagttattttttatatagaattttttttggagagatagcggagtttttgggttttagttttagtgatttttggatttttagattagaggttaaggttaggataagttagttaatttttggtttttttgttatacgggttggggtttttttgggttcggggatgaggtaagtggggtgtagggatatttttaaagttcgtgggtgaaggataggtttaatttaaatatttttttatttaaattgattagtagagaaggtttaatcgaagaagcgtttagaggtcgggaggatattggcgtcgttgtttttgttttcggagtagagaagtttttttcgtgttttttattttcgcggttttttaaaggttatttttgggttcgttggtcgggtagtgtttgttcgtttggtttttagggaggtttgaggcgaggaattggttatttggggttgggttcgcggagttaggtgtagagatttaaatggagtttttttcggcgagggttaggtcggagtttgaatttttagttttggtttggttaagtttgattagttaagggtttggggacgcgattaacgataaatgttggtttcgaagatttcggtttttgaaattgcgttgggggttgaggaggattttcgattgtcggaaagttgggagcggtttaagtcggttggagttttaatgtttttagttggttcgtttttttttggcgtcgttcgcggcgtcgttagtaatcggagtcgagaggtggaggagagcgcggggttgtcgatttcggtatcgggtaaggtgagaagggagtcgtttcgggtcgcggatgggatttcgtttttagttcggaagaaacgtttttttttatttttagggtcgagatttcggttttaattttgttttttttttgcgttttagtagtcgggtttttttcgaatcgggagttatcggttttgtattttgatcgaggatttttagtatttagtttcgtgcggtacgaaggacgttttttaaatttcggggagtagaggcgttgattggttcggttttattttagtttttagtttcgattttatagtcgcgcgtttatcgtttcggtgtcgtcgcggtcgatggcggagttgatggcgggagtttcgtttttggttttgcggtttatttcgtcgatgatttcgtgtatttcggggttcgatagattgtggaatagtatcgcggcgggatcggcggggtcgggggcgcggttttttcgagggagggtttgtttttcgttttagttgtttggcgtttttggcgttaacgggttcggtgtatcgttatcgcggtttcggtttcgttcgagttcggttgagtttttaggtcgggtttcgggtttcgggcgttcgcggggtaggacgtttttcgtcgaggcgtaggggtagttatattgcggggcgtttgggcgacggcgttaaagttagggttataagggtacgggataagcggggcggggggagtaggagattaggatagaggtcggcgttcgtcgcgggcgtttttacgtcgcgggtatcgttcgttcggttttagcgttcggggcgtaaagtaagggcgtaaattttgttcgaggcggcgacggttgcggtcggggtttattttgaagtcgttaggtgttcgcggcggtttagttgtttggattttttttttttttggggtgcgtttttagtttaaggcgatttttttgggcgttgagtcggcgattggagtaggggttttttcgaagtttgcgagtcgagtcgagttatcgggagaattgaagaggaggaggaagaggaggaggaggaggcggaggaggaggtggaggaggagaaaaaagaggaggagtagagtgggaggaggagtcgtcggtcgcgggtttagtcgcgcgtaatgttttttaagcgcgcgtttagtttagtttcggttttgtagttcgcgttagcgtaagttttcgcgttttttttatagtcgcgtttgatattacgttttgtcgtcgtgttattggtcgttcggcgttttaggttttggtagcgcgtgtttcgggaaggcgggagatttaagagggaggggagaggtaagaggagtagaggagagtcgagatggtgggagttggtgggcgaggttggagggcgggggtgggggggaggtagggaggagggagagcgcggggtttggagtttttaagatacgaatagttttttgcgatatttttagaaaggaaaattaaattttttattttaagaaggcgtagtaaggggatgttcgttttattgcggttttttttcggtttggagtcgcggttttaggtattcgtttgggaggttcgggaaggtaggtttgtggtagagttgtaagagttttcggtcggtcgttttttatcgagtttcgttttcggttcgggttttgtatagcgggttgtaggcggtcgtgtaagttttttgggtattcggtagagtttgagtggcgagatcggcgagagttgtgattttcggggaggggggttagttagtatatttacgttttaagttcgttagggtttaatttgtagtttagcgtgtagtttttcgtttttttcgg

SEQ ID NO: 7302 - DNA, 3969 bp, Artificial Sequence
  Description of Artificial Sequence: Synthetic polynucleotide
cgttttttttgcgagtcgcgcgcgtttgcgatgcgtaggttgttttggatttttcggggattggggggatttttttgggaagttaagggggatattttaagtgtgttttgtaaatcgtattttttgatgtgaaaatcggtatgcgcggtgcggtcgtacggggagagcgcgtgtttgggggtggggggtatcgtttaggaaagcggagttatttcgggcggaaagcgattttcgtagaaagcgtcgcgcgggcgtcgttgcgtgttcgtcgtttatagtcgtagttaaagagacgtaggcggttttacgcggtttggtttatcgtcgtttgtagtgttcgcggcgcggggcgtttcgaggttgggtttatcgtttttttcgcgtttttgaagatttttcgggttttttcgaaggagtattgtttttttttgtattttttttttagggagttcggtcgtagtttttttaggaacgcgttggcgcgtcggcgtcggtgtaggacgtcgtgggtttttttttgggttacgaagattgggaaatgcgagtttcgtgaagcgtttatcgcgtgtttcgtttagtgtttcggagatcgttttacggtttacgcggcgggggtatcgtaggttttcgttcgttttggaggaggggagcggcgttgttcgcgggtttggttgggtgttttttttgtcgtgttttcgggttagttattttcgtcgtttatttttttcggtttggtttttttgttttcgggggttgatttcgagggcgcgttcgggggtacgcgcggaagtcgggtcgaagggggttgcgggcgtcgtcgcgtaaacgtgaggttgcgggtcgatgtcggcgaggagaaggcggcgcggtttcgggtgtcgggtaattttttggggtttacgtgaatcgcgcgtggaaattcgtatagtcgttcgcggaaatttaaatttttcgtttttattcgtatcgcgttttcggcggttagattcgttttttttaggttttcgttttggttcgaggcgcggtttttgttcggttttttcgatagcgagtttcgggttttttcgttagtttttggcggttttgggtttttgtcgtttttttcgttttcgtttggggtttttttgtttttcgcgatttttgagagttttagatttcgcgcggatttttttggggtcggttttgagagtatagtttttcgtcgtagtttttggttttttcgtaatttcgacggttatttgtggataaataggatcgtcgttttgtttatgggaagacggggttggtgagggttagagacgtttagggcgaggtaatttcgtgcgtttagtttcgagtaggtcgttttttaggacgttttatagtcgaggggatcgttattcgggagcgtcgtgagttgtgggtattacgcggtggtggagagtgattttcgtttcggggcggtcgtgttgttcgaatttgttttagttcgcgaggggagacgggtttgggggtaggcgggagagggaggtttcgggaggaggcgagcggggttgagaggacgcgcgggaggggttttggagaggtcgtaggaggcgcgtttcggagggacgatttttgttgggaggacgaggttttaggtggacgttgtgggtcggtgggtaggagttcgagttttgtaggagcggtttaaattggttattgagcgcggaagaagggacggaaggtgagcgttattgggttacgtggggtcgagagaaaggttattgtttgttttttttaaaattagttttatacgtcgacgtttttagagaattggtttggtttggaaggaggttgaggatgtaggcggggatattaaagaatcgggtttaaggaggtgggaatttacggatttcgagtttttataggaggtgttttgggcggtaggagtgggaggggaggtttatgtttttgtagttttcgatatttacgttttcgggatatttacgattttcgggatatttatattttcgggatatttacgtttttcggatatttacgtttttgggatatttatatttttgggatatttacgttttcgggatatttatattttcgggatatttacgttttcgggatatttatattttcgggatattttcgttttcggaatatttatattttcgggatattttcgttttcggaatatttatattttcgggatatttattttttcgggatatttatattttcgggatatttacgttttcgggatatttatatttttgggatatttacgttttcgggatatttacgttttcgggatatttacgttttcgggatattttcgttttcggaatatttatattttcgggatattttcgttttcggaatatttatattttcgggatatttattttttcgggatatttatattttcgggatatttacgttttcgggatatttatatttttgggatatttatattttcgggatattttcgtttttggaatatttatattttcgggatatttacgattttcgggatatttatattttcgggatatttatatttttgggatattttcgtttttggaatatttatattttcgggatatttacgttttcgggatatttatatttttgggatattttcgttttcgggatatttatattttcgggatatttattttttcgggatatttatattttcgggatatttacgttttcgggatatttacgttttcgggatattttcgttttcgggatatttacgtttttgggatattttcgttttcggaatatttatattttcgggatatttattttttcgggatatttatattttcgggatatttatattttcgggatatttatattttcgggatatttatattttcgggatattttcgttttcggaatatttatattttcgggatattttcgttttcggaatatttatattttcgggatatttataattttcgggatatttacgttttcgggatatttatattttcgggatattttcgttttcggaatatttatattttcgggatattttcgttttcggaatatttatattttcgggatatttacgtttttgggatatttatattttcgggatattttcgttttcggaatatttatattttcgggatatttttattttcggaatatttatattttcgggatatttacgttttcgggatatttatattttcgggatattttcgttttcggaatatttatattttcgggatatttttattttcggaatatttatattttcgggatatttacgttttcgggatatttatattttcgggatatttacgtttttgggatatttatatttttgggatattttcgttttcggaatatttacgttttcgggatatttacgttttcgggatatttacgttttcgggatacgtatattttcgggatattttcgttttcggaatatttatattttcgggatatttatattttcgggatatttacgttttcgggatatttatattttcgggatatttacgttttcgggatatttatattttcgggatatttacgttttcgggatatttacgttttcgggatatttacgttttcgggatatttatattttcgggatattttcgttttcgggatatttatattttcgggatatttattttttcgggatatttatattttcgggatattttcgttttcgggatatttatattttcgggatatttattttttcgggatatttatattttcgggatatttacgttttcgggatatttatattttcgggatattttcgttttcgggatatttatattttcgggatatttattttttcgggatatttatattttcgggatattttcgttttcgggatatttatattttcgggatatttacgttttcgggatatttatattttcgggatatttacgttttcgggatatttatatttttgggatatttacgttttcgggatatttatattttcgg

SEQ ID NO: 7303 - DNA, 2490 bp, Artificial Sequence
  Description of Artificial Sequence: Synthetic polynucleotide
cgtgaattcgagtttcggttacggtcgttattcgtttttatttatttttacgttgtagtgcgattagttattcgcgtggtattcgttacgatttagttgggtttatagataggagttgtttttttttattgtaggcgggtgatttaaggtttttattgttttatatttgtttagatcgcggggtattcgggtttcgtagttttttggtcgcgttcggggttcggggagtcgggttgcggttggggggtttggaggatgagggcgaagattcgagttggattgcggagagggtgtcggcgcgggtcgggtttggggggaggatacgatcgggttttcgttttcggatatcgtacgcgtcgatatagaggggtcggttttcggttttggcgcggcgggttggcgtagggcggggtggcggttgaggggttcgggttttaggtgcgtttcggagcggtttcggcggcggtgcgggggggaatagggaggtaggatggggggcggggaggcgggaggggggagtcgaggttttcgcgtcgttagtttcgcgttttcgttttttcgttttcggttcgagcggtcgttatcgcgggcgggcggcgttgcgttcgggtgcggtttttcgtcggcggcggcggcgcggtcgagaggtgcgggtttcgcgcgggcgggacgcggggcgttgttcgtaggagcgattaggtgggcgtcgggtcgatcgtagtcgtcgtcgcgttttttttcgcgtttcgggttttggtttttcgcgtttttttttttcggatttcgttttttcgttcgaggtcgttttttcgtttcgggttcggtttttcggagttcgtcgattttcgttcgaggttttttcgttcgacgtttcggtggtagcggcggttcgggttgcgtttttcgttgtcgtcgttgttgcggttttgtttttttcggggagggggtttcggcggttttgcgttttcgggttttcggtttcggcgtcgtcgtttttcgttttttgcggttcgggttttcgtttgggttcgattttgcggggtttcgttttggcgtttgggtttttgttcggtaggttttcgcgcgttttttgttttcgattttcgggttgggcgttttcgtttttaggtttttttttcgtgtttttgtagtttttcggtttcgttttttcggggtttttttcgtttcggcgtttttgtttgtcgtttatcgttgtgtttttggttttgcgttagttttttttgggtttttttttcgggttttcgttgttttttcgagtttttgatttaattttttatttttcgtttttttttttttttttttttttcgtttttttttttttttttttttttttttgtttttttgtttttttttatttttttttgtgtttcgttttcgtcgggttttttttagttgggcgttttagtgtttgtgtttttggtattttcggattggtttcgtgtttgcgttcggtggcgtcggtcgttgtttttcgttagagtttttttttatttttggttttttcggattttgtttttgtttttttcgtttttgtcgggtttttagaatattcgggtcgggcgttttagcgtttttgggttttttggcgtttttttcgcggttgagtttattttttttttttagaatcggggttttgtttttagataaacgaattttaatcgaagcgtatcgaattcgagggttttagatcgggcgcgacggggttcgcgcgggaggagtttttcggacggggcgggagcgtggggtttggtaggggaaggtcgggcgcggggattgtatcggatttatttcgggacgttgcgcggggcgttcggtgggtgtcggcggtagcgtttgggtatagagaggggattacgcgacgggtcggcgatagcggttggggcggcggtcgcggggattttaggttgtcggttttcgtcggttttttttgattcgttgttttttcgtaggcggacgtcgcgggtatggattattcgtacgacgaggatttggacgagttgtgtttcgtgtgcggggataaggtgttcggttattattacggattgtttacgtgtgagagttgtaaggtgagcggcgagcgcgcggtaggggtgcggtagacgggcgttgcggggtttcgttgatttttagttttcgtagggtttttttaagcgtacggtgtagaataataagtattatacgtgtatcgagagttagagttgtaagatcgataagacgtagcgtaagcgttgttttttttgtcgtttttagaaatgtttgacggtggggatgcgtttggaaggtgcgcgtcgcgcgggtttcgatttttgattttttatagtttgagggggtagggggtgggggtgggagaggggttgaggggatagtattattggttttcgcgaaggtttttcgtgcgatattagggtttagtcgttgtaagagaatcgggcgttggcgttgggtgggtttcgggcggggaagggacgt

SEQ ID NO: 7304 - DNA, 5370 bp, Artificial Sequence
  Description of Artificial Sequence: Synthetic polynucleotide
cggtcggtttagcgtaggatttcgggataacggatggtaattgggggtcgttcggaggtttttaggattttattagtgttcgttgggttgggttggttcgttttagttttaagacgcgtagttttcggaatttttggagttgttcggtttagtcgcgtatagagtcggcggtagagcgggcgcgggtcgggttcggtagggggttgatcgggttcgagtgtcgggcggtggcggggaaggaggacgagaagcgtttattgttggtagttttgtttgtagtatagttttcgatttcggaagtagtagttggtggtgagggtttgttgatacgtcgcgtattgtaaatatttttcgtgttaggacgattcgttgattcgtattaggaagcggtcggagatgggtcgttggtagttttcgtagacggcgggatgcgggtagtcggagtttgtagcgtatagggcgaaagttcggtcgttagcgtcgttcggtttagtttcggcgtttcggtcgtatcgggtttatagttttcggtttcgagggttcgggtcgttcgggattatcgtttgtcgtttgcgtttttcggatcgtcgcgttaggggtcgggcggtttcggttagttcgttttagttttcgggtttcggcgtggagaggtcgcgggtttcgagttttggttcggcgttgtgtttttttttttttcggagaattcgcgtttcgtgttaagataaatgataacgagtacggcgtagggtggtcggttgggattaagataggcgaggtgaggttggggcgttcgttggttgatacgttttacggtggcgttcgtggttttttattttcgatttttttaaaatttgtggtttgagtgattagggagacgttttttttttagaattttttttattttaggtgattttgcgttttttttaagttcgttaaggtgattgttaggttttttattatttttgttattcgttatttattatatcggagtggtagttttagaatttaagtttggaaaggatggtgggtggcgattggagttgttttgtttttttaggacgtttgtcggaggcgtatttgcggttttttggcgattattttaggagttttgtttttgttttttttttatgttttgtaaatttattttttttattcgttggttttaacgttcgtgtttatagtcggacgacgttttattttacgttcgagattattcgggcgtttcgatttcgtatttatttagtagtatttttagagtggcgggttcggggcgtagggcgtgtttttttattttgatgtcgtttaatattttggcgtagttcgtttgttcgcgagggaagtatttttttagcgattcgggatttgttgttatatttatgggacgcggggcgcgttgcggatttcgtcggtcgggttgttcgttcgtcggttcgtttattcgtttttcgttgtcgcggttttggaatcggggaggcgcggttttcgtagggtaggggttgcgtcggttttcggcgatcgtggagcggcgacgcgttggtttcgggtttcggcgtcgtgcgggcgggtcggggcggttgtagttcgcgtcgcgttttttcggatatttgtagttacgcgcgtcggtttttttgttatttgtttgttagtttcggaattcggcggcggcggttgttgtagacggagtcgcggggaggaggcggcggcggcggtggcggtggcggcggcggtaggcgggggagggggtgggggtgtaggggcggtttcgcgggtcgcggggggggcgcgcggcgtagcggggtttcgggcggggcgtagcgggtcgcggggtttcgggcgcgtttttcgcgttattttagtgttatggtgcgttcgttgagtcgtcgggtttagagttggggttggcggcggagggatacgggtcgttttatttttcgaaattttttgatatttgaatttcgcggtcggtatttttgcgtcgggatgcgtcgtcggttttacgttaaatagtgtcgtttcgttttttcgcgcgtttcggggtttcgcgtttttggttcgcgtttcgcgtcgcgtttggtttcgagtttaggtttcggtttttcggttcggtcgtttcgcgggtttttcgtagaagttttgatcgttttcgaaataaatttttttgttttatttttttgaaaaattgatttgggagttggggagcgaaggttttttttttttttttttgttttttttattattaatattttgtaaagttttagcgttacgaggagtggtttcgagcgaggttagattgcgcggacggtagggagcgcggcggtttcgttaggggacggcgtcggtcgggagtggtcgtttgggaattttcgattgtcggtcgaggtaggtcgcgggggttgagtcggagtttttcgggcggcggcgtttgttcggggtcgtttggttcgcggagagggtcggtttttaggaacgaaggacgggggcgggtagaaggcgaggacggttggttttggattcgtgtaaggggggtttaggtttaggaacggggagtgagtttggagtgtgggtgaggggtttgggaaagtttcgggtttggtagagattgggcgggggattgagtcgatgggaggttggggtttcgggatcgagaatgggggatattgggacgataaggaaggttaggtttgggtttaggcgatcgagagtttagaggataattaaggttggaaaaggggttttcgggtaggggtaggagtagtgggtaagattcgggttttttagggtttgtagtgaggggcgttaggagggagtggtggttttagggtagcggttttgaagaaattaggttggttgttaagatcggggttttttggcgggtcgggtgttcggttaggggtcgttgggacgcgcggattaaggatagtgttttagttagtttgggtaaagtggatttcggtaacgggacgcgaaagttggcgagatggagttgtcgattttcgcgttagtcgggtttggtattcgcgttcggtgcgagaggttatagcgtcggatcggttgtttgcggttcgtggtttttatcgacgcgcggtttatcggggagtaggggggcggttgcggttcggggtagcggcgggttgatttttcgcgattcgttgcggggcggtttcggtttttttcggagcgaggtagcggcgcggagtcgggcgggggcggagggtatggggggcgggttttttgatttcgttggaggcgaaagggcggatcggatttggaatttgcgggaggtttggttagaagtggttttttgcgtcgcggggtttcgcggaggggttcggttttgtggaggattagaggttttcgttttattttatttgcgtgtgtgtcggtgggtatttgtgtgtgtttgtgcgtgtcgggttttcgtttttgcggtttttgttttcgtgtgttttttggttttgtatatacggtatgtgtgtttttgtaattttttagatttttaggggtgaatttgtggatttgtgtttgagttttttgtattcgtgtgtatgtgaatgtgtgggtttttcgtgtttgtgtttggggtgtgtgttcgtattattttatgcgggggtttaagtttttgtgcgtgttttagtttttgtgttgtgtttgcgatttttttttgtatgggtgtttttgttagttttgcgtatttgtgtttattttcggggttttgaatgtttttgtgtgttcgcgtgttttttagtgtgtgtgtgtgtgtgtgtgtttgtgtgtggtggggggttttgtgttttcgtgtatttttaggcgtttttgtgtggttaggtcggggagagtggatagttaatgtggagttttttttttatatttcggttttttttttgtttgatttggaaattttaggtttggattcgcgaagttgggttgggtttgagtcgtttttttcgggtatttggggcgggggcgcggttgttgtagggagaagtcgggcgggtaaggtttcggcgtatagagttagagtttcgaggcgcggagcgcggttcggggtcggcgggcggattaggtattttttgttttttgttggtcgcggtttatttttgtaatcggggttgggcgattgtttgtaggcgagagttttcgttttaggtttagatttttttttttttttttagggtgtatatggtaatattttttcgttataggttttgtatttttaatttttggcgtaaggttttattttttttttattttttttgtgtttggttttttttattttatagtttttttttttttttttttggttgaatgagggtttttgcgatttagttttttaggtttttttaattcgggttggcgtttagtgtcgatttggggtcgttggttgtgtttagaggcgtatttttcggattattcgaaggtttggttttaaggtaggaggatttgtgggaagtatttttttcgtgtcgcgtttggtttgttcgggtgcgtatgtatttttagcgtttttttcgcgtttttgttagttatattttacgttattaaggcggatatagggtggtttgtcgttatgcggttcgcgtttagataggggcgttggttcggtggacgttagagtttggttgttttttttggtttggggtggggttgttgagtttatattttttgggtttttttgtatgtttttttcgttgtttatttattttttttatatatatatatatatatatatatatatatatatatatatatatatatatatatatatatattttttttataggtttcgttttttgttttttgtttttatttttcgtgtttcgtgtttttagttgagttggtcggtttcgggtttttcgtacgtagacgcgtaggggttttagatttttttagtataatcggggttttcgcgtttttttatcgttttttttgtcgaagaagcgaagaagcggtcgattggacggtatagtaggggtcgaggtttagagtcggtttttgttcgtaggcggcgaacggtattttgtttcgttaggtttttgcgggtgtgattcgtgattcgtagattttttcgggcgtttttggtttatgacgcgggggttgttcgttttacgtaggcggtttcgggatgttttttcgtttagattttagcggtagaaatagtttcggattttttttatttgggggaaagattgagtcgggggttcggaattattggaagaagcgagaatggaaagggaggttttggagcgggggtttcggttttttttagtttgcggacgttttagttttattgagtttcgttttagttttttcgtttttttttttagggttttgtatttttttttttgcgttattcgtttttttcgagtacgg

SEQ ID NO: 7305 - DNA, 3120 bp, Artificial Sequence
  Description of Artificial Sequence: Synthetic polynucleotide
cggacggatcggcggacgttgcgggttcggtcgggttgataggaattatttgcgttgttttaggtcgtttttcggtttattgtttttttgaattcggtcggttttcgcgggtcgtttgatgtttgtagggttatagattttcgtatataaattatcgtcgcggggttgggggtggggcggaggcgttgaaatttaattcgtagagtttgtttcgtcgtcgtttttttgttttttttttcgttcgttcgacgttttttatttatttttttttaaataaggtttattttttttgttaaaaaaataaagttggtattaagtgtttcgagggagaaagttttttttttatttttgatttggaaggaagggtcggttgtcgattgagtcgggattgtagagggggttttaggagaggacgggcgggaggtgagtttagggtttttggttttatcggttttttttttcgttttcgtttgttcgttttatatttaatggtagcgaattttatggttttcggttatgttttgtttttttattcgttttgttcggaaagggttttttttatcggagttttcggtttttatgttgttagagatggaagtattattttttgttttttttttttttttataaaatagtttttgtttgtcgtttttacgaggtgatattttgtttttagttcgattttttttgcgttcggagtttgggttcggcgcgtaggagattgcgtgtattttggcgttttcgatttttgttagggcgtacggggattttagagcggattttttacgagttttaataggaggttagggagtcgggatattagagataaattttttcgaagttttttttcggttttattgattggagtttttgggttgaaattttacgagttttttatttttatgtttatgaggggagtaaaacggagttttcgggggtacgtaggtttcgtttttgggtgttggttttgtttttggtttttttagtcggtgtagtgattcggaatagcgcggtcgttttttcgacgttcgcggttttttattgcgtcgaggcgagcgttacggttaaagtttaagtttcggcgttcgttgcgtttgtcggagttttgtttgttcgagtaggtagcggggtttaggtacggcggcgacgtcgaagggttagtcggtagatagggttgggtttttgcggttagagcgtcgtaggaaagttttgtaaacggtgggacgagggtggcggcggcggcggcggaggtggcgagaaaggcgttacgggtttggcggagaagagggttttcgtgggggtggaataaaggaatttattttcggaagaaaggggtcgagtatgtagtcgggaatggttaattttggagatttgtaggagtgcgagcgttgcgatattagttttagggatttaacgaaatttgtttcgtcgagggttttagtttggtatttttattcggttttttttttttggttaatttcgttttaatgggggtggtgggtgtgtattcggagtgttattttttttgggaagaggggatagagtaggattcgtgttttcggttagaggaggtaaatatattttattaattttttttttatttattttttagtcgtggggttattgtttttattttttagacgttgttaattaaggtattcgtaaaattattttttttttcgtttttacggtaacgtttcggtttttgaggtttaagcgcgttcggaaacgaaaagcgttagggggttatagggtcggagtttttttttttcgtcgttttcggaaggggtggaggggatacggttgtaaggtgttcggttttttttttgtgtttgatatgaataaggggattaggatggtaagttttcgtcgtttatttcgtgggataaagggtttcgcggtttgagcggtatagtttttgattaaacgatagagttttgttatttagtattattttaggtatttgtgttcgtgatataattttattagaagataaaatcggcgaaattttttttataatgaaaagttatatttaatggtcggattttttttttattttttttttcggagtttgttcgttttttttcgttgttgttggatatggttcgtttataattggtatttaaagtattaagttcgggagaaaaacggggtttagggtttttgtaatttttttaaattgtttttgttcgaaatttttatagatataagtttgttaagagtaaatatttgtggattgatataattatattttttttttgtaaattaaatttaaaaaaaaaaaaataagataaaaaaaaatttgttattcgtcgttttcgggttggggcgtaggagggagggggttggggtcggttttagtattcgcgtcgggaattcggttttcgggtcgtttggttgtttttaggagttgagggatttcgtacgttttttaggcgggaaaagggttttagattttttttcgtaatttttaattttttgtttttttaataaataaatttttcgaatttgttgtttttggttagttcgagggggtcggtaggagggtttggggaggggcgagggttgtgtttaataaggaatgaaaatgttagtttttttcgttagttttattttttttagcgggagtttgtagtggttttaaggagaattattggttttttttggatcgcgtaaggttttatttggcggggtatttcgattttagtttaagagagttttcgagttattaagggttttcgaaacgttgagaagttcgaaagttgttgtagggttttggatttcgggttttagtttagcgcgttttaggatcgaatttttttataaattagttgttgggtgaaagggttgcgttttagaaagggtaggatcgtgtgcgcgtattagagcgcgcggtttttaaattcgggttaaatttttggtgatatcgaaatttattaatcgtcgttggtgttcgcggttcggttgcggagtttaggagtttatgtatggtgttattttatttttagtaaagaatatgttgtacgaatcgtcgagaggtgggtttggaggggtgcgcgggtggaggtcgttgaaagtcgttttattcgcgtgttcggacgtcgaaggaagttttttcgt

SEQ ID NO: 7306 - DNA, 3120 bp, Artificial Sequence; identical to SEQ ID NO: 7305
  Description of Artificial Sequence: Synthetic polynucleotide

SEQ ID NO: 7307 - DNA, 7861 bp, Artificial Sequence
  Description of Artificial Sequence: Synthetic polynucleotide
cggattttcggtacgggttgggaggagtttagaggcggggtgagttttaggttcgggcggtttagagtttcggtttagggggcgtttaggttaggagtgttcgtcgtttttagttcgggtggaagcggcgacggtcggacgttcgagttttattcgcgattagcgtttttcgtcggtttttgcgtttttttgttttagttcgcgcgtattttttatatgaggttgttgtttttgtagatgtttacgtgtttcggggcgattacgcggtcggtgaaggggtttatttcggttttcgttttgatttacgttttggagaagatgtcgaggttttcgttagggatggagttttgagcgatgattattttcgtaggtagtattaggttggatagtttttgtatttttgcggcggcggggttaggaaaatcggttagagttcgaggtagtcgaggttcggttttttttttttcgtcgggatttcggtttcggttttgtttagattagttaaatttaagtcggttttaaatttagagaagttattcgggtgtggaggaagtcggatgtgcggaggtttaacgattttttttttgtttgtaatttggagatttttcgtgttttggaaagcgagtggtgcgttggggattatttttagaagtgggtttttagttttttcgcgaatttttaaagtattcgtaattttttttattttttgtttcggataagtttaagaattaatgagttaacggtagcgagcggttttatgtatagggaaattgaggttaggttttgtaaggaggtgaaggttaatcggagattttttcgtttagtcggttttcgggagtttattgtgtgtttaggttttgggtattggtagaggagtcgggtcgtgattagcgttggggatagatttcgggttggtaggtgttggaggtgttaaagaagtatcggtagtagttggttaggttttgcgttcgttgtgtgatttcgggcgcgttcgagtttttttttgtttttaggttttggggtgttagggagggcggcgttcgggtttagataaatttcgatgttatttttttgggcggggaggagtcgcggcggtttttagtttttcgagggtttttttgtcgggtatttgcggtagggttggaagcggcgaggcgtataagggcggtttttatgttttataaggtttttttttaagttatttgggaaaatattcggcgagcgggtcggttgaaaggggggggttaaacggtgtttattgcggcgcggcgggtaatttgttacgttgttaaagtgatcgtatttattcggttttattcgaaagaaattgttaattttaaatttattagttttggaagaatgttgtagtagtaaattgtagtttaatgcggaggggatttgtttaaaaggggtcgaggaattttttttataaaaaagggggattagatggttgatatagcgtgaatggaagtggaattagtttttacggtaaattaagagaggaatagaaatcgtaaagggggaaaagagggcgacgcgtagagatgttagagttagggaaagatattgtttgcgggttgatgaatgaggaataagaatttgagatattttaaagaaaagaaatttttttcgttttttttttttttttttcgtttttttcgcggtttttttttttcgttcgttttttttttattttttttttagtttcggttgttttttaaagtttttggtttaagtgggaattttcgtgggttaagtttaagttaattaaatgaatttaaaattttttttttttgagttaattgttattatacgtttagtaaggttgtaaatgtcgggaattcgttagtttaagcgtaggaggggaagggaggggtcggcgggggcgtcggggtcgagcgacggggtcgtcggggtcggtttttgagtcgggtgggttgcggagttgtttggtggttcgcgttttggtttggtttatggggaaattgaggtgtatcgagcgtcgggagagtttaggttggcgcgagtagtagcgaggtcgggtattttagtcgcgtttcgcgtatcgttaggacgggaatgggggtcgtcgggaggagggattgcgtcgggtttcgacggttggatttatcgtcggagaaggattgcgttagtatttcggcggtgaaggttgttttggggttggcgtggtggtttttgttttcgaagagttgtttttcgagtacgttgcgttagcggtcgtataggaagttgtgtaggatgtcggaggtgataatttcggttagcgttagtttcggcgtttttagttcggttttgagtattagggttttagtcgggagtacggagtttattatgggcggttcggagtttttcggcgtcgggggacggtcgggtcgacgggggaggtgggcgggcgagaggggagtttaaggggcgagaggagagcgttgcgatggagaaggaattagagtagggggaggacggagaggaggaggacgtaggagggagcgggaggtgagggggcgattgggaggaaagcgaacgagggggagaggggaagagagatggtgaaatttgtagagatggtaaaggcggcgcggagggtggagagacgcgggtggaggcggaggcgggtgcggggggtgtagggtgggtgagaggcgggtggttgtagggaagcggtagtaaggggtttaggcgcgcgttagtttttcgtatattcggtcggggtcgttttttttttggtaaaattttagcgtttttataggagtcgtagtgatttttttaattggttattaatgattttttgacgtcggaggatagatttgttgtattcggttgggttcgaggagttttcgtcgcgagagcgcgaggggcgggggcgcgcggatcgttttaaatagtatttttttattttttttttttttttttggttttttttttttttttttgttttttttttttttttcgtgggaagcgtagggtagggagggaggtttagtcggttttgaggagaggaggggacggagaaggggagggggtgcggcgaggttttttaggattttagggattaggttagataagaggggacgtttggtttcgggtttcgcgttttttttaggtttgatttatgtttatcggtttggtttagttcggcgtttatttttattttgttgtttcggttggtcggtttagttttgtatcgtttttttttttcggttagagttcgcgttttttttttttttcggttttgtatttttcgggtcgttatagtcgtttcgagttcgcgcgtagttttagttgttacgcggattttttgtttagattgcgttgttgaagtcggcgtttcgttttatacgggtcgcgttaattcggtcgttgtgtacggtcgggtgcgaaattttttcgcgggtttacggggttgtcgaggcggggtcgtagcggtcgtcggggttggggttggtttcggtttgagatagttttatggaaggttaggttttcggtttttgcggggttaggtcgggggtcgagatgggcggataggaatcgttttggtagtttgtttttgggaaaagaattttttacgggatatagggggattgaaaggggtttcgagattttttttaggtgggagtaggcgtgtttgagagcgaagttttttagaaattgtaggtagtttcgcgagaggttttagtgcgggttcggtttgcggttcggtttttcggttttttgttgagttgtaatttcgggaagtcggtggcgttgcggcgtttttttttttttgttttttagtttttttttttttttttgtttttttttttttttttttttttttttttattttttttgtttattattttaggagtagatttgttttgcggcggtttcgaggtatttcggagtttagcgattttttttttcgaagtaggtagttgttgagtttagcggaaggtttcgttttttgtaggtttcgcggttttttagtgttagttttaagtttcggattttaggttttgatatgttgggtgagggagtttattttatttgtcgtatttttggtttttattattagtttataattttagatgtcgttaatagaggtgtttggattttttcggcgtgggttaggtttacggattagttttcgttggattgtgtggattttttagattttttttttagcgcggaggatttgggtggaagaatagcgagttgattttttatgagcgagattttgtttaaacgtttgttggtatagacgtttttttattattcggacgcgttttggttaagagggttttatatttggcgtttagattttagatttttggtttttagtttttgttagtagttttcggtatttttcgttttcgttgggacgtaaagggaggaaggcggcggtagttggtttttagattttgcgttcgggttcgttcgaggttggagtttaaggaagggtatatttggtagaaggtaggatcgttgggtagggcgttagtagagggtagcgttgttgaggagggaggtgggttagggtcgtcgaattttttatttatttttcgacgtagtttgtgggtcgtatcggttttttggttagagttcgagtttgagggggcgtatggagttcgatggtttttgtaggggagttttatcggggtttattttttggtttttgggaagatttaggtggagaggataaagtgttaggagcgagggagacgacgtcggggagcgttgttaggagttaagcgttgcggtagtttttaagtttcgaaagcgattttagtttttttaggatattaaagggggataaggattgttgtgtgttttgtggattgttttttttttttttgggtttcggtgtttttgtttgtgtaatggtttgagttggattttgtgaattgaggtttttttgtttggtttttttttgggtaagattattttattttacgataatttcgaggattttgttttttttagggttacgttttattgcgggaagtttttaggtttgtgtatttttcgtgttggggtgtagcgtttgggttttgaatttcggtttagagttagaggtttggatttcgttggcgtagtgattacgggttcggattgcggttagggagttttatttttttttttcggattcgtaagttcggagagtagtattgggagtcgggtagaagcggagcgtagaacgtttttttagttggtgcgtttaaatttttatcgcgtttatattttgtgtttttagtttagcggtaaaatttatttggattttcgttcggggaaaaaggagttcgtaggtagcgtttagttttaaggtgtattgaaatagggagtaagattttgtgtttatattttttcgggaggagatttcgaggggaaatatttcgggtttttttagcggatgattcgtgttattttgttatttttcgcggggtttaggcgcggaatgtgttcgcgtaaaagtttttttttttcggtcgggtcggagtttttaggtttcgtcgtttttttcgttcgttggtcgttatttggcgatttttttaatatttatgggcgttaatagagaggtttttagtatatcggtttattgtgggcggttcgtaggatttgaataggtttcggtttttttttttcggcgcggtttttcgaggggtcgggttaggagtgaatggtttcgtttttcgtttcgcgtttttttttttttttagggagaatatttttattttttttttcgttgtcgtcgtcgttcgggtttttatttacgcggtttcggtttcgggcggaacgaattaatttgtcgcggtttttcggaggttattttcgtcgttcgggtgttttttttttttgagtttacgggagtggagagagggtcgtcgcggtaggtcgacggttttacggagggatattgaaggggaagtggaggagaagagtaggggcgattcggaggggtggttgggtcggggcgggtaagatagttttagggttcggtagtcgttcggggttggttaatttttagttgttgtttcgtttagggcggagcgtcgaggggaaggaggtcgcggtttaagttcggaggttcgttcgttttttttttgaggtattagcgcgcgttttttcggttcggttgaggtatttatgagaacgggggcgtgtgggatagtttagggtttcgtacgacgttttcgttttcgtcggtgcgtcggggtttagtttcgggagagttaggtttcgatagtgcgttttagggggacgttcggaagggcggtcggtttcgcggtttttgcgttttcgttttggggttcgggtttgggtgcgggggaggggggtgcgagtcggttaggcggggttaaagcgtacgggttttcgttttgttcgtttcgtcggtttttagaggcgtagaaagaagtttattgttcgtcgagaaatatatttttgggggtcgagtgaaagttcgttttttttttgaattttagaagaaagttttttgttttcgtttttcggagggagagatttgttttttttttcgggagtttcgcgcgtttttttttttcgaaatatttgtcgggggaaaatttattttggagggtagatcgcgttcgttttaagtttggcgaatttattaaaaagatattagcggcgggggtaggtttcgcgtaggtatcgatcggtcggaatgagttcgaggaagaaaaggcgaagaatgcgttcgcgtcgcgtttagacgtttattcgtttcgtttagtttttgcgttttagtttcgtatagggagaggggttttcgcgtcgtttcgtattgtttgtgagtttcgcggttcgcggtttagtcgtttttattcgggtttttcggtatagtttttcggtaatttttttttgtcggtgttgcgtttcgttttggttttttttgcgcgtaggttttcggtcgtttttttttttcgttcgttgtcgtcgcgcgtttagtattcgcgttttttttttttttttttttttttttttttttttttttagcgtttttttttttcgttggcgtttcgattttttttttagtttcgtatatttttttcgtttttttttcgtacgtttttttttggttttttgagttttaatttttcgtagtggtttaggaaatttttttttcgcgtggggttcgcgtcgtttttttttttttattttcgtttttcgtaagacggtttagggttttagggcgttttcgtcggcgcgtataaaggcgcggttggttgttaaggcgggtgggggcgaggtcgaaaaaaacggttttaatagacgtgattcggggttaggtttgcgcggggttgtcggcggagtggcggtttcggtttagtgaatggggatagcggtttttttttttattttatttttgtttttttttaatgtaattagtttttaaggttcgggagagataaaggcgcgtttcggggcgtttacgtggagtgcgtaggcgcgaagtcggcgtttcgatcggtaggtgattggtacgcgagtttttttaggcgtttaggggcggaggaggggaagttttttttttgcgtttttcgaatttttttttatcgtttatatttcggtttttaggttagcgatgttagcgttatagtttaggttgattaaggcggcgggaacgacgggagagacgtcggggatattaggagatcgggcggtgggagagatagaggcgtaggtttttggaagtagagggggcgagataggggtcgggggagattgaggtaaggcgatgtcgaggtggagggagtagatgaaaggtcgagtcggagacgtaggggtataaagattcggagatgaaggaagtagagggggagaggtacggttttcgaaagagcgg

SEQ ID NO: 7308 - DNA, 1434 bp, Artificial Sequence
  Description of Artificial Sequence: Synthetic polynucleotide
cggtttcgcggcgaggggtttagacgaaggaaacgtcgttttaggggcgcgcgggcggagatggagtggtttaggttgggggagcggggagtagggtcgttatcgttgcgtcggttcgcgacgtttgtttttgttcgttttgtttttcgtcgtttttttgggcgattcgggtttcgcgcggcgttcgtttagttcggggtttcggattgaggagggggaggaggaggaggaggaggagtcgcgttaaggcggtcggcgggcgtatttacgtcggtgttgcggtttagcgtttcgtcgtcggtcgtcgagagtttggtggtgttgaggtttattagcgagggtagcgtttgggatatttagttagtgattatggttatggtgtttagtacgatttcgattttgagtagcggtatcgatatcgcgtttcgagttgtttttagcgttcgtttcgagttggtatcggttttcgcgtttaggcggtttttaggcggcgggtatcgcggcgggtaggggcgtttggttgtgttttcgcgttttttcggttcgtcgtcgttcgttcgtcgtcgtcgtcgtttcgcgcgtttcggttatcgtcgtgtttttttcgggcgttagggaaggtggttaggtggtttttgttcgtcgcgttttgcgtttcgcgtcgttcgttttgcgttttgttttgttcggttgcgttttttcgggttttttcgtcgttatcgggaagcgtcgttcggttttgagcgttgcgcgggttgcgcgcgggggtcgcggtcgggaggcggggttcggtcgggcgggatcgacgtaattcgtttaggaaatgggtggattttttttttcgttcggtttttcgtcgttttttggttgttggtagcgaggtttgtaaattttagttcgtttaggagttgggattagggtgatatgaggagacggatatattattatttttagattataaaatattcggcggcggcgcggggattttagttgggggtacggttcgcggttttttcgtttcggggttttttttatttttacgtcggggtattttttttcgattttcgtagagggttcgttttggggtaaaggttgtcggtagagagacggcgtcgttttgtttattggagttttttttcgcggtgattcgagggttttagttagtttgggtcgtcgtttgaaatttagtaggtagggtaggtttcgaaaagtagttagattcgcgagggtttttagcgttaggggggcgtcggggtatcggtggagagttaaaggcgtttttgcgattttagggtagtcgcggtgttttaaggttttgtttgggaggaagggagttaatcggtatttttgatatttgtatagtaaggcgggggttggggtggtttgtcgtggttcgcggtgcgtagtgagggttttgggagggcgtatattcgg

SEQ ID NO: 7309 - DNA, 5053 bp, Artificial Sequence
  Description of Artificial Sequence: Synthetic polynucleotide
cggttcggtattttgcggtttcggtacgtagttttcggcgttatatttattttttttgcgtttcgggttgagttttcgtcgattatttgttgttttcgaggttaaattttagcggcgggaggattttgttgttttttcgatttttttttcgggaattttagtttttttggcgtgtgttttagtttaggtttttgtttttgggtcgtttcggcgtaggaagttgcggggtcgggacgaacgttggcgggaagttttgatttgggtttttttttatcggtgttcgttttcgggtcgggtacgcggggcggtttttgggtatcgtaggtttcggcgtaaaggcgtttagagttcgtagtggttcgggttggttttcgcgattttcggtttcgtttcgtttcgcggtttcgtttttcggtcgtttcgtttttcgttcggttagaggtttcgggttttagggcggttcgcgggcgtagcgtttagtagtattcggagtcgtttggacgtcggttcggggttattgcggggtggcgtcgttgggttcgggaaagttcgggattggagagtggcgacgtcgggcggcgggatttatggaggcgcgcggggagttgggttcggttcgggagtcggcgggaggcgatttgttgttagtattgttggcgcggagggcggatttgcgtcgaggtgggtgttcgggtcgagtggttgtatcggggagattaggagatttttaggttttttcgggtttggtcgcggaggttggtaggagttagaggatttgggcgggagtgggcgcgaggatttcggaacgttcgcgtttgggcgttttagtttgtatttgttgtagggtttttggtttgggttgttagggagtgagtgaggttgtggtattgcgttgtttcggttagggagttttcgggggtttagggtgggtttaggagatttttgtagttcggagttagttttttgggttggaggaggcgtagggagtagtggcggggtagtgattacgggataggagggtttttaagaaggtcgttttagtcggattttttttacgttttagcggaatagagttagatgtaggggttaaggtcgagttgaatttcgatcgtcggttttttcgaagttaggttttagcgtttgcgtttatagatattcgttcggtttattttcgtttagggttcgtttgtaggaaaaagttttttttttttaggttttttagttttttggtggtattattttagtttttagtattttggtttttagggaatttgggtagtttttttcgattttcgggttagttggagtcgtaggatggggaaggaggtttcggagttagtggggagtgagagggatcggtcggcgggaagggggttatatttaggttgtgggggttcgcggttttttatttatttatttatttttcgacggtttttgggaggggttggtcgcgggggttggggggcggagagagggagggaggaaggaggattgcgcgttcgcgttcgggagagttggtcggagcgggcgggttggcgtttaggtttcgtcgatttcgttatttttgatataggagttttcgttagggttggagtcgttatgtagcgtaaggttggggtcgcgggcgcggcgcggggtgggttggggcggtttttgttcgacgcgggcgtcggcggcgagttgcggtcgaggcgttgttcggttcgcggtgttgaattcgcgttgtgtcggtttgtcgggtcgtttcgtttcgagtcgggttttcgtttgcgatcgttgtttacgatggggatttcgggcgcgtagcgggttttcgacgtttcgtattcggagttgcggttttgtcggatgcggggcgtatttatcgtcggtttttcgttattgcgtggggaggcgtagtttagtttttttcgtcggaggtcgagggagtttttttttggtgttttttatttattgggagatgggttggagtcggcggggtttatagttagggaggcgggtgtaatatgttagtaaatttcggtttttttagcgggtattttttttttttagagattttttttaagtgaagagggagtttttagtttttgatatttggaaaattcgtttatagattcgaggtttttatagggtatttttggatttttttagtgtggtttttttagggggtttgtagtatcgaagtggggtgtggggggtagaagtagcgggaagttagacgtttgagtaattttgacggtgttgggggtatttacgtttgatataaaggtagtggatcggtttgtttagtttatttataagtaattttgcggttgtttaatgatggggaaggtattgatatttatttcggaggtttgtagatagggttattaggtagggtagttatatttgcgaggagtttttagaaagagtggttatgacgtttaatatgaaggagattcgatggggtgttttagttttaggtgatggtgaagattcgtttttttatgttttttgtcgggttttagagagtagatttttttggggtggggtttttatttgagttttatatgtattttttttggtattggtaatattttgtaattgagtatttagtttcgtgaaatggtttgggttgtttttttgtttatatatatttttagatcgatgttagtttttttttagtttttgatataggatgcggtgtttgtatattttcggaatttgcggggttatttaagttggttggggaagagggtgtgtagggaaaggaggatttttcggtagttttgagttttgtgggtcggaggggagattggttcgcgttggggtgggaaggtggttttattgttttttggtttacgaggtgatttagaattttttcgtgtttatagagatttcgttgtgcgttggttgtgattagtatattttggatcgttttatttttaaggttttggatcgttattggtatagtaagtgttttaagtgtagcgattgttatacgttattggtcgagcgttgttttagtcgaggggagagcgtttattgtaaggacgatttttttaagtgagtttcgaaattttattttagtgtgggagcggagggtacgtttgttttagggatttttttttttataattattaaggttaggttttcgaagtttgcgtttttcgtaattttagtttatttttgttatttaggtagggtattttgtggtttggttaaattaagggtggggtttttttatgggtgttttttgggtggttgggtttggttgggatattagtaagtattatttggaaaaaaaagtaatttattatttaaattatagaagtagttattagagaagatatatttttatttgtaggattttattggatttagttttttcgaaattggtgatgttttagtttttaatgttggtatttagcggttttggtttagtggtttttatggttttagttgtggggtgtgagggattggttttagatgggtttttttttttcggatttatttttttagatttagtatgggttttgtaggtaatggcggttgggtttttcgaggtttttttgagattgaggttttttttttagtgggagtgggtagttttgtttcggcggttaggttggcgattattttgtagggtcggatagagttttttttcggggtcgtttttttaggtagtcgtttgtttttttttaattcgttcggggcgaaatgagtttcgcgttttcgcgttgagttcggttttgtgcgtttcgtaggcgtttcgggattaagtgcgtcgcgtgttagttgggtatttcgtttacgtaggtggtgcgtcgcgtttaggatttcgtgtattatttgtattgttttgtttgcgtcgtgtgtaagcggtagttggttacgggcgacgagttttattttatggaggatagtcggttcgtgtgtaaggcggattacgaaatcgttaagtagcgaggttagtcgaggggacgacgtttttattttttttggtttgaaaaaaatggggttgaggttacgtttaggggggcgttcggggaaattttttttttaagcgtttattaagggggtttgggttagggcggtgtaggtagtaggaagtcgaggtcgggaacggcggagttacggatagattcgcgtttcgaatcgtttcgttcggttcgaagtgtgcggtttttcgtttttggtcggaattatcgttttaaatttttggtcgcgaaggttgggttatatttatatttttagaataaaggggagttcgcggggaaattagggtgtttggagaagggagttaaggttgaaggcgggggcgtcgtggaggtgcgattttagggaaggcgtcgttttcgttttcgcggtagaattcgtttttcgtcggcgttttttttattttagttcgggtgttgttcgtttttgttaatcgtttttagcgttcgcgtttttcgagaagtttgtggggcgggatgggggtgggtatttgaggtttcgacgttttcgcgtcggtcggggtgggagggttgggggttcggtcggggtcggaggggttgtcgcgttttatcgttcgttcgtcgcgtagaggtcgaggttacggttaagcggtcgcgtacgattattatcgttaagtagttggagacgttgaagagcgtttataatatttcgtttaagtcggcgcgttacgtgcgcgagtagttttcgttcgagacgggtttggatatgcgcgtggtgtaggttagcgttcgtttttgtttttttttcgttcgcggttttgggggttttcgtagagtcgggcggtcgtttatttcgtttcgtttttaggtttggttttagaatcgtcgggttaaggagaagaggttgaagaaggacgtcggtcggtagcgttgggggtagtattttcgtaatatgaagcgttttcgcggcggttttaagtcggataaggatagcgtttaggaggggtaggatagcgacgttgaggttttttttttcggtaggcggagggatcgcggagttcggggggggacgagcgcgcgtcggcggggtcgtaggggttttagggagttcgcgg

SEQ ID NO: 7310 - DNA, 6343 bp, Artificial Sequence
  Description of Artificial Sequence: Synthetic polynucleotide
cggtagggcgggacggggttgcggtttattatggaatagtcgtatacgtgaatttttttgttttgattttggtgggagatgcgttcgtcgtttagatatttatagtcgtagttttgtttttgtatgtcgttcgatattttgtcgtagatgttcgttgggatgggagggcggttttaggacgtgttttggtcgtttttggaggtcgcgggaggaatttttagtcgaaggggtttgaaattttagttttgaatagttttttttttaggagagacgaagttttttgaggttgggatagggatgaatgagcgaaggagggtggaatcggggagggcgcgggaattgggagattgttggggagggtgttaggtcgtgttacgtttttttcgtttaggattttagtttgggttaaatttagtaggggtaggattcggagtagagcgtagttcgttacggttcgtagtttcgttttcgtttcgttagtttcgtttttgtttcgttagtttcgttttcgtttcgttagtttcgttttcgtttcgttaggcgtgtttttggtatgttcgtaggtttcgtttttattatggtatttagtttatttgtagtcgcgtacgatttttttgttttttgtagtcggagtttcggagcggggagtcgagtggattcggattagtatatatttgaagacgtcgtcggagtcgatgtttatattaggaatgagagcgaggttcgttatcgttatgttttttttttcggagttttttttttttattcgattcgggggtcgtttgtattgcgggaggcgggttttgcgagagcgacgattaatttcgtcggggaatgttttttaaggtttagcgttttagttaattgtatcgtcgatcgaggtacgtgttgattaatcgtaatttagttttttgtcgttttgcggtttcgttagtttcgtttaaaggaaacgtggaatcgggaatgggtggtgatgaaatttagttaacggagaagtttttttttagcggggttcggtggtatttttggaacggggtagttaggcggttcgcgaggttggggtaacgagggaggtttgagggatttgttagttttgattttttgtttcgtacgtagttcgaagattatttttttcgtggtttttatcgtttaaaggttttttttttttttttttttatcgttcgaaggtttttttttttttcgttttttatcgttcgaaggtttcgttttttattttttttatcgttcgaaggattttttttttttttcgtttatcgttcgaaggttttttttttttttttttttatcgatcgaaggttttcgtttttaatttcgttatcggtataaggaggtaacggtagtcgttatatttaagttttattttatttggttcgaaagtttttgttttttggaaattatttcggtttaggggcgttttcggtcggtttttaggggtggggtcgaatgtagaggttttggggtagggggcgcggggcgcggcggcgggtgggtaagcgggacgtttggtcggtgtagacgcgcggggacgagatgggcgtgtcgggtgcgaaagtaggagcggaggcgggggtgtttaattttttttatttggtgtttttttttttggtttcgaagtagggttggggattttaggagggtttttgcgtttggtttttatttttttttcgtatattttattttttagagagttttgggcgcggattagggtgtatttgggggataggtggaggtcgggtcgtcgggtttgcgtttttacgttcgtagtacggcgtgcggttagagcgggtgtgcggggatttttcgggataggttaagttttttcgggtgggtttttacgtttattaattagtttttttttttatttgttcgtattacgttttgttttttaggtttttatttgggaacgtttcgttttttggtttttttttttttagttaggtgttagttttggttaggtttaggtgttttgttttttttgtttaggttttttgttttttcggttgggagatttgtatatcggtttgaagatttttttgcggttttttttagtttttgtagggtttagattgtagcggttggaggcgaagggacggtagggcgcgtggcgtggttagtgtgttggtttcgattagcgggaacgtattgcgtatcgttcgttttgtttatcgtttcggcgggacgcgttcgcgtatacggacgtatagaggtcgattagggtgttttttagcgaggaggtaatatagtcgcgggaggcggggcggggcgtgtttaaagtgatagattgggttttggttacgtcgggtttttggacgaggggaaatcggagtcggggaggttttagcgagagtttcgcggatcgacggggatcggatttttacgggtggggtttgtgtagtagtgattttttcgagtgaaggtagagttcggcggtttttaggtttatttcgttttttagcggggagtatcgagggcgaggatcgattttttttggggattttcgagggcgagttgggagagggaggaggttcggaggagggagaggggttgttgggggtgggaaggcgaagggtttgtgaggaatattacggggacgaagggtcggggggtgggggtttgggcggagttggaggtcgaattgagcggagtttggaaggttggggaattagaggcggggtttagaagaagtcggggtggggttttggcggggttcgggggcggttttgggtgggtcgggcggggtttgagtgggtagggtagggttcgggttagcgtttgggttaggtttggtgggttcggcgttttatatgatgtcgtttagtaggttggcgttggttatttagtcgagcgcgcgcggttcggaggcggttatgattatgtatatgaaggggcggtcggtgcgtcggttcgtggggtagatggtggtgggcgtgaagcgtttgttggtttcgacgaattcgtaaagttgttcgtagacgcgcgggaattcgtggcgtaggaagacgtcgcgtagtcgtagttcgcgttggatgtggatgaaggttatttcgcgcgcgcgtcggttcgtttcgtcgttttgatttaggttcgtcgtgttcggcggtggcgttaggattagcgtttttatgtcgggttcgcggtttcgcgtcgggggcggtcgcgcggggttgtcggtcgttagcgttattttggcgaatttgcgtattgttggttcgtggttgcgtggcgcgggcgcgggtagggtcggtgttttcggtggcgcggtgtcgggttttacggttacggatacgttgagtaggaagtattttgtcggttcgtagaggcgtttagcggtcgttagttcgcgcgcgtagttgtttaggggcgtcgcgtgtgtggttagtttacgtagcgataggtaggtgggggatagtagtagtttttttaggttaaagcgtaggaagttgtcggtcgagtttggatttgggaagtttaggaagagtacgtcgcggtcgcgcgataggaagtcgatacgcgcgatgcgcgagaaagcgcggtgtatcgggtcgttgtcgcggtaaaattgtagtacgtggcggtatacgttgtttacgcggtcgtatacgtagcgcgttttgtgggcgttttagttttcgcggcggtataggcgcgagtagtagtaggtgtagtagttgtggtaggatttgaagtagaggtaggcgttgaatatggtttcggtgcgtcggtagcgcgtattggagtaggttattaggtcgttttcgtcggcgttgggttcgggggacgcgtcggtcgtttttttcggggtcgcgggtttttcggcgttgtcggtcgaggcggggggcgagcgtggcggcgttagcgcgggggtttcggagttcgcgggtcgcgagtttagtagtcggcgtagttgggggtttaggtagtcggtcgcgggttttgaggtttggtcggcggtgggtcgcgagtcgatgattaggttcgtgatgagttcgtttagttgttttaggtttcgttggcggttagaggtggggtcgtcgggggtcgcgtggggaggtggtcgcgtgcggttttcgggtaatttttaggttttggcgttcgggcgttcggtggcgcgtaggttattgttagtgatggtgatttcgggcgttacgtattagttgcggtttaggttttcgttcgcgcggttttttttcgttagcgacgtttcggatagggatagtgcggcgtagcgtttgggagaggtggataggtttacgacgacgggcgggcgtcggttttcgggggatacgtttcgcggttttcgtatttcgcgttttagtaggttttcgtagttgcggtcgcggtttaacgggttttttcggcgcggtttcggggttagaatgttgttttaggagcgcgagtagtggcggttgtcggtggttagtcggggcggattggtgtcggtgtcgtcgtgttaggaggcgagtaacgggtcggggttagagggcggtattatttgtagggtgcggtacggtcgcgggttttagttcgtttaggtcgggttgttgcgcgggtgcgggtacgttcgagttaggacgttacgttcgcggtatttttcgaagtttttcgtgtaaaaggggcgggcggtggagtgggttcggggtttttcggggatatagcggggttcgtagggtaggtcgtaggttcgtggagtttttttatagtaggagcgggagggcggtttttggattgggaaggtgcgtattttttttgcgtagtagtcgtttatgcgttttggattgggtttcgagagtttttcggacggatagggtttggggtagtaggcgtcgaaggttgggtcgggattggttgtaaagttgtttcggaagttttggggtttttttgtatagaagaattgggtggggttcggcggggtggtgaagggtagattgcggcgttcggcgtagtttcggggtttaggtaggggttcgtcgtagtagaacgttcggggattcgtatagtatgagtcgttgggcgtcggggtgcgcgatagcgttatgtggcggggttcgggtatcgtgaggtcgtggaattgcggggcggggcgggtttagtgcgcggtttcggtgggttcgtaggatcgcgagtttcgggtggcgtgttggagtattgcgtcgtttggtttgatgtttaggcggtagcgtacgtggggggcgggattcgcgggtggttcgggcggtgcgtagcggttcgcggcggcgtataggggcgcgacgcggtcggggtcgtttcgttgcggttgtaatttgatgggatgtagttcgttggtaagggcgcggagcgtcgggtacgcgggttttcggcgcggcgatgtttcggttcgcgtcgtacgttgggtttttcgttttcggcggggtaatatcggcggcgaggcgggcgcgggcgttaggttcgggggcgcgcggggcgtatttttggagcgggcgcggcggcgtggttcggtttcgcgggttcgggcgcgcggtatagcggatttcggcggcggtggtttcggtagggtttttatggtcggttcgtttagcgtttttaggaagtcgaagttgcggtagtggcgtttgttgaaaggcgcgggtttagtaggtcgggttacggatcgtttatatggcgagtatttggacgcgggtttcggggtcgttattttgatgttttggtatacggtcgatattagtaggttcggagggttcgtacgggttattttaaaagaggtttttaggttggcggttttagtttatattgttttgcggggtttttgttttggggggagacgcgggttagggcggtttttttcgtagtttaggtttcgttatttttttacgttggttcggtttatttggggcgtagcgggcggagtagttttggttgcgggtttgggtcgagaacgcgggcgttttttttatgtcggggttagaagtatttgcgggaggaatttagttgtttaggcgttcgttttgttcgttttttcgttttttttttgcgatggggcgggcgggttagaaaggtttagtcgtggttgtggttttcgcggcgggagttttcgcgtgaagttttagggttttttttttttcgattagtgacggcggggtcggttcgggtggattttttttcgggtggggtaggggagtgggggcgtggttttggggttgcgttttttggtgttcgtagttggaaggacgggtcgtatttgggttttatttataggtgttgttttaggagacgttagtgattgcgttttcgttatagcgtttattgtagagcgattttttcgatcgcgtatagtggaaggcga

SEQ ID NO: 7311 - DNA, 1089 bp, Artificial Sequence
  Description of Artificial Sequence: Synthetic polynucleotide
cgttgaggggtcgtatttattcgcgtaggtattagtaggtagttttggcgttcgcgggaggcggtcgggggcgggggtttttcggtgtttatcgtcgtttttgcggttgggttcgcgtttcgggtcggtcgagtttaacgttaggatttcgttcgagttttttagggtttcgttaggcgtcgcgttcgcgttcgcgtttttttgtcggtttcggttcgggttttatcggggcgtagggttggggaatcggagtttcgttcgtcgattcggagtatcgtttacgtagattcgtttcgggcgagggaggggtcgggcgcgtattcgcggggagggcggcgagcggggattagtcgaagtcgggagaggggcgtttttacggggcgggaaattggcgcgcgattttgggggaagtgtaggatggggggataggggcgttttcgcgggggtggatgggggattatagcggggttggcggggtaggggtcggcgtacgaggttggaggaggggagcgcgcgtttttattcgggttgggtcgtcgaggttcgcggcgtatcgtggcggcggtgggcggaggggggcggggggtatttttttttttttgtggcgtaggtgggcgcgttttggatcggtttgacgattttttttcgtcgttttatttttttggttaaaggtttttagtttttaattagggatatttttagtttatagtttcgaagttatgggtttttttcggttttttgaagtcgttatatttgtgttagtcggtcgcgtttttagattttttttcgcggagtttttttagtatttggagacgtagcgtagggtttcgaggacggtttggttcggagaaaagatatcgaagttttaattttttttaatttcgttttttttttttttttatttttttttttcgtttttaaagttcgggggttttatttttttttcggttcgcggagtttttcgaattttgcggggattcggcgttcggcggtgtttttttggggcgtacggggttggggcgggagcgaggagattaggtggggaggggattttagattttagacgttaggggagacggcgtttttcgt

SEQ ID NO: 7312 - DNA, 1020 bp, Artificial Sequence
  Description of Artificial Sequence: Synthetic polynucleotide
cgtagagatcgtagagattaaggaggcgttcgcggttgtagagttgtagagcgggattttttcgagttgtttgtgttcgggtagtcggcgcgtaattgagttagaggatagcgtattttttcggcgcgggtcggtagggtttttgcggtcggtaagttggtttttcgggtggttatcgggattttcgagtttaatggcgggggcggcggtaaaatcgataatattgtagagattatttttatttttaacggagtaagtgttcgagttttaggtggcgacgttatttttttttagtattttcgttttcgcggagcgtttggtattttttttttgcgtatttttcgtttttgattgtttttttagtttttttttttatttgttttttgtttttgttttgcggtttttttcgttttattttttttttgttattttttgttttttaatagtaggtcgggattttcggagatgcggtgtttacggagtagttgtagggtgagcgggagcgcgagcgggagggggagggagacgcgggcggcgacggattgggtagtagtttgtcgttggtcgtgtttttaggtttttttagttttgaggcgttgttcgtttaggtgggggcgttgggcggcggttagtagttgtagttcggtttttgttgtttgtcggtgtttttcgtggttttgggtatggtttcggattttatttttacgttggcgttttcgttgtattgttattacggggtttttttttttaatgtttttggttgggagtagttttttaatgttagcggcgttagcgtcgttagcgttgttttagtagttagcgtcgttagtcgtgtcgttattagtatcgatttttcgtgtagcggtttcgtttcgtcggattttaattattgttttaaggattgggattataatggtttttttgtgtttattattaacgttatcggttaggtgaggcggttaggcgggtcgcgggtttgggggcgggtagagagcggcgagggcggggttttacgttcgt

SEQ ID NO: 7313 - DNA, 6343 bp, Artificial Sequence; identical to SEQ ID NO: 7310
  Description of Artificial Sequence: Synthetic polynucleotide

SEQ ID NO: 7314 - DNA, 1109 bp, Artificial Sequence
  Description of Artificial Sequence: Synthetic polynucleotide
cgatatagggtggcgtgtagggagcgtgttttggtattaggcgggcgcgagggggtagggcgtacgttcgggatacgttttagggaaatcgtttttgggtttggtagttgaatttagacgtcgagtgtagttcgttcggtgcgcgcggcgttttattgttagatttcggaaattagttgttagggtggggtcgcgttttggcgacggttattcggttatttttgtcgttttcgttttttttaagagatttttttagcgggttaattttttgttcgggtaaattttttggtgagtttttcgttttttttttttcgttttttttttttttatttttgttgtttcggttttttagttcgttcgcgtcgcgttttatcgttttcgtacgttcgggcgtacgtttttttcgttcgggtcgttttttggtttttcgcgttcggtagttagtgttttatcgcgtcgtttcgcgttagggttcgtttcgagagtcgtttttttttcgtcgcggtcggcgcgggtttttcggttatgcgttttcgagttttagtttgcgtcgtcgcggcgttcgggttttgtagttttttgttgttgttcgcgttcgggtacgcgtgtttcgcgggttgcgtttgtatcgattcgtatatcgtggattgtcgcgatcgcgggttgtttagcgtgttagattttttttttttggacgtgcgtaagttgttggtggtcggtaatcgtatttagcggattttcgaggatttttttattttttacggcgatttggtttatttggattttaggaataattcgttgcgttcgttggaggagggtacgtttagcggttcggttaagttcgtgtttttcgattttagttataataatttgatttagttgggcgtcggcgtttttcgttcggtcgggaggttggtgaagtttagtttggttaataataatttggtgggcgtgtacgaggacgttttcgagattttggagtcgttgtaggtgttggagtttaacgataataatttgcgtagttttagcgtggtcgttttggtcgcgttgttcgcgttgcgttttttgcgtttggacgggaatttttggttgtgcgattgtgatttcgt

SEQ ID NO: 7315 - DNA, 1109 bp, Artificial Sequence; identical to SEQ ID NO: 7314
  Description of Artificial Sequence: Synthetic polynucleotide

SEQ ID NO: 7316 - DNA, 1384 bp, Artificial Sequence
  Description of Artificial Sequence: Synthetic polynucleotide
cggaagggattcgtcggttgcgtttcgtttaggttggtcggggtcggtgtgatcgtgtgatttcgtgtatattgcgttcgggttttcgtgaatgatagtagtttgtaatttttagtcggagagtagcggtggttatcgtcgggcggaaagggttataagttagaatgtaaagcgatttcgtttcgggtgtgggggatttcgggttttcggttattttcgaggtcgggcgtgttttgttcgttttttttcgttttgggcgtcggggcgattttattttgcgttttaagttgggggttttttatgttcgtcgtcgtcgagtttttcgtcgtcgaggcgttggtcgcggttttcgggttcgggtcggggtcgtcgtcgtcgtttagtttcgttagttttcggttggtggtcgtgagttcggttcgtaggttggttattttttggttggtcgattggatcgttttatcgatgcggagcgcgagttgtttattgttttttattatgtttaggattttggtttgggggcgagagaggtgataaagagttgtatgatgcgcggggggcgcgcggtcgggtattttcggttttatttgttgtgtttttcgcggttcggtttcgttcgcgtttcgatttttaggtatcggtagcgtcggttttttcggtataggaatgatagcggcgtttttagttttagtcgcggcggtggcgaggcggcggggggaggaggcggaggagaaaaaagaggaggagaaggaggaggaggagtagcgatcgtcgagatttcggcgggcgggcgtcgagagttgttttaagaaggatatcgcgcgttattaggtattttttaaatggagtttattattcgtcgtcggttcgggagggggtttcggtcggaggttgggggtatttttggtttttcgcgttttcgtatttcggagatatatttttcgggggggcggaggcggcggacggtagtcgggagggggttaaggtggcgtttttggcgaggggtaggggtcgtttggatcgaggtcggttttttgtttttttttttgagcggtggggtagttttcgttttggagaattggtgtttcgagtcgtgttaaggttggggaggtgttgggtgttcggaagagagggtgtttggaaagggggttttagaggggagtcggggtggatttttatggaagggagacgtttgcgttagtttaggagtggagttcgtgttttatcggttttttaaattgcgagtacgaaatttttagaggggagttgagttggtgtttcgcgtgttttttattttttattttttattcgtaggttagatttgcgttgtttattttaggagggagcgtttatttttttcggcgtgggtcgttggtgttttcgt

SEQ ID NO: 7317 - DNA, 1384 bp, Artificial Sequence; identical to SEQ ID NO: 7316
  Description of Artificial Sequence: Synthetic polynucleotide

SEQ ID NO: 7318 - DNA, 835 bp, Artificial Sequence
  Description of Artificial Sequence: Synthetic polynucleotide
cgtgaagtcggcgttatttagtttttttcgttaattgtttatttttttcggttattgtttttcgagtgtttatcgagtgttcgtgggttagcgagcggggtcgttggaggaaggggcgggtgtgtttagggttggcggcgggttcggggtttttgggaggaaagggtcgttcgtttagttttttttcggagtttagagacggtttcggcggcgcgggtatataggggtatatagcgcggggcggagggagggggtggcggtatcgttcgtggagggcgcgggttcgtttagtttttcgtatcggcgttttttcgcgcggtgtttttttcgtatatttatacgtatttatttttatagttatatattttagtatttgtaggtataaacgtttgtagggatatattacgatatagatatttaagtatatataggtatcggtttatagattcgtttttgagttatatataggtatcggtttaaaggtataggtaggtttatagattggtttttgagttatatatagtttagatttagatgtatatatatagatgggaacgttcgtttgtacgtgtatagatatacggatatattcgtatattatcgcggggtttcgagtatatacgcgtttcggtagacgtttatagatatacgtagggtcgggagcgtatatatatagatataggtttatatagatagattcggttttaaaaatacgtattcgtagaggtaaaggttagcgtataagtacgtatagatatatcgataggcggttttcggatatcgcgttttttgtcgtatttacggtttacgtaagggtttatatacggttttacgg

SEQ ID NO: 7319 - DNA, 2248 bp, Artificial Sequence
  Description of Artificial Sequence: Synthetic polynucleotide
cggttttcgggttagtttttcgttgttatcgtcgtttagttagcgttcgtcgcgtgggagtcgcgaggttaggtttcgtagacggcgggttttcggtttcgttgttttcggcgggcgcgttttttttagttggttcggtcgttgggttgtcgtcgttttttagttcgcggtgttagttttcgcgttttacgtttggttttcgggtttcgtgttttcgtagtagaagggattggggtcggcggggcgggtggggacgtttgggaagcgaggagagttttcgtttttcgggcgtttttttataatggggttagggttttttttttcgtttttcgcgtaggtgtgagcgcgcgagtgtgcgtttcggtaagtgtgagtgtgaagtgtgtgtgtgcgggggagtgcgcggagggagcgcgggcggcgggcggcgcgggaggcgggaggtagggcgtaggggagggggttgggagggagagtgtgcgcgcgtgtaattttatttcggggttttgtgcgagttcgggcgatagtatcggcggcggttggaggaggagcggtcggagacgcgtgtagttcgttcgttagagttcggtagtcggggtaggtgggagttcgcgcgggagtcgagtcgacgcgagtcggagtcggagtcgagttcgagcggagttcgggcggagtttaggagtttcgttcgcgggtagttcgtgggcggtagttaggcggggcgggcgtcggcggggcggttttttagtaagatgtgcgcggcgtcgcggggcgttttttatttgtagcggcgttcgggagtcgggcggttgggttaggcggcgttttcggggttgttgcgcgttcgcgtttagagttgtcgttttagggagttcgttacggtcgcgtttcgggtacgttcggcggcgtttaacgatgatcgttttttggcggcgttttcggagtttggtttgggaatattgggtcgggtttttcgtgtgcgttttttggatttcggattcgcgcgggatgttttacgttattcggatcggtaagcgttttttggagtcgggggttttcgtgcgttcgggagggggcgggaatgagggggttttttaacgcgtttcggagagatttttttaattttttttcgagttgttgagtcgatcggtgattattaggagtttttttttgtgaggataaagttttagagtcggggttacgggttttatttattggggaggaggtcgtcgggtcgtagtgggcgaggggtttttggcgcgtttttgggaggttagatttggtatagtgtggcgaaggtttttagtgcgatttcgagtcgagggcgtatttcgcggtgattgttagtatgaatcgtagtcgatcgagttttgcgatcgggttttttcgtagagtggggattttggggaaggcgttaattttttttttttgtttattttatttttcgcgggtttttcgtttttatttttggtatagttcgagtagtcgtagcgaggtcgtagggtatagattcgtatgacgagggtagtcggtttttttttttggtggtcgtttttggtttcggtggtatcggtttagtttcgtgttatggggcgggggttgggggagtaggatttcgttgttcgttgtagttggtttttcggggttaaggtttttttttcgtttggggtagtgtaggtagagggaagggacgatggaggtcgtttagtgcggttcgggtaggcggtttagggacgttagcggtttttaaagttagttcgaattttttcgtagttggcggcggttggcggggttgcgcgcggtttttcggggtttcggttttttcgcgttttttttcgtcggagatttttatttcggtttttaattttgttgtggtcgtttaaggtattttgtaggtttgagcgtcgcgtatgtttcgggtcgacgatcggtagggttgggtttggtcgggttaagacggagtttttattatcgtaggttttgcgttcgttattaggtcggatatttgggtcgtttgggtttattcggcgttagtattagcgtttggtattaggcgagtcggatttcgtcgagttagggttattttttttttttatagtttttttttagggcggattttgggttgttagcggcgtgaaagaggtgtcggaatcggtgtcgggtttggttttcgtatttgagatttttttaggaggcggttagaaatttagcgggtgggtttttttttgggcggtcgttcgggagtcgg

SEQ ID NO: 7320 - DNA, 3541 bp, Artificial Sequence
  Description of Artificial Sequence: Synthetic polynucleotide
cgaggttggatagttttcggtttgtacgtcggatttttggagagttcgagttttttttttgagtttattttttttttttttcggggcgtgattttattacgattatagtcgatgagtcgtttaagttgggagaaggagcgagaaggttgtagcggcgtaggttagatatttttgggtttaacgtttatttttaattagcgtttttgttagtagcgtttttttcggagttatagtttttatttcgagattttttttttttggaatttcggagcgcggtcgggtattaggggttcgcgtaggattgtagaatcgttgtcgttcgtcgttttagttttagttgttcgcgcggtatttatttgggttttagtgttcgggagaaggtgtgttcgcgcgaggcgtgaagttagagttcgttcgatttcgttcgtatcggacgcgtttttagggtagaggaggtcggcggagttgtgacgttgggattagaggaaggagaaggaaagtcgagacgggtcgggtagacgcgtcgaggagcgtttagtgtacgttggtagtcgcgggaggcgaggcgggcgcggtgagtagtcgcgtcggaatcgagtcgcgaattcgcgtcgtttcgcgttcgtagtcgttaggattcgcgggaattttggttcgtcggtagcggtattgaggagggaggggcgcggggttgagtcgtttttcggagttcgagcgtttttcggagtcggtaatttttgttgttcgggcgggatgcgggcgggaatttagttcgcgtggaatgtgggatcggtcgggttcggagtttttagcgttgggggaaagcggggtttatatagttaggacgagagggggtgcggttttagggttattttcgcgttattttttacgtggcggtcgcgttttcggggcgtgagtgtgtacgcggacggtaggggggtcgtgaatgaagttttagcggttaattagtacggtcggcgcgcgggatttcgggagcgacgtttaatggagagttttgggtggtcgggtagggtggcgggcgggcgcgcggggcgggggtcgggtaggggaggcgggaggtagtttcgcgggtagttaatgggcggcgggcggggtggggtttcggagcgtcgagcgggtcggggttttaagtcggcggagcgaggcggcggggttcgtagacggagcggagcggcggcggcggcgcggcgtagggcgcggggcggtatggttattatcgcgtagtatttgtcgcggggtttcggtggcggagtcgggggtatcgggtcgtttatgtattcggacgttgcggcggcggcggcggcggcggcggtcgcggagcgattgtatgtaggggtcgcgtatcgcgaagtgtagaagttgatgtattacgagtggttgggcgcgggcgcgggttatttcgtgggtttagcgtatttttagtggttatttacgggaggaggcggcggcggcgattgggtcggcggttcgtatttagaatacggtaaggtaggcggcggcggtatcggtcgagtcgacgacggcggcggcggcggaggtttttacgcgcgtttggtgtattagggggcggtttacgcgggcgcggtatgggcgtagggtagtatagcgtattatttgggttcggttatgtcgttttcgttcggggttagcgggggttattagttttagtcgttcgggttgtacgcgtaggcggtttattcggggggcggcggcggcggtttggtcgggatgttggcggcgggcggtggcggcgcggggtcgggtttgtattacgcgttgtacgaggatggttacgaggcgtagttggagtcgtcgtcgtcgtcgtatttgggcgtttacggatacgtatacggatatgtatacgcgggcggtttgtacgcggcggcggcgtatttgtattcgggcgcgggcggcggcggtttatcggtgggcgagtattcggacgaggatgcgtttagttcggacgatttggagtagttcgttaagtagtttaagtagcggcgtattaagttgggttttacgtaggtcgacgtggggttggcgttgggtacgttttacggtaacgtgttttcgtagattattatttgtcgtttcgaggttttgtagttgagttttaagaatatgtgtaagtttaagtcgttgtttaataagtggttggaggagatcgattcgtttagcggtagttttattaatttggataagatcgcggcgtagggtcgtaagcgtaagaagcgtacgtttatcgaggtgggggttaaaggcgcgttcgagagttatttttttaagtgttttaagttttcggcgtacgagattatcggtttggtagatagtttgtagttggagaaggaggtggtgcgcgtttggttttgtaatcggcggtagaaggagaagcgtatgatttttgcggtcggcgcgggttattcgtttatggacgatgtatacgcgtttggggagttagggtttggcgggggcggcgtatcgttatttttcgcgtttttatcgttttcgtcggcggcgttgtattattattattattatatattgttcggtttagtgtagtgatttcgcgggtcgggttttcgtcggcgcgttgtagggcgcgggcgcgtagttcgttcgcgcggtttggattttttttgttcggttgttttggattttataaaaaaaaaaaaaagtttagaaattttcgaataaaattaaatattcggacgatttttttcggtgagcggcgaagatagttcggtaggttgcgtcgttcgagtttcgggagagaggagcgaagattcggaattcgttaatttatttcgggtattttgttcgtcgtttgttttttgtttttattttttcgacgattttcgtttttgttttttcgggttgttcggggtcggatttcggtagcggtttttttaaagcgataggtaacgtagtgcggggttagggatttttcgggagagaggacgaagcgaggagagttttttatttttttttttcgcgtggatttttgagtttgcgggtttagggtggggggttgttattttattcgttatacgtttttttttttttataaggatgcgttttatttcgttttttttttttttcgggtttggttttttacggtttttatttattcgtggagtttttcggtttttggggtttttttaatttcgttcgcgtttttaatttaaatcgtagtatattgtatttatcggggtttcggaggggaggtcgcgagagtcgcgtttgtgtataaaagtaggaaatagttaaagttttaatttagtttaatttatttttttttttatatttttttattttattttttttttaaaaaaaagtaaaaaaaaaaaaaaaaaattaataaaaaaaattcgagtgtttatttttcgtttcgttttattcgagtttcggtttggttttcggttacgtcggaggggtttgcgtttttatatatttagacgggaaggggtttttgttttgttgtagatcgatcgtcgtatagcgcggtttttgtttttcgcgg

SEQ ID NO: 7321 - DNA, 1513 bp, Artificial Sequence
  Description of Artificial Sequence: Synthetic polynucleotide
cgtaagaacggtttagcgaattttgtgtaggggaggcgtcgaggattggagaggttttgttaagggtttcgttgggcggaaggcgcgcgtttttttttatgggaaagatagatgtggggttaatgaaagggaggtcgagaggcgcggggacggtcggggagacgggggcgtggcggggagaggaaagttttcggagaaagtcgatcggattatcgtaagcgaggtatgtagcggagttcggaggaggaaggcgtcggggattggggtagggttagggcgggacgggggtggggggtgtggggggtattataggtagttggattcgagggttttgagttgaaatttaatattcgtttttggaaggatcgtttttttttttttttcgttttttttttttttttttttttttttttttttttttttttttaatttttaggacggagttttgcgcgggagaggagagggtttgaggggaggagaaaggaatagtattgagaggggttaggagtttaggaaggggagggaagggtagtcgcgggttaggggtgagtttgcgggttacgcgcgattttcggagttttcgtagtttttttagtgtttttatttttagtttaggcgagtttataggattcgggtttttgtttttttttcgttttttttttgtttttttttttgttttgtggtttttttttttttttttagagatatttgggagttgtttttaagttttggggcgtttcgcggggttttgttaagggtgcgtgtgagagagggcggcggagtcggcgtcgggtgttaggggtcgagggtgggagcgggagttcgtggttttgcgttttggagtcgaggattggaagggggttgggttttttcgtcgtttgggcgtaggtcgcgcgtcgggaaggtagtttcgtttgttttaggggtgtttgcgtgttggttgttgttgttcggggcgaggcgtcgtagcggcgattttagattttcgggcgcgttgagtgagtgcgcgcgtgaaaatcgtcgtatcgtcgggggtgcgagtgtttgggtcgaagcggttattttagcgatttagttttacggttacgttttcgggggtttttggttttaggtaatttggggtaagcgttttagttttcgtttttttttttttttagcggggtcgtcgtagattttagttttgggagtatcgttttgtagcgcggtcggcgggtggagacggttggtttttaaattcgttcgtttagtttaatcgtttcggcggttttttttagttttcgaggtttttttgagcggtttggagaggcgtcgagcgtagtttagcgttcgtttgtttattcgtttcggttcgggaagggaattttcggattttgcgagttcggggcgttttcgcggtttagggcgggtagttttcggggtttggtcgagtcggtggcgttcgggaggtcgcggggatagtacgtagcgcgcgtttttggatgtcgtttcgtagcgacgtttcggttcgtttcgt

SEQ ID NO: 7322 - DNA, 3541 bp, Artificial Sequence; identical to SEQ ID NO: 7320
  Description of Artificial Sequence: Synthetic polynucleotide

SEQ ID NO: 7323 - DNA, 558 bp, Artificial Sequence
  Description of Artificial Sequence: Synthetic polynucleotide
cgtgtttggttttcggaaagtgcggacgagacggtgtgggtgggttaggagttatttgtaagggtgtttgtaaatcgtgaagtttagaggagaacgggagaaggatggaatcgagcggagaggggaggtgtatggtaagaatttcgttcgtttcgggttgaaggggagttgtgggtcggcggttaacgtttgaaggagaggggtttcgggtggcgggaggcggttggggattcgcgtaggttagcgtgtcggttttttttagtttatcgttgtcgtcgtcggggttgttttaagggagttaagcggagtgggagcgggtttgcgcgtttttgttttgcgcgtaggggcgggggggtttaggacggggcgtttttttttatttatatgttgatttaggatttttaagcggttcggtttaggatatcgtttggaaatttagtcgcgtgggagagggcgattttatttttaatttttttgttgtgcgtcggtttagtttttagaagttagcggacggcggaggaggtggttcggttttttttggtggttttgcgttttcgg

SEQ ID NO: 7324 - DNA, 7244 bp, Artificial Sequence
  Description of Artificial Sequence: Synthetic polynucleotide
cgtatttgttgggtcgtttcgggttttcgagttttcgtggttatatttttggtttttgcgggattttcggttcggagtggggaaattttacggtgatttggttttaagcgagaaggatatttgggttatcgtttttttaaaagttaggtagatttgtatagtttatttcgttttcggtttaatagaatttttcgaaaattttgtttaaaggagttttgggagtaggcgtttggcggtttttgcgcggaattcggcggttgtcggcgtttttttttcgattttatggtttatttatttaggtgtagtcggggttagatatatttggtttcggaatttttaggtgttggaaggtggggtttgggttttgcgtttttagaggatatattatttttgaagtatttttttatttttattttacgcgggagattttcgcgggggttgatattttttttttttttaaatttatttatagattttagtaagtggtattttttgggagcgagtaattagttttttatcgttattatagattttgttcgtgtcggagcgttttcgcgtcggggtttggtgaattttttggaagtttttcgttcggttttttagcgaattatttttatttatttttttttttagttttagtttttcggtgggtattttttagggttttttcggggcgttaggttttgcggttttcgggtgggggttcgttagtcgtatcgttttttttttatttttatttttgggtttagaagttgatagattgataagacgcggtttagtagtcgtgttaggcggaatgggttgcgttttgaggtcgcgacgattcgggtcgagtttgcgcgtttagattttcgtcggtttggaggttcgaaagagtaacgtagagacgtacggttaagagtggagggagaacgataggaacgtttattttttttattatttaaacgaattttttttattttgaaggagagagagaaaagtagagaataaaaacgagagtgatagaatattagaaattagagggaaaaatagaattagagggaaaaatagaattttagaaattagaggggaaaagatatagagataaaattagagttatagaaatcgagggcgattcgttcgagggtcgcggtattaattttagatgtttgaaaggtaatagttttttaaaaaggaaataaaatttgaaatttgttattttttttgtagaacgagttgttttttagggtcgtgatattaagataagacgagaataaggcgaaagttaaaattgaaaattgttcgagggggttttttagtagtgattttgttttttgtcgggaaggtcggatagatcgatgcgcgttttgagtttaagagaatttgcggagatatagaggttattttttattttcgtttagaaaagaaaaaaaaaggggggggggttatttgtttatttgtaataacgataaaaagaattttattattacggaaaagaaatcgagatgttgaaaagtgaggaaaagagagtttaaaaggggttgagggacgcgaaaagaggggcggggagaggaaaggtttagggcgcgagggacgtggcgggtatcgataggaagtgtaattttattttttttcgttgagtttttttttaaatacgaaaatttttataaattatatttattttttaggatgattatcgtattaggatttttaaaataaagtaattgagttttaaggagataggaggaaaaaattaaagtagtttttaattattttaaattcgtcggatttgggagcgcgtcgaaatatagtaggaagaaggtaggaaaaatcgttttggtatttatgttttgaatatttttttttttttattttcgtatttttgtttcgtttttatttcgatcgtagtaattgaattgttatttgttttttatttcgttttagggttttagagttatttgggaagttcggttttgttaagcgttttaggttagtaagagcggtgtagtcgagtcggcgttttagaagtcgagaggttatataagtttacgtagagaggcgtatcggatacggtaattaggagtaatttatacgttttcgggcgtacggaaattatttgttaggaaatttttaacgttttttttcgtttatttttttttattttttttttggcgcgttttttttttttttagaggtacgtagtggagtttttggagtttcgaatttttcggatattgtagaatgcggggtttttcgggcgcgggttcggttaattagagcgtcgtttgttttttttggttaatggtaggcgttatattgttgtttaattttgtttaatggagttttaaggattaataatagagcgggcgagcggtttattgagagtttggtagcgtcgggtaattgggtttcggttgcgcgtagcgttcggcgcgtatcgcgaggggattcggtacggcgagagttaggtcgcgggttttaattacgcggttcgtagacgagttttcgattcggatttttgaagggagggttggattgcgttgcgttttgaggggttcggaagttcggatatggtgattgaaggagggtgacgtggttagataaggggtcgggggtaaagggaagcggttaagagttttagcgtcgttagtggagtcgggaggcgcgtgtagcgttagcggaggaggaggatttcggagtttaaggtaggtagttgagggtcgtagggagagtagtgggtggagatttggtttgcggtttttgttgaggaggtttgggtttcgtgggttttagggacgttcgaagggtttgggagaggaggtaacgtttatagagaggaggtttgggattttcggacggagatataaggattttgtcgcgggttttggtagggacggggaacgcgggaagtagaggagatcgcggtagaagcggggagttgggtttgtttgggttttatggggttgcggcgtgggagggattttggtgttcgtttatggttagttgcgaaggcgatttttttggtttggtgcggtttgttgggttattcgtgttttaggattttaattttgagattagaacgtaggagtttgcgttcgagaggggttttttgggattttaagacggggagggcgtgtttgacgattttgtttttaaattcggaggggaggggagggtagtgtgaggtggttttcgagaaagatttttttttcgaaatgtttaatttttcgtaggatacgtttttcgtttcgattattattttagattgcgaagttaaaaaattgtattataggttttatttaatttttttttttagtatttgtttgtggggtttttttttatatattttttttttttaggcgcggtttttggatttcggatatttagattagttgttttttattgttttttttgtttatgaagtttatttttgggttgggtttgtttatatagaaagtttttttggtcgaatttttttttttaatattttttagttttaagttaaattttatatatattttgttttttattttttggaggtttttatcgtggaatttttggcgtttatatttttacgggttttagagttattgggtttaattttgtttaagttgttttttcgtttttattttgttttttaaagttattttttttgttgttgatttttttttttaaagtttttgttttaaattgtattaaaaataaataaataaaaagaaataaaatttcggtttaatcggtttttatatttgcgtttttatattttttttttttttatttttttattaaattgatcgttttgtttcgggtttttttgttttgtttttggtattagtttaatttttgggttaaaattgtcgttttaattttagtttcgttaaacgagtattttttttattcgttttattttaattaggttaagttttggggtattattttaatttttttaaatttttattatagttatttgaattagtgatttttatattttatatgtttttttattttttttagcggaattattaatttagataaaattttatttttagcgtgtatattaggtttaagagtagttatggttagattggggtgaaggtgttagggtttataaggaggtttcgattgtatttttttttagtaattttggtttttttagtttagttttcgcggtttaaatttttttttttagtttgggttttttaaggcggcgttttggtttagcgcgcggtgtgttttttattaggtttttttttttttttattttttttttcgttaggttttgttatggagttgcgttcggagttgtttagcgtgttcggtgcggcgacggcggcggcggtaatagcgacggggtcgtttgtggcgtcggtggcgtcggtggcggtagtcgcggcggtcgttgtatcgttatcggtgagcgtggtaggcggtttgttgcgggggtcgttattgttgttgcgggtagtcgagaagtattcgcggatttttaagtgcgcgcgttgtcgtaattatggcgtggtgtcggtttttaagggttataaacgttattgtcgttggaaggattgtttgtgcgttaagtgtacgtttatcgcggagcgttagcgtgttatggcggcgtaggtggcgttgcgtaggtagtaggcgtaggaggagaacgaggcgcgcgagttgtagttgttttacggtattgtcgaggggttggcgttggtcgtcgttaacggtattattttttcgaggttcgtttacgaggttttcggtttagtgtgcgtcgtcgacggcgggggatttggagcgggagcgttcgcggggatcggaggcggagtagttggcgtagggggtttaggtgagagcgcggttaggtcgtaggtaggggtagtaggatcgtagttttggggtacggggtttaggggtttgtttcggtttagaaagagtagaattttcgtgtttagtcgtcgcgattgttagggtttatcgttcgtttagtttcgggtatggagcgtgggtatagaaatttttttttttttcgtttttggagtatttgtattttattttttttttttgtatcgggtcgaaatgtatacgttttaatttttttattcgtttttatttaaacgtaggtaggtttttgtttttttgtttcgttttttttttaggtggaaatttgcgtattttcgttcgttttgcgtttttttataggttttttttttttgtttttttttaatttttttaaggaatttttttttttttaattgatattttaggttttgagacgttttaggttttgagacgttttagttttttttttttttttcgcgtttttaacgttttttggataatcgtttgttgcgttttttttttttttagtttttttcgtattttttttggttttttaggtttgtttttttatgttttttttttttcgttttttattgtttgtttagtattattttttttttttggattttcgtggttttttgtggggagggaagaaattaggttagagtcgttgagggaaaggagggattcgttttaaatttgggagggaagaattttttaggttttaattttggaaagggtggattagaaataggggttgtatttttgtttgtagagaagtttgggattttttagataattaaggcgtttttttttataggttgtattgttagggtaggtattttttatatagtgggtttttttgtatagcgtggttaggtagaagttatgttgttttttgtttgaattttggatttggttatttttttacggtagggtaggattggaagggtagttaagggtggaggtgttggggtatagacgtggggaaagtagtattgaatatcgagtttatagggtataggtagttggggttttgaggagtatagaaagagagggagttttggggttagggttgtaggggtttagagcggaaggaatgttagagtaaaaagaaagaggggtattggagtttagtgaataagggttgtggggttgagggagaggaaattgagatttaaagggtcgaggtgttgtgattgttgttttttagttaatcgttttttacgatacgttttttttttttttagaggttaagttgtagaagtttgatttgttttttaagacgttgttgtaggtaggtcgttcgggtagttcgttgtcgtcgtcggtgaagtttttattattcgacggcgtagattcggggttcgggacgtcgtttttagaggtgcggttcggtttaggttcggagaacggcgatggcgagtttttttttggttcgtttttagttcgggtttttaaagaggtaggtggtagttgtttaggtagcgttggttttggcggcggcggcgaggaggatagttcgggtttcgttagttttttgggttttgaattcggtttagaggttgataaagaagagggtgaggtcgcgtcggcgttagggttgggcggaggttcgggtttacggtagcggacgtcgttggatattttgatacgcgtgtttttaggttatcggcgaggcgttttggagttggtgttgtagggttgcggcggcgacgtggtgtaggttatcgagtaggtgttgaattattatcgtgggggtttggcggtcggtttgggttttgcggcgtttttagataaggtcgtcgtgggtgttgtagtagttgtagacgacgcgtggtttagtcgcgtcgacgtcgtcgtcgtcgtcgtcgtcgtcgtcggggggtttgggttgtttgcgtcgttgtaggcggggttcgtcgtattttcgtattatagatttttgttggtcggcgttatggcgtttggggcgttgggttcgttgagtagtcgttcggttttttcgtcgttgtagtttaacgttagttatttcggtgtcgacgcgggcgtttattcgttgggcgcgtcgttcggttttagttttttgcgtttggtttatttcgcggcggcggcgtatagtcgcggtttggtttttatggcgttttattttattgtcggtttggtgtttacgttcggttttcgtttatttatggattacgtttttagcgattttatgcgtgatcgttcggtcgtcgttgttgcggcggtgtataaggagtcgatttacggcggcggtttgtacgggtttatggttaacggcgtttcggagaagtagtagggcgaggggtttggtagtcggtcggtttttaaataggaattttagttttgttttcgcgggttatcgattttttttcgtttagcgttttttttgcgttttggttgggcgt

SEQ ID NO: 7325 - DNA, 824 bp, Artificial Sequence
  Description of Artificial Sequence: Synthetic polynucleotide
cggagtcgttaggagtgagtatttttttttcgggatatttagtttcgcggcgtttttcgcgcgttttggttttatacggatttgttagttttagggaataaaagcggagttcgttcgttttttattgtagtcggaggatgagtcgagagggttgagcggagagtgtggttttcggcggttggaggtaggagaatatgttgcgttcgttcgtcgcggcgtgagaggttcgaggtgggcgcgtcggggtaggggcggtcgcgggcgtttgttcgtttagtgggcgttgttcggatttggcgaggtggtggtttgtaatattgtgttcgtattgtttattgtgggtcgggcgtcgagttttcgcggtcgcgagggagttttttgggtgggaattggaggtagtgggggaaaagtttggagttagaagttaggtagcggttgtcgcggcggttgtggagggttgtttgcggtatttggcggcgcgcgttttatcgcgaagagcgggaaggcggcggttgtagtgtgcgtaaagttttgggtggcgcgtaaaggcgtaggcgagggtcgtcgtatagagtcgtttaagttgtggtcggagcgttagggcgatttttgggaattttttaagcggaatttttcgagataagcggtttttgttttttgatattttagtcgaggtcgagttgacgcgtagttatttaattttttttgtttcggggaaataattttattcgcgtcgacgattggattttggttggttgggtagcgtcgagattttcggggggtttagttttgtggttttgagtattttttcgtttagttcgcgt

SEQ ID NO: 7326 - DNA, 824 bp, Artificial Sequence; identical to SEQ ID NO: 7325
  Description of Artificial Sequence: Synthetic polynucleotide

SEQ ID NO: 7327 - DNA, 1415 bp, Artificial Sequence
  Description of Artificial Sequence: Synthetic polynucleotide
cgtttaaaatgatttcgggcgttttatttaaagagacgttttggtttaggtagttcgttggggtcgaaggttttattttttttcgatttatcgggtttcgcggcggaagttttcgtttaggtaggggatgttttaggagggaaggaggcgacggtgtttaaggacgtcggaagtcggggattttcgtttttttcgggtttcggttaggttattagtgttggttcgcggcgcgggtgtttagttgcgtttgggatattgcgggtacggttgtggcggtaacggtagcggtcgtcgcgtcgtcgacgttcggtaggattgagcgtacggagcggcggaatttttcgtttttttacgtgtagagtagcggattgagcgcggatagggcgtagtataggagttagttggtcgtttgtattttttagggtatcggtagcgagaagtcgttggttaggtttatttatattagtggttgcgtggttagtaggaagacgtagtagagtagtagtatcgataggtcgttgagacgtcgttgtgttcgtcgcgggtgtagcgcgggcggtaggggttgggtttgcgtcgggtgcgcggcgttatcggggttcggcgcgtgttgggcgttcgggaaggcggcggcggcggcggcgtagtcgggtaattggtgtagtaggtggaagttgagtacgttgattcgtttgacgttgatacgtacgcggcgtacgatgtttaggtagtagtgtagtagtagagttgtttgcgttagtagcgtcgcggcggttagtagcgtcgggtagtggattcgcggtggcgcggcgtcgggtcgcggtgtttagggcgggagtagtagtacgaggtttagggcgagcgtttaggatagcgttagtatgttcgtcgtgtggcgtttttggtatagcgtttggtaggtggcgggcgttcgggtgatgagtaggtagcggtttagggttacgaggtagtgggagaggagggatatcgtgagttcgaggtttagtagtttatttcgtagtaggcggtagttgtttttagcgtcgttttagtttgcggggggtttcgtagagtcggtgggtaggagttcgagtatcgttttttgcggtatttagagggcgtagacgttgaggtcggcggcgtagtcgtttacgatgaaggcgttgttggtggtttgtagttttcggaaggacgatacgagatagatgattatgtcgttggttagcgtgttttcgatggttaggttcgaatataggagtgatatcgggatgcgtcggttcgtttacgatttttttttttcgtagagtagtagtagcgagttatcggtggtggaggaggtggatgtggaggaggagttggttattttggttaattttttatatttttttcgttagcgtcggtttttggtagcgcgg

SEQ ID NO: 7328 - DNA, 1415 bp, Artificial Sequence; identical to SEQ ID NO: 7327
  Description of Artificial Sequence: Synthetic polynucleotide

SEQ ID NO: 7329 - DNA, 3039 bp, Artificial Sequence
  Description of Artificial Sequence: Synthetic polynucleotide
cgggcgtttataggcggcgcgggtagcgcgagtttcggagtttcggaggtttgtgcgttttgagtcggtatggatttcgagtattgcgcgttttttcgcgtggggtttgtattcggtttttatgtggtttcgggggacgagttttcgggttcgtagggaattttcgtcgttgcgttttatttgtatttcgcgtcgtttcgcggttcgcggttgattcgtttttcggtttgcgggtttttggagttttattttttagagtcggttaagtcgttcgttaagtatttgtaggatttcgggttcggttcggtttttaacggcggttatttttacgagggtttcgcggaaggtaacgcgcggcgcggggcgtagcgcgtagttcgatttttttttttttttttttattcgggtttattcgggtttttttgtttatttttttcgttcgtttattttttaattttttgtttttttcgtttttcgttacggtttttacggaagtcgggttggcgttggttcgggttaggtaaaggttagtgtggggcgggagggtgaattatcgtttttcggcggcgggaatggaaggcgggaggtcgagggaaggtgtagtggcgacggttcggagtttagtcggggttcgaaagtagttggatttgggaaggagagagtatgttttgtcgaagttggattggaattgttatttattttgaagtttagattcggtcgagggttgtggagttatattgagatttgacgaagaagcgcggtttttgtgtttggcgttttttgagggttttgaggttgggttttaatttagagtggttaaatcggggtcggttggggattgcggtttggttttggttcgtttttttttttcgggtttagtttttataggaagggtgttgtttgtgcggtagattggtatagtttggtcgcgattggtcgtgtaatgttagggttgtttttaagacggaataattgtatttttattttttatattaagttggtttttttgtcgttatgtattatgatagtcgtttttttggtagttttggttttttcgcgttggattattatcgttgggtagttaggagtagttttgggtagtttaattttttggcgtcgcgggtttacgggtcggtgttttgtgttaaggtcggttggatcgcgtcggtattcgagaatgcgtttgaaggtaggggtttggtaggttgatcggtagttttgcggtcgttcgtcgtattttatgatttgtaaggcgtttcggttttcgtattgtatttattttatttgcgttgttatatttcgtagtttaggtttagaattggattttttaagattcgttttaattttttgtcgtcgttcggttggcgtttcgcgggtttttacggagtggtcgggtattttcggttttcgtttagtcggggcggtgggaatgtgtaggggagggcggggaggtgtgtgtgggttaacggaggaaatgaacgagttcgcggagtttcgtgtttgtgttttttgaaagaggtttttttgataaaaattatagttgggatttaatgagaagtagttggtttggtttttttgattttagttagacggtagaggtcgcgtagtgcggtgagtatcgttagagataggtattcggtttggtttagcgtttcgcgtcgggtaggagttatttttttaggttcgcgtttttgttaggcgcgtcgtattcggtatcgatagttcgggttttcggattatatcggtgtcgcgcgaattgtagagagcgttggtgcggaacgagcggtcgggagaaatttagtatttcgggattcgacggtaagggtggttttgataacgaaatatcgagaaagaaaattaaagaaagcgagcgataattaagaaaaggggaagggaaattgaataaaataacggagagcgcggcgagaacgagagggtaaatggtagtcggcgagttgggatgaattaaaatgaataaatgaggaacgaacgaataaaaaaagtaggagtaagatcgaacgaaacggataattagagaagggggaaaggataaagagggagggagtagattaaataaaagaaaacggagtatgtttaaagcgtagaatatattaaaatgagaataagggggtaagaaaattaacgattttagttgaacggaggataggttaaacgaaagggaggtaggcgggtgcgagtagagtttggtagagattttggcggtcgttagtttttggcgtttttgtcggtgtttaacgggttgttagcgtttttgcggtagagcggatttcggcgtagcgcggcgcgcggtggagtttggttgtttgaggatagttagtttttagggtcgtatagtttatttggtgggaagtggcgggcgaagagggaattcgttttatttttcggtttttaaaataatcggttcggagcgtttttagtttatacgagtgagcgcgtagttgcgttttatttgcggcgcgattttttacgaggttgggtagttgcgcgttttagagtttggcgtatttcgtttttttttcgtttgtagttcgtcgttcgcgtagttttaggtcgttttttgttgagagcgtttagttttgttttgaatttaggttgcgtgttggcgttgttagttattttcgcgtcgttcgcgtttggttagtttgtttcgagtttggttttgacgtcgaaatacgttttcggtaagagatttttattagagttttgttcgttgtcgttgaggttttgagtcggatgattcggtcgatcgttaaagtcgaggagagttttaagtttttagattcgggttgaggtttttgggttaacgttgagaatttttaagaagggtatcgaggttttatcggggttttgtttacggcgtttatgtttattttggttttgagttttcggcgggagttgtaggagtttgggttttagcgagttttgtaggtcgtttagtgattttatagtggtcggaggaaatagtgcggcgcgggataaggttgtagcgaaatgtgaaagttaaggttggtttcgcgg

SEQ ID NO: 7330 - DNA, 1277 bp, Artificial Sequence
  Description of Artificial Sequence: Synthetic polynucleotide
cgcgtttttggggagcggtttatttatagtattgcgagtatttagtatcgttttagagtacggcgtatataggtataaatgtagtagaggtttttcgattcgttaggacggcgttttttttagatgggtattatacgtacgttttttgttttagttatttcgttttttagatgcgttttttacgagggaggaagggttttttgttagtttcgaatttagcgaggattagttttaggattgagaattaaatatttatttcgggcgtgatagttttgtttcgtttgttaatgttattgttaaggttataggtttgaggtcgagcggttggggttggggtttttagttgcgtaagaggtttttagtggaattgcgttttgggcgcgtagttttaagtcgcggatgggtcggataggtttttttcggtttttcgcgggcgtttgttttcgtagttaagtttaatttttttcggagtttttgggtttttttgagtattagaagttgaagttcggtgtttaattcgtgcgtacgtcgttggggatttcgatgcgcgaaggagagcgggtttcggggtttcgtcgttaggtaacggcggttggagcggcgagaggagttcgggacgagcgtagggtcgggcggatgcgggggtagcgtcgttttatattttggtttttagttttttttggttggggcggggttagaatagggaaagttgtagtggtcggttcggtaaagttaggcggggcgcggttagcgatttatttgttacgcgtgggtagtcgcgtagattcggttcgtgtatttcggtcgagtagttgcgattttcgacgggtcgcggacgtatagtttttttttcgggttataggttttcggttggggttggggcgattcggagttgcgcgtcggcgtacgcgatttcgttcgttttttattttttgttttattattagttttaatttggttttcgttcgtcgcgcgttcggggtttaggggagcggcgcggggatttaggttttacggcggagagagcgcgcgggattgcgaagattggggtcgagtgtcgttttttttgcgttttggtagcgtcggttttgcggagtagaacggagttgggcggagcgttgcgcgtattgttttttcgtttttcgaaaggttattttggcggcggggcgtcgtgacgtaggtttgatttacgcgcgggtcggcgttaatgcgaggttttcgggtagcgagcgaggttttgatggtcgacgtaggcggagagggtgggcgtggggcgg

SEQ ID NO: 7331 - DNA, 2394 bp, Artificial Sequence
  Description of Artificial Sequence: Synthetic polynucleotide
cgttgtaaatgcgttaatatttcggttgttagcgtatggcgagcgttttttacgtttattcgtaggagcggcgtttcggtcgttttttcgtttttagtttgttttgttttcgtttttttttttttttcggttatggttatttttggacgtttgagttttatcgtgcgtagttttttagatttattcgagtaggacgcgtaatatttgtcgaggcgggagttagaattacgcgttttttagttcgatttttgcgtcgtttggttggattcggagcgcggttattatttttgtaagtgcgtggtggattgcggtgcggggtgggaggtaggaggcgtggggtagtagaattaagggtttagtttacgaggggtcggaaagtcgaaattttagtttagagtttagatttttttagttttggaaacgggagttttgttttcgaatttttaacgtatttatttcggtcggtatattttaagagtagatttttgtttggtattggtgtttcgagatttggggtttttgtgtttgacgatttttagaggtcggaataattgaaatttaaaacgcgtcgttatttgtcgtttttattttatttttcgttttttttttatgtttgaaaatacggttacgatttttaggttttcgtttgggatggttagtgttggcgagtttatttttatttcgtttttatttagggtttcgtaaatttcggtatattgtagtgtagtcgatttggaggaggtcggcgttggtgatttagtttgtgataaattggtcggttagcgtaattatcggtgcggatatgttaagagggtttcggggtgggttttttcggggtacgattttaggttcgttgatgatcgttgtggtatgaatgaggttatcgtattcggagaggtggatgtttagatgtggatttaggaaatggttttatttcgaaagtttcgggttagtgggcgtgttttttggttagtgtttttacgttcgcgttagaagggtagtaggttttcgtagggttcggcgttttatttattcgtgttttttttgttgtttttagtttcggacgagagtagtttggagattagttcgttagattcgtcgtagcggtcgttcgttaggttcgcgttttcgggttcggacgtcgagaaaaggaagaagcggcgggtgttattttttaaggcgtagacgttggagttggagcggcgttttcggtagtagcggtatttgtttgcgttcgagcgcgagtagttggcgagtttgtttcgttttacgtttacgtaggttaagatttggttttagaattatcgttataagttgaagcgcgttcgcgttttaggggcggcggagtcgtttgatttggtagtattcgtcgagttgtacgtcgcgttcggtttgttgcgtcgcgtggtggtgtcggtgtttgttcgcgacgggtagtcgtgcggcggcggcggcggtggcgaggtgggaatcgtcgcggtttaggagaagtgcggcgtttttttagtcgtcgtttgttttttgtcgggttattttgttttcggtttcggttcggcgtttggtttttttttcgtttattagtatttagtatttttcgttttggttttttggaattggtgaggtcgtagggcggtatttggggttattttcgattttggagcgcgttttgcgattggagtagggtcggagtcgaacgtttggaacgtttttcgttcgtttttttgtagttttatttttttgggcgttagggtttttggcgcgtttttattagtcgtcgcgtaagtatatacgagggacgtgtgttagagtttttttttttattttttttttatcgttagttttagagttagattttatgtttgggttttatttgtatatttttaaatagcgatttgtataggaagtaagttatttttttaaaaaatagagtattttttttcgtagttcgagaataaaatgtgtggggttgggttttttgcgcgtttgcggggaacgtaggcgggagtcgtgttttttagatcggtgttcgtatcgttggttcgttttttgattggttaagtggggttcggttttagttggatcgaagggcgggttgtagtttcgatacggttttaggaagatatttgggggatggaggggtggtgatgttagggttgggcgcgggaagaaaaggagaggaggaagttgaggtaattttgggatttttgttagcgggaggcgttattggttttagagtgatttcgatttttcgttgggtttttagagttgttggcgtttcgaatatcgaaaagttaattttgtggattacgatagggtagaaggagttttttcggagatgagtcggcgaggttaggtgcggggcgcgttgtatcggagtagtttaggtcgggtcgt

SEQ ID NO: 7332 - DNA, 1627 bp, Artificial Sequence
  Description of Artificial Sequence: Synthetic polynucleotide
cgtttcgggtttggagggaggggaggtttttcggaaaggggtggcgagagattttcgttacgatttttaagttttttcgcgcgcgttggaggggatacggtgggcgtttaattttcggcgtagtagtaggttttataggttgtttgttggggtttggggaagtcgaaattgcgtatttcgggattcgggagtttttcgtagcgcggtttcggcgtggtgattgggaagcgtatattgtcgttagttagttagtcgtcgtcgtattggtttagtttcgaaaatttttaggcggcgtagaggtgtttaattttggttattacggcgtcgcgtcgtcggtacgtcgcgtgggttttagatagcgttagtcgttcgggtacgaagaatatttggtttggggattatagcgggttatcgatcgagggtagggtgggcggagaggggcggttgatatttaggaggcggagttggggtgcgggatcgtagaggtgttggatcgagtttgggtaagaggagttgggggatcgaggtaaaagtgtagggagggtttggagaggtgagttggagtttgggcgggcgggcgggttgatgggggggcggtgttttggagggattcggagattttgttttgattttaagttgaggtttatttttcgttttttatattttttagatttttttttaagattttgttttcgtttcgcgttttattcgttagcgcggaggtgaagtagaaggcgtcgtagcggtcgcgtattcggtcgcggggttcgtagttgcggatttcgggtcggtttcggtcgtcgtacggggcgcgtgcggtgagtatagggtagcgtacggagttttcgagtagttagttcgcgttatattagtttagattttcggtttaagttggcgggagacggcggaggtcggggataagaggcgttataggtaggagttagattgagttcgtttggcgttttttttcgggtttttgagatagtttcgcggggtttgggaagtgttgggttcggtcgtttattttggtagagttgggagtaggtggttaggcgttcgttttgtttttcgtacgtttgtttcgtttcgtagtaattgaattggtatcggtttcggttgggttggtacggaaatattatatttagggggtggcggggattttggggagggttagcggatgggagcggagggggaggaagggcggcgcggtttgggagagggagttggggtttttaggggtgcggaggagatattgggaaggagttttgggagatttaggcgaggcggattcgttgttatataggaatggggcgggagcggaagggttttattttttaagtttaaggttagcgttacgttttcgttttcgatgtcgttgatgagttcgtagcggtatcggttttcgttttttaggcgtacgttcgcgatgattagggaggcgtttagtcgatgtttttttcgtattttggcgcgtttttttaggggtttatattttcgggcgtgtagttcgttggtgatgaggattagcgtttttcggagttttttaggttttattttgttttagcgtattttgtagttgggaggcgtggtgtttaggacgtagggtagcgtggtcgtggttttacga

SEQ ID NO: 7333 - DNA, 271 bp, Artificial Sequence
  Description of Artificial Sequence: Synthetic polynucleotide
cggttcgcggagttagcgtttttttcgcgtcgatttcgggtttcgggcggtcgtcggggggcgtcgggcgtatttttcgttgttaatttttcgttcgtgttttcgttcgcgtttgggtttcgtcgtattttagtagaagttattatagagaataaattatttttttgttttcgagatgggttttcggggaggaaggtaaattgtttgtttcgtgtataataagttaggcgtggagagtagcgcggaggaggtcgcggtagttatcgagcgg

SEQ ID NO: 7334 - DNA, 884 bp, Artificial Sequence
  Description of Artificial Sequence: Synthetic polynucleotide
cgtagtattttggcgaatttttttacgtttttggtgaagttgtttcgataaattcgaaatatatgttgtagcgttttttattgttggtcgttgaacgtgttttgggattaaggttttagagagcggacggtgttcgagtcgttgttttagttgtgcgtttgtagtttttttagttacgttaagtcgtcggtgcgcgtttagttgttattggcgaaggacgagatttggaggtagcggagggggaaaagtttttgcgggattgggagagaatgaagattggaggcgtgtagtaagtggtcgggagagtagttagtataaagagaaggaagaaagaaataagaggagatgagttttaggaggcggttgatgttagcgaattttgtgtcgcgttgttttttttcggagttagggagtagcgagttttttatttagatcgcgttagtgcgtttcgggttttattagtttttattaggcgttgtttttttcgtttttatttagtttttttttttcgttttttcgcgagtgtatttaagcgttttcgttttatttatttttagcgtttttttaagtttggaggagcgtttagagtagtagaaatagtaggtattttatatcgttcggcgtggggatttcgcggagcgtcgttgcgcgtcgttttttgatttgcgtatttttttttttcgtcgtttagtttacgttttttttcgttgggtgttagttaatttttaagtttagatttcggtagtttttttcgttgggtttgtcggcggtttgttgtttttgtcgaagggcgttttcgtttttagttgtgcgagttgtaaagaggtcggggttttaggaattttggcgtcgtcgtttattttagtaggttttataatcggcgt

SEQ ID NO: 7335 - DNA, 1007 bp, Artificial Sequence
  Description of Artificial Sequence: Synthetic polynucleotide
cgcgggtttggttttaatttagtacgcggaggtttttttttttttagttttagcgaaagggcggcgggtgggaattattcgttattttggtaatttttttttgtcgtttgtttataatagtttgaattatatttttgttaggtagttattagttcgattttttttttttttagttttcgtttttttttttagcgtttaggttgggggcggcgtcggtgttagtttagtttagggcgaagtttttagggtcggttcgggtcgggttgcgggattcgtcgtggagcgtaaagtgtttgaagttttcgcgcgtattcggttttgtttttaaaggttttttagaaatgtaagaggttaggcgtagaaatatatacggacggtagttttatgagaaaatgtagataaagagttcggcggtagggttatatgttttttataatttttaaagtcgttattttaattagagttttttttgagttttaatgtttaattttgagtaaataagtcgttttgaaagaagaattcggtttttaattaaaagtgtattaatattttttttttttttaattttcgcggagtaaagtttcgcgcgggcggaggcgaggttaggtcgcggcgaggtcgtttcgggttcgcgtcgtttcgcgtcgtcgcgcgtttttaggtgacgttaggcgggttcgggattagggtttattttgcgtttttcgcgtcgcgtcgtagagttaattaaaagtaatgttacggtaaatttaaaggtttttcgttggcggagtcgcgttttcgggttagtttgcgagagagggtttttcgaggtaggtgttggggatttatttgtgtgtgagtgtgagtgtgtgtgtgtgtgttcgcgcgagcgtacgtgtgagcgtttgtgttgaaagggagagttttttggattttttggagatcgagattgttttttttttttcgtttatgtttttagtttttttcgtatatgtattagtgaagaaacgtacggatatcgtcgt

SEQ ID NO: 7336 - DNA, 2191 bp, Artificial Sequence
  Description of Artificial Sequence: Synthetic polynucleotide
cgtcgcgttttgttcggttttatttattcggtggcgtttgggttcgttttagttttttatttttattttagggtattatttattagggtttcgtttcgttttagttttacgtgcggggttttatttcggcgttagcggttttttaaatatttttatttttatatattattttttttttattcggacggtagtcgaatagggataaaatttatggcgtatagttagtttttttcgcggagtacgttttgtgttgttttagtcgttggggttttttatttcgggttatagttttttggcgtttttcgggtcgaggtagtcgggtcgaggagtgtcggtgtggttcggttacggggcggggtcggcgggagtttcggtcgtcgtcgtcgtcgttgttgttttcgtttgttttttgggtcgttcgttcgttcgtcgttgggtgcgttgtacgcggggggtagtcgtggtgtagaggtttatgtagcggcggcggcggcggcggttgttgttgttgtcgtcgcggaggtagatagatcgggcgttgttatcgtcgttttttttcggttttatgtcgtcgtcgttgtcgttttttttttttcggcgaggggcggggggtttcggttcggggtgggtattatttttcgtagcgtcgtttttttttttgtttttcgttcgggcgttggagtcggcgagggtattcgtcgttttttaggagtgtatttttcgcgcgttttgtcggagcgagggggcgggcgtgggcggacgtcggggtagcggggatttcgcgcggttgtaagaggagggggtttttttaaggatgttcggcggtttttcgtttttaggtgcgagttgagtttgatcgggagcgagcggcgcgtcgttatgtcggcgtgacgggcgttttcggttgttcgcgcgggttttcgcgttgttttacgtcgcgtcgtgtcggtatcgggttgtaggatgggttgtatttaaagtattatttgtaaggcgcggattcggcgcgagaatatcgtggtgtacgatgtgtgcgttattatcgattagtgttttacgcgtatcgaggagatttcgtttatcgttttgcgttataagattttttattttaaagttttcgttcgcgtggttatgttttttatttttcgttacgagatttgggtggtgggttggatttaggcgtgtaattagatggagttttttaatatttatagcgatttgggtatgtaagcgattcgtcgcgcggtacgggagcggattttgggtttttagttttgtttgttattttgatttttttttttagtttttttttattgttgtttttatcgtttttttaaatttttttttcgtttttttttttattttttttttttttacgtttttgttttagtgatagggcgggtgtagggaggttttttgcgaaggtattttttcgtggtttgtttttgattttttagaaacgcgaggagaaaggtgcggggcgggaagaacgcgataaggagggttcgagaggcggaggtggggatggttggcgagtgtttggcgagttttagggcgtcgtttgtgttttgtggggtttttcgggaagagtttgggggaaattatagaggagtggagtggagtgtcgggggcgtatgggttgtgtcgcgcgttttttggagaaatcggagcgggtttggaagagtaggtttcgggtattcgagcgggagttggtagttttgtttttgttttcgcgattgttgaagtttcgaatttttgtttttcgggttagggagttcggaggcgttttcgtttggaattataagtcggatatagttgtttttttgttttcgcgttttttggattagttttggtggggagttggaaggtatcgagtgcgtttcggttaagaagggcggatagttttgtgcgagtagcgttcggttggcgcggcgcggggtgttttttatgttaaaggaaaggatggattttttgtttgtttagggtttttattttttaaaatttttttaattgcggtattggaagggatttttttggcgtttatcgtcgaattttatcggcgagttgggagttttttaatttttagtagcgtcggttggtgcgcgtcgggtttggttgttgcggtgaagattaaggatcgtcgcggttttttaatcgttaggggtcgtaggttacgggcggtcgcgttcgg

SEQ ID NO: 7337 - DNA, 859 bp, Artificial Sequence
  Description of Artificial Sequence: Synthetic polynucleotide
cggcgcgttacgtagggaggttgttcggggttggcgcgtatcgagggggtgggggtcgagttcggggcggatttttttttcgatttttcgattggaggatagggaggaaatggttttgtatcgtacgatgaaaggtaggtaggagggttattaggcggggggtggtaggggacggaggatgtttagagttggaggatttcgttcgttttacggatatcgttattttgttttttattttattttgttttttattttatcgtagcgtttggtttatttattttttggttttcgttgttcgtttacgttttaacggttcgtagcggggtcgttttattgtcgtatttttatttcgcgttttgcgcgtttatttgtttacgaagttttcgagtatcgagtttttgtcggcgttttggtcgtttattacggcgatttgcggtagttttagtaggtagttttgttttagcgtcgaaaacgcgttttgtagacggtttattagcgggattagtttttttatttttcggttttttattttgttcgaggggtcggcgattagttggtttttgttcgtttttacgatttgatagggagtaggggtcgcgttgttttggttgttgttgttgcgtcgggtttagttagttaggttttggcgtagacgtcggagttcgtcgttagttcgtcgtttggttttgatagttaacgattcgtagcgcgtttgcgcgggcgggtaggggcgtggtttattttcgcgacgtttcgttttcgtttcgcggttgtttcgtttcgggttttttatcggattattaggttaggcgcgtacgtattgtagtttagttgcggttagatgttacggtttttgcgt

SEQ ID NO: 7338 - DNA, 791 bp, Artificial Sequence
  Description of Artificial Sequence: Synthetic polynucleotide
cgcgcgattgtagttttggggggcgcgttcggaatcgaaatggtttaagagatttgaggatcggcgcgtttttttttttcggttttagtttttaattttcgttatagcgtagagggggtagtgcggtgggagggggggagttgtggggttggggtttcggtttggtcggtgaagttttaggattcgttcgtttggggttaaggtaaggggtgcggtacgaggagcgtagggagtttcgagttttaggcgtagatttagttgcggattcgtcgtatagttttggtgttgtaagcgtggatcgtgggcgtaaggtttcggcgggaggtattcggttcggtcgcggtcgggtttgtagggttttggcgtagcggatttcggcgcgttttggttcgcggttcgtagggtttagacggggtcgagatagttaagttcggttcgttcgcgttaggcgttggagttaaggttgacgggcggttttgaattatgtttggaggagcggcgcggtttttagggtttcgttgagacgcgttgtagggttgttcgggttttttttcggcgacgcggttagtagttcgcgtcgcgtttttagcggcggtaaaaattaggagtttcggggttttgtcgggcgtcggtattggagggtaagagatgttggtttttttcggggtttattatttcggggttttatagtatttacgtgggatggggatttcggagtagattacggacggaaaggaacggtggttttattttttgtaaaagaaattttcgcgcgtatacgggtgtttcgg

SEQ ID NO: 7339 - DNA, 586 bp, Artificial Sequence
  Description of Artificial Sequence: Synthetic polynucleotide
cgggttgcgcgtttcgagttgtacgggtaggtatttttttcggttttgttttataaggtggggagagcggggttggacgcgggagggggcgggggggggagcgtgagaagaaacgaaatcgcgggaaggaggggatatcggcgggttgggtagagggcgaggcggaggttaagttgggtttgggcgtcgtcgttttcgcgcgcgtttgttgtcgggttcgggttattcggagagcgcgggcgattcgggtttcgcgtttgttcgtcgtcgtcgtcgtcgtcgtcgtcgttacgcgtttagtttcgggttgttcgttggttcggtttcggtacggcgcggcgcgggggcggtgggtgtagttttagttgtcgtgcgtttcggcgtttttgtgcgcgagtttcgtttagttttttttcgtatgtttttgtgtgttttttttcgtaatgtttttcgtgtttcgcggggggtgtgtggtacggttcgggcgttcgtagttttgtagtttttcgttgtttttttttttcggttcgtttttgtcgttttttgtcggttcgttttttttttttcggaattttttttttttcgt

SEQ ID NO: 7340 - DNA, 1678 bp, Artificial Sequence
  Description of Artificial Sequence: Synthetic polynucleotide
cgggatcgacggcggcgtttttttttcgtttttcgtcggtaggagaggacggggcgggagaggaaggggttagttgtggttgtagtcgttatttttcggcgttcgggattcgggacgtttagtcgggttttgtagagggtgttttatttgggtattagcggtttttcgtttttagttagggtatcgaaggcgcgttcggcgggatgtagcgaattgttttttgtttcgggatagtggagcggtagaaggtttaatttttcggttcgtttacgttcgtaaggtggaaaaagtggggtgaaatcggggaaatttagcgaaattggggcgaaagaagagagattaaagcgtgttatttacgtgttagatggcgaagaagatgagcgtagcgtatagtattagagatagtatgtagtagaacgtagcgaaagtgaaggttatggtcggcggattttaattttattatatacgttaagaagtttttaggagttcgatgtttttttagaggatcgtattttttttaaggagtcgcgtttgtacgtttttttttaggttagtgtttaggagggcgtatagttagcgaagcgattcgagggttagcgaataagcgttggattttcgtaggtttcggcgattttagattcggtttttcggcgaagataggaaaacgtgtgtcgagagtcgttggagggaatcgttcgtaaatcgaagaagaaattaaattagtagcgaatatttgtaaattagtgttaagttgtgagtttttcgagattaatacgataagcgatgcgacgattttacggaggatcgagggaggaggttttattcgttttaggaagagttttttgtttttttttattaaatcgttgaggagagacgagcgtttcgtttcggattttttcgcgttatcggggcgtaaacggatagtgtttagcgaggtgttcgagcggttttcgagttttttttaaattttagagtcgggtagcgttttttttcgagagaaggagtttttaggtagtcgggaggaggtaggtttcgttggttttgcgttttagacgcggtttttagcgtagtcgtgcgtttcgaggcgcgttcgtttttaatcgtgatttcggttagtcggttttcgtaatttaagtgtttcggaaatcgggggtcggatcggggcgagtattggttttatttaacgggttaattttagttcgggtggttgtagtagtgggttttaggttaaacgttgtagttcgttttatttgttgttgtcgttgtcgtcgtcgtcgtcgtcgtttttgttattgcgagaattgtagcggtgcgattcgggatttttttttttcggcgttttattttcgatttttgtttcgttgagcgcgtttttttcggcgggcggagattgtagcgtcgggggttgaggaaaggtgggtggcgaagcgtcgtcgggcgtttggtggtcgttgtcgtcgttattgtagttgtgtacgttcgtttttcggaggaaatttgaagttagtagtataagtagggttggaggtcgagcggaggtggggcgggatcggttggagtagggattttttaaatacgtgcgtttggaggaggtgggaagttgcggaagggtatggtgtgtgtttcgcgtttaaacgtcgtagtcgtttttttcggtttttgtagtttcgtttatcgg

SEQ ID NO: 7341 - DNA, 1600 bp, Artificial Sequence
  Description of Artificial Sequence: Synthetic polynucleotide
cgagacggagttagtatttgattagcgattaatagtggatcggcgaggcgggtttttaattagagcgagatttttagaagttggatagtttttgtatttatgggagtatgcggcgtagttggtagtgatttttaggaaatttcggtagtagtcgtcgtcgcgggtgtggtgatttcgggttcgtcgtttatttggagcgtttcggcggcgtttggtttagaattatcggggcggatagttttttggagttgtacgcggattgcggaaggggatagtgagcgggatcggttcgtatttcgttcgcgggttcggatcgttggaagtattcgggtttttttttttttttgtttttcggtttcgttttttttttttcgcgttgcgcgtggcggtttcgggttgcgcgtttttgtaggaggagatcggtattgtcgtcggcggttttttttttaatcgttagtttcggtcgcgcgtttcgtttcgtttcgcggaggagggtgggggcgtttttcgcgtcgggttcgtttagttttttcgcggttgttcgggtcgggttttttattggtcggcgggcgggaggtgaggggcggtagggttcgtttttggcggttcgcgttcgggaaggtcggtagtcgagcgtcggaggtcgtggagagggcgggtagggaggcggcgggcgtcgaggagatgtagcggcggcggtggtggcggtggtggcggcggtggcggcggcggcgtttggtttcggtcgtagtttttgcgtttcgttcgttttgggtcgtttttgttagtttcgcgcgcggttcgtttttcgtcgcggttcgtagtttgcggcgttcgagtttcgagggcgttttttcgggcgttgggttcgaggcggttaagacggcgggtcggtcgggtacggggcggcgggcgttgtgttgcgggttgcgttggtggggggcggcgggtcgcggcgcgggtttagggttcggcgtgtgcggttgggaggtattgtgggggcgggcgcgcgggcggcggtcggggttatggtcgagggcggcgggggcgcgcggaggagggcgtcggcgttgttcgaggttgttcgcgcgcgttacgagagtttgtatatttcggacgacgtgttcggcgagttcggttcggatagcggcgggaattttttttatagtatttcggtcgtttcgcgttttttttcggtcgttttttcggacgacgagcgcgagttttcgggatttttaggggtcgtttcgttatcgtttcgcgtttcggacgtataggagtcggaggaggacgaggtcggcgcgggttggagcgtagcgttgcgggatcgttcgttttcgcgtttcgaggatatcggcggtaaggggttgttcgcgggtggatgtcgggggcggcgttggaatcgggcgcgggggaggcgtgggtgttggggcgggcgagtttagatttttcgtgggttggtttgtgggtgttttttcggaaataaatgaggttgtaggagcggtgatcggtttgattgtttttgggggtttcgaattcgtgggtggagagggtaaggcggaggtcgtggttagtatttttttagtgataatgtcgtcgg

SEQ ID NO: 7342 - DNA, 2394 bp, Artificial Sequence; identical to SEQ ID NO: 7331
  Description of Artificial Sequence: Synthetic polynucleotide

SEQ ID NO: 7343 - DNA, 1160 bp, Artificial Sequence
  Description of Artificial Sequence: Synthetic polynucleotide
cgtaggattcgtttttcgatggacgtgagttttatcggttcgttggtgagattttttacggagcgcgattattttagattttttttaatcgtttcgtttattattaagtatttgagttgtcggagttgggggttgatgtcggatagttttcgggggttgacgttcggtgatttttttatgttattgcggtcgtaggcgttacgggtaggtgggtgggtagggggagtatggatagagaggaggggattcgtgaggagtagattttagggcgagagtaagagcgcggtcggggtttttcgggggcgagcgtcgcggtagagttcgcgttttttttttttcgtcgttatttatttattttttcgggtagttgtttttagtgttttattttgggcgtttcggggtagtgcgggttggggcgagtggcgagggaaagaatgattgaaatttttcgagtagttttatcgcgcgcgtcgttttttttcgagttttagattgtttagtgttttagttgtaaagggttatttcggcgtttcggtttttcgttcgtcggttcgtttatttacgttcggggcgttatttatacggtaatgtttttgtttttgggtgcgtcgttgggaaattttcgaatttttataggtaaagatagagtgggatcggtagtttttagatttgaggcggaggggtcgcgggtcggagttttttgtagtcgttagtttgggaagattggagtgcgttgtttatcgagggtttgcgtcgcgtcggtcgtttcgggtcgttttgtgcgcgttcgcgcggtttgtattcgagcgttttcgcggcgtgcggtacgatgtaggcgcggcggtttagttcggtgattttaggtcggttcgcgcgttcgtcgtaacgattcggtagtcgaggtagcgtcgcgttttacgttcgttatcgtcgtcgtcgttttagtatatcgtaggcgtgagtttcgtcgcgatcgggagagtttttttagttgtgcgttttcgaggtatttggtcgggcggggaggcgtcgggtcggggcgtataggggttaggcgggggcgttgttgtttatttttcgtttttcgggcgtgcgtttcgtttcggagttcgtatttcgcgttcgcgtttcgtttggaagttttggggtatcggacgcgt

SEQ ID NO: 7344 - DNA, 588 bp, Artificial Sequence
  Description of Artificial Sequence: Synthetic polynucleotide
cgtaggcggcggcgttttgtattgcggagtcgcgttttgggggagtagtatttttagtttcggcgtttcgtagttagatagttttttttagggtggtagtatttttcggttagggtgtagggattttcggggcgaggcggtcgcgtattattttttattttggtaagggttaggatcggattgttgtaggcgttgagcggggttattcgggtcgagtgtttttttatgatgagtcggtcgtttgtaggagcgttgtcgtcgatcgtttatattttggggtcggttggagcgcgtttttttcgggttcgtggtcgacgcggttttttgtcgtcggggagtattagcggttcgttttttttagtttcggttttttcggttgttcgtcgggtttcggttgtcgcgttgtttattgcggcggtcgttttgtagcgtatatttttttcggtcgcgtagttattttatatatacgcgcgtatagttttttatttggaggttgttgtaaattttaacgttacgtataagtgtattttttgtttttatttcgtagtttatttgtttcgttttttttttcgggacgtttagtttcgt

SEQ ID NO: 7345 - DNA, 878 bp, Artificial Sequence
  Description of Artificial Sequence: Synthetic polynucleotide
cgggaggcgaaaacgaaatttatttttttgcgtttatttttgttagaggtttgtaggacgtgttttaatttggtatttcgagtttagaataaaagttacgggggttgcggtatgggtagggggaaggcgcgcggtggttgacgcggggtaggggttttggcgagcgcgggaggggcggttagtagtcgttcgcggggttggattgggagtttcgtgcgatttcgggtttggcgtttgggtcgggggtggttttcgggtttttttcgggggtcgtcgaggttcggtttcgatagttttgcggttgttgcgagcgtttttcgagttttcgtttcgcggtgttcgttttaggagcgggcgcggcgttgtgtttttttatttgcgcgtagagggtcgttcggtgaagttatggcggcgggttaggggtaaacgagcgttcgagcggggttggtaggttttcggggcgcgggaggatcgtgggattacggggatgaaaagttttgcggtttcgacgcgtttggagtaaatcgtggttttgcgcgtttttgttttttttcgtttttttttttttttttttttttttttttcgttttttttacgagtttattttttgttttggtaattagtaaagttttttcgttgcgcgtttttcggtatttttttttagaggcgcggggcgggagtcggggtgtcgcgattcggggttgggacgtaaggcggggtttcgagtgtttcgggcgtttttagcgtttagagcgcgcgttttgttcggtatttacgtttttttgggcgggttttagcggggggttgatacgattgtcgttcgggatagattgcgagcgaaggattggttttaagaaacggttgtagtcgcgggtcgt

SEQ ID NO: 7346 - DNA, 561 bp, Artificial Sequence
  Description of Artificial Sequence: Synthetic polynucleotide
cgagtgggcgcgaatttttatagtagcgttaagtagtaggattatagcgttagcgtttggtttcggaggaaagataagttggagtacgtaagggcgattcgttttcgggggtttcggttaggtatttgtcgtatgtatttttttcgtggtggtggtatgagcgcgcgcggggcgcggggggtaggcgaggggattttggtaggcgtcgacgttttaggtcggattcgggggtttttttgtttgtagttttttgttttaatgatcgggttgcggggaggggagggtaggtttttttttaggtttttggtttttgtcgattcgatttgtttatttgcgtttttcggtagggtttatttgtacggggttttggaggtgtttgtgtagagtgagtacgaaggggaagtgttattagcgtggtttcgagtaatttggcgttgtatggtagtgggttttagagcggcgtttgttcgcgtttttgggggttgttttatttagtttaaaaattagtaaattaacgaatgagtaaagttggcgtcgttagcgattagcgtggattcgcgt

SEQ ID NO: 7347 - DNA, 1235 bp, Artificial Sequence
  Description of Artificial Sequence: Synthetic polynucleotide
cgagttgagttgttcgcgaggttgcggtaggaggtttcgttttttcgggtagggttttttttggaggttttttcggttttttttagacgtattcgcgtcgcgtttttgtttttcgggagtagtttttttttagtcgtcggttttgggagttttatcgtttaaacgggagttgagtttgtaagcggttaggcggcggtgcggttggtgttgttgttgatgttagagttagaaagtagttgtgattggatttaattagacgttgttgtagtaaatagataagttttttgcgtgattggttttaaagtggttggtgttaaataattagtagaggcgtaaaagtagtttttttgcgttgggagtttagagtaggaggtagagttcgcgggaagttcggagtatttaggacgtcgcgcgttttttttcgttttttttgattagggagtagttcgttttaggcgtttagtcgaggtttttagtttagtgggagtaagttatagagaataattcgagagatagagagacggagcgcgtttttttgtttagttttgaaaagtgagtcgttttcgggtttgtaattttaagtttcgtagtagcggcggcggcggttgtcgggaaggaggtaggtgtaggtgtaggagggaggcggttttgggtttcgcgtttgggtttcggttatggtttcggttttggggagcggtagagggtttggagggttgagtagttaatttaaatgtaagtttaagaggaggaggaggcggaggtttaagcggaaaggtaaggatcgcgtggcgcgtcggtttttgtttttttttattttcggtttttttatttcggttttttatggggttttcgggtttgttcgttgtgagtagttttattttggggtgttggcgggatggttgtttcgtgtagggcgttcgggagtttagatttcgtggaaatgtttggggtttttttttgtttagaggggatagtgagtagttacgttgcgatatgtttgagggattcggacgaagtggggcgagggcggcgaggagtttttcggggatttcgcgcgttttcgggtttcgtagtttttagtggtcggtcgggttggtattgttttttatttttcggaggttatttcgttttttagtgttaaaggaattatttaaaaacgggggaacgagttttcgcgttagttatttttatttaaattgtttcggaggaagggataggcgaagttttgcgatcgt

SEQ ID NO: 7348 - DNA, 5964 bp, Artificial Sequence
  Description of Artificial Sequence: Synthetic polynucleotide
cgcggtggttggttgtagtttacgtttttacgatttttgtagaaggaaattacgttttttttttttttttcgtatttttatttttattttaagttttcgggaagttttgcgttggtattagggtaagcgtttgtcggttttcgggagttaagcgaggtcgcgcggtttgggacgtaaatgggagggagtagtcgttgtcgttttgcggggttagggttattgggtaggcgtagcgcgggttaagagtgggaggtttagggtaggggattcgtattcggggttatttttgtcgcggcgcgttttgcgttttagtagtgtatagggtggggatttttcgaggatagtggtgcgtcgacgggtttttcggtttttttttttttataggtttcgttgtgtggtgaaggagttagaagaggcgatttgggtgttgagattcggggttaaatcgtggagagtgtttggagtttatattttagatttttggacgtcgtagttagtttagtaggttttatttggagtcgtttcggggtttaatcgggaggtagcggggtgtaggcgagagggttaatgcgttcggttcggttggtttgaggagtttttgtttttagcgatttatagggtagagagtttagggtttcggtttgatgtttttaatagttggggattggagagttggaggggtcgtagatttaggttagagtttaaagtgcgtcgcgcggcgagtcgttggatttttttgggttttacgtggtttttgtgttatatggagtgataggtcggcggaaggcgttttagtcgtcgtttagcgttttttaaggtgtaaggaggtaggatttttttatattggcggcgtagggggttttacggttgcggacgttcgttttggattttttagttcggtagattttttgggtggagaggcgttttttagggtcgcggcgaaggagagcggtttttcggtacgttttttcgtattttttttagattagtttcggttttatcgtttaggagagggttcgtttgaggatttttgtttgtgtcgcgcgtggttagtttcggtttttttattttatggttggtttttagttttttagagcggatatttttttttagggatgtagggcgaggaagggcgggtggagttgcgaatttacggggatttggaggattttttggttttttggagaggggtattatgagagggatttatgggatatagatttgggggattgggtaattttattttttttggtaattataaaaattttgagtaaacgtgtttattcgttatttcgtagaaatatataatgtaggtttatataggtatttttgcgaggttttttagttaagggcgtagcgtttttcggaagtttttggttttgttattagggcgttatcggttttttcgtattggggatatttcgtttgggttttgcgtagtcgttgtatttaaggttttgggagtttcgcgtttttttttaggcgttcgggataaagtgttcgagggtttcgtagacgtttagttttgttcggggtttacggtcgtcggggttttttaacggatcgtcgagggttacgttttgttggggtgtgagcgacgatttttttttcgttttatgaggttcgttattagttaggtgttttatgagacgtcgtggcgagtacggttatttggtagttcgttcgggtagttttaatttaattttttgtttttcggggtatttttttttcgaatagtttttttcggtttttttagttttgtttaaggggtttggaaatgttcgtagttttaagaaaggttttatttaagtataggatggggtggggcgggcggggttaagattgttttggggattgaatttattttcgtttttagcgattttcggcggataaagcgtaagtttgtgtatacggtcgattgagttattggaaatttagtttacgaatcgtagttagggaaacgggagtttgtttagttgtttttgcggaggggtgtgcggaaacgttcgcgatgggaattttttgtagattatgtatggagggagtttataaaaaggaggaaggggagcgcggtggggaggaggtcgcgtgggcgtggaaggttttagggttttgggggtgttcgtttgtttaggcgtagggaatggcgcggagttggttggggaaggagtcgattacgtttcgtaggttaattggtttaagaaattttgtaagcgttggaaaaggtcgttgaaggagttcgttgtacgcgtacgtatatatatatatatatatataaaattttaaaaaaaaaaaaaaaaaaaaaaaaaaaagagcgtcgagtatgcgtatagagaggatgttatattggaatgagttgtagtgggagtcggaggatcggagcgggcgcgcgagggaggcggcgggcggggagcgagcgggtaagggcgggcgagcgagtaagcgagcgaggtcggtgttttttcgggcggcgatcggggtttgggtttacgtcgagggtaggacgaattttattaggtaggacgtcgcgtcggttgttgttttcggcgtttaggttggtcggagagtagtttttcggttcgtaggttgagtgcgttggttaggggttttttttagtttaggaaaaaaaaggaaaaaaaaaaaaaggaaggaagtttgagggagttggggttggaggtggcgggtgggggaaggttggggagggtgtaggggagcgaaagagaagggtaggagaagaaagcgattgtatttgagcgaagttttaaatttttttgtgcgttttaggttgttatttttgtttttcgggtttttttcgtttgcgttttcgggttcggaaaagtcgagtcgtgcgggagttcgttcggagttgtaaagtgtttttttttttcgggcgtagtttgttttttttcgtcgtttatttttttcgtttttgtatttattttagcgacgtagtcgtcgttgttatttatttcgcgttttcgcgtttttttcgcgttggggtttttttttttttttggtttgggtgggagaaaaagatggtgaggacggggaatcggagatcggtatgggggtaaaaatcgtgtagatattcggaatcgtttttttggaaatatttgtttgagtaattgaaataaaattggtagtagtagttttggagcgtgttttagcgaggatggtttttttgtttattattttttttttaaagtaatattttgttatttaggggtttttcggttgtttttttttattcgatttttttttaaaattgttgatttgagttggttttggagtttattttttaatatgcgtgcgtgggtatgtgtatgtgtgtgtatgttttgtagaaattcgttaaaatgtaattgtaggaattgcgagatgtatttattgattttgattaggggcggtgggaaggggttggagggagttgggggattttggagggtgggaagtggttgattttcggtggtcggatatttatttagagtttgattcgtattcgtgtttttttggaagcgttataattgcggggaaggagtttttagaaatcgtgttagttttaatatggcgggttaaggtggtttttaaaaattgaaaataaaggttttgaggtgggaaaaaatttagttgaagtttttattttttagtttcgattttttttggttattttaggaagcgttttagcgaattaagtggggaaaaaaagaaggaatgggttgttcggtttttttttttcgtggttagagtttgtgtgttaagtttattgttaggggggaaagggatggagaagtgtttttggttcggattagggtatcgaaacgtaattgtcgtgtgtgtttgtggattagtgtgtaggtttgcgtgtgcgtagtttttttgggtgtgtgtgttaaagagaattatttcgaatgtgtgtgtgcgttttggaattagattttgttatgatttgacgtgataaattgcggatacgtggtgtaaagtatatgagggtagagggagtgatttattttgtttttttaggagacgagttagttttcgttttgtgtgtgttggattttgcgcgggtagattttcgagtaggtggggcgaggaggtgtttattaaaaggattaattgtttcgggtattgggtgtaatcgggttgtagacgttagtcggatttcgtgtgtgtagggggcgcgttgtatttaatagtgggtttttgtttttttttacgtcgttttggggtgggaggtgggggatcgggatcgaagtttggagaagattaaagtggtggtggtggtggtggggtggggtagaagggcgggagcgcgcggttttgggagataagtacgtagggtcgaggcgaggggttgttttttttatttttgggtttcgcgttttagggaaggtgggggatggggatagcgtttggggaagaaattgttttttgttcggtttaggaattttttcggcgtatcggagaggggtatttttttgttttggcgggtatggaggtcgggtagtcgtcgggggatgtgagtgggcggcgaagtgcgggggaaaggtcggcgttttagggcggggaggatttgggagtggagttcggagataaaatcggggttaggtagaggagttagagggaaagttagtaaacgcgagttcgggtgagagttatcggaatgcgggaacgtagtttagtcgggaatagggttttcgataggggtcgttcgtggttaggacgcggtcgttgaatagaggtcgcgcggcggtttttgttcgagggatttcgtgggcgggggttatacggaggtcgcgtacggttttcggggttggcgggggtaggtgggaggatttttttcgggttcgcgaatttgatttggtagcggttaggtgtttggaagcgtttttaaatgatagggttataaagatatgttggttaggtttgtagttagcgtagtaacgtggtttgtaggagcgtagaacgaggttagatagggttattcggacgtcgtgttgttagtgggtgggggtcgggagtaagcggtattggtttggagatttcgcggtaggtgattttttttatttgggtagcgaggttgaacgatggcgatacgtcggttaggacgcgttcgtggtttttttagtttgcgtttgggcgcgttttttcggggtcggtttttttatgggtttcgcgaggtggggagtagtttaaaatggttttgtgttgcgaagttgtagttttagtcgcgaatttttttttttgtttttttgacgtcgtcgttgataagcgtaatttgttttaaggtttcgaaattcgcgattttgtacgaggtcgtgtcgtggaagcggatgtatagttgattataaagaatattttatagggttttcgaagggtttaagtttttttttttggtggggaggagggaggagtcgagattgggtaggagttcggtcgattatcgttttggtatttaggggttcggggcgtattagtagttggggttggggatttggatgcgcgaaaagtcgagggagttttcggggacgcggatggggattattcggggtaatagttacggatatcggtgttcgtggttgatggcgtttgtggtgttcgagaatttcgggacgacgttggaaagtttgggagatcgtttttaaatttttggagattagttcgtagtttcgttttcggaatttttaggatttttgggtttttaaagttgggtgggattttaagaaggtaaggcgaggttcgtggttttgacgatcggtcgttcgatttttcgtttattttagttttttttattttgtttttttgaattttgtcgaatcgagtcgggtttggggtttcggggtttcgcgtattaattttagtcgcgttttgagggttttcgtagtatagtcgcggttgattcgaggttattggtgggaaattaatttagacgaggtcgattttttttggatttggttcggttgtcgt

SEQ ID NO: 7349 - DNA, 5964 bp, Artificial Sequence; identical to SEQ ID NO: 7348
  Description of Artificial Sequence: Synthetic polynucleotide

SEQ ID NO: 7350 - DNA, 5964 bp, Artificial Sequence; identical to SEQ ID NO: 7348
  Description of Artificial Sequence: Synthetic polynucleotide

SEQ ID NO: 7351 - DNA, 703 bp, Artificial Sequence
  Description of Artificial Sequence: Synthetic polynucleotide
cgtttggggattttcgtgttgggtatttcgtacgttttggacgcgcgtagttttatcgggagcgaattttgtttcgtttgcgggtgttacggagaggggttgggaagtcgagttagttttggcggcgattgggggcgtttttggttttttgggggggcgggggcgcgtattgttgtttaggatcgggcggcgggcggtggcggcggcggtggcgcgcggtggtcgtttagtattcgatttagtagcgcgtcggggattggttcggggcgcgttgggcgtattatgcggcgggtcgggcgcgggcgaggggcgggtcggcggcggggtttattggcgtcgggttaggttcggcgcgagaggcgcgagcgggttatgggttgacgtcgagggtttgcggcgggggcggcggcggggacggggcgggggttcgttagttgcgggcgttaaggtcgtttagtaggttaagggttttcgttcgggcgaatgggacgttcgtttcggggtattagtcgtttgtagttagaagtttttcggattttttggaagcgtaaaaaataaaaggtaatgtgtttttgtttttcggtcgcggtggtagggaggcgattgacggtagtttttcgtttttcgtgtttttacgttgggtcggggaaaagggacgcgtcgttgtttttttattgggggtttggagtcgtttatttcgcgt

SEQ ID NO: 7352 - DNA, 1315 bp, Artificial Sequence
  Description of Artificial Sequence: Synthetic polynucleotide
cgtgggcgttcgggggattcgcgggtattcgggacgaggcgagggcgtagaaaatttggagtttaattagtacggagttgagttttcgcgttttaatttttaggtgatttcgtgcggcggcggcggtagtagtagtggtagcggcgatcggagttcgtagtagtttcgagcgttttcgggaggataggcggcgagttcggcgaatcgttatttgttagtcgatcgcggcgtttcgcgggtcggggtcgggagttcggggcgagttcgaacgcggtttttttttcgttcgtcgcggagattttgtcgggtgggttgcgggcgtttttcgttgtcgtttgtgaacgttgtgggtgcgcggggttgcggttacggcggcggtggcggcggcggcgggagtcgcgagtcggggtcgttcgggttgtgtttcgtttcggtagtagcggtggcggcggcgtttgtggtttaggatgcggtcggggggcgtattgttcgttttgttcgttagtttgttgttgttgttgttgttgtgtttgttttggtgttcggtagacgcgttcggtcgcgttaggtaatttatttattcgtcggtcgcgtttcgcgtcgcgcgtttcgtttggcgttttcggatttttaagtcgtttatcgttttttttcgggcgcggagatttttggtcgcggcggggagtagtttacgggcggcgacggtttgagagtggagtgggggagggggtcgtagggaggcgatttttcgatcggtggacggcggttggggagtagagggatcggttagggttgcgggggttttagcgcgtatcgttgtgggcgaggtagttgtggagcgggatttgtcgtcgggtttcgtattaggattttatgttttttattttggtttttgttgttttttttttttcgttttaaggtttttttaattttggggttggggatttggtttgggagtcggggagtgcgagatttttttgttaggtaaggagcgcgatttttagttttttagttaatagttttcggcggggtgtagtaatttaagtttttttttcggttgtgtaggattttggtggaggaaagtagggaggttatttacggtattttcgtagcgttgaggacgtttcggagttcggcgatcgcggtatcgcgcgttattaataggtatagcggcgtttagcgcgggcggattggggttcgggagttgcgagtcgggtatggggcgcggttgtatcggtttggattcgttgggagtaggtaggttgggacggcgcgagtgagtgtaagagtgtgcgtgtgtttgaagagggcgcgg

SEQ ID NO: 7353 - DNA, 1316 bp, Artificial Sequence
  Description of Artificial Sequence: Synthetic polynucleotide
cggggtttttcgaggtcgtttcgtcgtttaggatggagtaggtttggtttttggaagggcgcgcgggttgtttggggacgggggcgttttttttcgcgtttcgcggtttttttttttttattgtaggtagcgcgcgtttgtagcgttttgggatcgaattgatgtttttgggaaacgaaattaaatttttttgaagtttttagttcgggttttttttgtttttcgttattcggcgtggtttagttcgggcgcggaacgagggcggggtcgtggttatcgcggcggaaacgattcgggtcgggggcgggcggcgaggataagggggttttgtgcggtattcgtttagtttgcgttttggggattgcggtcgggcggcggggttggacgggagtggacggggttgggcgcgggttgggcgcgttgggtcggttaggcggcgcgttgatcgcggttttcgtgcgtttcgtaggcggggagttcgtatcgtcgcgttcgggtcgcgagtgatgataatttaagaggtcggcgcgggcgggcgtgagcggcggaggagtcgggcgcggcgatacgcggttatggagcgggagtcggcggggatcgaggagttcgggttttcgggacggcggaggcgtcgagagggtaggacgcgtacggtgcgttttaatttgttgtcgttttcgggcgtcgaggattttgcggttggcgcggttaagggcgagcggcgacggcggcgcgggtgtgtttagtatttggtcgataatcggtttaagattattaagtatacgttgttgttttttttgtttaagaatttgttcgagtagttttatcgttcggttaacgtgtattttgtttttatcgcgttgtttaatttcgtgtcggcggtgaacgttttttagttcggtttggtattggcgtcggtgttttttattttggttattacggtttttagggatttgtgggaggattatagtcgttatcgtttcgattataagattaattatttgggttgtttggtttttagtaggtgagttgggcgggcgggcgagcgagcgcgcggtggcgtagggtagggcgtttcgggaatttggtgttgggtatagtgattggtaggggttgggtgtttagaaggtagttttatttagggtggagggttcggttgcgcgggattcggtgtcgatcgaagttatagcgtcgttaaggtttttttgtgttttcgtcgtagttaaaggggcgttttggatgcggggacgcgtggggattttttgttatttcgtgtcggggttagaatgattttaaggttagaaatcgacggtcgt

SEQ ID NO: 7354 - DNA, 1110 bp, Artificial Sequence
  Description of Artificial Sequence: Synthetic polynucleotide
cgtttatttcggttcggagcgtggttaggagagtcggtatcgtagaaagcgttgcgggaagcgggttttttttcgtttattcggatttacgatttttagtaggtttagtttatttttttgatttatgtttttttatgtgtttttttcgggaaggggcgaggagggttagttggagtaattcgggagaagtttgggaggattggtaggtttttttcgtttttttttattggtttttcggaagtagagaaaaatggaagtcgaggtagagttaggaaaaggcgtaaaggggtagggttttcggcgttaggagaggagtagagggtgggtaggcgacgaggggaggaggtgcgaggttagagatttttgtagtggaggcgtcgggagaattcgaggtcggtgttttgttcggcggtttataaaggaaggagaaggcgtcgcgttttcgttatttgtgcggcggtttcgagcgttttcgcgggagttacgttttttagtagttttatttggattttttgcgttatcgtcgtcgtcgttgtgggaggcgatttggatatgtttttttggattattggcgaaaagtcggttcggagcgaagtagttagttttcggcggcgggttttttttttttcgttttcgttttttcgcgttttgatcggttttgggggtcgtttagggtttaggttcggtcgttttcggcgtagcgtttcgtagcgtttcgggattcggcgttttgttgttaggcgtttagtgcgcgggacggggtcggggtatcgggcgaagcgagtcgttcgggaggcgggacgcgggggcgcggttgcggtgtttgggagaggggagtttttagcggggtagtcggggtcgggagagcgggcgtagcgcggcggggatcggagtcgcgggcgtcgggaaaggttttcgttaggaggggagggaatttcgggagcgcgagttagggggaggcgcgtcggaaagcgagagtgataagtagtttataagtcgaaaagtttttcgcgggaggcgcgcgtcgcgtgggtttcgatttagtcgttgcgcgtcgtcgtggtatataggttgaaaagtttgcgaagttatagaagttaggttcggcgt

SEQ ID NO: 7355 - DNA, 1655 bp, Artificial Sequence
  Description of Artificial Sequence: Synthetic polynucleotide
cgggttttttatcggcgaattgaaattggttcgtgaagaagtggtaaagtaatataatttttgtagcggttaggtcggttttcgggaatttcgttatgtcgtcgtcgttatttttttattttattcgttagtttttcgtcggtgttcgggggttttcgatgtaataggtacgatcgggttaaacgttgcggatcggtttcggtaggattcggaggtttttgtaaatgtcgttgcgattttatagtagggaatcgagaagaggaagaagcgaacgcgagtaggagcgtagcgtttttcggatttttgaggttttttttgtaatttgttatattcgtagtttttattcgatattgaataataatcgcggggaggagaggttatttgtagtcgaggttcgtaaattgtcggttttattcgggtagcgttaattcggtgttcgcggacggtgattttcgagttttagcgatgcgttttattgggtttaaaatagatttaattttatagttagcgtcgttgtttgttttagatttattagggttggtcggttttgtaggaatttttttttgtttagggatggtttcggtaggaggtttaggtttgcgggaaggaggttgatgacgaaattttttcgataagttttgtttttttttttcgttcgacgtagggcgcgcgttttttttcgtagtcggaggaatgggtagttttaaagagttgagttttgggaaggttagggttgtagtagtttgaggttcgaagttaggaaaaaaatgtgtttaaaaaaaaaaaaaaaaaagaggaagaagaaaggaaaagggtggagtgggagggagttacgttggaatttatcgggagagggttttttcgggtttaggaggaggtggttttaagttttcgcggagttttaggagtttggtggcggaggaggcgttgtcgtcgttacgttttttcgcgttttttttttatattttgaggagggaaggtagttcgtaatttgttagatttgtcgtcgtatttttttttttttttttttcgttttttttttcgtttttttaggttttttttatttttttttttgaaatcggtagttcgtatagatttgtttaatggttgtatttttttcggggttggttgaggagtcgcggttaatagattaagtcgggggagtttagcgaaggggagggagagggttattttagtttcgtgcgttttaggtagtcggttgttttagagcgcggggagaggggataggtcggggagttatcgggggagcgcggggcggtattttcgcgtcgtcggggcgttattttcgtagtttgttcgtacgttttgggtagtttcgttaattgcgttttatatttatttggttttcgggtcgttttcgcgttcgattgcggggggcgatcgcgtttcgtttcgattttggcggggtttttttgggtacgaaagggttaattatagttcgttttttcgcggaggttggttttggtagtggttagggagtggagaaagtaaattagagtcggttcggttatcgattttgcgaagttttttcgattttagtttagcgcgggagggtggcggaaggtggtgtatcgtagcgtggttttcgtcgttgtcgtcgcggttttgtaaagtgttagcgggggcgaaagcga

SEQ ID NO: 7356 - DNA, 1655 bp, Artificial Sequence; identical to SEQ ID NO: 7355
  Description of Artificial Sequence: Synthetic polynucleotide

SEQ ID NO: 7357 - DNA, 304 bp, Artificial Sequence
  Description of Artificial Sequence: Synthetic polynucleotide
cgcggtgggtagggttttaggaggtagttttcgttcggcgatagttttcggggcgtaatttttcgtaggacgcgtatttgttaggatagttattaagaggatgcggaggttgggggttttttcggggataaaattagggtattttaaggaattttttgcgcgtttaggtttgtttgtgaagttggtaggcggaggataatgggagtaggggtaggtttttagaggcgagttcgtttttattttttttatttgttttttatttttgcgtcggtcgtatttatttcgttttttttttagcgttcgt

SEQ ID NO: 7358 - DNA, 1666 bp, Artificial Sequence
  Description of Artificial Sequence: Synthetic polynucleotide
cgaaatcgcgcgagtggtaggagtaggttaggtcggaggttttttttcggtttttaattcggcggtttgttttttttttttcggggcgtttgtatagtagatatttgtagtacgggcggtcgttcgggttttcgatataaggcgttggtatttgagtttttgattggtaatgtattataaatcgttttttttaggtttttttagagtaggagtacggaggttatcgtgtttataaatttttttgtgttcgttacgttttttgggttttgggcgttcgggtttttagtcgtagagtacgtttgttcgtgggaattttaatatttgtgtttcgcgaggtcggcggggcgggggcgggggattgggattattttgtttttttttagttcggtttttttcgttttgttcgtcgttggtttatagagcgtagcgagtggaacgaattgggtgcgtcgtttttagacgttggcggaaattaaatgatgaggcgaggtgggatattcgtttttcgtttcgcggtcgacgtttagtttacggtaaaggtattatacggtgtttcgtttcgcggcgacgcgagcggcgggatgattcggtttgggttttggcgtagttaaaggttcggttcgttggggcgcgattttagttcggcgcgtatagtttttcgagttttaggttggattgggtgcggttgtatttgtggagtgggtggttcggtgattgttattcgggttagtgttgttagtagatgtgtatattttgggcgggggttggcggtcgagtgttattagtaggggcggcggttaggtagttattcgtcgttttttaagttcggcgttgcgcgtagggtttggagtattcggtgttgagacgcgaatgcgtataaagagaaaagtgtttttagtgtttttttaaaatggggaatagggaagaaggataagtattatgtaagattgttattgttatttgttttttgcggattatgttgttttttttttcgttggtttggttttgagtattgaaagtcggggagagggcgtcggttttagagttagtcgtattcggggatcgtaggcggcgttggttcgggttatttaagttcggtagatgagtttttggtttgcgggggatcgggtcggaggttagggggacggtagtgtcgtcggagggagcgcgtagtttaaggtcggtgtttcggtttcgcgcgttttttttcgggttcgtagggaattcgggttatttggggagtcgggttttgtcggttacgttggtttttcgcggttttagaattaattaaacgttttttttggttaagggaagttttgcgtcggacgggggtgggggcgtgtgggggcggtatgtgggtatcggaataattagttttatttttgcgtttttatagaattcgcggcgtagcgagaagtgaatagcggtcgtttgaatggcggttttaaaaggcgatatttgtaagcgcggtcggttgtgaattgaattgagttaaatgcggcgttcgttcgtatttgagtcgcgagttattagtgttaggcgcgttcggtcgttcgggcggggaagcgcgcggttaggtcgttcgcgttgaatgcggtaagttgcggcgcggtcgttttatgggaatgtcgttatttgtgttgttagcggtcgggagggggtgcgt

SEQ ID NO: 7359 - DNA, 5030 bp, Artificial Sequence
  Description of Artificial Sequence: Synthetic polynucleotide
cgcgttatagtggtttttttcgtttagttacgcgtagtgaaattttcggtaatcgggttagttaagatacgggatttgtatcgtagttttttagtttttggagtcggagtcgagcgttttcggtagtttttttaattttttttttaaagtgcgaagggaaaagtttcgtttgttttacgattgtaaggtcggcggatttgggagtcgcgttcggtttcggaggattcggcgggttcggggtttttcggtagcggtttttttgttaggggttaatagtagttttcgcggtcgggcgggcgcggacgttttttttttattcgttcgggaacgtggatatcgcgttcgtaggatgttcgtcggttgggatcggtagttaggaaatatgagaaggtttcgttatttttgttttcgggcggcgcgcgtcgggttgggtaaataaagtcgagacgacggcggtggcggtggtgagcgcgttggagttcgcgtggagaatatgcggcggggatgggagtgcgtttagtttcgaggcgggagagttagtcgttttgtagtcggtcgtcggtttcgtagttataggtatagttttcgcgtcgtcgagttttagtcggttgcggcggaacgttaggttcgttttggtttttgcgttttgggcgtcggtgttttttcgttttttttttaatttttttttaaggtttggtggagaggcgttcgggtagcggttaaggttggtttaagggtttgcgcggagtttgggagtttatttggtcgcgttttttttgttttaaaattattcgtcggcgttgggggagggggatatttttgtagggagtgattttttcggttatagtttggagtgaatcggggtaagtgatttgagaagaggcgcgggtggtcgcgcgcgggagttttgggagggttagtaagtgtggtttatacgttttcggattttttgcgataggatagcgttcggatttttgttatcgtttgtttttgagtttgttgtttgtagatttatagcgcgtcgggtgtttgtgtttgcgatttttgcgtgggtttggggttgtcggggaagtgttcgaggtggttaatttcgtgatgatttcgttaggaaaaatacgtcgtcgtatttaggaggacgcgttggggtggttcggagaaggtcgggtcggggaagggtgttttgtataaataaagtagtatgaatatatatttttaagggtatgattttaaaagaaaatattaacgcgagttttgattgtagaataggggttgtaagtacgaaaattttttttgatatttattatcgaggttatgtgtatattttaggtacgtatttgtttgcgcgggaggacgtagttttaggggatatacgatatttagtagaggtttgattttatttttttacgaatatagatcgtagtcgtcgtttgatcgcggtggttacgcgtggttttaaatgttacgcgtggtttttgttgcggtggtcgaagggcggggcgggggcgttggcgagtgtgggcgtttggcgaggtaaagggtgtgtgtgtgtgtgtgtgtgtgtgtgtgtgtgtatgcgcgcgcgcgtgtgttagtggagtagtagtttatgtcgcggttggacgggtaaagggggcgttggtagcgaagttgaggtcgttcggaggaaacgggagttgtttcgaggcgcgaggcgaggagatggggcgggcgaagttcgtcgcgcgttttggggttgtaattttgcggtttcgcggtcgcgcggatttgtttttgacgtcggtgcgcggtaggtagaggtttagggttttcgcgattttagaggtgagttgttggtttttttcgatagtggtagtagtggttcgggaggtgcgtcgattaagttgttttttgttttgggtttttgatatttttatagtttttgaaagggttttcggagattttagagagaggcgggtgtcgaggggttacgagttcgcggttgatattcgcgttgcggaagagaatggtattgattgagggttttggggatttgggttttggcgttttggattttaggattatgtatttttcggggcgcgttgggggatgataggaagattttgggagagaagggggagaagtggtgttttcgttttgacgttatttaatttttttttgtttttgaatttaattttatttcgggggattttggcggatagaagatgcgggggttttaattaaattatttacgatttagaaaatacgaaaattttttaaatttcggtatggtttgggatttatgagttggggggttttgtggatacggttggtatattattttaaatttttttttttatttaattttttttgacgtttcgagttggggtttttagaggttttagttttttgttgtgattgaagaattacgcgcggttttacgtcggtcgcgtttcgtagttcggagtatgttttttttagatttaaattgaaatttagaggttcgtttgggaattcgttttttttgtttttgcgggtgaatgattttcggttgtagttttggggagtgaagggattggggggatcgatcgtttaggtaaggaagagggtaggtatttgttcggggaatttgtaggggcgggggcgtgtagttaattggggagagtcgtagggtttttgttagttgcggcggcgtcgttttttttttcggtttcgtagttcggcgattcggttaagtttaaggttttgaatttgtaggggtttgagtatttttagttagtaagtaacgagatgtattttttttttttagaagtcgagtttcgttgcggagttttcggcggtttagtttcgaggttttgcggtcgcgtcgcgcgtttttattaatcgatattatgaatattatcgtttttaataagtttagcggtgcggtgttgtttgaggacggaggcgtttcggagcgggagcggggtggtcggttttatagcggtgttttggatagtttttacgttcgtttcgaggtgggtattttcgacggttcgttttttaaggataatttcggtttgagatatcggaggatcgggtatgcgtatttttttgggggttttgttcgtttgcggttcggaggggtgggggtggtgagttgtgacggggtttcgtggtaacgcgggcgggtggacgggaaagggttcggagttttttgggagtgtaggtttgtttttttagggttcgcgtatttttatgttaaggggtttttattttaaaatatgagggattaattcgtcggggtagttttaaagagtttggtggagattaagggcgttaggagttgtttttcggtttttcgttgtttggatttcggagttgggggttatttgttttttttcggattgtgggtgtcggtgcgcggttgagggcgaggaaaaaggattgagttcggtgtagagaaataggcgaagtcgagtagtcggggagtttaggtttaggtttcgcggattttttttcggttattcgagtttttcgttagagtttcgcggttcgtttggtttaaggagtcgggaaggtcgtttttcgttagggagtttcgggcgtgagcgcggttcggttgggttcgcggcgaattcggagggggaggtttcgggtttgcggggtcgggtttgagtttagcggggtgaggggtatgttggggggggcggtagtttgcgggtgggttagttgtttagattgtcggtgagtggagggtaggttttgtttggttcgattcggcggtttttcgggcgtttcgtcggggaggggcggtcgttttagtcgtttttatttgaacgattgtattagttgtttgttttgcggcgtcgttgtttagtaaaatagagattcggtttcgttaaaatgttattattagtcgtttcgggtggaattgtattttaaagtgtttaaagaggtagaaatttaggaggtttcggcgtaggcgcgtaagtttcggggagcggttgggttcgttggcggtcgcgcgcgatatttttcggattcgtgagggagcgtagcgttttaggttacgttttaggtttttggttgtttttgttttttttttttttgaatgtgttttttttgaggtttttttattttatatgatgggatagagtttgtcgtatttttaatttttttttagtcgggaaacggttcgacggtgtttttgggttttgtagtttttttttataaattattaatttttttagaaagtttttttttttttttaaaagattaaaggaaatagtttaaagagagtcggggcggtaatgtttttttgttttattttttatgtttagtcggcgattttttttttgattataagcgacggaaagtttttgggagtagataagagattttcgagggaagtttcgagagttagtcgtatattttgttaggtttgttaggttagggttattcgagggtgcggcgttagcgggtgagggaagggtagtagttagtttcgttgtttagatacgcgattggaatagtagtattttttaaattatttgattttcgttttttaaatttttaattttggggtattgggtttaaggtatttttttatttaagataaatttatcgaaatgatttttttatttagaaattgtgtggtttttattttttgttttttttaaatattttgggcgcgcgtaaagtaggggcgtaaggtaggaatgcgtagtttggatgcggggttcgggtttggtcggggcgtggagcgttcgggcgggtaaacgcgtcgtttattagggtcgttttttttttttatgttttagcgttcggtagaatggcgggaaggtgaggtataagcggtaggttttgtaagatatggcgcgattttttaagtagtggttttataagtatcgtgataattcgtattttattaagatcgagaagatatttttggttttcggttcgtagatgacgttagtgtaggtaattaggatttattaatattttgattcgttttttcgcgaggggttgaagagcgggaacgtttagagttcgtgtggttttttacgtggcgt

SEQ ID NO: 7360 - DNA, 2868 bp, Artificial Sequence
  Description of Artificial Sequence: Synthetic polynucleotide
cgcgtttcgtattttagaggggagggagaaagggagtttaggcgcggggggtggggttgggggagtacgagagagtttttttttaaatacgtattttttcgttttttcgacgttgtagcggttttattatagacgtatttattgttttttttttaaaagtcgttttaaaaataacgtaggaattaaagcgagtttttcggttcgaaatgtacgtgtaattttttatatagtttgggttgcggtcggcggtagggtcgttgtcgtttattattatataaataggtatcggggcggcgtaggcgggggttgttttttttgcgttttcgtcgttttcgggcggataagtttcgtttttttcgttataggaattgtttagataataataattagtagatatttcgttgttgtacgagagggagagaaagtatagtatcgtttcgagataattagaaatataattaatttataacgtttttttaaattggaaaaggcgattgtgtaattattattatatgtttaggtttcgatttttcgggttgtttttttttttttttaatttttacgttaggtagaggggtgtgtgttttttttggtatagtagtataaattaataaatattgtagttgcggtgtaagtagtagtttcgcgcgttcgtcggttcgttcgtttttttttttattttttttttattcgagatttagagcgttatttaagttttattattcggttttagcgtttcgtgcgttcggtttaggtaataatttttttaaaaatcgaaagagaaaagcgcgaggcgtacgtatatcggtttatttcggcgtagagatttcgtttgtttcgggagggggatttgtttgtggtgtttttcggtttttaagtttaggtaataatttcgtaaatatattcgtcgtttagttcgtttttattcgcgcggttttcggcggcgttaagtgggtattttttttgttttgtttttcgcgtcgtttcgtcgcgtttcgttaaacgtggattttattcgcggggttcgtcgcggagtttttaggtcggggttttgggtcgggtagcgggaggcgttagggaggaggggcgtttagggattcgcgttttcgcgtttttaattttcgttacgcgagcgcgttcggttcgcgggttttaattttatcgtcgtcggtcgaattttgttcgttcgcggcgcgtatagtcggcgttcgcgtatacgcgcgtataaattttacgtaattcgcggtcgtttcgtttcgtcgtcgtcgtagttcgtttgtcgcgcgtttatagttcggttcgagtcgcggggttcgagcgatagcgacggcgtcggtcggggtcgcggcgcgcggaagttattttgtacggttagcgtcgggtataagtttgtttcgcggttttcgggggtttgggcgttgagggagaatcgcgttgagggggttaggaggagggggagagggaggcgtcgaagggtataagagtggggaaaagtgcggaaagaagtaatagtcgttttattcgggattagaaaagtggttagtgcgtttcggtcgttcgttttgcgtcggggatgcggcggcgtcggcgtcggttaacggtttagggaggcggtaggggcggcgggagtcgttaggcggagagagattaggtaagagatataacggtttagggagagcgagcggtcgcggcgcggtttcggtagcggcggtagcggaggggggtagagagtattattttttatttttttattttattttgtcgtttttgtttcggttgtttttagttcggttcgttttttttattttcgggggcgtttcggttgtttagttttttttgatttcgtcgtttttcggtttttttcgttatttatcgttattgcgtcgcgggttcgtttgttttttgcgtttatatttggggttattcgttatgattttttcgtttgtgtttaaatgttcgagttattttttttttttttttttttttttttttttattttttcgtttttattttttttttttttttatcgtatttggtttacgatattttcggttttacgatattattttttttatatttagaggttttcgttttacggtcggaattttgttgttagggatcgggcggtttgcggtaatcgtgggtattgttgaatttgaattgaggggcgagggaaaagttttttttaggtgtggtggggagagggaggcggatgtcgggaaatcgtagggacgcggttagaaaggcgacgggttgtcggagttggaaaggtaaagttggaggttcggcggcgttttgttttcgcgttggttatattcgtcgcggttgttcggggtagggagggatttggttgattttttttgtattttgtgttttcggagttgttttttcgagcgtttagaggttttcgtttgtttgttttttggaggtagggttattattagttttacgtttcgcgtgttcgtttttcgtatttcggggttaaggaaagggatcgcggtttggatttttcggggagtttttttgatgaggggaagggtaggtttggggacggcgaggatacgcggcgatcggagagaggttatttgattcgcgtagttcggatttttttttttttttttttagggacgtttggtttttttttaagcgaatcgggatgggaagtgattttaatgagattgaattttagttggattgaaagagaggttagaagtttcgtttgttagtagtttttttagtagagcggaatgagtaatatttatacggtgtttgttttatttttttattcgtattcggtttttatttgttgttatttcggttttttatattcggttcgcgtttttcgttttttttttcgcgtagaatcgt

SEQ ID NO: 7361 - DNA, 2678 bp, Artificial Sequence
  Description of Artificial Sequence: Synthetic polynucleotide
cgagaggcgatggcgtttgttttggttagatttaagggtaagcgaggttgcgcgcggttttcgtagggtcggattttcgagttttagggcgtttttttattcgggtgtagatttttcgcggattttttcgttttttcgggttttattagttgcgtaggaatggagttggttagagttttgggagcggggagggaggcgtcgttattagagggcgtcggagttttagcgttgcggtcggtgagcggttaggtttttcggtttagtttagtaaaggtttggggacgttcgacggttgttttttttattggattttattgtttttagttttttaagagtagggttaagttagtggggttttcggttttaagtttagtgtttagggtgggtgggtgggtgggtgggtgggtggatggatggatggatggatggatggagtgtcggtttatagttatttaacggttaaagtggttttggaaaaaaaatgtatagaagatatttatttttattagcggagtttcggagttttcgtagttttttgttgatcgttttcgtttaatgtagtcgttgatcgtttatttttcgacggttaggattttttagggatagggacgtgtttttagggtaggtttttggatggacgcggcgattgattttatttcgttggacgttgtgttgggaaggatatagagaggtggttggggtagtttgcggttataaagcgaggtttaaaggggcgttttttttatttttacgttttttgggtgtcgatttgtatttttttttcgttatcggattggggttatttgggatgtttcgggggtattcggagggttaagtatcgtcgagggacggtttcgtgggaagagttttttggatttagaaggtagacgttagtagtattgttttaggagtcggaggtcggggtgggggagtttttagttttttgggtcgtacggagttttttttgggtaaggtagtaagtatttaggtttaaaggatttatttatagttattatttattgagtattgtttgtttgttagatacgatgtagagaatttcgcggcgtggggcgggttttattgaatttttcgttttatttcgcggggtgggtttgtgattagtttattttattattgagaggtcggaagtataaaggttatattcgtttttattgagagtcgtcggcgttttttgttttgtttgtataggcgaggaaattgaggttcggttggtggcgtcgtgggtttggagttcgagttacgttgattgtaaagacgggttttattttcgtagatcgagttttgtcggcggttgcgtcgtaagtcgggtaggtggcgagtttgagtttttacgtatagaaagtaggattttttcggttgttttgggtcgttatcgttagtaggtttttcgttcgggattaatttgtttgttttttattggtttttatttagttttcgttatcgaaaggtttcgtttcgtagttttttacgcgcgttttattttacgtttaaggtttttagtttttttagtggggttttgttatagggataataagcggttttttagtcggcgtcgtttaggttgcggattttattgtagatcgggttagcggtgcggggtttagcggagtttgagaaggttaaaggtcggagcgtattgcgtttcgggagtatagagggagcggaggaggggcgaaggggatgggtggggggtgtcgtcgagggagtcgcgcgttagagatttcggttacggttagtattcggtttcgggttcgttttttatcgcgcgtttcgtttcgtttcgtttggtttttttttttaaagcgttcggcgcgcgttttttatcgtcgtatttttatttttcgttagtcgtattgttcgttcggcgttcggttttcgattcgcgttcgttcgttcgttcgttcgttcgttcgtgttatgaacgttaaggtcgtggtcgtgttggttttcgtgttgatcgcgttttgttttagcgacggtaagtgcgttcggcggggaggttttggcgaggttttgggtttcggttttcgttcggcgtagagtcgcggtttttttgtttgcgttcgtagtttgcgtcgttcgatatagtgggggtggaggtagttcgtttagttgggcgttttggtgcggtgtcgcgtttaaagttttatttttgcgtcgagggtttgtgatttgtagagagcgatcgtttgattttaagttggttgtagagcgaggttagtcgggataattgggtaggaacgttttaagagagcgttcgggattggcgcgggaaggcgcgagggtggggagtcgcggattttagatttttgtttgtttattttttatttattgttttttcgttgcgggttcggtttttataggcgaatgggtttcgaggttttgttgcgtatagtgttggaggtcgggcggtgtatggcgagagcgcgttttgtaaagttcgttttatgtcgcgatttgaggttgtgaggttcgatgtagtcgcgtagttttcgttttttgcgaagtcgattttttttttatattttcgcggggtttttggttaggcgcgggcgggttgcgcggcgtagttgtcgggtttgtgttattcgttaggtcgcgtttttgtatagtttcgcggttcgtagcgacgcggatttgggcgcgcgtttagtcgt

SEQ ID NO: 7362 - DNA, 2756 bp, Artificial Sequence
  Description of Artificial Sequence: Synthetic polynucleotide
cgttttcgtacgtattaaaagggttaggcgggttgcgaggttcgtcgttttggttagatataggacgtttacgtaggcgtatcgtatcgtatagattttgcggtggtttattaagtagtatatcgcgttcggaacgggagcgcgttaggaggtttacgttgcggagtagtagtaagacgggagtatagagtaggttggttagttttatgttaaggttgagttgtttaaagtttagcgagtgtataatgtggtttgttattatgggttcgagcgcgtaggttatcgaataggagatgtcggcgatggcgtagacgttgttatagattgagatatggcgtacgtttattaggaaggcgagcgtgggtagtagtgttgtgtcgattagggttatgttaaaatagaggtcgtatagtgagattattagcggcgcgaaggagcggtaggcgggtacgatgtacgagttggcgtcgattatagttagtttaagcgcgtcgtatagttattgtaggtgtgggtagcgcgtcgttaggcgtacggtgaggtagacgtttagtatatgaggtacgaaggtcggtagttaggttatgtttattttttattcggaagtcgttatcgtatgttttatttacgtggtaatggtgggttcgaggaaggcgaggggaatgttataggtggtgagcgcgtcggttattacggtaatgtaggggtttagtatgaggcggtggatgggagtgtttattggtaggttggttcgagttcgtgtagtcgtcgagaagggtttggttattgttagtagtaatagcgcgttaaagagcgatacggtagttagtattaagaagggtacgcgtttgtcggcgaatttatagaggatgttttcgaagggcggggttattaggttttcgaagttaatgaaggttagcgttacgtttagtgtacgattgcgtttcggttttttcgggtatttatcggcgattatggttatgttagacgtgtcggcgaaggttgagtttaggttttgtaggttgcgcgtcgcgaatagcgtggcgtagttttcggcgaaggcgaataggattgtagaggcgaatatgacgtttaggtcgattagtagcggtacgtcgtagtttatgcggtcgatgaagggttcgtttaaggggtttattagtagttgtaggatagttttggaagtaaatagtatttcgatttttacgttttcgtttttcgtagggtagcggggtcgaagggttgagttcgttggttacgtagttgtcggggacgtcgaggtgttggtcgtgtaggcgttggtattggtcggagtgggtagcggtagggtgggtttttatatttcgggagttcgggtggggttttcgtcgttttcgcgtatgtgggcgatgtagtcgggtattatgggtacgatgattatgtatagtatgttgtttagtaatagcgttacgtatacgataataagtattaggcgtttttgtcgtcggggtttttgtagcgtcgcgtttatagttttcgatagtttggtggtcgtcgttcgggtttggttcgtaggtttcgcggattttatgtttttatttcgatgttttttcgaggacgttttcgttagggtcgagcgttggcgtttcgtagtgtagaggcgagggtacgggatttcggggaggttgttttggtcgagtagatttttttgtgttttaggtggtcgcggagtttatggtttagcgtttcgggaaaggaaaggatttcgttcggcgaggcgttgtagttatttttagtcgatttcgggattcgcggttgttgggtttaggggcggtcgggaagtcgggcgcgtcgaggggtcggggtcggagattgggcgtatttcgttcggggcgcgtttagagtagttttcgtcgcgttaagaggtcgttcgcgttggtcgagggatatgttgttgtcgttcgttcgtttgttcgttcgttagtttcgtcgttgcgttttttttttttcgcgtcggtttttgtttttttcgtcgtttttttttttttttttttttttattcggggttgtgacgcggcgagttttagttttcgagtggtgttcgggttatttacgtcgtttatgttaatgcgacgtcggcggggcgggggtcgggggcggggcgtggtcgggtaggggttcgttttttagatgttttagggttggaggtttaggaagggttttcggtgtggaagttttgaattagtttttgggatgggcgtttcgcgtcggtagttggttttttgtttttcgttttttgtttgtttttcgttcgcggttttaggattcgcggggttagcgttcgtttttttttttttggggaagggggcgcggtagtcggtttttcgaggttttttgggagaggcgggagttagaggtttgcgattttcgttttagtttggatttcggcgtatagcgagtaggaagttttcgaggtgagtcgtcgttgcgtttatttgttttcgtagttggattgtggagtcgcgttcggaggagcgttggatacggatatttttaatttttttttcgatttcgttttttggttttttgtatatatattttcgttaggaggggaggggaaggtttagtaattgtttggtttggttttgatttatcggttttttcgtagaatttttcggtcgcgaatcgcggtcgggagtttgtggggattgagggtagaagttgtcgcgttttagtcggggtcgcgaatattagtttggtcgttgtcgttttttcgt

SEQ ID NO: 7363 - DNA, 990 bp, Artificial Sequence; identical to SEQ ID NO: 7133
  Description of Artificial Sequence: Synthetic polynucleotide

SEQ ID NO: 7364 - DNA, 829 bp, Artificial Sequence
  Description of Artificial Sequence: Synthetic polynucleotide
cgtagcgatttcgcgtaggtgagggtattggggagttcgtggtttttttcgttcgtcggtttttttttattagtcgttagttagggttttcggcgtcggggaagttttttatagggttttaggttatttaagcgcggttaaacgtcggcggttcggtttcgtttatttgacgtagtcgcgcgttcgtttcgatttattaggcgcgtagggttcgttttcgaaattcgcgcgggttttcgtagtcggtcgcgcggtttttagtcgcgaagagagcgtcgcgtacggtggcgtcgttatagtcgtgggtcgtcgcgtttaggtagcgttttagttgttcgtaaagtttttgtagcgtcgtttcgtcggggtttacgcgcgtcggttagagtagcgtttatcgttcgagttttagattttaggtttcgtcgtcgtttacgtttagtttcggcggtagtcgtgggaagtagtgttttagaggcggttatagcgtcgttggttgtcggcgcgcgtcgcggaatttcgcggtcgagagtcggtcggtttagttgggcggggatacggcggtttcgggtttgtgttttagttttagtcgggttttttcgcgtcgttgcggttgttgcgcggtgcggtcgtgataagttatagtaaatttgtttttcgcgtcgttttaagttattaggaagcgtaatcggtgtttttggggatcggcgaagaggttttttcggagcggcgtttagttttttaggttgtcgggttgttcgttttttatggtcgtcggcggtagcggttttagggtttggcgggcgcgggtttgatttcgtcgtatcgt

SEQ ID NO: 7365 - DNA, 4119 bp, Artificial Sequence
  Description of Artificial Sequence: Synthetic polynucleotide
cgggaaaggtggtagtcgaagatttcgcggttttttttcgtttaggtatttcgtttcgtttttagtttcggttttgtttttcgcgttttgttggtcgggtattcgggcgtttaggagttttttttcggggtggcgcgcggcgatcgtcggcgggtttggtagtagcgttagtcgcggggcggttcgggtaattcgttcgtttgtcggttcgtttacgtgcgtagagaggagcgaagcgcgagtagtcgtttcgttcgcgtttgttgtcggtgggtgttttatttaaggggtcggcgggggtcgtaattcgagttttatcgtagggattcgtatttgtataattcggttttttttcgttttttcggatttagggttcgagatgcgagtcggattttttttcgaggcgtcgttttgtttatggttagcgcgggggtcgcgggattcgttagagcgtaggcggagtgggttggcgtacgtggtaagaacgtagttatttttttttgtttttttttttttttttttttttttgagaaataggattttgtatatttttgttggggtggggtatttattagggtgttaattttgttgcgatttttttttatgttttttttatttttaattggaaaaaagcgtatagcgcgagcgagaaatttttttaaatgtgttttgggtgatttaagttagagagatggtcggtcgttggatatcggttgttttggagggagggggagaagtagcgttttagtggaagagtagagggagagatcgttttcggtagttttagggttttgatcgcggtgcgttgggttcggcgagagttggcgtacggttgtagcggtcgaggtaggtgagcggttgaagattcgtttgtagcgtcgcgttttttttacggcgtggcgtcgtggttttcgttcgtttcggtttatattaagttagggtcgtttcgggttcggggtgaaaaagggataggataggtttgcgaggttgattttgcgcgttatttttggttttcgcggttttggagcgggaaagggttttggggtagttcgtaatttgtataaacgattatgaatgagttatgtaggcggcggtgcgttggatttgggtattcgggattagttttttgtggggtttcggataggttcggttatttattgcgggttggggcgtattgggaggtagaagttttgcgtttagtaagttagaatttgttgttatttggattttggaaaagtttttaaaaattgttttgggaacgaaatagaagggtttttatcggggtttcgtaaagtaaaacgagtgggttgggggatggggatggcgttttgaaagtgattagagatgttttcggtcgttattgaggatcgcgttgggtttatcgaggtgttttttggggagggagagaaaatatttattttagtacgtgtattttggttcgggtgcgggtagggcgcggttttggattttgggttatgggggttagggggattttgtggttgtagggatcggtagtgaaggttaggttagtgtttttatagaattttttgtttagcgagttcggagttcgttttgtcgtcgggatattgttggtaacgacggcgcgcggacgtagttaatagggaggtgtgtagtgtaaggtgtgtgagcgggtgtgtgaagagggtagcgggggcgggagtgtgtagcggaagtggagcgagtgtgagtgtgtgtgtatgtgtgtttggaggggtagggtgagtgtttaagtttttatttggacgtttttacgtagtcgatcgtttagacgcgtcgggaagggcgttcgtttcgcgtagtagttgaaggggggcggggagcgcgcgggtagaggaaggagggtgttttcggttgaggatttttttcgaagttttttatagtaattttgttttttttagggtttatttttttagttttaaggtgtttaaaatatttaaataaataaataatttaaatttgtttcgttttcgtttttgtataaatagaatagattttttaaaaaagtaatacgtatttatttttattattagttatttttttttattaagtaatttagaaaaaagtagttagttttcgtgaatgtatgtagtttttttttttttcgttgtttttttttgtttgcggttttgagttgttaagaaagtgagtaggggtttgattgtagtgtttcggtttcgttcggttttttttcgaagtttaatttttcggaatggtttttaaataagggttagggaggcggagtcgtcggtatcggattttcgttttttttggaaagttttagagaatcggaattttttttcgtttcgggaggttgagtcgtagtttggagtagttcgtttttttgttgtggttgtgattgggtttatggcgcgttttttttttcgcgatttttgcgtttcggatttaggttgtagttagggtcgcgcgttcgggattttagcgattttcgtcgtttgcgagttggaagtcgcgagttcggcggagttcgcgcggtcgagttcgtgtatgtaaattagttatgtgacggtaaaagtcgtttggtttagttttgttttttagtttatatatgggtagcgacgttacgggtattgaagatttgtttataaatatttagagtaatatttttcgtttaattgagcgaggagtaattgattaatagttcggcgaggggatttattgattgttataataatattatattagtaatttttggttttttagtagtcggaatatagataggagagagttagtggtaaatagatattttttttattttttaaaaaatagtaatttgtttgttatttttatttttgttgattttttttttttggtgtgtgtggtggttgtttttaagtgtggagggtaaaaggagatattattttaggtttagtttaatttttttttaaaacggtttttttgatattttaggtagcgagggagttgggtttttaggttgtgcgaggagtaaatgatgatcgttaaggtcgtagataaaattttagtaatttttagtggttttgtgtattagttgtttgataatatttattcggtggaggatttcgtcgttacgtcggtgattattttttttaatgtcgaattgggaggtttttttgattagatgaacggagtggtcggaggtaagtcgcgtgttttcgtaggttcggatttgcgcggttcggaggtggtggatggggtgtagtgggtgtgcgggaatcgtaggagaggattggggttttaggtggacggtgttgattgtattggttttgaagattggaagtgggtgtaggaggaatttgcgatagttgagattagggcgcgcgggtagatgcgttaggtcgttagtaaatcggcgtgcgtgcgtttcggcgcgtttagtttcgggcgagcgtagggatgggggtggaagaggcgttttttcgggtttcgaggtttgcgtaggttttttggtcggtagtatttcgattttttttttttcggggtaggggtaaagtgacggtaaagttcggggttttcggggagagttgcgcgtttggagagtcgagcggcggagaagcgttaggggaaagcgtcggtagtttttttttgggtagagtcgatttcgggaaaatttcggagcgttttttttttgcggtttggaggcgcgtttttatttgttcgtcgttcgcgaagttgagggggttagtaaggcgggggtttcggtcggcggaggtagcgagtgggtggtggaggagggcgcgtaacggcgggaagtagttttcggattgtcgagggaggttcgcgggggtatcggcgacgtcggtttttttggcgatgttgtggaaagtcgtttttcgcggttttcgcgtttttttcgaggtcgggttattggttttgggttgaggcggggacgcgcggttgtcgggaaaggcggagaagattgggagggtacggaaatttacggatttttttttttatattttttattcgttttagtagttttcggttgaagcgtagcgggagagggagggagaaaaaggtataaggcgtcggggatggggagtagtcgggaaattatttatttttttttcgggtttttttttcggtttggtattattacgg

SEQ ID NO: 7366 - DNA, 1575 bp, Artificial Sequence
  Description of Artificial Sequence: Synthetic polynucleotide
cggtttgggtttttgggcgcgtttgtcgttgcgcgggcgcggggcggttgttatattattttggtcgggtttcgaaagggaggagtggagtttgttcgttttcgcgagttttcgcgcgtttagtttttttttatttgttcggcgtgtttagggcgtttttagcgttggaagtcgggggcgtttgttcgaggcgggagtcgttgggttatgtttttgtttattaggtttttcgaatttttggtagggtagcgtttgttcgtgttttcgatttttttcgtaggtaattcgcgcgaatttggggttcgtagagagcgagcgttcgcggatatcggttgaatagtttggaggttgcgcgagggggcgtcgcggggagggataaaagttagtaataaagagtatagatttcgtttagtagttgattgattcgttttaaaatagtcgtttttatttgttgtttttcgcgtttcgtttttaggcgtagtattcgggtttgtagttcggtcgttcgaaagtgggcgagtaggttgagtgttagcgagtagagggttagcgttagtagttcgtacgattttggattcggtagtcgtgcgtcgcgtttcgttcgcgtcgttattagagttatcgtttcgggcgcgtttaattttttagggtcgcgggtatcggtggttgtcgttttgtgggtgcgtttcgttattattttttcgcgttttgagaattaataaataaataaatagaataaataaaggcgatagtcgttgttaaaaggttttatttaaattgcggggtagggggaaagggtttgtatcgttggaaaacgttttttttcgttgttttcggtaaagaggacggaaaaattagtagtaggagaggaagtgtcgaaaaagtataattagcggtaattggggtatatttaggtgagaaaaaagttatttcgaagaacgttttaagtttaggaaagttaggggaatttgatcggtttttttttttttcgtttagtttttttttttaagtgtttgtagagtagttggtgtcgcgttgttagtttttttgggcgtttcgtgtttttcgggttagttagttttagttttcgggcgaaggggcgtatacggagggttttatgggtagaggtgggtcgtggcggttggcgaggagcgtaggggtcgatttcggcgtttttgtaatttgatatattttttgcggcggtacggatcggatgagtaattcgtgttattttttaaattaatttttttttttttttttttttttttttttttttttcgttattttttttttatttttcgcggggtcgacggtttggatttgtttatttatgtaaattcgtttagggtggggggcgtggtgagtaggttcggcggttttagttcgtcggttcgggagtttttttgtcgcgtttttcgttttttttgaagtgatatttggggttatttataggtaggaagggggtgtggagtggagttggcgttgtattttttttttttttttcggatttatatcgagggttcgtttggttttttacggaggcggtgaggcgggtattattttttatggacgcgt

SEQ ID NO: 7367 - DNA, 2401 bp, Artificial Sequence; identical to SEQ ID NO: 7143
  Description of Artificial Sequence: Synthetic polynucleotide

SEQ ID NO: 7368 - DNA, 1579 bp, Artificial Sequence
  Description of Artificial Sequence: Synthetic polynucleotide
cggttcggtgtacgtcggtgttattttcgcggttaagtttggggttgatattatgtagtatacggcgttatttataatgtatcggtttttttttgttatatataggtacgtatatttattttcgcgttcggagggagtttagggttcggttcgtgggcgtttaggcgtcgattttttcgatttcgtatttatttagaagttgtatcggtcgcgatttcgttttggcgttttcgggggtttggggttcggtcggcggcggtcgcggcgagcgatttcgggtaggatttagttagcgtcgaataaaggttgcgcgtaggtagcgggcgtcgtttgtattttcgtttcgcgtttcggcggcggcggcggcgcgggggttcgggcgggttcggcgttcgttcgtttcgcgttgttcgtttcgagggcgtttcggttttcgcgttttcgttcgttgttgttcgttatcgtcgtcgtcgttcggttatcgtatcgtatatattaattatttatcgttcgtttttagtttttcgggcgaagttaattataggcggaggtttcgttaatggggtcgtcgtcgtcgtcgtcgaggaggtagttagtcgcgcgttcgggcgtaagcgatagttttttagggacggggatgggtcgggggcgcgcggggggcgggggcgtacggggcgcgtcggagaaattttttacggttcgcgttttgcgtcgcgttcgcggattttgcgggcgtgattatttattttgcgtgtgttcgcgtggggttgggggtttcgggggaggttaggttagtcgcggtggggggaggggagggaggaggaggaggagcgcgggaggaagatgaaaggcgagtagatttgttttggcgtttttagggagtttcggttcgcgcgcgtttttttcgtttcgcgagtttcgtcgttcgtatttcgttttttagttcgtcgttcgtatttattcgcgcgcgtagatcgttagtttagttatttcgttgcgagggagcgcgagcgagtatgaatcggaggtagtttatattttaaatttgtacgtaggggtggtgttggtgtacgtcgttgtcgagcgaacgtacgattcgacgagtagtattttagttttcgggcgggggcggcgacgaggtttttttttttttttcgtttaggtaattaattggaagtaatatttgtgcgagtggggttttcggagcgttgtcgttcgaggaggtcgtcgggaaggcgttggcggtggatgatttcgggtgtttttcgttttttagcgaatttttttaagtgggtatgttaatgagggtttacggcggggagggggtggaggagggagttgaattggagggggtttcggtcggggggaggggaggggaggggaggggagggcggggttaggtatttagattaaatttcggtttaaaggattttcggaacgggttacggggtggagaaggtaggcggttcggtattttatttttttgattttgggtgttttggtattttcgggatttttcgagcgaggggtttaggatagggtgaatacgcgtacgtacgttttcgtttttcgatttcgg

SEQ ID NO: 7369 - DNA, 919 bp, Artificial Sequence
  Description of Artificial Sequence: Synthetic polynucleotide
cggtttatttatttcgcgcgtttttatatacgttttttttcgattttttacgagtatacgttcgtttcgcgtgttcgtttttttttgtttttcgtttcgattttacgtttttttttttttttggatttcgttttttggagcgcgttcgtttttttttgttacgtttttttttttttatttttttttttttttgttcgttgttttttcgtgcgcgtttttttttttgtatatcgttttatttttgtcgtaggttcgatttttgaacgtttttttttttttggtttttttttttggcgcgcgttttttttcgtacgattttttttttttgtcgggcgtttcgcgtttgtacgtttttttttttttgtcgcgttttttttattttgcggcgggtttttatttttgtacgttttttttattttgtcgcgttttttttattttgtcgcgttttttttattttgtcgtttgtttttatttttgtacgtttttttttttttgttgcgcgtttttttttcgttgtttatcgcgtgttttttgtttatttattcgcgcgtttttttcgttttgcggcgtttatattggtttttgaggcgcgagttttcgttgtttggtaacgggacgtcgtttttgggtggcgagtaggcgcgtgtgtaggggtgagcgtatcggaaaggttcgaattgtttttgggatttgtttttttagtttcgttgggttcggcgggtagaggcggttttgatcgttgggttttgggcgtcgagtaggatttatttgaggcggagagaggtcgtttcgcgtttggggttttcgaaagcggttagttgtttttttgttttttttgagcggggagcgttgcgttttttgcgggttgcgggagatttttttagattttcgggtgggaaaattatattgagcgtttcgg

SEQ ID NO: 7370 - DNA, 944 bp, Artificial Sequence
  Description of Artificial Sequence: Synthetic polynucleotide
cgttgggcgaggttagggttgcggtaggggagtcgagtcgggagaggggcgtaagatttggcgttgggcgggacgttcgggtagggtgcgggaggggttgagggtcgtttttattgttttttcgttttggagttggggttaggcggtcggagattggttggggcgtacggcgaggttcgggttggagtttcgaggtgggaggcgttaggattagtcggggcgttcgtagcgtaggttgttatttatttgggcgatttttgcggcggcggcggcggcggttgggtagagttagggtcgggggcgtacgtcggaatatttgggtcgtcgggtatcgagcgtcggggggttgcgcggcgcgtatttggagagggcgtagttatgcgggcggcggcggcgggggggggcgtgcggacggtcgcgttggcgttgttgttgggggcgttgtattgggcgtcggcgcgttgcgaggagtacgattattatggttggtaggtcgagtcgttgtacggtcgtttttattttaagtcgtcgtagtgttttgatatttttgtcgatttgtcgttttgttatacggtgggttataagcgtatgcggttgtttaatttgttggagtacgagagtttggtcgaagtgaagtagtaggcgagtagttggttgtcgttgttggttaagcgttgttattcggatacgtaggtttttttgtgttcgttttttgcgttcgtttgtttcgatcggtttatttattcgtgtcgttcgttgtgcgaggtcgtgcgcgtcggttgcgcgtcgtttatggaggtttacggttttttttggtttgagatgttgtattgttataagttttttttggataacgatttttgtatcgtcgtgtagttcgggtatttgttcgttatcgcgtttttaggtagcgtcgtcgtcgtcgttttcgcgcgtttcgacgg

SEQ ID NO: 7371 - DNA, 1096 bp, Artificial Sequence
  Description of Artificial Sequence: Synthetic polynucleotide
cgagtattaggaaagcgaagttatataacgcggttttttttagtttcggcgcggtagtttggaggggatgttttttttgtaaagcgagttttttaattttttcgggttttggcggagtttcgggatcgcgtaggggtaagtggagtgtcggggaaggggcgttggggttggggtgtcggggtaggggtgttttgttcgtacgtatttacgatagtgagtagtatgttgtttagtagtagcgttaggaatacgatgaataggatgagttttcgcgagcggcggtttttttgtagttagcggattagcgttagttcgtttagggttatggtttcggggtttcgttgcgggcgcggtgcgcggtgaggatttaaggcggtcgtggattttttattttttcgttttttaggtcgcggaagggcgggttagggagtcgcgcgtatcggtattcggggatattttcgggcgttttagtttcggtttatttgtttcgagcgcgtttttacgagagttcgcgttttttggaaagagcgttcgcgagcgtcgtcggggatttaatttggagatttaatttagaatttttaggacgttgttttgattttcgtcgtttttaattgtgttattttttaaattgtacgttcggtttcgtgtattttgcgttttgcgttttgcgtttcggttgtttcggggttttcgtagtttcgttcgcgtagttttgggggtttttttgtttttttgtttttttcgggttcgttttttttcggtatcgcgttttgcgagtagggaatcggggtcgtgttatttcggggtcgtttgcgatgtttgttcgggtttttcgtgttcgcgttaacgttcgtatcgtagtgggtttcgttagttcgggcggtttcgggtcgtagttttcgttttagcgtttcgtcgtcgtcgtttagtttatttcgttcggttttgacgttacggtcggagggagcgggggcggggggttggggcgtttcggttttcgttcgttcgcgtcgtcgttgcgtaggaggggttgtcgtttttttgttttcgtttcggtcgcggtcgcgtttttttttcggatttagcgcgtggtcga

SEQ ID NO: 7372 - DNA, 4048 bp, Artificial Sequence
  Description of Artificial Sequence: Synthetic polynucleotide
cgtacgtttagatgggtttttcgcgttcgggtcgtagttatttgagttttcgtgaggttgaggttgtgtgttagttgttttttttcggcgtttattacgtagtgattttttttaaaggcgtgttttagttttagaagttgggacggggagaaggcggttcggattcgtttgggttttcgggttagcgcgttgtgtaaaaggaaattttcggggttagtgtcgttttttgcggggagtatagtagaaattttattagggggggttgttttgatcggagtcgcgtatttttttcgagtcgggttggttcggtatcgtgtttagggttttcgtatagtcgcgtcgttcgatttgcgggggtcggtggtttttttaagggtttacgaagggaacgtttgtttagttgttcggttcggaacgtcgggtttttatcggtgcggtatttaattagtcgttgtcgtagaggagttagtttttaggtttttgatttcggtcggtttcgtagtcgttttggcgtcgcgggtttcgttattttttcgtcgggcgttggaggtaggggagggagtcgtagagtttggttaggggattggcgtttataattcgaagaaattatttttttttttttttaatttttcggggaattttgatttacggtggaaaggcggcgggttgttttttagagtttttatggagatttatttttaaattatttgttttattgttttttcggaaaagtatagaggcggggcgagtcgttgaagttcgatcgggatagaaatttggtcggcgggtgtgtttggttatagtcgttgttgtttttcgcgaattgggtttcggggttttcggttttcgagaattagaagagaaacgcgagcgaagggatcgaaattcggggggttatcgatttgtagatatcgttaggatagtttgtaacgtaggaagattttagcggtttcgggtttggtgaggggattataagtatgattgatagcgaatgaggaagggtagttttaaattttttaagtaaagttttagagttttgggtttatttattagtataggaaatcgatttatcgaaaatttaaataaagaaaaataagtcgatagtttaggtaggatgtaggtaaatttagttcgggattaagggtaaaaggttttttgggtttttttttttttggtttgattttttaaaatatggggaggggggtgatatttattcgattttaggtttcggtaggaacgtaatgggttaatgaatggataagtcgcggagtattgatcggttgtcgtcggaggtaggttttttattgattttaattcgtaaattaattatttttttttttgaagttttaatttttttttttttatttcgtatttagagaaaaataaataaataaaaaatatcgtaagaaatgaaaatatacgaatagatatttttttttaagatagttttttgattaggttttttttttttttttttaaagaaagaaagaaaaataaaaattagatcgaatttgttttttcgttgtggttgttcggcgttttaattaagtaggtcgcggcgagagcgttaagttttggagtttttttttcgtacgggttttcgtttttttttaggttttcgaaaagtaggaaagaaaaaataaattttatatttttttttcggggcgcgaggattttttcgtttttagaagagggtggaagattaagaagtcgcgggtttggattgaaggggcgtaaagtgggtggtgaatagggtcgaacgtagtcgaaagtaagtttggcggtcgagttttgttcgcgtttttcggagttaggacggttgggggtattgtcgagggtattaggagtttggggatttcgcgggttttgggtttcgcggcgtcgggtacgtatagtttagtttgttttgattcgagcgtattgggggataattttttcgttcgtatttttttttaaagggttaagcggttcgtaggttattattttaaattagtcgtagtttcggagattggggatcgatattacgttcggtttcgcgtcgtttagttttttaatagggcgcgttggttcgcgagtcggaggaattttcgtttaggttttgttaagcgtttattcggagtaggtcgggggtagtgaaggatgcggcgggagcggcgcgttgtagtttcgcgacgtggtacgtattttggaagcgatgatttagatatcggtagcggtggatgagttaggggtagaaggtggacggatttcgttgttgcgaggcgaatagggggtgtggcgagtgcgaggagggtagggggtgggcggttagggcgtgcggcggcggtatcgggtgtattggtacggcggggttgggcgggtgcgagatcgtttcggcgaatattaagttcgggttggagtagacgtttttatcggcggcggcggcggcggtcgagtggaagtcgttgaggaacggatttatggggttggagttagcgtagttgagtgtcgcgggacggatggggttttcggagcgcgaggcgggtaggggattgtttttggttattagcgattcgatggtgaagtagcgtttgggcgtcggttggaatatgttgcgtcgaggagcgggcgttttgggtttttagtttttggcgatcgtcgtacgttgttttcgtcgttcgttgttcgcggcgaggacggacgagaattggggattcgtttgtttggggtgggggtgggggtggggggaaggaaaggaagaaagaaaggaaaggaaaggaaaaaggaaaggaggggggagggagagggagaggtaaagtcgaggatttcgagaattttgtattaaacgcgtttaatttgaagagaggggggaaaatttttttagaagaatttgtaggcgtggattggggtaatttttttttttttttttttttttttttttttttttttttttttttttttttttggcgagatggcgtggggggatcggagttagaggtagggaggagaaggggggaaagttttcgggggaggtaaaaaaaaaaaaaagtttttttttttttgtaaaaggcgggtagggcgttttaagtttaaggataatttatggaagtgttcgtttttttataagttgtgtaaacgatttgttagtttatgagtttaattagtgcggggattatataaatagtttttttcgaagtttggtaaatggtttgatgattggtcgttattattcgttttgaggtggaaggggggagattttttaaagtgcgttagagggaggtgagcgtttgggaattcggaggtttggattcgggtcgagagtggaacggagtcggcgtcgtcgtttcggttgagttttttgtcgtttatcgggcggtcgggttttttcgcgttttcgtttttcgtttttagtttattcgtttttgcggcgttcgttgcggtttttttttttttttcgtttttttttttttttttagttttttttttttttttttttttttttttttttttttttttttttttttttttttttttttttttatttatttttttttagttatcgtttttttttttattagtattatttttttcggggtatttcggtttttgtagagtttttggtcggcgtcgttttcgttgcggttttttgaatttcgagtttgtttcgtttaagttggtaggatagaaggatagatagatttttttagtttagcgtttcgtcgttgttgttttacgcggtttcgcgtcgggagaattgggatcgttttaagagtatcgcgagggtaagcgggtaggggttggttttcgggttaaaggcgtcgttcggttatattaatttttatatttagtaaaatttttagcggttttttaggttaggagggattttggagtgaggggtacggggtttttttattttattaattacgtttagtttcgaggttttagggtcggtgcgttcgcgatttttgattcggttcgttcgtttgcgagttgagatcgggagttgtcgatttcgtcggagtagtgggtttttaattttttttttttttcgttttacggtttttagcgt

SEQ ID NO: 7373 - DNA, 3292 bp, Artificial Sequence
  Description of Artificial Sequence: Synthetic polynucleotide
cgcgtttaagttttagtttttgaaggtcgttggatttttcggcgttttcggttcggtttagtttttttcggggttcggataaggaggtcgggcgtttttttttttatttttttggggttttagatcggtcgtagtagcggtacggaagagattatcgggtgcgagtagtagacggggtgcgggaaggtgagtagcggttggttgattggtatcggggttttcgcggttgtagtcgtcgcgttttcggtcgtcgagttttcgtggtagaggatgggtattcgtacgatgcgttgcgtcgcggtatggtttaggttggtcgtttttagtttcgtcgttagttgtcgtttttatttgttgcggcggttttggaattagattttgatttgcgtttcggtgaggtgtagggacgcggttaggtcggttcgtttcgagttgtttagatagcgttttatgtcgaaggtggattcgagttggaagatttggttgcgcgagaagattgtgcgcgttttttttttgcggtacgtcggttttttttttggatttttagcgttttttttttagttttttgcgttcggagtggtcgtcgtcgtttttacgttcgtttcggtcgcgtttggcgtcgtttcgtttttttttttgtttttttcggagtcgtttttttttagaatgatttcgttcgggtttttggagtttagttttttgtgatcggggtcggttttgagtagtggtttcggagagtcgcggtttgtgtcggaggcgggggaggagttttttagtaaggtttttttcgaggttggggagatagatagacggacgtatatatatgtatatcgatatagttttgagcgaggttcggcgtttggggacggtaggtttaattcgcgtcggtttttaggttttaggttatgaggttttattattttcgcgggttgtttttttttcggttgggttagagaagggacgtcgagttttgggattttttttttttcgaggataggtaagtagatggtggtagcgcggttatttttttttatttttttagttttttcgttaggggtcggtagaacggttttttttcggtttaggcgtattggaattattttttttttttaggtcgtgttttaagtttcggtcgttcgaagtttttttatttacgttcgaggttatttttttcgggaagtatcgtgttcggggttttaattttatttttttttttattaagtgggattggattaacgggtagcgtaatttagcgcgagggtaggttaggggtcgaaaaaaattgatcgagtagagggtttgcgggtgttggggttttagaattgcggagggaagtagcgcggggcggggacggggcgggcgcgtagggggataacgaaagtttaaagagaggtcggtatttttaggtcgcgggaggtggtcgtcggcgggggttagggtgtaggggtattattaggttggggagcgttttaggtagtgcgcgggtagggtaaatttttgcgtcgggattttaaagcgagggaaagttaggtcgtttatttgcgagagcgcgaagttcgcggcgttttttagggtttttttggtcgttgcggtagcggtagcggcggcggcggcggtagtcgaggttggcgcgaagagcgttcgtgggggcggttgaggtttagggggcggtcggtggtggttttcgttgagtaggtttttgatggagaacggggattttttgggagcgggtggggggggcggcggcggttggggttgtgcgttggcggtgtcggtagcgttcggttcgggtttcggtatggttttttttttttcgggttttcgggagggagggagcgggataggcgggcggcggggcgagtaggcgagaggtcggaaattagattataaacggaatttaattacggggcgtaaagtcgggggtcgtttcgggcgtaaatttaacggcgggagggcggagtgaggatttagacgggcgggttcgtatgagggaggggtgcggaggggcggggagcggttttgtcgcggtatcgagggatcgaggcggttcggttgcggttgcggttttcgcggaggaggtagtaagagtagttttcggttcgaggttgcgttaattcggcgtcggatgttaatgatgaaattaaaatgttatttaagttaaatgcggggagtatacggcgattgggcgcgtataatggtaaatgggattaggtaggcgaaggtttagtcgagtttcggtttcgtagtcgttttcgttatcgtttttttttcgttttttttcggattttggcgttttggtttcgggttataagagttcgttcgttattggttttatatagtttaattaggtagtaaatgaggataagtttattagtataaaaggatattggttttcgttaaagaggtattcggagcgtttttgcgagcgtaggaggcgagcgagggacgcggagtaggcggcgtttttggtcgaagcgtattaacggtcgcgagttcggagatcgcgtttgttttttttttttgcggcgtagggattcgtttttcgtcgttaggtttgcgggaggggggaggggcggattaggttttttcgggttatttcggggttatttgcgttcgtagttgtcgttttttcgttttttggggttggataggggttcgtcgtttttacgtagttggagagttacgtagcgtcggtttaagaggtaggacgtgatttcggttttcggagaatttattatttttttattttttggggttcggcgatttcggtattttttttaaagtttgttaggaagggcgaggttaagaagagagggatttgggttttttatttattatttagtcgatagtaagggaatttaggtgtaagttttcgtattgcgttttcggatttagaaattcgcgtggttttggtttttagttttggaaaatcgaagagtgagttttttttcgggattaggagtgggtgtgtttgtgtgcgtatgcgcgttgattcggttaaaattcgcgcgttattcggtggggttgttggggtaatagtttttcggtatcgacggttgttttcggaagggtatttttttgttttggtcgtcggtgtttaaggttcgcggattaatttcgagtttgtgatttcgacgatagtatttttttttaggaagttttttcggttagttggcgtttggagttgtttaattaacgttttaatgggggtaaggtgaatcgaaggcgtagcggcgtagtttttttcgtcgcggtaagtagcggtattcgttgcgcgtttcgacggtagcga

SEQ ID NO: 7374 - DNA, 3753 bp, Artificial Sequence
  Description of Artificial Sequence: Synthetic polynucleotide
cgcggttattttttcggtgtagcgtttttttagtttttgcgcggtcgtaggtgttagggcgaggaagttcgtgggcgttttcgtcgcgcgttaaggttttatttagagtaagcggtcgcgtgttagtcggtgatttagttatacgttgaattaatgtaaattattaataataaaagagtgtagggaagcgtttttgttttttttattttttttgtttggtttcgggtttcggattttttttgagtcgtagaattgttttatcgcgtttagtttttttttcgcgcgagatatataattttgttatcggtcgggtagttgggcgtagcgataagttggtcgcgttaagttcgcggcgagtaaagtggaggttttattaggtataagtagcgttatcgtttgttttatatttttggagaggaagtgcgcggtatagggtatgttatagcgggagttgttgtggttaagtttaaggcgagtttagtgtcgggaatatgtcgttgggtatttagttcgtttgtttttagaaggtaatcgtttaaatggcgaggtttgttttttagtttttgttttttttcgcgcggatttttgagttggattttagtcggggtgcgttttagttcgcgcgacgattttgggcgttaggagggagagtgggcgggtagttttagttacgtgtagtttgggcggcgttaaggtttcgatttttaatttttgatttcggttttattttttacgtggagcgagttaaatttttatagatagacgtatgtaagtttttttatcgaaaaatttgaaaatttttcgtgcgttattatgtcgggtaattaagtttattaaagttagtaaagatgtttaaaatgttttatttttttttttttttaaaaatatttatagatttgaattttttttttttcgtttttattattttcgggatgagggaaacgaaaagaagtaatttagtaattgtttaaagtttttgagggtttggtttggtcgagcgtgtatgtatgtatatatatataggtgtatatatgggggaggagtgtatttggttttgtaggtgtttttttgatttttttttttattaattatagtttgtttggttaaaatttttttttttattattattcgagaatattttatttcgaatggtttttaaagcgtattggttcggtttaggtaggaagtaggttttttgatttagggaatgttaataaatattcgaaataattaaaataaaaagtagggtagagattataaataagagttaatgaatatatatggtgtatttttttatatttttggaaatacgtcgttttgtttcggagttttgtttatagtatagtacgcgttcggttttgcgggtagttgggggcggcgcggggcggcgggtcggttagtagtcgagtttgttgtataggttgtagagaggtaaggtcgagaggttgtttttcgggtagtagagcggcgcgggaaaggcgagcgagcgcggtatcggtacgcgtagtagcgaattgtttcggaatattagcggtatgtttattagagtttgcgtcgacgcgtgcgttatgttggtcgtttttagtttagtcgagagttgtcgtttttatttgttgcggcggttttggaattaagtttttatttgggttttcgtgagttgtaggttggaggcgaggtaggcgcgtttcgagttgtttaggtagcgttttatgtcgaaggtggattcgagttggtatatttggttgcgcgaaaagacggtgcgcgttttttttttggtcgcgtcggtttgtcgtttagcgtcgtcgtttcgcggtcgttcggatttcggcgagggcgagttcgcgggtaggagttttttttttttttttttaaagttcgagtgcgaaggagagaggaaaggcgtgcgttttaagtcgttcgggttcgagttttcgttgtttttgggggtatttgaggagcgagaatagatagaaaggttatggagttggttggggagtttcggagatcgttagttttttttgggattaagcggttggtaagcgtttgtagttttggttttattttattaattttttttttttattttttttattggttttttaaatttagtatttcgttttttaaaagcgataagagagggatttagttatttggagtatggggtttttgtgtttttatttttatgaatgggttaggggtaatagggagaggaggtttggagggggaaatattagtatggttttaaaaggcgaatttgtttggtggtaattgagttggaagagtttttcgagttttatagggtggtattattttataggtcgtttgtttggaaattacgttaaggattaacgtaggattttttttcgttaaatgttgtaaagaggaatcgtttttgaaatgtattattgttaattattttggagtgttaattattttaaggaggagagagagagaaaggtagagatacggagcgagtgaggaagaagatttagaaagagattacggtggagatagattgtttagattcgatttgtagatttttatttcgtgttcggaaagaaagtattagatgtgtagtgattgaggatagtcgggtgtaaggtcggtcgcgtgtttttttcgttgtggtttatttttttaataatttaattttttttaggaagtttaagtcggtacgggtttgtgttcgtttgtttttaggggtttatcgggcggaggaggtattatagtgcgcgttttttttttcgcggtttcgaattttcggttgtcgtagttttggttagagggggttcggcgcgggagttttggcggggcgtttagttttttttttttcgcgttcgttcgttgttatattggcgacgtgcgatttttatttaggtaaggaaaagggatggggggatggtgtttggggttttgttttttagggtcgtgttggtttgggtagaagtaggcgggcgttttttagtcgtcgttcggttttttttttttcgaggatacggataggttgcgttttttggttggttagtcgacgggttttcgcggtgttttcgaggggttttcgtttaggatggattggatggtgaagttggagacgttatcggtcgtcggatattttttgttcgtattttttttgttgtttattttgggtttataagaaatcgaaggaaattaagaattttttttagagacgatttgggtgatttgggtggaaggtggtgtagtaggtaggtagtggggaggggcggggaggaaatttagggggagggggcgtcgaggttggtgaggcgtttttttcgcgttagggatatgtaggtatcggatggttgcgtaggggtttttgttcgtttggttttgggtgcgttcgtttagtttcggtgtaaatgtttttttttcgttcgttaattcgtcgggttttcggcggcgcggaggcggcgcggttttatttgtatagaggttattcgaacgcggttaatcgtagcgtcgtcgagcggtttcggaaaattttaaaacgtttcggttaggtatatagtatcggtgcgtttttagagcgcgtcgagggtttggcgggtattagcggcgtttaattaggggtagttagggttgaaagtagttgtagattttagttcgggtttttggcggttgcggtaatttcgattttttggattttttggatttttttttttagaggtaggggcggtgcgggattcggagttggagtggttcgacgttttcgtaggcgacgggttttcgcgt

SEQ ID NO: 7375 - DNA, 829 bp, Artificial Sequence; identical to SEQ ID NO: 7364
  Description of Artificial Sequence: Synthetic polynucleotide

SEQ ID NO: 7376 - DNA, 1328 bp, Artificial Sequence
  Description of Artificial Sequence: Synthetic polynucleotide
cgggcgagagatgtttttttgggcgtttagggtcgggcggggtcgcgcgtcgggttgtgggtcgcggtggagatttgattcgtatttcgagggtttttagagagtcggggagcgagtagtagagttatcgtttttagttttagtttgaaaagttggatcgtgtcgtcgtatgtgcgtttggtagtcgggcgtttcgggttttgcggttatattattttggggcggggacgtgtgcgtttcgggcgttcggacgttattgagttacgtttgagtcgtttattttcgggggtgagcgagtcgcggttcggggcgggattttggcggggggattcgagcggtttttaggattcgcgggacgtcgttaattggcgggggtgcgggggagataataatttgtttcgcggtaataagaacggtgattgttggtcgtggatttattttataggtttgtttttttttattaacgttttttttagttttcgggttaattcggatagtttgtttatttattgtaacggttaaggttggtttgtgttagaacggcgcgcgcgcgcgtacgtacgtatatatacggggggaaatttttttaaaaatgaaaggttagaagagtttagcggcggcgcgggcgttgcgcgagggtttcggagttgattcgtcgaggtaggaaattttttcggtcgcgacgttcggtttcggttcggcgttcgcgtgggatggtgtagcgttcgtcgtcgggttcgagagttgttgtattgaaggtcggcgacgatggtagcgcgttcgttgttcgtgtttttcgttcgcgtttttttgttcgttttggtcggtgttttgttcgcgttttgcgaggttcgaggtaagtcgtcgaattagggcggttcgttgttcgtttcgtcgagggtatcgtacgttgcgtttgggcgcgtcgaggtttagggttgtttcgaggggcgacgcgtttcggcgtattttcggagtttcggggtttgcgtttttagcgcggcgagatcgattttttttttttaggtgttaattttttggggaagggcgatatttggttcgtagttttataggagttagtatttgtttcggagggtatagtttcgggatcgttttttcgtttttatttttttgggtgatatttgtagatgtttttgtattttgatatttatacgtgttattcgggacgatgcgtgtcgggtttttttgttggttttatttcgtagtgaatatttttattttaggtttcgggttagttttttattaggttttttttttagtttcgtttttttcgttaatatatttaggggggcgcgtagcggtttcgt

SEQ ID NO: 7377 - DNA, 2957 bp, Artificial Sequence
  Description of Artificial Sequence: Synthetic polynucleotide
cgagtcgttttcggttttgcgtttttttttagggtattaaggtttttaacgttaatacgtggggttgttattaggggaaatcggaggtttgagtttagtatttttggattcgtattcggttagtttttagtttttttttaaatttcggttttttttcggttgtagaggaggtgattgaggcggaagtcggcggtcgcggtttggtggttaggggcgaagttaggggaggggttaagggtttggggagcgtgggtggcgattgtcggtggtcgtttttcgaaagaaaagtcgttcgttaggttttcggggaaggtgttaaggtcgttagttagagcgtttatagtagaagcgaaatcggagaagtaggtggcggtttcgggtgcggatggagagggcgaggtttgtaggtttaggtaagtcgcgttcgggggttttagcgttggcgtttcggttttttttacgtttttggttttcgagcgtacggtcgcgttggttttagttttttttttttttttttttcggaagttttcgttgttaaatattttttcgtagttggggtttagggtttagtaattgtttttatttgtagaagaagaaatagtttagtttagaaggttcgagttttgacgggtcgtggtgtgagttagcgaggaggttagttttagaaagattttttgttggtttttatagagggtttgagttttcgtttttattttatttttgacgggtattttgtattcgatgggtttttatagtaggattgggaagaaagtgataatttagaaaggaggaggaagggagttttgggaaaggtcgagtttcgttaaggtgaaggaaggtttgcgagatgttaatggtgggatttcgttagtcgttttgttaaggatagcgtagattacgttaggtttttaggtaggttttagagttttttaaacgggtattttatttgttttgtttatttttggggtaggcgttgttttttttattttattaggtagggtattgaggtttagggaagttgagttatttttaaggttatttagtttgttggttttttcgttttttttttcgaaggagcgtatagagattgagagtttcgggatcgtcgtattgtaaacgcgggtttgtggtgggtttagtcgttgtttgagaatttgtttatgtttaagtattttttttttttttttttttttttcgggtatttttaatcgcgtagggagaaattaggttgtttaaggtgtttttattttcggagtgttcgcggttcggcgggaagatggggagttttggacggagcgagtcggcgcgtcgttgttatttgggtcgttttcgtcgcggggtatttttttgaagtagtcgttgagcgataggttgtggcggatggagttttgttagttcgttttgttgcgtttgtagaaagggaagttattagttacgtattggtagatttggttgagcgttagttttcgtagcggcgcgttttggatggttatggcgatgagcgtcgagtaggagtagggcggtcgtattagttttagtagtttttgttggtcggagaggtttagttaggcgaggtcggcgttcgttaggtcgttcggggcgtcgaggagcgggtcgggagtttcgtagttcggggtcgcgtagggcggcgtaggttcgggattcgaagcgtaggatttggggttgagcgttggcgcgtttatttataggagggggttttcgtttatcgcgtttagattttttggtttatagttcggggggtgcgcggtggtttgggtttggtcgggcggggtcgaggaggggtttaggtcgtcgtagtaggtggttatgtttagtcgcgttcgggtttgggttagcggtgtcgtatcgaaatttattggcgatttatttagtttggtcgttagtagcgttcgggtgcgattagttcggtttagtttttcgttttttaaatatcgtcggggttagagtttatggagagtgacggtggcgagttttttttttggtagttttggaggagcgaaatttttgttttcgttttggtgttagtttttcgtttcgtttaggtttgatacgttttggatcggacgtttttttgatttttttttttttttttgtgcgattcgtttcgagtttatagtcgttcgcggttttggttgtagggattttaagttcgtagtttcgtttggttttacgggtttcgtagtttcgattgttttggatcgtattacgattttttaaggtttttagggttgtggtttgggagtttcgtttaatgcgcggtttttttgttcggttcgggatatttcgttttaaagaaattcgtttcgtcggggtttttgggttattcgggattcggggttagggatagagggcgattatattgcgtaagagatcgtaatgaagttcgtagatttttaggttggagtcgtagagcgaggtggcgaggtggagaacgcggggttgggtttggatagcggttttggggtcgtttggagttttcgtttttttaattcggaaggtagcggattgatatttgcgtcgaagtcgcgcgtattttacggagggtcgggattttggaaatttcgaacgttttagtagtttagggtagttatcgttttttttaagtcggggagttcggggtttcgttaggttttttcgcgttgtgatttcgggcgcgtagagcggagagcgttaagttttttgttgggtgtcggaggacgcgtcgaaaatagggacgtttttgtagtgcgttcgatattagttttttagttttgttgtcgttcggggttgttgtagttcgggttatttcggttttttaagttgttcggttttcggttttttttgtttttcgcgttgtggggtggcggaggatggatttaggttgacgttgggttgggtatttggaaagagggttcgtttttcggatttcgagtcgggtatttgtgcgaaagaggcga

SEQ ID NO: 7378 - DNA, 1860 bp, Artificial Sequence; identical to SEQ ID NO: 7150
  Description of Artificial Sequence: Synthetic polynucleotide

SEQ ID NO: 7379 - DNA, 1422 bp, Artificial Sequence
  Description of Artificial Sequence: Synthetic polynucleotide
cgcggggagtagaggtgtttagatacgcggtttgttttcggtttttattttatagagttttttatttcggtattgagttcggaagttcggttattagttcgttattttataatttttttagtttgggagtttttatacgggtggtcgttttttcgtagcggtttagtttttagttgtaggattttcgggattttcgtatttattatgagcgttgtaaagttgcggaagcgtgagcgtcgttggaggaggcgtttagggggaggcgattaggtggcgttttgtttttcgttagtttttatggtttttggaaggttaaagttttagacggcggttaggaggtcgcgttttcgggtttttggttttagggtgatcgcggcggggcgggcgtagttcgggagttgtttttatttgtgaagatagcggcggttagcggggcgggcggagggttttcgcggagggtagttcgtagtttcgatttcgttagggagtagtcgcggtttttgtcgttttttttttttcgcgggcggtttgggggttgcgtttggggttggcggaggcggtgtcggtggggatcggtggggggttcggatcgaacgcgttagcggtagatgcgtttttttttttatatttaaaaattaatttgcgttttattttcggtttcggagttaaatttaattatttcgggttgtataaagttagaggcgcgtcggggggtttgtatcgggaatcggtatcgagtgattcgttcgttttagttcggtcgcggcgtttgttttgtttggatgtggttcgagtttcgggtcgggcgcgcggggcgggggttttggattattcgtggcgtttttcgttttagcggagtcgaaagttattcggagttgtttttttcgcggttagtgttatttcggggcgcgagtttttttgtcgagtcgcggtttcgcgcgtttttttcgtcgtttagattcgcgcgttttttttatttgttgtggtcgaagcggttgtcggggcggtcgggtcgcgttttcggagatagacgcgttgcgtttttttcgtcggggattcgttttttattcgcgagggtagcggtcgagttgggatcgagttattaatagattgcggggttgcggcgtcggtcggtgagttatagtttcgcgtacgagcggtttagttcggttagtagcgtcgtcgtttttgcgcgtatttttcgcggcgatagcggggattcggggtcggaggtaggcgcgtaattatggggatcggggcgggcgatggcggcgggcgggtttttgtcgtagggtggggatggtttttttagtcgggcggtcgtcgttatattgtagagcgtatttaaagagatatttcgtttcgcgttcgttttttagtattagattttcgttcgaaaacgtcgtcgggcggattgtacga

SEQ ID NO: 7380 - DNA, 1479 bp, Artificial Sequence
  Description of Artificial Sequence: Synthetic polynucleotide
cgacgagtttacgaattttatcgtggtcggcggtagtcgttggtcgagtttagcgtttaggtttaggttatttttatgtcgtgcgattcgtcgggaacgggtttaggttcgtttgtttaaggttagaagtattttgttttcggtttaacgtcggatcgcgtttcgttttttttattttatattaaggaaaggaattagacgtttgggagaaaggatgagtagtattcggtgggattcggttttaattcggggtcgtttttaatttttaattttttagagtttttttcggtttcgtttttttttttacggtttcgaggtcgtcgcggttttttttcgttttgagtgtagatagttcgggaagtggagagcgtagttcggagttagggagtcgtttttaggagttttggcgatgggagcgtaggtggcgggcgtggtttttttaattttgttttagtcgattcggagtcggttttcgtgtagtagttatcgttcgggttttcgtttggttatagtattaggttatagtgcgttggtttttgattatttttttggttcggtggtcgtttttcgtttttttttagttcgcgtcgttgttttgttttaggtttcggtgcggttttaagttttagtttagggtttttaggtttttttaggcggcggtggcggtatttatttgggtcgcggagtcggggtttggtacggtttcgtaggtggtaaatgaaattttggtagttgtcgtgttttagggttttacgggtatagagttcggttagtagttgtagcgtttggtgatagagcgcgtttttggtttcgggtatcgttttttcgtattttcggatcgcgtcgggtaggcgggcgtaggagatagtttttcgtttgttagtttagagtcgtcgttttcgggtcgttcgcgtttatcgttagggatttgtcgagaaacggtgcgagtttgagttcgagttttagatttagtcggttcggttttttatcggttgtatgtagtttttcgttagtcggtcggttaggttttttttttttttcgttcggttttttcgtttttttttagatatcgaggagaggcggtgtcgtatagtttagagcgtttttttgtttgcgtttcgttcgttattcgcggtcgtcggggggcggggttaggttaggagtgcgcgtcgtagggtaggatagcggcggttttagatcggggatttggggtatttttcggtttttggtcgagcgcgagatttggtttgggatttcgcgtttagagcggtcgcgttttggtttggggagtgtgagtgagtgcgcgtttcgggcgttttcgttattttattttttatttttgatgtaaattaagtattcgtttttatcgtcgagtgtgtttaaagtacgtttttggatgtttagtgcgaaggttataatttgggtatattcgttagatgcgtagaatcgagtttttgtttcgaatttggaaagagtcgt

SEQ ID NO: 7381 - DNA, 446 bp, Artificial Sequence
  Description of Artificial Sequence: Synthetic polynucleotide
cgtgcgtttcgcgtattttgtttttcgcgcgacgtcgttcgcgtcgttcgcggttcggtcgggagcggtagttcgtgtttcggtttcggtttcggtttcggttggcgtttgtatttgcgattatcgtgagtagttatggcgtattttatagtgtagagagtcgttttggtttttgggtttgttttggttttgtcgttgttgttgtttaaggtttttttgtttcgcgggaagcggtaggagtcgtcgtcgatatttgaaggtaagagtaggttagttttttttgagtttttcggcgtcgaagagtacggagaacgttgtttgagggaggggtgattttgagagtttgtagtttttatcgaaatatttattaaattgattggagagggcgggcgagacggcgttgaagggttaatgtttacggtttcgttgttattagcgggtggcgg

SEQ ID NO: 7382 - DNA, 2991 bp, Artificial Sequence
  Description of Artificial Sequence: Synthetic polynucleotide
cgtttgtcgtttataggcgtcgttgagggatagttggtttagtttgcggattttttttcggattttatatttatgtttagggaaagtcggagttacggcggtataaattagcgtttttattttgattatttgagcgagcgttcgcggttcgttcgtttgcggtataaacgtataaattttttgtagtattatatattatgttttagagataaatatagttttaggggtttttgttttggtaaagtaatttttatttataggaatagattataaaagtattataaaaagtggttttgaatcgggaaacgggttgggggtgggttacggttatatttgttatatttgggatcggagtgtattgggttttacgtttttttaaataatcggtgtatttcggggtagggtttaggtttgcgagggttttatttttatgggggagggcgcgagaaagttgaatttagttttttaaggtttagttttggtttatcgaggaatacggagcggttatcgtaatgggttttcgagaagggtgttgcgtggaaaaaatcgcgttgtgtttttgttttgtggggcgggggcggaaattttagttttttcgttttttttattttaagagaggtcgtttttaaagcgttgttgggaggggggtatttaagtttaattttttgggcgcgagggattttaggggtattatttttcgggcgggtgggcggttattatttttttagagtatttggtatatcgggttggggttcgtattcgtagggtattgcggggcggcgttcggtgattgggtggggtcgtcgttgttttttttttcgttgggggcggtagttttttgtttgcgcggaggcgatttagaaggtacgttcgttagtaggagggcgggcgtcgtagggttttcggtggagatgcgttttacgatgttggataggtagtttaggttcgatatcgtcgtatttttttcgggtttgggttttgcgcggggagggttcggttagtaagtaggggtggggtcgcgataagttttttattttcgggtttagtattttgagatagattggaaattgaggattttagttagagttcgggataatttaaaagatagggagttatttgtttagtattttattttttgtattattttttaggatataggcgtgtgtgagtgggggtgggagcgttttagatagaggttaggatagttttatgaaggaggaggagcgagtagggagaggttcggaatatttatcgttgggcgtttcgttgtagtaggcgttttcgtagtagtttcgtcgtcgggcgtcgttcggggggtcgttgtagtttatttgtaaatagtaagggcgattgagttaggttcgcgggacggttcgaggttcgaatattaatttttgtagtcgttttttttttaattttagtttaaggttttagtttcgggtttagatttgttttggttgggggggtaattacgggtgggtaggagatgaggtttgtaatatgtagggttaaattaagggcggatagttattaaggggcgtaaatttatattttggaagtagggataagtagagaaaaagatttttacgttcgcgttgtagtgttttaatagcgtttttaatggggtagttcgaacgtttgttcgtatatttttaaaataggttattttagtgatagttgtttaggataagggggttttttttttcgggaaggattttggtttaaatttttcgtaaggttagtttttcgttttcggaaacgcgtttttgatatttcgagcgtcgttttaatttttttattttttggggtttcggttttattatgtcgtcggagtagttggagcgcgggttggacgcgtcggagtcgtcgttgtagtgttcgtcgtcgcggttcgggggtagcgggttcggcgtatagaaggcggttgcggcgttagggggcgcggcgttttggtcgcgtagtagagtttgtaggttttcgatatagcggatggcgttgcgtaggatttttattttgggtaatcgttggtttggattgttcgacgtgtagcgtttgagtgttttaaaggttttatttattttgtttaggcggcgtcgttcgcgtatggtggcggttttgcggcggtcggcgttggtggttttgcgtttgtacgttttgtaggtttatagtaggtagcggttcgtttggtggtgttcgttgggcgcgcgtatatgttcgtttttacgtgcgttcggggtcgggtgtatcgtcgcggggaagtgcgagtgtttttcgggttttaggagcgcgtttacgtgtattaggcgcgggtttaggttttcgaagaagcgtaggttcggggagtcgaaatacgggtcgttatagaagtcgttcgttgtggtaaaggagtagagagagtcgtcgggggtcgttaggtttacgtcgcggagcggtggcgatagtagttttatattttggcggtggcgcggtacggttttggtttcgtttaatttaagcggtagagagtggtcggaattttttgtcgttcgggagtttcggttgtagatagtaaagtgttggtagtttgaatgtttatttattgttttttattttttttttttttgttcggtttgatttgtggttaaggaaagcggcggtagcgttttagggtttttttatttttagtttttcgttaggcgttttgggttatttattcgtagtagtttaaacgtttcggagtttaggcgggtagttgggggagggggagttcgaggttaataggaatattgcggggcggggtttgggggggttttcggggtggtcgtaggggttcgtagattggttagttagttcgtttttttatattggcgtgcgcgttaggttttttatcgggtagggagggagggagcgatcggtagttttaggcggttgtatttggtttttcggtacgttttttttaaatttttttaatattcgattgttgtattcgcgggaaacgttggttgcgcgcgt

SEQ ID NO: 7383 - DNA, 928 bp, Artificial Sequence
  Description of Artificial Sequence: Synthetic polynucleotide
cgagtttcgtagtttttttttttcgtttcgttcgttagttttttgttttttttttttatattttttattttaaagttaggcgtcgggcgtttttttttgtcgtcgttcggtattcggttaatttttttaaaatgcgtttttattttgttggttgtttcggtagggagtatggaggattgggggttcgaagtttgtaaagggtgattttagcgttgtagttttttcgaaacggagatttgttatttttttagagggcggggaagtttatattattttttgttttatagtgttcgtttcgtttcgtttgttggtttttcgtttattcgagatattttaggtacggttcgtattggagagggtcgcgttgttgttgcgatcgtacggcgttcggggtaggaatatgttcgtttttttttgcgcggggggaacgaaatttttagagtgcgtttcgatacgttttttttattatttaaggtaggtttcggtagttttggttatttaggttcggggagttttagtcggatttgttgcggtttttttcgtagcgtaggtaaggattttaaattttaaattagggatttcgattttttttttttttttttcgttttttttttttttgaaagagaaatagatagaaagtttagttttgagataaagaacgcgagtgattttttcgaaataaatttgaagataacgatataatagtgaatggtaggacgtataaaattttatgggtttaggttaaatggtattagttataggttttagtcgtagtcgtcgcgtcgcgtagttttttgggttatcgcggagtttgaaaagacgcgtttaaggagattatttaaagtaagattttttcgttcgattttttgtttttttaggatttatttttttttttacgggcggttagttttcgttttttcgttttcgt

SEQ ID NO: 7384 - DNA, 1267 bp, Artificial Sequence
  Description of Artificial Sequence: Synthetic polynucleotide
cgcgggattttagggttttttcgtagttttttgttttcgtcgtatcgcgttttttcgggtttcggtcgcgttcgttagtcggaagcgttttttttgcgggtgcgattttcgtagttatttttttttagtttggcgggggtcggcgagagtggtttttatagtattttataagttcgggaattcggggtacgcgggttcgttttgttgcgggtttcgattttttgggacggaaagtcggttattagtagtaagagggtgcgtttattcggtcgcgttttttatttttgcgtttttgaggtcgggttttttgagaaggggtatttaacggggatatttttaagttcgtgagtttttatttttattttgttatttcgagtagggtaaagagattttaggaatcggtttacgttatcgtcgttttttagattagcgtaaagttcggttttaggtttttttacgtcgtcgtggtttgtgggtatttttatttttcggatttttttaatcgttatagttatgtttatttgttttggtagtgtatatatagaattatataattaaaattaaatttatcggtatcgttttcgagggttttcgtttagtagggggtatcgaagttaggtggaagtaaatgagtttggattttgaggcgcgtttggtttggagtcgttaaatttgttagcgggcggcgggggaggtggttcggtagcgtcgggtgttgcgttcgtatatgcgttcgggaaggtagtttcggtcgtttcgtttttagttcgttttttatcgttggcgcggcggcggcggcgtggggttcggggttcggtttttcgttgcggttgcgttcgtttgggagttcgggtaggagcgcggggtttggttattgtggtttgttgcgttttttattgggggtcgatttcgttcgtttttttcgttcgtagaattgcgaggatttggattgtaggcgtcgtagtcgttattattcggagtatcgaagtcggagttttaggatttgcggtcgaaacgagagagcgggaggcgtacggcgtttttacggttttacgcgttttagttttttcgagtcgtagtcgttaatgttgttttttttattttcgtatcgcggtgggggttgtcgaagttgttatagtttattttcgtcgagtcgaaaagtcgtcgagttttcgcgggtgggtattttttttcgggggaatttagatcgaggcggcgttatcgagcgcgtacggattttttcggaaaataattattcgggattcgt

SEQ ID NO: 7385 - DNA, 1225 bp, Artificial Sequence
  Description of Artificial Sequence: Synthetic polynucleotide
cgtcggtcgttttttggtgttttcggggttggtaagcgcgtagttgaggaaagggtataaaggtggcgagttttgcgggagtagttgtgtagaatttgtcggattttagggtttggtcggtaggttcgttttcggcggttgggttttttttttggagtttagattttttagtcgtaggttgtttttcgggcgggttttagttagggcgcgtagttttgagcgtttgtcgttgcggttcggttggtaggtttcgaggggcgcggggtcgcgggtcggtcggtagggttttgtgtcgttcgttttcgggtgtgcgcgaggcgcggagtatttaaattgatattatatgtttttttattagttgtttcgcggtcgagttttaggcgtataattatcgttagtgggcgagagcgttagtagtttttagggaagggatataatgattgaggtttaatttttgaaggggaatttggagttgcgttttttttttgttatttcgatgttgggagtggcgttttggttttggcgttttttgggtaagtattagtcggcggtatttgcggaggtggttggtacgttgttattttttgaaatgagtgaggagggaggtttagatttaggcggttttacgcgttcgttttggtattagtagattgggaattgtcgtggttatgttcgaagtttggaaagtttttttcggtttttttttgggatagttttttttttttcgggaagttttttgtgtttagaggtggggttttgtagttggaggggtagatggaatttgcgaagtaaaggaaggtaataaaaggaagttaggagaaatcggaaacgtgggttaggttttgttttgttggagaagcggtgttttcgtaaagtttttgtttgcgttggtttcggtcggagtttagattttttaaacgtttgttattttttatcgagttgaggtttcggtttttattcgcgttttggtgagggtttttttttagttttaagttttcggttattttgaaaacgcggtttttttcgaaggggaaataagtgtagtttaatttcgtttgagtgatttataaataaggacggaaagggtcgttttattacggtttcgtttgtcgtgacgatgtaatttttcggagcggagtattgttataaagtgataaggttgttataagcgtttcgattgatttttttaattagttttttatgtatgattcggagcgattttcgt

SEQ ID NO: 7386 - DNA, 1627 bp, Artificial Sequence
  Description of Artificial Sequence: Synthetic polynucleotide
cggttgtcggcgcgagcggcggttttttttcggttgtagaacgtttttcgttgtcggagaaggggtttagtaaaattgatttttttttatttgtttttatttataattgatggggagatgagaacgtaatatattttagtatcgagtttttgtcgtttggcggagattttgtttaagacgttttcgtaaagtatttttagtcggggaataaagtacggaaagttgttgggtagagcggtcgggaggagatatcgggagtcgggtgggcggtggggtggtcggtgggttgtttcgggttcgggagttcgttcgtagcgcgttttgttagtaaggggagagggacggtgggaagcggtcgtttttcgggtttgggtcggggatggggatggttaagttattcgagttttcgtttttcgtcggtaggtattattcgggggtcgtgtaattcgggcgtttattgataggtattttacgttcgcgaggggttgtttcggttttaattgcggcgttgcgttttttttttaggacgtaggttaatgttcgttcgttcgtttttagtcgggcgtagagttgttagatttcgggcgttttagcgttcgttttggggttaacgggcgggagggggcggttaagttcgtaggcggttttttcggttttggtttagtttttttcggttggtttttggagacgttgtgttcggtagagaagtaatttttgttaattttagttatgtgcgggggacgtcgagttggttttgtttggtaagaaatttttatttgatgtttttttcgttttttttttaagggggtgtatagtggaggagggtttttaagtttatttgtttttttttttaagtcgttagttttgttagttttgacgcgttcgttaaatttttttagttttttgcgcgttttttgtacggtaggtagagagagtagtttggaaaataaattaattgtttagtggtaatatatatatatatatatatatatatatatatatatatatatatatagcgattcgggattttaggtttcgatttttatcgcgcgtatatatatatatatatatatatatatagcgattcgggattttaggtttcgatttttatcgggcgttataagagtattagtaaattgttgaaaacggttttattttattggggggaggttggtaagaaaaaagaaaaagaaaaaaaaaagtttgttacgcgtaaggaagaaagaaaataaagaaaaatattgtaaaaatagatatttttttgtttttttaggttttggtttttttgatagaattttgaaattcgttattattttttgtagtagtagtagtagtagtgggatagagtaggagtaaaataaatcgatgtacggtaaatggtgtaattcgatttatttttaagttaatttattaggcgagtcggagtttggttttttttacgtattcggtagttttcggcgcgggttttattttcgggtacggacggtaggaggcgcggtcggtcgggcgcgttcgttttcgcgggtgaatcgtggttagcgtcgtttggaggtttttattttggcgtcgcggttttgttgatttttcggtggttttcgcgtttttttttttcggcgttttgttgcgt

SEQ ID NO: 7387 - DNA, 1857 bp, Artificial Sequence
  Description of Artificial Sequence: Synthetic polynucleotide
cggcggtcgtatttggttttatagtgtaaaatgtgtttggcgaggaagtcgaggcggcgttgtagtagttgagcgtgggggtttgtaagggcggttagttcggggaagcgaggttcgtggcgtcggtagaggcgtagtagtcgggtcgcggcgttttgttcgcggtgtagttttaggacgcgtcgcgcggttcgttcgcggaatacgtatattgattgtaatagcggttcgttatatttgttttatatgtttgttattcggtagtcgtgtattaagttcgttttattgtttagaaagattagcgtttcgttcggatcgcggtgtaggttgttggtggtacgttgtatgacgcgcgggttttattgtaggttgaagaggttgtttacgagtcggtcgaagttggtcgttaggtagtcgaaaaggattaagtcggtttattgtattaggtttattagtttcgtttggttgaggttggttagtttattttcggtatttcggagggggcgtagacggtcgtttttcgagcgttagggcgcgggtattattacgttcgtgaggttgggtagttagcgtgttaggtttattacgttgttttcggtttagtgcgtagcgcgtagttttttttgtatttgcgtttattgcgcgtttcgagtttttattcgagttagtgttagcggcggtacgtggcgttggaggtttagtaggcgcgttagatagtaagatagggtttcgttttgaatttgtttcgggttgatgtcgtagcgtacgtaggcgcgggtgtcgtcggtaaaacgggttagtcggttggagttgcgttcgtaattttcgcgttttagggttattattcgggcgtcgcgagtcgtttttagttacgtcgtcgtttgggttttcgaaaagttcgggggtatttgtttttttaggtcgcggttttagaagacgttttcgtgtatcgcggcgttttttttcggtcggggttgtttggttgatacgtgttatttgggttcgtttcgggattgtcggggcgggtcgttcgcgtcggtcgttagggtgagtagcgttcggaaagtttttagggagtcgtcgcgggcgttttacgttaggggcgggggtagagggaagcgaggcgcgggcgcggggtcgtcgtttcgggtcgggcgtcgtgggagtcggttttcgggcggtcgggaggcgggtagttcggttcgcggcggtaggagttttttttatagcgttagtagcgagtttagcgttagtagttagagtttcgcggtggcggcggcgtttcgtatttttttgtttatgttttcgcggttgtgtcggtgcgtcgtcgtcgttttaagtcgagtttaggtattcgggtttcggcggcgaggcgggttcggtagtttgtgggtttcggggtttcgggcgtttcggttttatcgcggtcgcggggcgttgcggggttttgttcggcgtttcgttcggcgttgggaattcgagttttcgtcgttttttagttgtttttgtatttcgttgtgagatttttcggtgggcgcgatttataggcgttcggattacgtgggagttagggggatttttttttttttttttcgttttcgtttttcgtttttcgttttttcgttttttttttttttttttttatttaaagcggcgatggtttttttcgagagggagaggcggttttatattcggttcgggatttgggggtttggaggaagtcggattggttgcgttcgcgtcggggcgtaggagggggtggcgtagagtcggagtttggggtttggcgggagggacgcgttttgggttttcgcgggggtgttttggtcgtcgggtttttttgtttaggtagcgcgg

SEQ ID NO: 7388 - DNA, 2423 bp, Artificial Sequence
  Description of Artificial Sequence: Synthetic polynucleotide
cggagcgtagagaacggttggagatatagcggtcgcggtttttttcgtagcgtaggagcgttaggtattgcgttgggttaattgcggttagggagttatttgttcgcgatagcgagcgcgtatttatattttcgattaatttaggttggtttttagtttattttcgggttttaacgtttaaatatttcgtattgttggtttcgatatttttttattcgtcgttaggaattagcgtagagggagatgcgttttttgtggcgggtgcggggcgaggattttgattttagttttgggaagtgaattgtacggaggagagagttttttatcgttagttttgttttcgttttttttgcggttttattttagttcggatgtcggcgatggggaatagattagggacgtaggagtatattggatcgggggtggatttatttggggaggtaggtaatcgattcgcgtatcggtggcgtaatttcgtttcggtgatcgaagtttgtggaggtagttttattttcggttttttggttcgatatttttttgttatttttttttttattttttcgagttttgggagtttggatttcgaaggtgtaaaaagttaagagtttggaaaattgtattgtgtaaatatattgattttatttgtttttttttaggagttttatagatatatttaggtaaaaagatcgttaaataaatgtttttagttatcgtaatgtaaaaataaatattaattttttagacgtagtagtagtcgcgttgcgtttaaagttttaacggttacgtttaataattataaaagtgtttagcgagagtgttggcgtgagtgtgaatgggtgtgcgttggggggtacggtggagcggtgtgtaaaatcggagttgtaaattatcggataagggtatggagtggttattcgtcgtcgatttagcgcgggcgcgttttttcgtatatatttatagtagagttcgtattgggaagagttaaaaaataaatatttataaggacgaggaaagcggtttcgttttcggcgttttcgggttagggcgagcgcggcgaggggcgtatcgatcggttcgtagcggggcgggagttcgagcgcgcgaggagcggcggtttcgggtttttgcgggtttttcgggagtagggcgcgggtattttcggggtttatacgtcggttttcgcgcggatcgcggacgcgcgcgtttttttcgcgggcggcgttttttatagggtcgagtcggagtcgttggagtttaggttgttttttagtttgtagttgttgagttgttttcgttgtagcgataggttttgcgtgttgcggcgtaggtattttaggttttgtaggaacgattttttggttttttttttttttatgggggatattttttttttttttattttttggatttcgtcgaaggttatcggttgcgttttgaagcgagattggcgcggtcgtcgtagtcggtttcggtttttgggtagtttggcgggtcgtacgggttgcgggaattcgtcggttaggtatacgaagtgcggtattatcgtttggtaattggagtagatgtttattagttcgtcgggtttggcggttatggcgttttcggcgtttgcggggtcgggcggcggggcgtcggggtttttcgagggcggtcgttgcgtcggggtttttcgggaggtagtagtcgggggttcgtcgggcgggggatttaaatttgttgcggggtggcggcggttttcgcgggttcgggtcggcgtttttcgggagggcgggcgggcgggcggattcgtcggggggtacggggttcggggggcgttgtttcgtcgcgtttcgaggcgttcgtcgtcgttgttgtcgtcgtttgtttcgcggcggttaggttcgcggtttatatagttcgcggttgtttatacggttttgagttcggatgatagcgaatgttatttaaagcgtgcgcgtttcgcgttttttcgtttgacgtcgtttcgtcgttttgggaaagtaacggtttttttttcggcgtcgttcgtttttcgttaatcggtttcggaaggtaggtttcgttcgcgggggtttcgggagaagtcgcggtttcggagtacgcggttggttcgagttgcgttcggatagggatttttaatcgtcgcgattgggcgggtattgttttttttgggatttttaagtttgtattaatcgggttggtcgcggggtcgtaggtttttttttttcgttttttggttttagatgtatatatttgaggcgttggttattttatcgtcggttttgcgcggggcgcgaggtagtttttagttttttttgtagtttggcgagtttgagcgttcggttttttagagttgagttcggaagaaggggtgggttttttttttggatttttgttattttttttcgtaggcgcgcgcgcgt

SEQ ID NO: 7389 - DNA, 1146 bp, Artificial Sequence
  Description of Artificial Sequence: Synthetic polynucleotide
cggtatttgggtttttgcgcgtttcgtttcgcggtcgggtttatggtattgtgagtttgtaagggagtttcgtttagcgcggggagcgttcggttttttttcgttttatgcgttcgcggttttgaagtttgagcgggggtcgggggtcgggcggggtcggggtcgtcgtaggtatggcgttcgggagtcggtggcggtcgatattgtcgtcgttgttgttgttgttgttgttggcgttggcggcgcgcgcggacggtttggagttcggcggcggtttcgggtagtgggttcgttacgcgcgttgggcgggcgcggcgagtagcggcgagtttagttttagtttgcgtattaacgttacgcgcgcgttgttgttttatttggacgacggcggcgattgcgattttttggagttgttgttggtggacggtcgtttgcggttgcgttttacgttttcgtgcgtcgagtcggttacgttgtagttggatacgtcggtggtcgacgatcgttggtatatggtgttgttgattcgcgacgcgcgtcgtacggcgttggcggtggacggcgaggttcgcgtcgtcgaggtgcgttttaagcggcgcgagatgtaggtggttagcgatttgttcgtgggcggtatttcgttcgacgtgcgtttttcggcgtttacgttgagtatcgttaagtacgagtcgttttttcgcggttttttggttaatttgaagttgggcgagcggtttttcgcgttgttgggtagttagggtttgcgcggcgttatcgtcgattcgttgtgcgcgttcgcgcgtaatttttgcgttaacggcggtttttgtatcgtgttggttttcggcgaggtgggttgcgattgtagttatacgggtttcggcggtaagttttgtagcgaaggtgagtttcggggagcggtcgttcggtgtttgggcgcgggggtgagggtttggggcgtttcgtgggggtcggagtgtgtgtgggtttttgaggtacgggggttgggtacgagggtttgtgagtgggtgcgagcgttttagggttgcggggacgcgtgttcgggcgagggcgcgtggggttggcggtgggcggggcgagtgggcggggtcggtttgggcgtggttagcgtgagttttgcggcga

SEQ ID NO: 7390 - DNA, 577 bp, Artificial Sequence
  Description of Artificial Sequence: Synthetic polynucleotide
cgttttttttattttgcgcgttttacgtgttttttgtaaataagagaacgcgtaggcgtcgtaaattagcgtttattggtcggcgtgtcgtcgtttcgttggagggaggatttaggtttcgttggtcgcgggttcggtattcggtgggtcggtggagcgtttgttgggttcgggtcgtcggtttcgttttcgttatggcgttttggttgtagtttttgtcgttgttggggttgttttcgggcgtagtggtcgttttcgtttagtttcgagtcgttagtttttaggtttgggggtcgtcgttttcggagttgttggcgtttattcgtttcgcgttggagatgtttaatcgcggtcgggttgcggggacgcgggtcgtgttgggttttgtgcgcggtcgcgttcgtcgggtgaggacgcgtcgggggcgggggcgttaggttcgggtttaagggataggagttttgatttaatattgggatggggtttgttcgttggacgaatcgatttttggtgatggggaatgggtagcgtcgtacgggcggggttttgggcgtcgttaagggtcgattgtgttcgt

SEQ ID NO: 7391 - DNA, 1721 bp, Artificial Sequence
  Description of Artificial Sequence: Synthetic polynucleotide
cgtgagttttcgaaaggcgaagggtaggtagtagtcgttggtttttgcgtttattaggagtttcggatgttcgagttagggttgcgttaaggcggtcggagtagagagggagacggggacggggataggtagggataaagtgtaagaggtaaaattggttgaaaagtagaagtgtaggagtcgttaaggggcgggacgaataggttcgtgggtcgggcggagttaagggtgggggtcggggtttttttaggtggtattcgcggcgttagtttttagtttttttttttttttcggttttgattggtaggcggtttgcgattagtcgcgaacgttatagcgtttcgggcgtttaggagaacgcgaacggtttttcgcgggagcgggcgagtaggagggggcgtcgggttatatatatagcggttcggtttcgggcgggtttggcgtttagggaggcgcgtattgttttttagagttttagttttagtcgcgcgtttttcgttcggttcgtcgttttatgtagtcggggtagagttcggcgttcgggggtttcgtcgtttgtttttcgtattttttcggttgcgtatttttgttcgaggtcggtcgtgcgttttcgcgggacgttataggcgtagttttgttttttagtttttcgggcgtattgatcgtttgatcgacgtacggttttcgggtcgggatgtcggggttcgggacggtcgcggtagcgttgttttcggcggttttgttggttttgttggcgttttgggcgggtcgagggggcgtcgtcgtatttattgtatttaacggtacgttggaggtcgagttggagcgtcgttgggagagtttggtggcgttttcgttggcgcgtttgtcggtggtagcgtagtttaaggaggcggtcgtttagagcggcgtcggcgattatttgttgggtattaagcggttgcggcggttttattgtaacgtgggtatcggtttttatttttaggcgtttttcgacggtcgtatcggcggcgcgtacgcggatattcgcgatagtgagtggcgcggttaggcgcgaaggggcgggggcggggggtaacggtcgtcgggttaattcgtttagttatattttgagattttcggcgggtatttgttcgggggtttcgggaatcggggcggattcgggtttcggttttttttgacgcggggttggggacgtagatatttttggtttcggtagtttagcgtaatttttgaggtcgggcgtcgtttttcgtttttagaaattcgggtttcgagcgtcgaattttagcgttttcgttcgtgggtatagggcgcgcggtgtagttatagggggttcgagatacgcgtttcggtttggtttaggttggggaatcgttggggtcgggttcgcgtttgaaggttcgggattgggtgcggtcgtcgggggttttttatataggtaagttaatttgagttagcgtaggtttgggtttcggaggttttagagggtagtttgggttttggaggtttttgggggcggttgcgtcgggaattttggttttttatttttaattttattttagaaatagggttttcggaggcgaataagtcgaggggcggagtgggttagggattatttgtttcgtaatgatttgcgtttcgtttttaggtttgttggagttttcgttcgtggagcggggcgtggtgagtattttcggcgtggttagtcggtttttcgt

SEQ ID NO: 7392 - DNA, 1721 bp, Artificial Sequence; identical to SEQ ID NO: 7391
  Description of Artificial Sequence: Synthetic polynucleotide

SEQ ID NO: 7393 - DNA, 615 bp, Artificial Sequence
  Description of Artificial Sequence: Synthetic polynucleotide
cggagtttcgggtacgtatcgtcgagcgttttattttgagttttttcggtattcgtagtttcgatagtttagttttttttatttgaaagttttatttgaggttttttttaattttgtttttttgtatttttggcgtcgcggggagttaggggttaaatttcgtggttcgcgtggtttttttttttttcgtagttttttcgtttttattcggcgtcgcgtttggagcgttcgtttcggagattcgtataagagaggaggggaaaaagtgggtttgtttttcgggtggttaatttatcgagttcgcggtgttttagaggaggcgttagcgttaggttagcgttaggtcgggttgtttgtttttcgcggtaaagtataaatgcgttcgagcgcggcgtttgaagtttttggcgagtatagtcggttcgcgtttagttttttttcgcggtcgtcgcgtcgtcgtcgttgttgggatcgtcgtttcgtcgggttttaggttttcgcggttcgatttcgagtttatcgagtagggggcgtcggtcgtttttagttcgcgcgttcgtaatattcgttggtttcgcgcgtttcgttcggcgttgcgcgttcggtagacgtcgg

SEQ ID NO: 7394 - DNA, 1542 bp, Artificial Sequence
  Description of Artificial Sequence: Synthetic polynucleotide
cgggacggtcgtcgcgcgtttttttttttcgttttttgtttataagatttaatgagttttttcgggaggtagcgtagcgagttaggttcggaattagtaggttgcgtcgcgcgcgtcgcgtcggggcgggagttgggtttgggcggcgggtaggagttggcgggggcgtacgggtagcgttgcggatagttcgggagtcgcggcgatggcggtgtaggcggcgttttttagtacgtattttttcgtgtttttcggtttcgggggtttttcggacgggttagggggcgttttcggagttttggataagggttgttgtttcgaggacgatgagatcggggtttcggcgggtgcgttgttgtcgggagtcgaaggaggggacgtgcgcgaggttattcgcgatttatttagttttattgattcggcgtttagtaatattaagttggcgttggataagtcgggtaagtcgaagcggaaggtgaattatcgtaagtatttgtagaagtagattaagcgttgtagcggttttatgggcgtcgcgtttttcggttcgtttttttcgagcgtcgtcgatacgttagttaaacggtcgttggtcgtttttagcgtttcgatagtcgcggtttcggtttacggtaaggttgtttttcggcgggaggcgtcgtaggtcgtcgcggtcgttagtttgtaaagtcgaagtttggtcgcgtttttcgattcgttgcgttacgttttcgggggtgtcgagtcggcggggggtgaggtggttgcgtcggcggtcgggttaggaggtgcgggtattgggggcgcgggaggggacgtggtaggtttcgcgggggttacggcgattttaggggttaggaaggtttcgttgcgggtacgtaatttgttttcgtttttttttacggagtcgtttcgggtaggcggcggcgggtgtggttcgtcggggtcggacgtgagtttgggcgatttggagaagggcgcggaggtcgtggagttttttgagttgttggggttcgattacggcgtcggtacggaggcggtagttttgtttgtcgtcgagtttttcgacgtgtttttcgtcggagttttcgtattgcggggattttcggagttggagttcggtttttttgagtcgtcgtcggtagtggtgggaaatttattgtatttcgagttttggagcgtttcgggttgtttttcgattaaaaagagttttttgattgtttttcgcggcggtttgattttgaacgagtttttgagttttttgtatttcgtcgttgcggattttttcggcggggaggacgggcggggttatttggtttttttcgtttttttttttttagattgcgttttgttttcgtcgtcgtcgttttattaggtgttttacgattatagcgcgggttatagtcgtatcgtttattttagtttttggagattcgacggggtttgggaaggggcgtcgggggaggagggggcgtatcgggattgatttcgaggtacgtttttttttattagagacggttgtggagagcgtcgcgttttcgt

SEQ ID NO: 7395 - DNA, 1542 bp, Artificial Sequence; identical to SEQ ID NO: 7394
  Description of Artificial Sequence: Synthetic polynucleotide

SEQ ID NO: 7396 - DNA, 1768 bp, Artificial Sequence
  Description of Artificial Sequence: Synthetic polynucleotide
cgcgtttggagtgggttttcgatatttagggtaagtgggggcggtagagtttttttttcggtcggtatagtagtttttgtcgcggtttcggtttgcgacgcgtttagttttagtttttcggttttcggcgtttgttgagtgttcggcgggagaggcgtagggagcgcgttatcgggaggcgcgggtagcggggattggttttttttcgggttagggttttcggggtaatcgtttttagcgcgtatttttggtgtaggtggaatagttttttgtttcggtagggttttatttatcgcgggagaggttaatttcggatttaaatttcgtagtcgtagagcgggttaaaatcgttattttatttttttttattttttttttttttattttaagataaaaagttttaggtcgggtaggatttgattatttttgtttttttttattgcgttaattttgcgagcgagaggtttcgtatcgaggcggaggttggtaaaggggagtggaaagggaggatggatggggtcggggggtggggtggtgatgagggcgacgaaggagggggtgttattttttttttttttttttttttaaaaaaagtatttttttcgcgagaaatcgttgcgcggacgatatttgaagaggtggggaaaggagggggttgcgggagtcgcggtagagattgtgggtgttataagcggataggagttatagttgggatagttgcgagcggagtcgagtagtggttgtagcggttacgattgggagtagtcgtcgtcgttttttcgggagtcggagtcgtcgtttttttagtgggtgtagtcggggtttcgacgggggtcgggcggttatcggggttggagttgcggttacggaggtttttgcgtttgcgtcgcgtcgagggtagggatagggattggggtgaggggttgtttcggaacgtttatagttggcgttggtttttttttgtttgatagttttttggttcggggtttttggtgtcgggtttcgcgttagatgttcggggggcggtggtatcgttcggagtcggcggggacggcgcggttggtttttagtttggcggagagggtaggttgaggagtggggcgtttagagcgcgtatcgcgcgtaattcgtgtcgttaaaaaaaataaatttagagagttcgttcggggtttaggatcgttggggatatgggtattttgcgtcgcgtttttttggcggggttcgggaggtcgagggatcggtcggggttgttgtcgtcgggggtttgggttttttagttagttgtggattaaacggtttttttttatttaaattaattgcgttacgcgtaggcggcgtacgggttgggtttgggaatggggatcgcgaggttttagtatttcgatgttttgaaagttttttcgtttcggggatttgtttttgtgttgtagttggtaggggtcgtttgaagtgggagtagcgtttggagaaggcgggaggagttcggttcgggggacgggcggcgggatagcgggatttcggcggcgcggtgcgttttagggcgtagcggcggtcgtagatcgagtttcgggcgcggtaagaggcggcgggagtcggtggcggttcggtattatgcgtcgagggcgtttgttggagatcgttttgggatttatcgtgtttttagcgttttatacgagttatggggcggacgttaatttggaggttgggaacgtgaaggaaattagagttagtcgggttaagagaagaggcggtggaggatacgacgcgt

SEQ ID NO: 7397 - DNA, 2656 bp, Artificial Sequence
  Description of Artificial Sequence: Synthetic polynucleotide
cgtataggaattttagtcgtttaagtttcgggtgggcgcgtcgtatttttttaggtattgtttagatagttcgttttttttttttgggcgttttttttagtttggttggggtcggggcgggttgggggaggttttcgcgggtttgtttgatatttgtaaatggaagtgggatttaatttggaaaataaacgcgttagagtttgggggcggagaggagcgggaggaggggagaggggggaaaaagattttaattattatcgcggttttagcgtttttttttttcgtcgcggttgttgtaggttcgtttaaattcgaagttgagttttattgggcgcgcggcggcggcgggatggagttggagttttcggtcgaggcgttaggagtttattagatttcgcgtgttagagttatcggtcgtttacgtttcgggtcgtaggcgttattttttttcgggagttttttttagttttttacggagatttcgtagggttttcgtagttttttcgttttcgacgtttatttcggggatttttttttatcgtttggtttgagtttattattttagcgagttgtagttttaggatgttatcgttagtatatttatatttcgggagtatttttgttttttttatttcgagtaatttaagcggtttttttagttcgtagttaaatttcggttatttttgtatttttgttttaagtacgttttcgttatttttcgtttataagaggagaacggtggaaagtgaataaaagttgtttttcgtaaagtttaattatgtttaatgttaaattatttcggaaagtatatgtgataaaagttaacgagagaggagaggagggaatttagattatagtatagttaaaaatattcgggttcgttattatgtaagtcggggggttagatgtattttagtttagcgatttttattggcggaattttcgcgtttatcgcgcgtcgcgttaagatggtttaggttatttttattgttttttcgttagcgttttttagttttttatatttgttttgtatatatattggtttgtagaggggattcgtttcgaatcgttcgggagtggggtttgagttcggagttggtgtttttggcgttttcgtttttaattcggagatagttttttcgtatttttggggatggttagattcgcgttgttttttttttaaagataagtagtttttttatacgttcgttaaaaattatgtattttcgtaaagtatttcggttttttttttttgttaagatagtagggatagtttttgtttttaattatttcgtaaaggatgtcgtttttagtcgaagagtcgtcgtcgtcgtttattatattttattttgattataagtttcgtaagttcgagttaggcgtggggaacggattcgtagattggtaatttttttttttttttagcgaaagtggaggttgggttttttttttgcgtcgcgtttcgtttagcgatgatttaatttgtatttcggggttttttaagtgtattatttatcggtatttgaatattttttattgcgttcgagaggtatcggttgttaagtaggttcgttatttgaatttttttatttatttgtaggggcggttgggagtcggggatgggtgtattgattcgtaatttttttcgtaatttttttttagatttttagttttaaatttggttaatttttcgtgtaaatttttcggttttcgtcgcggggttaagttattttttttttttgtttgtagcggtagtaacggcggttcggggttgcgcggaggttggaattttataaggtgaaaagttttttttacgcgtttcgtcggttttcgtttttttagtttatttcgtagtttatttgtatttagtagttgaggttgtgtttcggtaggcgcgttttagtcggtgtattaggtagttaaattattacgttataaatttttacgtatttttgttttcgttggcgatttacggttttacgaggcgtttttttcgtggttttttttattcggtgttcggcgtttttgtttcgggcgagtcggtttttcggttgttgtcgtcgtagcgtttatcgcgcgttagtcgggattgaggtcgcgagtagaagcgttttgcgttcgggacgtcgtcgtcgtcgtcgtcgggggttcgtaagcggaggaggggagtcgagatgaagagaatagtagcgggaggagagggacgggaggcgcgagattttaattcgtaggttagtttatagcgtagtttgcggggaggagcgtcggtttttttgtttgtttcgagttgtagtcgtcgtcgttattgttcgtcgtttggttgtttcgggttttttattatagtcgacgtcgacgtacggttaagtttttttttagtttttttttcgcgtttgtttttcgtagttttttttttttaaatcgcgagcgaaaagggcgagggggagaggagtttcggcggcggggatgattagcgatttaggagcgtggcgtaggggagagggggcgcgcgggagggggcggcggaggaggcgcggcgaattggagggtattttcggcgtcgggtttggaagcggttaattttagagttcgagtttttttttagttttttggggttttaggatgatattaacgtatttttttgtcgcggggagagcgt

SEQ ID NO: 7398 - DNA, 623 bp, Artificial Sequence
  Description of Artificial Sequence: Synthetic polynucleotide
cgatattacgcgagtgtgtacgcgttggggattgagttttcgaagcgaagttttgtcggaggagttttaggcgggagtgggaacggttgggcgtggggttagtaacggcgttattcggtagggtggggggagttaggtttgttagagttagagcgcgttatcgtcgtcgcgagagacgtcgcgttgtttaataggtagaggcgttttttagtagtttggtgggagtagagatataaaagtgttttaataaattcggagttggcgtgtcgatcgcgggttggtggcgggcggcgcggtgtttcgcgcgttcgggttttttggtttttcgggacggttttgtatgttgtgcgtttcgtatttcggttgcgcgtttcgattttagcgggaggggacgttcggttcgtaggtttttaggggaggggtggtttttgtaaaatggttttttattttttgttgttttgttttttttttttggtgcgagttatcgagttttacgagggtcgggtcgacgagtagagcgcggaggcggttttggtcgtgtttaatgtttcgtatttttttttttggaataattatatttttttcgattggtagaattttgtgggtaggaggcgttacggcgt

SEQ ID NO: 7399 - DNA, 1967 bp, Artificial Sequence
  Description of Artificial Sequence: Synthetic polynucleotide
cgatgatggaaaggatcgttaggcgattttttaaaaggtttattaaatattcgggttttattgttacgtttttattcgggggcgaggatgttttaaaaatattttttttttttcgttttatgtggataggtcgcgtcgcggtatttacgggtatcgcggaaaggggtataatcggggtggttttcgtttaggtggtagcggagatttagggttaggcggattaggtttggtttttatttttttttttcgggttttgttacggtttcgtttcgtcgttagtagagttttcggttcgcggtcggtcggttagcgtacgcgcgtaggtgtgtttgttaggatgtttttttcggcgacgcgtttaggttcggatttcgcggcgcgagagtgagcgttggcgggggcggtgggatgttttaagtcggcgtgaaagaggcgagagtgggcgagtacgggcggtcggattaggagtattttcggtgattatttagtttttattttattttttcggaaattgtcgggtaggcgggggatcggtcgtagggcggggttttttttggcggtgagtgagcgagatcgttaggttgaagtatcgggagattgttttggtagtttttggtcgttattcgcgtcgtaataaaagtttttcgcggtttttcgtttagttagtttcgtattgattggtcgtcgtgggagggattcgagttggttggaggcggcggtcgagcgttgtttttgtgtcgttcgcggagggggcgtattgggtgttttttggttcgtttcgtgcgttttttaatcgggggtcggtcgtttagggtaggtataacggtatttggagttgcgatcgcgatatatagttttttcgttcggtttttttcgatcgttttttagtatacgtttttcgtttagaatgttcgtttaatttatttagttttttgcggtttttgttttttttttttttttttcgtttattagagttaaagcgtaaatttttgggtggaggtggggggatgatagttggaggggagggtgggtacgtatagaagaattttttagggaggtcgggatggaaatagttaaaatgaaatgtatttttttgtatattgtcgaggttttttgggcggcggcgtaattttcgttattcgcggtagtattattattgttttttttttagttttttattgtttatattttgttaggatcgggaatttcgtttaaagaaaggagatagggcgaggtgtttcgggcggttatttgttatttttttttcgtttcgtgtaatattgggtacgcggcgcgtgtaaagatatacgcgcgtatacgcgcgcgtatatattaggtagttttaattacgtttttttcgtttttcgttttttcgtatttttttttgttaaaacgcggcgttcgatttttttattttttagtgttcgcggtcgagggtaggttttgtaattaattagtaatttggtaaatgaaaaattaacgttatgtcgattggggtgtaataacggttatattaataataacggtcgtgcgattttgtttattttgttttattttgtaaatcgttatttttttggggcgggggaagtaaagtagcgattttgattttattagatttaggaatataacgatttggggcggttgttttagttttattgtttatttttttcggagtcggggttgataagttatttttttttcggaattcgagttcgtgcggcggtattattcgagtcgcgatttttttcgtttcgtcgttcgtttttggggaaggagcgttgtttattattagcgcggtcgttgagtttttaggagtcggtcggttttgtttttatcgtcgcgggcgtataaagtgggaagggcggacgcgtcggaggggcgtcgggcgttggcggttcggggaggtagtttcgtgtagcgtagttttggagggagcggggttcggttgggtagtaagggcgacgcgt

SEQ ID NO: 7400 - DNA, 2558 bp, Artificial Sequence
  Description of Artificial Sequence: Synthetic polynucleotide
cgtttcggggtggggacggaggtcgttaaggttgggatgagtatttagtcgagtcgagttatcgcgtgttttttcgtagatatcggggtttttgagaattaggagggaatagttaaaagaatggaagtttggcgttttgaaataagttttttgggttttgagggaaatttgggcgtttacgggtagtcgttttttttattcgtcgttcggcgttcgcgattcggttggcgttggttgtagcgtttagttaggcggcgcggggaagagtcggcgataattcgttcgagtttcggggatcgatcgcgtttttatatttttttagtttttagcgatttttatcgagatttggagacgattttagtaaatttggggaagtaatttttttcgaggagttagatttttgaaagaaggagagttgagttagggacgagggaaagcgaaagagacggggaggaacggcgatagttcgggcgggttggatttcgcggcgagagcggtaggggaggcggattcgtttcgcggcgaaggggaagtataaaagtttcgtagcgagttgtgggaggaaaggcgagaaggggtttgttcgtttttttttttcgatttagggtcgtgattttttgggagcgatcggttgggttttaggtttttggttagcggcgttagcggttagcgcgttcggtttaagtacggtgcgagcgtttcggggaggcggcgagcgagtcggtgcggagcgtttcgtgcgttcgggtggtttcgcgggtcggcgggatcgtgcgtattttaagcgcgtgcgggagtgtgcgaggcgttgtgcgagttagcggcgggcgcgttagggtgggaaaggtatttcgaacgtattaggtgtagagatcggtatttatcgagagcggtcgggagcgtacggcgagtttcggtgttatcgtcggtttcgtcgagagtcgaggagggttcgtagcgttgtagattttttggagttttttttttttttttgtaaaaggggggtggggattaagtttaattaagaaaaagtttattacgtttttttaaagagaaataaaacgtaagtagttttagttttgttttttttcgtttttagatttattcgttagttttttcgattttagttttttagtcggtcggcgaataaatatataaataaataaattataattttattttgcgttcgcgtatcggttcgtatatataagagtatttacgggttttgttgtttcgttagtttttggcggtataaagttttcggattttcgatttttttgtttacgtttttagttttcgtatatcgttacgttttttattttttatttcgatcgtgttttgaagaggaagggttggggaggtagttgcgtttaggttgatagtcggggtttttttttttagtcgatttttaatcggtggcggcgacggttgtagcggtaggaagggaatacgttaaataaaaaaggtataagtttagcggtcgagtggtcgaagcgagcgcgcgttttttagatttttttagtttcgggaagtttcggcgcgcggcgttcgttgggcggtgcgttttttttcggttttttatttatcgtagtcgagtcgggtattgtggggtgggtgtgcgtgtttgtcggggggtgtgtgtttgtgtcggggaggggtgttgttggggaattgttgtttttcgtattacggcggtagcgatagtatcgttcggtagttcgtagtattcgtttttatcgtttttaatttttttttgttgcgaggttagtaaattattatcggttgttgcgttttcgtcgcgttttacgttaacgtcgagtttttttttttgtaaggtttcggcgtttttttatttttagtgttggcggtcgagttcggttttttgtttatagttgtttttttttttttttttttttcgcgtcgttttcgggtttagttcgtttattatttcgtattggtcgagttcgcgcgcgtttttcgttttatttttttttttttttttttttttttttttttttttttttgcgtttcgcgtttcgggtttcgtttgatatttagttgttgttggggcgtcggcggtcgttttttatcggtcgagcggagaggaaggaaggagttagaggataggagtgtatggggatttagaatttttaataggggaattgagggtgaagggcgcgtagtagtttttatttatttttaagattttaatttgtattggatacgggttttgttttttttttttcgtatttcggtgtttaagtacgtagttttgtttttttttttaatgtttgttttaatttagtgcgtgttatttcgtttttaattttttttttatggttcggggttgtagtttttttgatatttgttttaaaaggtcgtttttttagtttaaattcggtttttttatttttttggttattgcgcgtttttcggtttgagtattcggattttaataagtttttcgaggtagagttcgcgggcgttagtgaattaggtgttagaaggttcgcggggatttattgtcgaagcgagatattcgtttttagttgtcgcga

SEQ ID NO: 7401 - DNA, 2558 bp, Artificial Sequence; identical to SEQ ID NO: 7400
  Description of Artificial Sequence: Synthetic polynucleotide

SEQ ID NO: 7402 - DNA, 1508 bp, Artificial Sequence
  Description of Artificial Sequence: Synthetic polynucleotide
cgttttttagatagcggagtcgggtcggggcggtttggttcgggtcgtcgtttttgtttttgggtttgtggggttggggttcgtttgggtttcgggttcgcgcggcgtttattattcggggtgtcgcgggggggcggggagagcggtcgtttagtttagtttcgcggatgataggagtcggggagtcgaggagggaggagtcgtcgtcgtagtcgagcgttgggttgaggagtagagagagcggggcgtcgagtgcgggcggttgggagcgcgttgagcgggggagaggcgttgtcgtacggtcggttataggattattttttcggagaatagggtttttttatggtatgtggttggtaattttttttttgtttttggattttttatataaaggtgagatttgcgcgggcggttgggcggcggaggcggcggggttagggtggcgcggttggcggcgaggcggggtgttcggcgggttttaggtgcgtgggggaatcgatcggggtgtaaggtttcgggtggggcgtagcggggaggggtaggtattttgataggggtcgagtgagagttagttttcgatcgtttcgttagttattcgcgtttgtcgttttggggcgcgttcgtaggggtggtggtaaaggagttttttatttttttgttttttgtacggcggtagttttgttttggattttttttttagttttttgttttttttttgcggtttggtggtattgggatttcggagtgtttttcgagtcgaggggtttttaggtcgtgatttttgatttaggagtttttgtttatttaggtttcggattcggcggttgattttttcgttatgttcgtgcgtttttttttcgtcgcggattttagttttggcgcgaatgttggcgtatcgtatggcgtttattcgcgtattggttggaggtagggtggggatagtgagagtttcgagagttggaggtttttcggatagtaagtttgttttttaaatttagaggttattttttttcggttttattttatttttttgtttcggttttagtttcggtttggtgcgttatcgtggttatttcgggtagcgcgttttaagatgcgagatttttcgttttcgcgtttggttagttggatttggggataagtttttaggttggggggcgtgttttttttttcggagagagggggttgttaggggtgggtttaggtgttcggtatgtttagatttgcggttggggcgttgcgtatttgattcgcgaggtagtcgggatcgggaggttggaagagggtagatattttcgattgaagttatttgggtattgagtcgggattaggtaggcgtaggtagtttgggttttaggttatcgtagaggacgtgttttcgggcgcgtagatggcgggagatgaggcggtcgaatttcgcgtttttgcgtggtggagtatatacgttttaataagtttagcgttatttgtttagttttttaatttttttttttttcgtttcggggcgg

SEQ ID NO: 7403 - DNA, 1119 bp, Artificial Sequence
  Description of Artificial Sequence: Synthetic polynucleotide
cggtggcgatatggtaggtagtttcgcgtggcggcggtcgggatagttgggcgcgttggtaggagagtaggtatagcgttttttataggtaggatgacgcgggtttcgtagttcgtttttttacgttgtttcgtattattgtttcggttttgacgtgcgtgcgatagatttatcgtaaatagtttttagcgggagtacgaggtcgggataggaggtgggcggttatataggatattttattttttttattttttcgtagtcggcggagtcgatcgtcggaaaagggaggcggtgggcgaaaggaaagcggggagttgggagaggagttgtaaataaagagttgtttttgtgcgaagttttgagtcgggtttagttagttcgttttttgtggtttacgtattgttcgtcggtttacgcgggagtttcgaggggcgaggcggaggttgggcgtagtttttgtagttagtagttattttcgcgcgtttcgtcgcggtttagttaattatttgttgcggcggcggtcgtgttttttagggtgtattagtattttcgtcgcgggcgttgttttcgcggcgtcggtatcgatgttcggttatttttaggttcgaacgattgcggttgcgggaaggcgggtcgaggggggttacggtattttagggagaggtcgggagtcgttcggatttcggaggggatggggttttttttgggaggtattcgttttttttttgggttttaagattttttttagttttgcgtttcgattttatttttttcgaaacgtcggggaatcgggaaaggagggttacgggtaaagcgggggcgggcgttttttgattagtatgcggcgtcggttgttcgggttcggattttcgagtttttttttcgcgagcgtatattaataagtttataaatggaattcggtggcgtcgtttgtaataaaaggtagaagttgcgtttcggcgttttaatgagagtattttttttcgtaataaggggttggatttagttgtttggtgtcgtttgagcggggcgagttgttagagtaattaaggtttagcgcgtacgtggggagagggagttggttggggttttagcgttagtcgtcgtttgcgcgttcgg

SEQ ID NO: 7404 - DNA, 1119 bp, Artificial Sequence; identical to SEQ ID NO: 7403
  Description of Artificial Sequence: Synthetic polynucleotide

SEQ ID NO: 7405 - DNA, 653 bp, Artificial Sequence
  Description of Artificial Sequence: Synthetic polynucleotide
cggaagtaaggcgggttagttatcgtttcgagttaaagtttttgtagttttggtaatttttcgcgcgtttttgtttaggagttttatattttagagaaatttttcggcgtttttagtttcgttgttttttttaggttttgggatatagttttaagggattgagcggttcggacgggatttgaaatttttggaggattagttacgttcgtatagttcgtttatgcgcgttggtattaggattcgtaggttgttagcggcgagttttcgtcgcggttttttagggtattttcggagaagggggcggttttgaggaattttttgtatttcggatgttttatttttttcgtttttagcgttttagggttttgttcgggttttggtcgcgcgtggtgttttttttagtcgcggagttttgttttttagtgtcgttgaaaggaaagagaaagaaaacgttttcggttttggaggttttgtttttttttgaagcgatgttattttttttttttatttttttttttttagattttttttggggtttcggtagaggcggggcggttgcgtttcgagttttttttcggcggtagcgcgggagcggggttggaaaagagggcgtcgggagtcgtttcgttttttatcgtttttggttttttcgt

SEQ ID NO: 7406 - DNA, 1768 bp, Artificial Sequence; identical to SEQ ID NO: 7396
  Description of Artificial Sequence: Synthetic polynucleotide

SEQ ID NO: 7407 - DNA, 1101 bp, Artificial Sequence
  Description of Artificial Sequence: Synthetic polynucleotide
cgttgcgaggattaagggagatggaatgtagcgtaaagttttacgtaaacgtgtcgtgtaatatgaagttttttattttgagttggggagcgggtggtacgcgtggaagttgaatgttattatttttgggattaggcgtagcgttttttagaagcgtttttggtgacgggtttttgtttttttttaggacgttttttttagaatgtttcggggttttggacggttttggagaggacgggagggaagggaaggagacgggcggaacggggacgtatttgtttttattgtatttttttcgtttttttatttttagttatttgcggaggaggaagcgttttcggcgcggggacgcgttgggtgtggagtagttggattacggggtgttttcgtcgttggagggcgtgatttcgatggacggtagttgtaggaattttttgtcgggggttaagacggcgggtaggtttcgggttagttcggtttttaggttttgtttttgtacgttttttatgcggcgtattttgaagcgtcggcggcgaagcgtgggggtcgacgaattggattagatcgggttgttttcgggcgtattttgcggttcgggtatttgtagggcgggtagcggtcggttttttattatgttggtcgtcggtatgggggtcgtcgtttttgcgttttttttgagtttttcgttagcggtttggttcgcgtttttttttggttgttttttattttcggtttcgcggtatattttttaattttggggtcgaaggaataagtttttttttcggagcgtagcgaggaagggacgcgaggggacgcggcgtagcgcgtcgtcgttcggagtttaatttttcggagcgcgcgtttttcgggtcgttagtcgtcggcgaggttattcgggaggggcgggagtcgtttgttagttattcggtagtttttttggggtttttttcgcgcgttcgtttgtttttttttcgttgcgttttttcgtttgttggcgtttttgttttagcgggattcggtagttaggggttttagggggcggtgtagtaaatttttagcggtttgcgtttagtagattaggttggggagtcggtttggcgt

SEQ ID NO: 7408 - DNA, 1101 bp, Artificial Sequence; identical to SEQ ID NO: 7407
  Description of Artificial Sequence: Synthetic polynucleotide

SEQ ID NO: 7409 - DNA, 2341 bp, Artificial Sequence
  Description of Artificial Sequence: Synthetic polynucleotide
cggtttttgtaacggaggcggtttcgaaggacgtaggattttttcggaggcgatagttttaggagttttggttttggagtcggcgtacgtttaggcgcgaagggcgggggttcggggcgttagggatttgtgcggacgggggttggggaaggtttttcgtcggagaggcggcgaggtcggtttaggagtttcgcggagtcggcggttttttagcgtttagagtcgggcgattgagtgtcgagaggaagggaaagcgttgatatgtaaataggggtttttatttggaggagttcgtttagatagatttttcgatatatttatttgtatttttattttcgtgtaacgaggttatttatttattttagggtttattaggtagggattcgagttcgggcgattgtagttttcgttttcgtcgtgtttcgtttttgcggagaggaagtttagtgtttagcgttggggttacgggagtttcgggtgtcggtgggagtggtggatttcgaggtttttcgtttttgatttcgtttcgtattttggggtttttcggtttttcgtcgtttttttttgtagtttcggcgggtagcgaggtgggaggggggtcggggttttattttgggggttgggatttcgggggagggtcgtttttaatgcgggcgtttggtcggttggttcgcgagtaggattcgttattcgagcgtcggaggagtcggcgcgaagtcggggcgcggagggaagggagagaggttacgtttttcgggacgcgggtttcgtatttattcgttcgtcgtttcgttttttcggtcggttttcgtcgttcgcgttcgttgtttcgtcgtttattttaatagtttcgtttatttggttaagtttgtagtcgagttttttaatattttatatattgattcggttatagtttgatttcgtagttttttcggattagttcggcgcggtttttttggcgttttgggttttttttgcgtgttttttgcgagcgttttgtttttatttttttgtgtacgtttgttgttgtagcggagcgaaagagatagttaatcggatgaaattttttttttagttaattttgggaagtgattttattttgcgaatcggggaggaagttttatttttttttttttttttttttttttttttttttttttttttttttttttttcgtttcgagtttttttttttttttttttttttttgtttttttttgttttttttttttttttatatttttttttttttttttgttggttttgtttttcgtattatatattatataaatatacgcggagatgtttagatatatttatgcgttgcgtatataggatatttgtttttgggagataagagttagtcgggaataatgacggggtttacgtttagcgttcgcgttttgattttcgaagtttgaatttttttttattatttttttttaaaatttaaagttaaagatttttggtttttttgttttttttgaggcggttggtcgaaggtggtttttttgatttatttatttttcgtttttttttatagatacgtttattaatgttttttttagtcggagataaattttttgggggtggggtagggggggtatggagggagagttggttagggttgcgggtaatttagcgtttattgtcggggaagattcggacgaaaatcgaggtaaattaattattaaaaagtgtatttaataagaatttttttatttaggtttttcgttgtcgagacgcggtagatttttagagcggtttatttatttatcgaagcggattttgggcggtttcgggttgattcgcgttgttagggcgcggattttatttcgggcgtattgttaggagaaggggtttttcggggcggcgcgtttcgattttgggttttcggtgttcgtagagggcggagattcgcggcgttttaggttatttattcgtattttttcgagttaaatttttagcgtttattcggattcgacggtttaagtattgatttttaggtaagagtcgttttttttggtttttagggaattgatattatcgcgggacgttttttttaggatagttagtaggttttaggagcgtagtacgtaatagcgtagagtagatttagatttttttcggggtgagattcggaggttcgcgttttggatcgttttttttatttagtttggaggtcggcgtttttcggtttaattcggagattttttcgttttttttttgggtcgtcgcgcgttttagttggagtagtttcgaggggttgggttttttcggtcggatttttttttttcggatatttaaaataggttattttgtttacgtttttcggattacgt

SEQ ID NO: 7410 - DNA, 3857 bp, Artificial Sequence
  Description of Artificial Sequence: Synthetic polynucleotide
cgagtagaaattatcgtgtttttgggggtttttcgggcgtcgtggggcgacgcggtgtagcgtttagggtcgtcgtaggtcgggggtagggtttttagcggttttttcgcggttagcggttacgtaggaaaaattcgttttttcgtttttgtatttgttgataagtcgttcgaggtgtttgcgttgagcgtggttatatcgatgtagttttttaggaaatggttcgggagggggagggggcgagtgagggattaggttcggttttttttcgttttttttgcgtaaatattattattttttttttttttcggaggtatgaggtttttacgttcggtttttcgttcgtattttcgtcgattttttcggtttcgcgttttattcgttaggttttttttttgggagtcgattgcggtgaagtcgtcgttagtacggtcggttttgatacgtgttttaacgtatgtttgagttaaggttgtttttataggagatacgatttggtggcgtttttttattttttttttttcgttattttttatttttatcgcgttttttggtgtattttattttaggaggaaggggagagattagcgttttgatgtgttggttaagttggtacgtgtagcgggtatggcgtggttcgagttttttgggtatatcgaggtcgattgagtgttttttttatcgagagagggggttcgggtaggggcgcggagagttagtaaggcggggtggggcgcgggttgggtgagtcgtatattaggttttttgtaaggcggaggaggggagcgaataaattagaggtgtaagcgattaatttaggtttcggagttagtttttttaaacgagggtggggcggaaggggtggtgggggggaaaggaggggatatcgttttaaaagggtgaggaagagtttggggcgtcgttttttttttttttatttgtatagttaatagttttggggtttttgttattgcgcgttgattgttatcgggtagattattttttttttttttttttttttttttttttagtaggacgcgttttttattatattaaaaggaagttaagggagggcggagggagagcgggcgttggggcgggcgaaagttggggagaggttcggtcgttttcgattttattaatagtagcgggaatgagtattttattttttatatgtaaagaaaggggagggaaggggcgggcgaggaaaatgtttaattgttgtggaagttattagtttttaggaagaaaaaaagttcgttgaaaaatttaagttgtaaatttaaaatgaaatagtttagcgtcgcggatgatattcgggtcgaatatcgtgtatattcgtatatagtcggtttcgaataattatttattggttttagttacgttgggtttttcgatttaagtttttgagttatttcggataaggatatttatttatattttaagatttttataagggaattattttaattttatttaagttatttttgagcggattaaagaaagttgtagcggggagaggcgagagaaggagggagggcgggaggtatttttaaagtataaatttaattcgataggtaagggatagaggtcgtcggggtttttagtttttggatattatttgatatagttttgcgagtaaggttttttttatttcgatttcgtatattttttttttttcggggaaaggtatttagagttttgggtttttcgaagtgggggtagcgggggcgaggaagaagcgggtggtcgtttcggggtttagtttatttcgaggagaatgtttgggtggcgagtttttacgtttcgggagtgagtcgagggttttttcgttttttttttttttttttttttttatttcgttttgttttatagagaaattttagcggggaggggggtagcgaatgggaggggtagagagggtcgcggtcggatgtttttttttttcggcgttttttgtatttatggagattcgtaagttcgggcgtttttcgcgtggtaggttcgttttttgaagtttttttgtttattttttttttcgattattgattgttttcgagcgtgaagttcgttatcgaatttaattttcggtggttttgtagatttttatacgtggggtggggcgtgagagggtgcggaggttggtaggaatgtttttaggaggtttggattggaaattgagtttttttttttggtcgttattttagttatgtgttaaaattttaatgttttgttaaaatgtattttatttagtacgcgggaaaacgtatgttgttttttaggtaaaagtgtatatttttttttagtgtagatttcggttttaagaaaaagcgtaagagtttgtgttttggttttgaagtttaaattgattatcgtggcgcgggggtggggggcggcgggagggggtagattgttggtttttttttattttttttttattttttacggaaaaaaaaatatatatatatatattttatgtaggattggtgataaattttagcgaacgttagttttattggatttttatttttttttcggtcggttttttattttttacgttagcgttttggagtttcggttggaaagtgtataaagtttggaggtggagggtgtagtagggtgttgggtgtttataggtatttttttgtaggagtttgtagtattaagtatatatatttttaagtttatttggaggatgttttttagttaggtgatttcgcggtcggtttaaggttcgggagtagcgcgagttcgagtttcgtttttttcgcgtaggggcgtttaggttaggtggggagcgggtagtgattgagtttaggtttagaaatgggagttattgtttttttttcggtttttttaaagagtggagttgtgtttgtgttttttcgtggagggatggacggttaattaaaatcgaaaattcgattggtaaaatgcgaggggatatataaattcgaggggatatataggaggtatattaagaggaaggagggagtgtaggtaaagtagaaaaatgcggataaggagaagaggaaaacgtcgggaagcggagagtacgggggagtagggtgggtggggacgggtagtgcgattgtaggtgtttattcgttttcgggattttttggtcgtagtcgcgttcgtcggggcgttgggtcgttgcgttttggaggggggtagagttcgttaggtttgtgtattcgtatttttttcggcgaatttcggtttggacggggttggattattgaggcggtagatgcgataggcgtgagttaagaaggcgagcgtttgtcgtttgttatttatttagtattttattttttttttttcggaaaaaaaaaaaattaaaagattcgaatttttttttttttttgtttgatttagtttaggatacgttttacgcggtcgaaaatagttttggaaatatatttgttttataaaagtgaattttttaataagttttggggcggggggcgttcggcggtcggcgtcggggggttttgtttttcgggaggagaaggaatcggtcgttttcgtttttttttttttttaggcgttttcgggagggggtcgttgggcggcggaatcgcgttttcgttcggggagttattacgcggttttttcgcggaattttgacgttatttatacgtgggggaaggggttgggagagtaagaggaagcggcgggggagggggtcgcggttgggagagcgcggcggcggcgcggcgggtttggtattttcgcggtgggcgtagcgtcgggtagggttcgggttttgggtagcgcggtagaggaggtcgtgtcgcggatttcggagttagcgtcgcgattcgttttttttttcgtttttcgtttttcgt

SEQ ID NO: 7411 - DNA, 1439 bp, Artificial Sequence
  Description of Artificial Sequence: Synthetic polynucleotide
cgcgggttttttcgttaagcgggacgtcgcgtcgggcgggtgagagaaagttcgggtaggagagtatagagtcggcgattggacgcgagcgcggggcgggtggagagcgttttttcgggcgtcgttgttgttgtttcgggtgttgaaaagtcgggaatttttcgggaagtagcggtatttttttttttggaaggtgggtgtgggggttttagattgcgtatttgttaaatttttttgggtttttcgggaggggttcgttagatgtgtttttttttagttttattcgggggagaaggatgggggcgggggcgtgggggtgagtatagtcggatatcgtaagtgggaatttggggtgttttttttcgtagttttcgggtagtcgcgcgtcgcgaatttcggtttatttgtaagtaaggcgggtcgggggtagagggcgtcgggttgtgcgggggaatcggttcgcgtttcgggattggggggcggtggaagagagagcgagcgggtatgcgtagtggggcggaggaggtggcgatggtcgggggaggcggggggattgttgtttatttgtagttgggttaatttcgcggcgtaggcggcggcggagcgcggggagttcgcggcgggtttagttgtcgtagtattatgttcgagttttttttcgggtagacgtcgcgcgtcgtcggggtttcggtaggggaggatgttagacgttcgggagaggttagggtagtagcggcggcggcggcgcgatggtggtgattatttttgttcgaggcggcggcggggatcgtatattttttcggcggcggggttgcgggttagcgtcggtcggggtcgcggcgttgttggtcggggtaagttgtttgtgttacggtcgttttttgtagggcgagttcgtgtacgacgacgtgtgggcgatcgtgaataatttcgacgtgcggttcggcgtttcgtttcgttggggtatttttattaacgatttttggggtaagggtatggtcgagaatattagttataagttttatcggtcgttttgcgtttttatttttaagtgagttttttatttcgcgttagtcgtcgttgttttttttatttttcgttcgtttttcggatcgggagaagttgcgggattgatttgggggtattttatttttgtcgttttttttttttacgttttttttttttttaggatgtgtatggtattttgtttcgggatttattgttcggttaatttgggttttcggggcggttcgggaggcgtcggttggggagttgggatcgagttttttaattgtttgtttttttagcgggtttttttttcgaggtagggttgggagcgggttggtgaaatcgttttcgtattttttcgtttgtcggatcgtgattaagtgggattagcgcggatttagagggtttcggaggggtggcggtggtggcga

SEQ ID NO: 7412 - DNA, 1288 bp, Artificial Sequence
  Description of Artificial Sequence: Synthetic polynucleotide
cggagagggtttttcgggttaattttgggtaacgatgagtattttcggtttcggtaggggcgtcgggtcgttcgtttttttttttttttttttttgcgagttttttttttagaggacgcggggagtcgggtttgcgcgtttcgtcgtttgttatttagcgttcgcgtcgggttgcgattggacgcgtcgtcgttaggtattcgttagaaatattagtgcgttggggagaggaggggggcgtgtttgcgagtcgagggtttgttttggtttttttacggtttttttttttttttagtattttatgtcgggtttttagttttagcgcgtttcggttcgttcgcgcggcgggagagttggcgtaaatttcgcggtagtcgtagttttttcgcgcgttttttttttttttacgtttttcgttttcgttatggggttaacgtggggtttttaagagttgtcggtttttagcggcgtaatttttagttaaagttatcgcgggcggattatggtttagggcgttagaggggttagaggtacgggaagaggaaaagacggttaattgggaaaaaaagagaaaacgaaagaaaagttaaacgatgagtttttataaggaggacggagtgaatagtttgtgttagaaggttttgtatatcgttatcgagttgtgtttcgtcggttaggtggagtgggagaagtgttcgggtattttttttcgggataggggtagttagggcggaagtagtataggtaatcgggagggtttcgttcgcgttttcgcgtttcgttgggatttcgcgcgttaggttgtaagtttcggggttttgcgtttttcgcgtcgttttcgcggtatatttggggcgttacgtttttttatttcgttttttttttcgtttagtttttgacgatttcgagggtggggcgtttgggttttgtttttttttgtttatttgtcgggttttttttattttttggttcgtttttcgtttttcggcgtcgtttttcgtttttagtttcgtcgcgttttttcgcgtttttttacgttttttatttttttttcggagtggagaagtgagtgcgggcggtgacggcgtcgggacggttcgcggtttggttgtttgtgggggcggtttatttgtgggattagggttgttttcgttcgttttatcggtcgttggtttcggttttgttgatgggggttaggcgggacggataagttatgtttggacgtagaatttttttgtagaggtggttgttttggttttcgaggtaattcgcggttgtaatttgtcgg

SEQ ID NO: 7413 - DNA, 1006 bp, Artificial Sequence
  Description of Artificial Sequence: Synthetic polynucleotide
cgagttcgggtttttacgttttatttggtagggggcgcgcgggtttcggagttgtttagtattttttggttaagttttttgcgtttttcgcgttcgggaagtttttcgcgtcggggaagttttttagcgtttcgttttcggtagggaatttttttattaggatattcggggttttttaggttcgttattcgtttttattagtttttatttattttgtttagttttatttcggtagtgtagcgtgttttggtggttttttttcgtacgttttggagggggagtgttttgtatttcggggttgtttcggagtttagtgtacgagtgtatatgggttttttttttttgtttaaagggtaggcgagcgttattcgttttagttttgttttttgtagttgggtggtttttttttttttttgttttttaagatacgcgttcgaaatcgaggggtgagagtaaagatcgtttattaatttagtattttggatttagagtttttaatttcgaaaggaggttggtattgttcgggttatcgagagagggagggagaagagttgaggttgtaacggtttttgggttttttagatcgggtttggtatttaggagatcgtgcgggagatcgacgttgagcgtcggtttcgttttcggcggttttttttttttttttatttcgtttttttcggttcgtttttttttttttggaggagtagttttttcgcgcgtttttcggagttttttttattgtttttgtttttataataggttcgggcggcggggaagacgggggggtgcggggtcgttttagttcgggtttttttggggtcgttttttttttatcgggtgtgcgagtttttggttgtttttattcggttcgggagttaatttttcgacggagtcgcgtcggggcgagttcgattttttttttcgggtttttttcgggtcgcgttgtcgtttcggttttgcgtgtgggaatgatgtgcgtattggagggtttaagttttttacgcgt

SEQ ID NO: 7414 - DNA, 1185 bp, Artificial Sequence
  Description of Artificial Sequence: Synthetic polynucleotide
cggagagttagggttcgtttaataggagtacgcggagatattttagacgatagcgcgttttttttatttttatttcgtttttcgggcgttttaggttagcgtttattagattttacgtttgggggattgtttgggttttagcgagagtgttacggttttgtacggtagcggggaggtggcgagcgcgttcgatttacgtcgtttttacgtttatttttttttattacgagttttttttttttgttatagtattatttttattgttggtcgcgtttgttattttgtggggttggtgatatgaatggatgggttggatatatttttcgttcgtttagaaaaaaataaaaaataaaaaaaaaattcgtttagatttgtatagagagggggaaagatttttttttgcgtttttagagtttacgttgtcggttagagaaatttatagttttttttttttatatttattttttttattttttaaaaaaacgtttaacgtaaataaataatatcgttttaagttcgtcgtcgtttcgggtggttttttttttttgtttggtttcgcgcgttttagttttgcgggaggcggcggcgagaagttgcggttttgggtgcggtgcggggcgttcgggcgataggcgggcgtaaggcgggcgcgtagtagatcggttggcgtcgtattatgttttttagcgcggtcgtagtttacgtcggtgcgtattgggacgttgtggtttttttcgcgttttttaattttttcgttgcgttcggttttggtaatttgggtaagagttttttgatcgagaatttgttgcgggtcgggggcgttttaacgtttaggttgtagtcgttcgcgttttacgattcggcgatcgttttggttatcgcgggcgcgtagtttcggtttttgtttgttagtttagtttttttaaagttgtgtttcgtagtcgaataagttagtttcgtcggggcgttttacggaacgcggtgggttttttaagtgtttagtttttttgcggatagtgcgaggttgtcgggtcgggtttcgggggatcgagattgtattttttagtttttagcgttaggtgagttagtttttttttttttttttagtcgcgttcgcgtttttaggtcgggtggtttagggatttgggagcgtcggcggtgcgtattgcgtttagggagagtcgg

SEQ ID NO: 7415 - DNA, 409 bp, Artificial Sequence
  Description of Artificial Sequence: Synthetic polynucleotide
cggttttggttttacgcgggtagcgttagttggtcggtgttacggagttttcgcgtttttcgttcgtttagttttcgcggatttatttattggggttgtttcgtagcgcgatttttttttatttcgggggagggttaagggcggcggtggggggcggggtgggggggaagcggcgggagggggcggtgcgtcgtcgttttatttcgggttcgcgaattcgtagcgtttttcgtagtatttttttaggttcggttttttttttttttcgcgtcgatggtacgcgtcggttcgtttggttcggttgtagtggatgttgttagaatttacgcggaggaaggaagagacgtaggtaggttgcggttatttaagcggttattcgggttttagggatttttttttcgagagacgg

SEQ ID NO: 7416 - DNA, 1813 bp, Artificial Sequence
  Description of Artificial Sequence: Synthetic polynucleotide
cggggtcgttgcgtttttttgattattgacggttaggacggttttagtttcgttttatttgtaagttttattttaggttcgagttttcgagggtagggatagtttttcgggtttcgaggtttgattagagtttgaaagtttttgtcgggggttgtttcgatttagcgaggcgttaggttgttcggcgcggttgggggcgtttagcgtcgggattttagttttgtttcggtcgttcgttggtttagtgcgtacgtttcggtagtttagtttttttttttacggcggtaggagagttttcggtatttgtttggggcgggggcgggggcggggcggggcgggcgtcgcgtttttttgtttgattggtaggaagatagattaatcggaggggtttttcggggggaggggcggtgtcgtgtttgagtcgggcgcgggcgatcgagggagttgtagttattcgcgtgcggtacgcgtcggtcgtttgttcggatcgcggttattagtgtcgcggtttttcgattttcgtttcgtcgagtcgcgcgcgcgattgttattttttttaattgttttttacgattttttttgtgtatgtatttattttttgtttcgttttgttttttttaaggcggtggcggcggcgatagcggcgtaagttcgtagcggggagggggcggtcggaggatgcggcgcggggttgcgttcgttacgttcgttgttgttgttcggttcgggtttgagcgtcgagtaggtgggtataggtgcgtcggggggcgggaggcgagcgttggttagagggaattcgtggattcggcgatcgaggggcggatttggcggtaagggacgcggcgatcggtgtcgtttcgttttatcgtttatttttttttttttcggttatcgcgttttttttgggttttttttttattttcgtattttattttagtggttttttatttttttatatttattttttatttttttttagatttttttgtaaaattttttagtcgttgcgtcgttttttttaatattttttttcggtttcgtttttagtttttagtttttttttacgttatttttatttttattttttttcggatttcgtttttaagttaaggagcgggagggggatttattcggtgtttgtcggagtggcgcggggggtgtggtcggttcgtttttttcgtgtttttcgtagggtaggttatagttttttagattttcgtttaggtggtaaagaagatggagttgggggtcgcgtttcggcggcgcggggttcgaaggcgaggtcgtttagttcgtattttattttacgtacggtatacgtcgtcgcggtttttgttacgtatattttcgcgttgtttcgtttacgtgggcgtcggggaggaggttcgagagatgggaagaaaggttggtatttatttttttgtcgggtcggcgcgttttgggcgtattggttttcggagatggcgcgtaaggattgattttcgtggtgttagatattttgtcgggcgttttgcgtcggggttagcggtttcgttggtttgcgttagtgcgttgcggtttcgttttttagtttttcggtttttcgttttattttttttgttgtgggtttttgagtattcggtttgggtagtttagatagaggtcgtttacgaggttggcgttttttttcgttttagaagtatttcgtttttatatattttagttcgtcggttttttgaaggttgggttagtttcggtttttcgttagtttttgttcggttttttgagttttagcgatattgtatttaatcgttagttttttttcgtcgttcgt

SEQ ID NO: 7417 - DNA, 1294 bp, Artificial Sequence
  Description of Artificial Sequence: Synthetic polynucleotide
cggttggagaagttttcgttagcgttgtttgtggttagattcgttttttgttttttttcgggcgtatatatacgtttatttagatatttcgcgcgttttttcgcgtttttgtttgttcgttcgtcgtcgtttgtttttttttttttgttttcgtcggtcgttttttttttttttttttttttttttttttttttttttttttttttttttttttggtattatagagttgttttgaaaatagaagatagagggagtttcggagttcgttatttttagcgatttttatattgggaaaaaatatggagttagtttcggtagttttcgatttcgtcgttagcgagttaggtagtagcggcgcggacgcggtcgtcggttttagggagatttcgttgaattaggaattcgttcgtaagagcgagtcgtttgtttcggtgcgtagatagagttattttagtattagtagaggtaggaggttggagaggggttggggagggggcggcgggagttcgggcgcggagcggggggcggtcgggagcgggcgttcggggcgcggggttcggcggtcgcgcgcgagtttgcggcggcgtttcgagttcggaggattttttttttttttttttttcgttttttagaaatgttgtaaatttttgtagttcgttttcggtttgcgggagtagagtggggcgggggaggcggcgggaaggttgatagtcggcgggtttatttttttggttttgatttttttgtaaatattggaggaaagttgcgttgttttaattaaatacgtttttttaaaatacggagatgcggggagtgggggttcgggaaagaaatttttaaagcggtagtgtttttttaagaaggggtaaaaaaatttgtttatggttatttttttttcgttttattttttttttttttgatagtttcggttttggttgttcgagtcgggggtgtgttttcggttttttttagatttgggcggggggcgggaggagtgagcgatttgggaagtttcgggggtggagagggggcgtttcggggtttgggggcgacgtggatattttttttggagtacggcggtgcgtttgggatttgaaggaagggtcgaaggaagcggggtgcgggcgggcgagttgttcgttaagttgtttggcgggcgcggcgaggggagatgcgtaagtttgtagatcgggggttcggagttcggcgtttaggttggcggggggcgtgtgcgcgttaacgcgtagagggcggcggttttgtggggcgttttacgcgtattcggagggagcgt

SEQ ID NO: 7418 - DNA, 939 bp, Artificial Sequence
  Description of Artificial Sequence: Synthetic polynucleotide
cgtcgtaaggttatgggtcgaagtggtgtaggggcggcgttcggggaagcgattggtagagttgtgcgtattgggggtgttgtaggcgttggggagagtgtggagaggttgcgtggagttgcgcgttcggggtgggggttgtatttttaatgaagcgcgtgaagggtaagcggtgatgggttttgcgttagtggggttgggagttcgttcggggttgtatatggggttgcgcgtaaggtgaggattgcgtatgtgggtttggggtttgcgcgtatcggaggttgtaggcgttggggagggtgtggggggttgtgcgtggggttgtttttatcggaagttgtacgttttgggaagcgtagaggcgggggtgttgttcgcgttggggagtacgtgaggggatatttagggattgttcgcgcgaatggtttttaacgtatgcgttttattttatattttatagtcgttatgacgatcgggaggttcgtaacggttgcggggataagttcgttgaggttgttaggcgagttaggtttttttggatttcgtttgattcggttgggttgtgtttgaaattgatttagttttattatattttttgattatgagaaaataaggagtaagtttaaagcggttgtaatttttcggtcgtagttagtttaaggggcggcgcggggtttttttcgttcgggagtcggaggtagaggaggagatggaaaagtcggttttaggcggcgggaaattgttaaggggtttttggaggtttttttcggggaggatttaaagtttgaaagagcgaaaaggtttggagttagaggtggtggttaagattttttttttcggttttttttagttcgttcgtaattttttggcgtagtttcgggaaaaggtgtaggaattgtaggcgcggcggttttttagtagaattattttcggtatcgg

SEQ ID NO: 7419 - DNA, 939 bp, Artificial Sequence; identical to SEQ ID NO: 7418
  Description of Artificial Sequence: Synthetic polynucleotide

SEQ ID NO: 7420 - DNA, 899 bp, Artificial Sequence
  Description of Artificial Sequence: Synthetic polynucleotide
cggtttttgagggttcgggtagttattcgtattttttcgttacgcggagaaagtcgagtatataggtcgtagggtgggggttcgcggggagagggtggaagtagcgggtttttcgcgtttggggtggtcgttgttttatttaggttttcgtttgttttttatttttttagattaatcgttttttgtaggtgttaacgcggtgtttcgtattaggtggtacgcggattttttttagagtttttcggtttagacggagttaggttaaggtagaagcgcgggtagtttcggcgttattttatagcgttttatttgtagttttggggtttttattcggttttagggtgtatagtagtcggggcgcggttcgggaaatgtagttgcgttttttgagtatattgtttaggatggtgtttacgtcgtcgttttgtcgttttaggtattttttttcgcgttttagagattcggttagtttgttttgtcgtattcgagagcgtttcgggttttggtacggttatcgttcgtttcggttttcgttattttattcgttgagcggttgagttcgcggagttgggtgagtgtttgcggttgatcggttcgtgggagtagggagcgtatagtcggttggtgttggagggttacggggatttacggggtatcgcgggagtcgtcgagcgtagggaagttagtaggtatttgtagtgcggagtttgtaaggttgaggtaggagatcgttcgaggcggggagggcgggagcgagcgagcgagcgagcgcgtgggagacggaggcggcgtgttcgtttttaatttcggtatcgtcgtgcgtaggcggggtcgttttagttttttcgtgtttagaagcgttagagatagggagttagtgggcgcgtaattgcgttcgg

SEQ ID NO: 7421 - DNA, 899 bp, Artificial Sequence; identical to SEQ ID NO: 7420
  Description of Artificial Sequence: Synthetic polynucleotide

SEQ ID NO: 7422 - DNA, 547 bp, Artificial Sequence
  Description of Artificial Sequence: Synthetic polynucleotide
cggcgttttggcgaattcggttattttagttttttacgtggtgagtatttagggtagcgggtcgatttttcgaggttttatatttgggtttgaggggcgcggttcgtagcggcgggtgtaggggcgattgttagtttttatttcgtttcggggtgcgttcggaggtcgatatttggaggacgtttttagttttcgcgggacgttacgtttgcgcgttagggattcgggataagaagtgcgcgtcgggtttcggttgcgcgtcgcggggttattagtttgcgcgtagggtttaggcgatcgtgcggttatggatacgttacggggtatcggtattttcgtggtgtgggattacgtggtgttcgcgggtatgttggttatttcggtcgttatcggtatttattacgttttcgttgggggcggttagtagatttttaaggattttttgatgggcggtcgtagaatgatcgtagtgttcgtggcgttgttttttatcgttagttttatgttagtcgttattgttttgggtatttttttcgaggtttatcgt

SEQ ID NO: 7423 - DNA, 2505 bp, Artificial Sequence
  Description of Artificial Sequence: Synthetic polynucleotide
cgtttcgtttcgtatcgggggcggaatttcgcgttttcggatttgggatagtattagtagcgtgaaatacgcgtattcgagtgtaggagtaaataggtaattttttgttttggttatttttagttcggtcgtttttttagcggtttgggatagtagcgcgtggttgggaagacgcgggagggggacgcgaggtaaatttgcgttaagagttggttaggttaggtgagagggagtggtattcgcgtagatatttatcgttggcgtttttttcgtagattaggtgttggtagggttgtaggagattttagattttcgagtcgttgttgatcgtgtgttttagggtttttacggtgaatttgggcgtttcgtggagcgtatggtggtggtgatggtggtggttggcggcggttgtcggcgggattgcggcggtcgcggcggtcggcggggcgtaatagttgttgttttcgttggcgttgttggttgcgttgtaggcgtcgtcgttcgtcgtttttttttcgggcgtttttcgttttttattcgtcgcgggggtcgtattagggttcgagttcgggtttgggtcggagttcgagtttgatttagggttattgtagtttcggggtatttcggaggttacgattcgcgagtagatgtttcggaagaggttttttatgtaggttgttaggtagatggcggcgtgttcgtggatgcgtagcgttacgcggttgtttattatttagcgatatacgcggtttacggagaaggtgaggtcgtagcgggtcgatttgtcgcggtttaggcggtcgtcgtcggcgttgtttatgttgtagagggatagtgcggttagcgtagtcgtcgtatagtgcgcggttaggttttaggatagtacgatttttatggcgttttggatttcgtatttggtgtatttggcgaagcgtaggtttaggcgttgcgtttttttggttatgcgtattagcgttcggtttattagcgtcgatagtttggttagcgcgtttttgggtaggtcgtcggggatcgtcgggtttgttcggggatttcgcgaacgtagtagtagcgtttttagtttttggagagtttaggggatttcgtttaggttcggtagtagtcgcgagtagtgttggtcggcgtagtttagtttttcggagttttttattagggtagtgttgatagtgttaaagttgttgtgtcggttgtgtatggagttagttagaggcggttagtagttttcgttatacggggacgtcgggtgcgagtcggaatagtataaagataagttggaggagcgtatcgagttcgtcgcgttattataattcgagtttagcgttagattttttagcgtttttattacgggttttttattttttttggttatcgttgcgttattttatgttgtagtcgtttgggagttaaagggaaggagcggcgaggagtagcgagtgtcgcggggcgcggggagagtcgagttcgcgtcgttttggtttatttttttattagtcgttgttattaattgttagtattttcggttgtttttcggaattgtcgtcgttggaatatatagagtagattttggagttattttttagagttcgggtcggagttgggcgtaatggggagcgagttaggtcgggaaggaagttttcgtcggggtttgttttttttttttaaaataaaaagtgtttagatcgtttttttttgagtttcgttgggcgtagtagttatcgggcgtcggttacggtgttcgtgggattgagattattttagatgtcgtcgtcgtcgtagtttcgcgggtagttggttttcggttttcggtttttagttttcggttttggttcgttcggcgttagtttgttttgtatcggagcgtagtagcggtcgtggcggttgtaaattttgtcgaattttagtaaatttcgggtagttagtgggacgggcgtatgtaaagtaggggcggcggagagttagtggaatcggagaatgttaattatttcgttttttttttttttttttaaattttttttttttatgcggtttcgttttttatatacgttttcggcggatatcgaggttgtaggaagtggggagtagtggttagggatttggggaatttttgtaagcgtagagacgtggatgttgttttttgttgttgtttttgttcgtattttttcggagggtggtgggttgggtcggtgatttttttatttaggtgtgttttttatcgcggtttataaggtgtttgtttgacggtcgtttttttttttgcggttcgtattttattttttttttttcgtaatatttgaaatatggtttttttttttttttatttttatttcgggtacgtaaattaattagtgcggtttttttttagtcggggtttgttttagtatggagggaaataagtttgtcgagcggaggttcgtggcggtggatattattgggaggtcggattttcggttattcgttatttgttattagggcgcgttaattcga

SEQ ID NO: 7424 - DNA, 1587 bp, Artificial Sequence
  Description of Artificial Sequence: Synthetic polynucleotide
cgaggagtggggcgttcggaaggacggggattgggaagcggttaggacggggagaaggcgcgggtgttggaattatttattagaagaaatttaacgagatttgtcggcggattaaaaaaaaaaaaaaaagtgggtttttttttatttttagattgatgatttcgcgtttttcgcgaatgttacggttaaggtaggatgttttaatcgttttgttattcgtattattttttcgtttttgattttcgtcgtattcgtcgagattttgcgagattttaaggttggggggttttgttaggcgcgttcggggtatttcgggaaagaatagaggtcggagtcgcgtttttacggtgcgttttttgagattttattttttagtttcggtttttacggggttcgtagagaatatttttaaatttaggggaggtatatagatttttataaagggaggatggggagaaagtgatggggtttcgaagagtcgttttagggaaggagagagaaagagtagggaagagaggaaagaaatagaagaaaagtagagacgggagagaggagacgaggggagtagcggggagaaacgtaggaggtagaataagtaaggaaattttttatttaaaagtttttttgggttcgagggttgggagttatttgttttgcgtcgttttcggttttttatcgttttggaggtaggagcgtaaatttgcgagcgttcgggtttatttttatcgttcgtttgtatttagatttgggaaggggatggaaggggcgggggggtaaaggtaagaagtaagacgaattttaagatttcggttcgaggagaagaggtttgtcggcgtttgcggttagttcggcggcggcggttttggcggcggcggcggcggttttcgggtggcggcgcgttcgggttgcgtagttaggcgggcggcgaaggttgaggtgtcggcgagcggcggggcgcggagtcgttttttcgttaatttcggtttttttttttttttttttttttttttttttttttttttttttttttttgttcgttagttttttttttttttcgtcggagttttagtcgggtgcggattggtaagcggcgcgtttcgcggttttttcgggcgtcgcgaagttgggaggcgcgtaaagtgcggtttaggggggatcgtcgggggttttcgttagtagttttttgttcgaggtcgtagtttttgtttttttcgtttttcgttcggtcgtttggtcgttcggtcgtttcgtcgatcgagggtttattagcgtttttttatggtcgcggtagttaatcgatgattgaatcgaataaagagtagcggcgagattaatttttaatatttatcgatgggtagcgggcggtcgagtttcggcgagtttcggtagtcgtcgttcgtcgttttagggcgttcgtttgttcgttcggggatttttttaatgcgtttagggcgcgttcgggggttttttacggtcgcgcggtcggcgttgttcgtattaatttggagtcgtcgtagattaaatcgtttttaatattgaaatatcgattttatattggcggttattttgggggttatcgagacgcgt

SEQ ID NO: 7425 - DNA, 5693 bp, Artificial Sequence
  Description of Artificial Sequence: Synthetic polynucleotide
cgcgcggagagggtttaagagcgtttttttaaaggtttagtttcgtttggagagagtgggcgggtatcgggtttttgggggaggggttgtcgtaggtttgggagggaatttagcggggttggtcgtagtttgggtaggtcgtagtttgggtcggcgggaattcgttattggattgaagaggcgtttggtcgtcgttgacgtcgttgtttttttttcgattcgttcgttcgtagtgttattttgtacggatcgtagtttgttttcggatttttaggacgtattgtaggacgattttaaagagacggataattcgatttcgtcggataaggagacggttaataacgagaacgaggagtagaattcgggtattaagcggcgcggttttcgtattattattaaggttaagtagttggagacgtttaaggttgttttcgtcgttacgtttaagtttacgcgttatattcgcgagtagttggcgtaggagatcggttttaatatgcgcgttatttaggtgcggttcggggcgggtatagttttttagtttcgttggtttgggagtcgggagtttcggaggagtttttcgttaagtttttttggttacgagcgcgtttggttttggtttgggagtagatcgtgcgttcgagtggggtatttgttcgaggtcggggattgtgaatcgaaagattttatttagttttgttgtttttttggtattgcgatttgggggcgggttattttatttttttgaatttcgtttttcgttttgtttatggaaggttgtaagtttttttggggttcgggatttttttttatttttatttttcgagtagagaaataggcgatgttttttttttttttgcgtcgaagcgcgggtagataaacggttagaggttggtttcggagtcgaggggtcgaggcgagagtcgtgtcgggagggaggtttttatagagtcgttaggtcgcgggcgagtcggggattaggaagtttaagtttttatgagtcgttttacgggttcgcgaaattttttatttttggttggttcgtcgaagtttttttttatttttttcggtttaattcggttcggtttcgtttcgggggagttttggtgcggaagaggcgtaaggatttagtaggggtagtttagttagggaagggagaagagggggggagaggatatttttgattttgggtttatagtttttttttttgttttaggtgtggttttagaatcgacggtttaaagaacgtcggatgaaatagttgagcgttttaggcgttcggaggtacgttttttttcggagttcgcggcgtatgcgttcgttgggcggtcgtttggacgagtttgagatgttggggtttatttcgtatatttattacggaggtaaggggcgtttcgggattcgttgtttcgtatttgttttatttcgggagttgagggcgaagggtttcggttagtacgtttttcgtcgttttagaatatcgtttattcgttggatatacgattatagatatatgtatatttatttatatgttttggatataaaattagatatatggttttatttatatagtgatgtatatagaagtatatacgagatatagtgatatatttatttacgtagggtataaggtgtatttatatttgcgtttagagattttagggatatacgtttagatacgatcgtacgattacgtataggtaaattttatttttttatatataggtatatttacggagatataattttatagacgcgtatatttttattagttatattgaggttagtattggtaaatttatatgtatgcggtttttacggatagacgtatagtttttttgtcgttttgtgtttggtgtatttggtatgaggtggatttcgagcgttggagggtagtgtgaggggaggggatgggggtttggatttattttaagtcgtttgtttattagtatcgaaggtagtaatttttgttttatgtggcggggtgtgtgcgtatagtatttggtagtgttagtttaaatgtcggtagttgttttgggtaggattgtagtttattttttagtttcgagatttttggggtttttatagattgggggtataagtgttgggttaattttagatttttatcgtttttggggttgtagagagcgaggagttttagtttataaagggttttagatggtggtattaggtttgggtttggggtgagttgtttttttgttattttagttttttttttttttattttttttatattggattggtgagttattttaattttttttattcgatttttttagttttttattttgagtcgtattgtttgagtttattaagtttattgttttgttttttttagggttgagggtttaagaaagtatttttttttttttattttgaagtttttgaatttggagagattttaggattgtttatgtttgagaggtatttgtatttttgagttgtaacgtaggttaggaagaggtaattttttttagaaagtgggtttagtggtagtgttagtaaggtaggagttaggtatttaggtagacgtagaagggaagggaagataattttattattaattttagtatattcggaagtttgaggggggattagattttgagatcggatcggggtttttagaaattgtgggtaaaatgttaggttgtgttttttagggtagagattttaggtagtggtagggtttaggttggagcgttttagtcgtttaattttggatagttttttaattttggatagatttttaatttcggatagatttttaattttggagagttcggatggtgggcgtgtttttcggagtttttatttatcgattttttttatttaaatttgtttttttttttataaaatttgggttcggagtagcgaggtagtgggggcggtatcggttcggaattttttttcgtttggataattaattaaggttttttcgaggattatttcgttttcgtttcgatttattttatcgttttttttttttgcgcgttggatgaggtggggagttggatattgggggtttttcgtttttcgtaatggtggggaagattttttagtttttagcgaggtagtttcgtttaattcgcgttgggagatttcggcggtggcgatcggtagcgggcgagaaaggggtcgggcggcggggtcggcggtttttcgtgggagcgcggataaagttttagttgcggtttttgtgttttttttagacggcgtttgttttaattattttcggttcggtcgttatatgggcggaggcggcgcgtacggcgcgggggtagcggttttcgttggtttttcggttcgtcgcgggtcgcggtcgttttttatttttgtttttttggggttttaaatttgtcgttttttatttttttttttattttcggggagaattaaattaatggttttaaaaagtaattggtaatcgttttagttgttgtttaaattgtttttaagttacgtttttagatattttttatttggatagattttagggtttggagagggaagagggtggtagggggtattaggaattcgttttttgattgagattttaggatttagtagggggagtggatttgtagaagagatttaggtttttggattcgttggttttttcgtcgtataaagcgggtgtttggtataaggtggttttttcgtgacgttttttacgttagttttttagggttttatttggtgggggaaggtaggatatttcgaaggttttggaaaaggggttatgtggggcggttagagagttgatatagatttgttgaggtagaatgggtttgtaattcggagtttttatattttttgaatttatgggtaaaatttttatttttgtattttttttgagagagagtttatagttattattagttttttaaaagattttaatgtttttagatgttttagaatttgggggtgttggtaaaattaattcggggtaaggttggaggatcgagtttttattttaaggagttcgcggagttttggttatgatttagagaattttcgtgttttttttttttttttttaagtcgttggagtttagtttttttttttttaggttaggttaggtcggtataaatggttttatcgggatcgacgcggcggtcgtatttggcgaggcgaaggatttggattgggttggtagggcgtagggatcgagtttagggcgttaaggtcgtttcgttcggtttaatttattagtcgtttttgtcgcggttcggatttagtttttttcggttaggtcgtttttcggttttaattatttcgcgttttgttttgttcgttggtttgtttttgttcggttttttttttcgggtttgttagttttcgtttttttggaggtttttgggatttatttttgatttatcgttttgcgttttttgggcgtatcgatttttttttattttcgggtttatttttgattttttcgttgtcgttttcgggggtttttacgcgtgtttttaatcgcggtcgttttttttttttttgcgttttttcgattttttcgcgatttttcgatgtttcgggttttcgggttttagtcgcggatttcgtgtttttgggtttttttttcgtttttttttttgtttttttgtcgattttttcgtttgtttttcgttgtttcgtatttttgtgttttttatcgattttaagatatttaggaattattgtttgtttttgcgtttttggtcgtttttgtttttttttatttttaggtgttagggaatttgtgattgaagttttcgagtttttgtcgcgtgtgttttttacggtttcggagtttttttcgtttttgtgtgtggtttttggtagtttgagttttttgttttttcgagattttttattgtttttttttttaatttttttcgtgagtttgcgacgtttatcgttttaaggggcgtcggttttcgtaggtttttttaattttgggtcggtgtcgcgcgtttttttttttcgttcgttcgggtttttttttcgggtttcgggtttttcgtttatttcgtttttttttatcgcgttttgtttttttttcgttttttttttgtagattattaaggcgattattacgcgtcgggaagtaattacgattttttcgcgtacggttcgttttcgtaggcgtagttttcggtcgattttagttttttggcggtttttggtttcggttcgacgtcgttgggagcgttggaatcgtcgttcgtcggttcgtacgtcgcggataattttaggtttatcgatatgatttcgtattcggatatatcgagtttcgagttaggtttgtcgggtacgttgtattttatgttcggcgaggtatttagcggcgggtttagttcgttttttttaatgagcggtattagcggttatagcggatttttgtcgtattttaatttcgagtttaacgaagtcgtcgtgtggtaaggtcgtcgggtcgtttttcgcgttcggttttcgggggtttcgtttcgaagtagttttttgaaattaaaacgttcgacgtagacgcggtgggagacgtgggtgtttttcgggggttttttttcgggttcgtatttaattggtagttgtttttcggttgggcgtcgagggggggtcgatttttatttttatttcgcgggttttttaggagttttagtttatcgttagtatttttttagtaatcgcga

SEQ ID NO: 7426 - DNA, 589 bp, Artificial Sequence
  Description of Artificial Sequence: Synthetic polynucleotide
cgtcgcggaggttttagcggtaggtgcgttttagtaggtagtagtagtcgttattttgggtaagtagtaaatttcgtataaatttcggagttattatgtttgttttttcgttttatcgtcggtttttttgttaggagtagtagaggatgtggtgaatgtatcggttttatcgaacgaggtaatcgtttcggtagatggttcgggaggtttaggagggagttcgtcggtcgagtcggttggggcggcgggaatggcggattttagttcggttttgtattttgtagagtatagtttgtagagattttgcgcggttcggagtttttcggtaaatggagtttgggaggtcgtcgcggttggcggagcggtattgaggtttgtagaagtacggtttggttttgttaaatcgtattttgttcgttttcgttagtttagagtttttcgggattttggcgagggcgcggggtaggatttttttcgcggtcggtagtgaatgggagcgcgtgtaggggcgttagttttgtttttttttgttgtgagtaggtagcggggttttagtcgtcgtttttttgaagtttcgagaacgaggcga

SEQ ID NO: 7427 - DNA, 1294 bp, Artificial Sequence; identical to SEQ ID NO: 7417
  Description of Artificial Sequence: Synthetic polynucleotide

SEQ ID NO: 7428 - DNA, 1373 bp, Artificial Sequence
  Description of Artificial Sequence: Synthetic polynucleotide
cgattttcgttgagtttacggtttagtttttatatatttatgtcgcgtttttagtcgttgggtgaggagttatttagcgtcgcggttttttcgaggggcggtcgggtagcgagtagcggtcgagcggacggggtgagttaggggcgcgcgcggggcgtttagtattgcgtcggggaagttcgtagttttcgtttcgaatttgggttcgttgaggttgagggaggggacgtaaggggagggaagaagagaagggaggagtgggggttaggggagagggggtggggagggattttggaggtataaagcggaggggaaggggagggacgcgcgcggtttttattaggaggcgagtgggtgtaatcggcgttttttagtcgcgcggggcggcggattcggaggatttagaattcggagcgcggcggtcgcgggcgttcgggaggaagaggaggagtacgaggcgggcgggcgggtgcgtagcgcgaagaggtagtttcggcgttgttcggttcggcgttaggtgagtttttgatttaggcgtttcgcgtttttttttcgtttttagggtttttcgttttcgttcgagtttttggtgtgcgcggaaggttcgggttttgttgcgcgttttaatttggttcgggcggttttattttttttttagcgggcggttttaggtcgggggtttcggttcgggggtttacgcgtttaggttttaattttgtaagattttagtcgttttttagtcgcgcgtttggtttcgagttgtgcgttggcggtaatggcggagtttttggtatagttcgttattttttcgcgggtagttcgggttgggggatgttagtttttggggatcgttgtatttgtttaagtttaattttacgtttttttcggtgttcgattttgcggtcgaatcgtaattgcgagtcgtaggtaatggcggagtttttggtattgttagttgttcgcggttgggggttcgaggttgggagggtttcgttttcggaatatcgtttcggtttggtttttaattttgcgaggagtttttttgcgtttttttttcgcggttatggcggggtcgttcgtattttttatttttttcgtttgggcgagattggggtgtaagagcgtcgtttttaaaatttgggaaagttgtgtttttttcgtaaaggaggttttagggaggtcgaggggcgcgtttcgttacggttcggggttgggtagtggaaggagcgttcgatgaggttgtttttaggtggttagggttcggagtagggttttcgggggatttaatttttagggttatttaggggttttgcgttcgaggtttcggaaggggttttttcgggattgcgttttagaggacgttagacgttcgt

SEQ ID NO: 7429 - DNA, 1524 bp, Artificial Sequence
  Description of Artificial Sequence: Synthetic polynucleotide
cggggaaaggcgtggaggggggttgagcgggttcggggttcgttcggaatttggggggttgaggggtcgggcgttgggcggtggagggaggaggtagggggatgcggggagtggtgggggagtttttttaggaagtgagtgtgcgcgcgcgtttgtggggagatgaggtagttgttggtgcgttttggggttttcgattcgagttttgtggcgggtcgtttgttttttttttttttaagtttcgatttttttttttttattttttttttttgtattggcgggcgggcggcgggggcggttggggttttagtttttttattttagttttttagttttttcggtagttcgggggcggttttagttttagaaatgtcgtcggttttcggtttcggtttttcggttttgtcgtcgcggtcgttggggttgttgttatcgtcgagtcgggcgtcgtagcggttttttttggggtttatatttgtttcgttagttcgtgttcggagtttttttcgcgggttatataattaggttttcggtcgagtgggcgaagtttagtatatttcgggggcggggggtaggggagggtttttagatgtttttttagtgttttcgaagatatcggaggggagtatttcgcgtagagcgtagttggattttcggggtgcgggtttttttttttgttttgttttttagtatttttggtaattgcgtaaagttgtttgggttgtaatggtggggtgtagggggcgttcggttgttgtatttgttagtgttgggtttaggttgagaggcgatttttagtttttataataatgtttcgggttttttggtttgggttttcgtagcgttcgattgatcgttagcgatacgacgagaacgaggatttgtcggacgtggaggagatcgttagcgttcgcggttttagtttggaggagaagtttcgtagttagttgtattagggggatttcgtgtacgttatggagggtaaaggtgaggcgtttttatttcgggtcgttttttgcgttgcgggtcgagcgtacgtggggagggagttgtcggtggttgggttcgtatttcgcgttcgcgttttttattttaggggattcggtgacgaaacgaggtcgagtattgggggggtggggtggggtggtgagggaggagggtaggtagtaaggggggtcgggtatgggtttaggttcggttcgcgtttattattagttttagggtgggtagagttagggggtcggcggatagagggatttggagatggataggcggatcgagggagggcgggagcgtcgcgtttttttttttttcgagtcggtcgcgttttttgcgttgtttgaggtgtcgtcgtttggttggaattgggtttagggcgtttttggggtatcggggtaaggttttttaggttcgaagtttttttaatttcgttttcgtttggggtttgttagtgaggaattggtgatgggggcgcgtcgggtgtttgggacgatgtttttttaggtttggggttcgtagagtcgt

SEQ ID NO: 7430 - DNA, 1009 bp, Artificial Sequence
  Description of Artificial Sequence: Synthetic polynucleotide
cgaagtggcgggtcgtggttattttttttatttgttgtattttttggagtttcggggcgtaaatagtcgttgtatttttttttattttcgacgggatgatattatagttttttttttagatagcgcgggtttttgtttcgtttttttttagcgatcgtagcgacgattttgttttagggcgggggagtagttttttaagtcgcgggcgtttattttttcgttcggatttcgggcggtgttggtcggggcgcgcggggaggcggggattagggattttttaggaattagtttgggttgttgtatcgttgttagggtcgttttgcgtttagtcgagtttagggcgtcgtcggttggacgttcgttaatttttattgcgttcggttttcgagcgcgttcggttggattcggcgcgttttttcgttttaggcgtcgttaagttttagtattatgcgtttttttagatgttcgaaagcgtttttttagggtagtttatgtttttttgtgtttttttcgcgacgggtcgggtttattattttatatttttcgggtttttttatgtttattatcgtgtgtttttttagtatttttttttttttttaagttttaatatagtatttttttatatatttttcgcgtcgttttagaggtttttttagttattgtttcgtttttttatttttttagtttttttagttttatcgaggcgcgtttttttagtacgtttttatttttttatttttttttcgcgtttttgtatttttttttcgtatttttgtatttttatttcgagtttttttgtgattaaatatcgcgtttttttaagcgtttttttttcgcgtcgttttaagatttttttttatattttgtatttttttcgtatttatttacgtatttttgcgcgtttttattcggcggtttttttatttttagattcgttttcgcgatttagcgcgcggggtattgggtagggatatttttcgtttttacgcgagtttttcgttgtagacgt

SEQ ID NO: 7431 - DNA, 961 bp, Artificial Sequence
  Description of Artificial Sequence: Synthetic polynucleotide
cgtcgtcgttgtgagcgcgcgaggattcggggttttaagtggtgagaattattcgagggatttttcggatgtttttttttttttttgtttttgagttttgtagtatagcggtgtcggtcgtcggtagggaaggttgtattttttttgcgtcgttaaatcgtgtttattatcgcggtgattgtcgtttaggtcgtatttttgagtcgtattcgcgcgtaggggcgtacgggtacgcgtatagggaggtcgtatatatatatatatatttgtatagggacgagtcgggggtttttgacgttcgtcgtttatttcgtttcggtttggagttttttggtttcgtaggtgtagcgacgtttagttttcgtgcggttagcgcgtcgcgtcggcggattttgtagtttagagagtttagggagtttagggaggggagcggggcgcgggcggggtagtgtcgtataatcgtaggcgcgtttcgcgtcgttttcgtttcgggtttattttttttcgtcgcgttttttttagtttatttacggacgagcggattttcgattttcgcggtagggatattttaagagttttgtttaggtttgcgtcgtttagtatttcgttcgtgtcgggggttcggcggtttcgggcgagagacggaggttacgcgtagggttgggcgtaggggtcgtcgttcgaggattatgggtgggttagcgtttcgtcgggttgttagttggcggggatcgtcggcgtttgtgtcgggtcgcgttcgaggttgcgtcgttcgtgtcgtagcggttaatgcggtagtattcgcgaacgttatcgcggcgggtttcgttggttcgggttgcggcgtgggggcgggggatcggttttgagcggagtttcgcgggaggaggagcggacgggaggttgggagggattcgtaatattacgtaggatcggggtttttaggtgtcggggaaggcga

SEQ ID NO: 7432 - DNA, 961 bp, Artificial Sequence; identical to SEQ ID NO: 7431
  Description of Artificial Sequence: Synthetic polynucleotide

SEQ ID NO: 7433 - DNA, 980 bp, Artificial Sequence
  Description of Artificial Sequence: Synthetic polynucleotide
cgtttttttgtttcgttcggtgtaagttcggggtcgtcggttggggtggggcgcgtagcgcggtaggtaggtagggttattatgtagtttttagttttttggttttttcgtttttcgtttcgcgtttttgggtcgttttcgtttgttcgtattttagagtagttttgattcgtgggggcgcgcggtttcgcggggattttgcgggcgggcgggcggtcgggcgcgcgcggggcgggggcggcgcgcgcgcggggagcgtgtgggtcgggcgggcgcggcggggaaagttgggcgcgcgagtcgaggttgttgtttatttgtagtcgcgtcgtttatttgtcgcggagtgcgcgtttcgcgttttttcggttcgtttcggagttcggtcgttttttttttgttatagcgggtaattgcgtcgatatgcgatacgagtagtttacgcgtttcggaagtatcggaggagttttttcggtttgggcgagttaaggtgattttttcgatgattttttcgttttcgcgggtcgtttgttttcgtattttgtttgtttttttcgcgttcgattttcgttttcgtcgttagggaatcggtagtagtgtatgggtatttgtttgtttgtttgtttcggtatttttattgtatatatttttttttcgtggttttttcgattgtttcgtgcgtacggggggagtttggagtttttttttgtttcggtcgggggtgcgtttgaggatgtgtacgcgcgcgggggatgcgtttggagggtgggagttcgatggaaataggcgatttaaatattttatcgaggatggcggtttttggttcgagatttgtcgttgtcgcgtggttttttcggtagtagtttagatgttaaatagttgttcgtttttagtatgtaagatgtgattttttaatgtgtatttttagcgttgttgtaaatagatcgtcgcgagttcgtgtgtgtttgtttcgtttacgt

SEQ ID NO: 7434 - DNA, 408 bp, Artificial Sequence
  Description of Artificial Sequence: Synthetic polynucleotide
cgcggcgtttttttcgaaatatttgagtataagtagtcgtaagggcgagcgtaggacgcggggcgtggacgtcgggttgggaagagtttcgattaaattcgcgggtggttttgattttttttttcgggaggagttttgcgtagaggtcgtggttcgcgcgggtaagttatttgtggtagtttggtagggtagtttttttcggtaaatagcgatatgttttcggtttttgtcggttttggtttggtagagtcgtttttcgttttttggtttttggtgcgttcgaggcgggagaggagtttcggtcgcgtggattttagtttgcgcggtaattatcgcgttttgattttaggttcggttgtttagggaaggatagtttagggcgcgtttagcgagttttagggggtacgg

SEQ ID NO: 7435 - DNA, 2190 bp, Artificial Sequence
  Description of Artificial Sequence: Synthetic polynucleotide
cgggtgtattaatgcggtcgaaaaagatacggatacgtttttttgggatttgagttggttcgtagtttttttaaaggtgttaagtaagcgttagttttttttaggcgttttaggtttagtgttttgtgtcgagggttttcggtgtttttttagatttttcgggatagtttgaaggggttaggagcggcgggatagcgcgggaagagtaggtaaggggagatagtcggattgcgttttagtttttcgtgttaagaatatcgtcgcggaggcgcggttagttttttttggatcggatttttcgtttttagggttaggcggcggagttttagttttgttttttttttagtttcgggcggtttttagagttgagtaagtcgggtggagggagtttgtaaggattttttgagcgcgatgggtaggaggaggggtaagggtaagagggcgcggagtaaagattttgaatttgtcggggtcgcgttttcgggttcgcgtcgttagtatttttttacgcgcgttcggtttcgggttattcgttttcgtcggttttcgttttttttcgtagtcgtagggaagcgagtttgggaggaagaagagggtaggtggggaggcggatgaggggtgggggattttttgacgttattagaaggaggtgtcggggtaggaagtgggttggggaaaggttataaatcgttttcgttttcggttgttttttatcgaggttcgcgggaggttcggagcgcgttaggcggatatttttttcggttttttttcggtagcggcggcggttcggagcgggtttcggggttcgggtgtagcggttagcgggcgtttggcggcgaggattattcggggaagtggttgttttttggttggagtcgcgagacgggcgtttagggcgcggggtcggcggcggcgaacgagaggacggattttggcggtcgggtcgttggtcgcggggagcgcgggtatcgggcgagtaggtcgcgtcgcgtttattatggttagttattgggatatcggggttttgttgtgcgcgttgtttagttgtttgttttttataggtgaggcgcggttgggggtcggggtttgaggcgggttgcgatggggcggtcggagggtagagttttcgaggttagggcggggtgtacgcggggagacgaggttgtagttcggagaagttggttacggcgagaatttgggatattagttgtagcgggtacgtttggggtcgttgcgtttttttttcgagggagcgtttcgaggagtggttggtttggattcgcgagtattagcgtttagatcgggttcgcgttggggttgttcgtttgcgataggatcgttgattttttatttagttgtcgggttggggttttattgtcgaggttttgggtattaggagtagtacgtatcgggatttgtttggtatttagagtttatttttagaggatttggggtaggtacgtagggtttttcggagtcgggagtagaggtttttgaaagtttgttaggttgttcggggttgggttgaggtcgggattttggtgatattgggtattggtcgcgatttcgcgttacgagagtgtaggaggggagtcgatttggaggggattcgtgtttgcgggggagtaggaggattttaggagagggttagcgtcggtattttatgattcgtttgagtttttaagtcggattgtttcggggaacgttcggcgagcgttcgttttttttcgtcgttttcggatcgcggggttttagtgcgttgcgtttagttattcgggtggggtttttgtcgggagtaggcgtggtgcgcggtttagttcgtgtcgcggatattagtgattttgatttataagggtagtttagggtttaaatatcgttaatttattgatttataagtttagtttttaaaattcgagcgaagagagggcgggcgattttgattaaacgatgtggtttgaggaatcgatgaggttcgttcgttatttaagttagttttcgttgggcgtttgggagacgggcggtggaatagttaggggtcgggggttttattagtagttagatcgtcgttattgaggggttaaagtttcgaggaatttgagggttcggattcgtagtttttgtttagtggggttgagtggcggagatttgtgtttcgtttttttgggcgtagagagttagatttcggagcgt

SEQ ID NO: 7436 - DNA, 2190 bp, Artificial Sequence; identical to SEQ ID NO: 7435
  Description of Artificial Sequence: Synthetic polynucleotide

SEQ ID NO: 7437 - DNA, 679 bp, Artificial Sequence
  Description of Artificial Sequence: Synthetic polynucleotide
cgtcggtttaggtttcgtgcggtaatttttcggttttgttgtttatttcgttttatcgttttttattttttagtttttgtttagttcggggaagtcgcgtcgtagcgttttagatgttatttatttttttttgcgaggggtttgtgatagtttagggtgttgtgtattttgtgcgattgtttatcgttcggtttatgcggtggtttgagtagtttcgcgtcggtattttacgtatcgaatttcgggattacgtgagtcggcggagggcggggaggtggcgttcgggcgtcggcgtgaattcgcgtttttcggagtttagcgtcgtgtttttaggtttcggttttgattttagggcgtttaggtggaatggtttcgtagttgcgcgttgttttcgcgttttcgttttgtttcgcggaaatcgttttcgatagttaattcgatcgggcgcgcggcgttttcggtcggttttcgttcgatttcgcgtagggtatagatcggggcgtacgcgttattcgtattcggttattcgcgggttaggtcggtcgagcggttgggtttagggggtatttttacgtgcgtagtcgttattcggtttggtcgtttagacgttttcgggggttcgcgtcggttagtttagttcgagtttggcgtcgcgttgcggtcgttgttttttattcgg

SEQ ID NO: 7438 - DNA, 2013 bp, Artificial Sequence
  Description of Artificial Sequence: Synthetic polynucleotide
cgttacgtagtttagggcgtttagtttatatcgtcgtatatttattgtcggtttagaggtttggtcgttgagcgttttttggatggcgtggtttgatcgtttttttttttgatttatttttagtttcgagggtcgggttttacggcggcggagagggcgtcgttcgtacggtttcggttgtgttatcgtttcggattgttttcgcgtagcgaggtttttttttcggggttttcgggtggggtcggtcgagtcgggtgcgttatttttttaagttcgggcgagatgagagttgttagcggtagtcgaggttagcgcgggacgtcgttattttagcgttaggtcggagttagtagtcgcggagtcgcggagagcggagggggcggcggggtcgggcgtggcgggttttttcgtcgtttattgcgcgttcgaattttgggtttcgcgagcggcgggcggtattcgttgtaatgcggagaatgtgagaggtagcgtagggcggtggggaggaaggggcgcgggagagggcggcggcgagatagacggagagtagcggggagaacgaggatcgggttgggtaggtgggataaggtagggaggcgtcggagaggtcggattggaagggggggagaagggcggcggcgtcgcggagggggtcggcgtttttcgcgggagtgcgagaagttcgagtcggtatttgggtttaggttcgggttgggagcgcggtcgcggttcggttaggtagggtgcgggagtcgggtcgttcgcggggtttttacggggagtagcggggtatttaaggtcggcgggtttcggaggggtttagggtcgcgtttcgtaggtttcggtcgtttcggtagggggtttttgtgagcgttttaggagggcgagtcgggagtgcggagtcgggtgtgcgcgtttgggtgtgcgcgtgtgtgcgcgagtgtgggcgtcgggtagtgggggcgcgcggtagagattttgtcggtatcgtatcgtggcgagtaggaggtaggagcgggacgcgtaggggagtcgggattttttcgcgtatacgtatatgtatacgttgcgcgtttttacgcgtatatatacgttttttttgtcgcgttcgtcgtcgcggttattatcgcggagtcgagttttgcggagcgggaatcgaggtcggagcggggatcggaggtagtcgagtcgggggatgtcggttcggagcggagtcgcgcgcggacggcgcgttcgggacggtgagtgtggtcgggtcgggacgttgtagcggggttagggtcgtaggggcgtaggtcggggagtcggtgtgtttgttcgtcggcggcgcggcgcgcgcggtttttgattgggcgggagtttcgggggtagcggcgggggtggggtgttgggtgcgcgttcgtggggggcgtgtacgtttggggttgggagggggcgtgttcggtagtttaggtcgcggtttcgttttatttttatttgtagttgtagtttcgacgatttgtagtaagtttgtggagtttttggggcgcggcgggtcgggaggggtggggacggaggcgttttgagggtgtaatttcggtttttttttttagagaagagaacgcgaggggagtggggcgggggcgcgggtcgggtcgtttggcgggcggaggggtgcgtttttagttttttagtcgcgtagtcgttcgttttttgggatatttatttaggttcgcggcgtcgcgttggagtcgtttcgggcgttagattattatgatttcgttagggttaggtaggatcgcgcggggatagtttttaggtttagggtttgggatgtttttgtaggtaggaggaagatattaaggtttagttgggggagtgcggcgacgtgttcgggcgtgtatgtgtgtgttttcgcgttttttgttttttaggacggtggttggaagaagggaatttgtcgtaaggcgcgttttattcgatttggatttttaggagtttttaagaggtcgggggcgtttttaggtttgtcgg

SEQ ID NO: 7439 - DNA, 1501 bp, Artificial Sequence
  Description of Artificial Sequence: Synthetic polynucleotide
cgtggtttttcgtttggtttttcgtatttattaggaggaggttgtgcgttattaggtattcgagtcgcgggttgtttcggatgtcgggggttaggcgttcggtggcgtagtcgtgttaggttattacgtaggggttgtcgatggtgatttagtatttgatttgatcgtcgaagtggcggaagtagagtttcgcgtaatttttgaagtggtcggttagggcgcggttggtttagtcgtcgtaggcgttttgtaggcgttggggtaggttttagtggtatagggtgattacgggttgtacgtttagttttcgtagtcgttttagtaggcgtcggtagtagcgtagtttttcgcggttggggacgttcgcgttgttattggggagtattcgcgtttacgagatggagaagcggtagtgagtgatttcgagttcgcgtagcgttttcgtgtcgcggaagacgttgttgtagttgtcgttggttacgttttcggtggcgggttgtagcggcgacggggcgtttaacggtagattggcgtttcgggagtttttcgggggtgttagggggtggtgggtgaacgtattttagatggacgtatttttgtcgtgttgttgttagtcgttttcggtttggtaggcggcgttgtttacggtttagaggaagtcgtcggggaaggtgttttggaagaggttcgcggtttcgggggtaggaggtcgcgagaaacgggtttaggtttgcgcgtcgtcgttcggtttcgtacgtaggcggcggtcgtttaggtttagtagtattagtagtagcgatagcgacggcggcggcggtcgcgggcggcgcggcggggcgttggcgggtatgttgcgcgggagttaggtttcggggtttcgcgtcgcgtttttttatgttcgcgtttcgtcgcgttcgttcgtttatcgtcggcgcgtttattttcgtttttcggcgggtttcgttggtaataattatttgcgagtcgggattgttttcgttttggtattgggggcgggggtaggggcgtcgagggcgaggggtgttcgggaggggcgcggtagcgggtaaggtgcggtaggcgtcgttcgcggacgtcggagaaaggtatttgttttttttagttttcgggagtcgtgtaggacgtttcgtggacgtttaggtttattttttttgtttgtcgcgcgttttttgagagtagttttggagcggtttcgtcggggagaaaaggcgtcgattaatttttttcgatttgggggcgggattttgtcgggttttagcggagcgcgtcgttggggaagtatttgtttttattttttttttattcggaggtttaaagaagtttcggttggatattgttggagttaattagggattggtcgaaattttagagggattgttaggtgggatagtcgagggggaatttcgtcgtgcgttgaaagggatttttttttaggtgagatgttcgcggggagacgcgtttattcgcgtttttttttcga

SEQ ID NO: 7440 - DNA, 668 bp, Artificial Sequence
  Description of Artificial Sequence: Synthetic polynucleotide
cgaggttgttgcggtgggaagagggcgttgggagggaggaggatttggggcgtagtcgtggtgggtgcgttttgttaagaagggcgggggcgacggggcgcgtacgtggaggaggaggaggaggagggagacgggagggcgtgtgagcgagtgagataagaaaagggagcgcgttcgtcgtcgtcgtcgtcgtcgtttttttttggagagagaggttggagtgaggttgtgcgaagcgtcgtattttaatgaggacgggtcgaggtatatttttgtattagtggtcgtaatcgaggcgtcgcgttttagtagttgttgtcgtttagttcggtttcgtcgtcgttttttagttttgtagtttcgtagtttcggtcgcgtttagttcggcgaggatagtattaggaggcggtttttagcgcggttataaagattttcggcggcgttttttcgcggatcggtgcgtggtttgttttttttggggacgggagttgcggggagggcggtcgggggatttcgtagagttcgtttcgttcgtagtcgcggggcgtcgagggtagggcgggcgtttagtttggtttcgtcgtttcgttcgtagtttttcgaaaggcggtcgttttgttttggttagtttggttcgattcgggggcgttgcgtgcgggcggtttcgg

SEQ ID NO: 7441 - DNA, 1006 bp, Artificial Sequence
  Description of Artificial Sequence: Synthetic polynucleotide
cgttatagtcgtagagtttttatttcgagttcgcgtttttttggtcgcgtcgtgttattttgtttatttattgggcgatttgggtacgagtatcgcgatttttcgtttcgcgtagttttttagtatcgtggttttagtatatttgtagagtagttaggcgtaggaatcgaaattcgtcgggtggtgggcgggaagggaaaggtagatgtttaagtgaaggcgtttatttttttttttacgtgaatagaagttgatttttaattttaagtgagaaatgatagggagaaaaagtatgtaattattattagaaaaggtgagaggttagtgttgttttttagcgaagggacggggtgagatttaaatttatcgttcggttaggggagttcgtttttagagtatcgagaagttggggtgcgtgggcggagagagagtagggtgcgttcgatagttttgcgttaggttgtttttaaatttaatatttttttttttttttttggagttattttttttttcggaatatgtaagttttgggtggtttagttttgtcgttagatttagtttttaagtgcgggggaaggagatgggcgtttttagtcgcgattttttgggaaggtggttatttatttgcgttttgaaatagaagaatagggcgacgttgtagataatttggtttagttttagttttaggagggttacgaatatggagcgggaggcggtagggggttggtgcggcgtaggcggcggcggggcgtgtagggggttttcgtgcggggtttcggggtcgtcgtttatttttttcgagttacgtaggtatttggtgtagtttttgttggcgcggcgtatggcgttcggttttttcgtttcggagtttttttttttttttcgtttttttttttttttgtttgcggttaatttcggaggttgcggcggagtttcgacgtggggcgtcgatttggagttcggttttgggttttggggcgcgcgggcgagcgggtagggcgttcgg

SEQ ID NO: 7442 - DNA, 867 bp, Artificial Sequence
  Description of Artificial Sequence: Synthetic polynucleotide
cggaagtaaagttcgtagtgaggtgggttggaagcgggttttgtagtagtcgcgagttcgggtttaggtttttaggcgcggttggagtagaagtgtagggatcgttacgatttatcgtcgcggtcggtttcgtttcgttagaggagatttcgtacgcgtagtcgattggttcgggttgatcgaggggatttagacgttgttattttttttttttaaggtagttttcgtggttttgtatgtaggaagtgtttcgattaatttttttttcggttttcgtagagattttaaattttgcggtttttatttttcgttgtatttttttttcgtttttttttttaatgtttttgttagtaaaagtttttatttgtagtatcgggtatgttgttcgtttaacgcgtttcggggatttgttggttcgtgtttttaatttaggggtggttatacgtttcgcgtttttgtttttgggtagatttttttatttgtgtattttggtttttttatttagtaaagagatgtgcgaagtgtgcgtttggagacgagtcgtttcggtgatttttattcgttcgtagcggtggttttggtttttcggattcgcgttcgcgttttgcgggtttttcgcgtcgtttttgttcgtcggattattcgggtttagagggtcgttcgtttttagcgtttgcgagcgtcgttttcgttcgggtttggggagcgttagcgcgttttttttacgtcggattttgtagagtatgtttagtgtattttatggaattcggtttttttggggttaggattagattttcgggttttcgttgttgtcgagggggcgcggaggaggggaggttgggagatagttagcgttttgtttcgcgt

SEQ ID NO: 7443 - DNA, 1072 bp, Artificial Sequence
  Description of Artificial Sequence: Synthetic polynucleotide
cgcggagaagattgtttggtttcgtcggtttcgttaacgtgacggttagtttcgtcgagcgttcgtattcgtttatatttatgattattcgtatattcgttttaatacgtgttaaggcgcgatcgcggggtttttggtagttttcgttgtatttttttttttataggggtatttatagttgttatttgtatagggggtaatttttttcgatttagttgtggtcgtcgttttttttagttttttttggtttttcgtatttttcggtttgggttcgcgtcggtcggttttttttttttttttcggttttttttttcgtcgtttttattatatttttttttggttagtggcgtacgtcgggggacgagttagagggagcgggtcgcgggggtgtgtatgtatttttcgttttttttttgtagcgtatattgtatatggtagtgagggggcgagtaaaggtggtatcggtttttcggttgttttagcgaaggcggcggttgtagtttttgcgttgtttttcgttttttagcgtagcggcgattatcgcgttgggatttcgtcgacgttgttttcgcgtcgagttcgtcgtcgtcgcggtttttaattagtatttgagaggtttttgtatttttttggtagttttatttttacggtgtttgtagggtttttttttgtattttttttttagatgcggcgtataatcgttattagttggaattttttattatcgatattttttggggtttttgggggaaggggggggcgggtagtaatcgcgtcgttttatgtttgtggtttgttttggtagttcggtggttttaaaaaaaatttcgagaaagttgcgtttttttttcgggcgtcgaggaggtggtaacgcggtaagtaatatcgggtttttgagatagttgtttcggagcgggtgtagggtttagtttagtgtatttgtttattgtcgcgtttttggtgcgagttaagttgtagtagatatgatgggttcggggcgaagcgggcgttcggtggtcgatagatggtagtcgagggcgaaggcgtttttgggttagggcggcgtaatcgg

SEQ ID NO: 7444 - DNA, 1633 bp, Artificial Sequence
  Description of Artificial Sequence: Synthetic polynucleotide
cgatacgttttatttatagagttttagagaagttcggattcggttggagttaagagtcggaaaataagtatttagattgtcgcgtaagttgtcggagattaagtgttatatatattggcgtcgagagaaagggtgggcgtttttaagtttttggtggagtaatgttagtggtcgggtatgcgggggatacggggttttcgaattcggattcgaatttttagttgagttattcgttaaagttggttgttcgttggtagacgaggtcggttttagatcgggtggtagggtgttttcgggttttgagtggttaatagtaattggggaagtattgaggaattttaacgggaaagttcgttttatatttgaaataggtagttcgtgaagtttttaaattagttttgaaacgtcggcgtttagaggttaggttttcggcgagggttttttttagttttgttcgttttcggttcgagcgtcgggcgttttgtcgttcgaaggacggataggggagagaggggttgggggagtttttcgcgtttttttatcgtttttgtcggcgtaagggcgggagtggagaaggcgttatttagattgtggcgttgggtaaattgcggtcgtagtttttttaagtttgttcgaattagaacgcggagtgagcgttcggttcggtttttcgtttgcgttttgtagtcgtttcggagtgattcgggttttttggttagtcgggtttgagttattaattaaggggtagaagggcgcgagagtagcgggaggcgggagttagggtgttttcgcgtgtgtatataatgaggcggcggagacgtatattttttttcgtcgaagaagtcgtaggagtattcgtcgtttaatacggagacgcggagttttatagcggtggtagaaagtgagtattaatttagtaatagggggaaggaaggggacgtcgggcggttagtgggacgtgcggtagtcgagggttgtagtttgtttttgtagcgcgttcgcgtttatttgcgattttttggtaggggatgttcgttaggttgaattttttggtatcgtacgtttggcggattttttcgtagtttcgagtttttatattcgtttcggcggggagggagagtagtagttttaagaggggaagaattatagtttcgatttaagaaggtatggtgtaatatataaatttagttcggtaaattttacggtcggtgcgttttttattttgttttttaagtcgaaagttcgttagaggtagcggcgcgtttttcgtcgttgtttagcgttatttttttttgttagtcgaggggacgagtagcgtagttttttggattgcgtttagtaaatttttataagttagatggacgatggtaagttaataagggttggttgggaaggttgttgttttgtttttttagtttttagatggaaacggtgtaattaaaacgaggaagagaaggaaaagaagtgtttaaaaaattattatgggggtttagagttgtaattcgagtttcgagtcgtagaattttggagcgttgcgggttcggttcgtcggagtgtgcggtaaaggtgggagcgcgcgtcggttttttcgggagggagatggataagcgagagcgagtgtgtatgcgcgcgt

SEQ ID NO: 7445 - DNA, 1143 bp, Artificial Sequence
  Description of Artificial Sequence: Synthetic polynucleotide
cggtatcgtgtatagtttgattttacgttcgtacgttgggttttcggttttttggtagtgtatttaagtgtatttcgcgtgtgttcggcggattttcgtgtatatcgtcgtcgtgttgttgagtacgaaagattttcgagaggagttcgtagatgagagtttagttgttgttgtgagattgattgcgggtggtagtcggtaagaaggaattgttagtatcgattttggcgttttttattaattgcggcgtagttttttttgcggtgttcgtttttcggtattattgtagtttttgtagtaaagttaattttaaaaatttaaataaaataataattttttaaaggttcgaaaatttcggtttttattttttttttagtttgttcggcggcggcggcgtttagtgagtgatacggcgagcgtgagtcgcggttttagtcgggtcgagcgcgttgtttgagttgagtcgtcgtaggtgaggggttcgcgttttcgttcgttttgggcgtcgcgtttggtattgattttgtcggtcgtttattgtcgtcgtcgtcgtcgttcgcgggtattatgatagttttgagcgttggggttataggttggttatcgtcgtcggtgttcgggaggttgcggcgcggtcggtttcgtgttttgcgttcgaggttcgcgatgcgcgttcgttagttttttggtcggttcgggttaggacggtttaggggcgttggggttgcgagaggggttgttagaggggttgcgggcgggggtttcgcgcgggggaggggtggggaggggcgtttttattcgagagcggggcggtggggtttttgtcggtttggtcggggcgcgggagtcgcgatgcgttttttttatttttgcgcgtgggtgtcgggggcgtttgtcgcgggatgtttttgggttggtttgggaagtttagggtcggcgatatttcgggtttgtttcgtttgggtatttagtaggtgttggggggtaggtggttgaggacgaggttattgggtattattatagcgttgtatttgttttttcggtattagggtcgttgtttgggtaaatttttgggttaacgcgcgggtggggaggtgggggtgggtagtttggttttagtaggttttcgcgggggtttcgcgg

SEQ ID NO: 7446 - DNA, 1143 bp, Artificial Sequence; identical to SEQ ID NO: 7445
  Description of Artificial Sequence: Synthetic polynucleotide

SEQ ID NO: 7447 - DNA, 1371 bp, Artificial Sequence
  Description of Artificial Sequence: Synthetic polynucleotide
cgttttttttacggcgttcgtttagttcggtggttttaattttttgcgggagttgtatacgtttcggaaatttgggatagaaattgagttttttttttttttggtggtggtgatagtatttgtttagatttggtcggacgtcgtcggtcggagtatttagttcggcggagaaggagttcgttcggcgttggggattgggatttggagtttttttttttatcgtacgtacgtttcgtttcgcgtacgttcgttcgttcgttcgtgtttggcgtagttttatttcggatggtttttgttttttcgcgggttcgagggcgttggaaatttagcggcggcgaagcggagaggagtttcgcgcgttttcgttcgtacggttttaggtttggggtttgcgttggagtcgcgcggggagaggtcgtttttgcgatcgtcgcgttcgttttcgatcgttcgggttcgcggttagttcggttattagttatgggttttggttcgttttcgttgtttttggtgttgtcgtcgtcgcggttgttgttgttgttgttgttgtttttgttgttaggtacgcgtataggcgttagggtttcggagggacgggcgttcgagaaggggcgcggggttcggaggggttgtcggcgagaatatcgcgcgggcgagcggagagggttggcgtcgtcgtcggggattcggaattcgcgtagattggttttagttcggcggcgatttgggtggggtggttttttttttttcggtttattttttatttttagttattattaaatttgggagttattgagcgggcgttggtacgcgtcgggtgatggggaggtcgagatcgggtttttcgttttgggcgtaggagttggggattcgcgttttcgcgttgttcgtcgttttgtttcgcgtattggtttttaaattggcgcgtttaagtttttcgttttatcgtttgtatttcgtttatttttttatttgacggagatggttgaagatttggttaaggttatttcgggaagaggggagtcgtttcgggattggggttggagttggagcgttagtttttttttcggttgtagttttttagcgtttttggttgcgtcgttgagggattttttatcgggagagcgttttttgtttttttttcgttttttagaggagtttgttgggggaagtcggttttggttcgtcgttgggaggtttttgggtgtttgggagggttggtgggtagcgagagtcggggatcgggtaaggttgtagggaatttttggagggtttaggtcggcggtttgtcgtgcggttgtgagtttagagcgtttttcgttttcggtgtcgaggtttgtattatttagaacgttatacgtttttaatcga

SEQ ID NO: 7448 - DNA, 1545 bp, Artificial Sequence
  Description of Artificial Sequence: Synthetic polynucleotide
cgcgttgtgagagttaggttatttaaatgttacgtttttcgtatcgtcggcgaggggataaatgattattttgatggattcggtagtttaaggaaattatcgttttcggagggatggcggtagagtaggtcgggtatgttgtatttgtttgagttggatcgcgtgtgagcgagtttacgtttttcgcgggttaggtttagttttcgtgttttttgataggtgaagttgagtatttttattaaattttcgggaagaataacgattttattttatattaacgtgattggaaattttaatttaagaattggatgtatcggtcggtttatttggggtttgtttagttttttattttatttcgcgtttttgatgtgttaggttttttgtatagatagtttatatatttaatttttaaaatatcgttttttgaagcgatgtttaattaggaaaatttgttttaaattgtatgattatttttcgtggttttttttttcgaatttttgttttgtttattaggtgcggtttcgtttcgtattcgtatatatttttttcgtcgttgttttgagcgtagcgataagggtttttatattttcgcggttcgtaatgtttcggggttaagtcgaggtagggaggcgttttcgtagtttttgattttataattcgcgcgcgtgtgtatcgagtcgcgggtatatcgcgaatatatatatatatatatatattcgtgcgttttcgtttttcgttcggttcgggtttttcgaatttattttcgaggcgtttcgggcgtagggttcgtttttttttgcgggtttttagcggttgttcggtagtggttcgtacggttttcgatgtcgcgttttcggtaggttttagagttagttggttattgttattcggtagttcggatttcgcgtttagggttgtatttcgcggatggagcgattttcgttttcgtcgttcgagtttaggtttgcgtttatacgcgcggcgtttatacgcgcggcgtttatttggttgtagtttcggttagggttagcgcgtcgcggttgaagggggcgttcggatttttttggggcggcgcgtagtcgggatagtttcgtatgacgttcgcgttttagcggtttcgggacgcggttttatttttaatttttggcggttttagtttcggtttttgtgtttcggtcggcgtcgttacgttatgggtttgtaggttgggagtagcgcgggtcgggaacgcggttggggagagttgggttgggtttttttatcgtcgttcgttcggggcgtttaagttggcggggcgtacgggtagtaattgagcgtattttgggggatcgagggggcggtttcggggaggggcgcggcgtcgcgttaagggggtgttttgttagaggttgcggcggaggaaagtgggagttagagcgtcgtcggagtttcgggaaggcggtgttcgttcggttttaggtcgcggttgtagcgtcgaggggaaagcgagcggaagttgcgcgttggagggagtttattattcggagttattcgcggggttcgcgt

SEQ ID NO: 7449 - DNA, 1545 bp, Artificial Sequence; identical to SEQ ID NO: 7448
  Description of Artificial Sequence: Synthetic polynucleotide

SEQ ID NO: 7450 - DNA, 1027 bp, Artificial Sequence
  Description of Artificial Sequence: Synthetic polynucleotide
cggtgcgtgtataggggcgtttcgggaggggtggtgatcggtagtcggttttttatttttcgcgtttattttttcgtttttgttttttttttagttggtggcgggtagtgtggtgatggtttttgaggaggtttgttcggagcgtatcgatttgatttataaaaattatcggaaattttgtaatttgttgatcgacgtggaggagtggggttaggtggttattattagtatgtttattcgttacgttcgtacgtagtttttgagttttatttagaacgtaagtgggtttagtttaggtagagcgggtcgaagtgtgtttcggggaggcgtttatagattcgtcggttttttcgtttaggaatttttattagaggagaacgcggaaaaagttttttacggtttagaggaggacgaggttaagggcgcggggtttgaggagacggtcgtcgcggtcgttttttttcgaaagttttatgttatggatttcgattatcggttgttgttgcgtaatattaaatttttgttgtagagtcgtagcgtcgcggtggtgatggcggtggcgtagttttatttttatttggcgtttaaggcggaagtgggcgttatcgttaaggcgttggtgcgtttgttgcgtagttataggtgcgtttcgtttttagtttcgttttttttttcgttttttgtttcgttttacgggttgttcggtttcgtttttttacgtttattagtcgtttttatttttgtttattcgttttatattgatcgtagttttgtttttcgtattggtttttttttcgtaacgatttgttttattttttttttttattcgttgatttttgttttaatcgaggggttcggggtgttttgattcgtttttttcgtagtgaggtgtagtacgttgtgttttagaacgtggttattatgtttattaagcgtcgggtgagtttgcgacggcgggttgttttcgttgttcgagggtcgtttttgcgggtattggaggcgttgtcggggttgggatcggggtcgg

SEQ ID NO: 7451 - DNA, 693 bp, Artificial Sequence
  Description of Artificial Sequence: Synthetic polynucleotide
cggattcgttttatttgaggatttcgggtttatataggcgatcgtttcggttttagattggaagcgatattttagggattaaagtttttagttcgcgttcggttttagtttttgttttcgttttagagtcgtagcgagtagggttttgcggtatcgtttagagattggtttaggaggttttagtttttagcgttagtatatatttatcggttgtagtagttttattagttttgttttttttttcgggtttcggttatattaagagtttcggaaacgtcgagaattttgcgggtttagaacgttcgcgcggacgttttttttacggcgtcggaagtcggcgtcgagtttgttatcgggtatttttttgttgttttgacgacggcgggcgttgtaagagtggagaagttgtaggtgttgaggcgcggtgaaagaaattttgggagttaagagtacgaggagttggtgtttgtgttatatttgtatttgcgggtaagaaatcgttggtgtagcggcgggttagggtttgggagtcgatttagggtttaggtgtacggagcgggtttttcgggaattttgagagtggtcgtttttcggagatgaagggacgagggcgtagcgattttcgtatttatttcgttttacgaatattcgtttcgtattcgtcggttattcggggataaaacgtttgttcgt

SEQ ID NO: 7452 - DNA, 1496 bp, Artificial Sequence
  Description of Artificial Sequence: Synthetic polynucleotide
cgttttcgaattcggagaaagtagttcgttcgtttttttattcggtagttagtttagtttattcgagagttgagttcgagaagtcggtttttgacggtgttggcgtggcgtttgttaaaatatgttttttgtattttaatttttttcggttattttttttgtacgtatagttcgttcggggttatttcggttttttagcgtagttttttcgatttttgtttttttttttttcgatttatgtttgtttaaggtcgaatgtaaaatttatttttaagaaagcgtagcgggtacggggggtatttagcgtgttatgtttcgtagtttttttttagttaagattagagttttagattttagattacggaaatgagtgttatttagattaaggattgcgcgtttgcggtttcggttttcggttttgggtgtttttttggggtgtttgtgcgtttcggtatttttcgtcgtcgttcgtgagtttgcgttttttatttatttaggtttgggagcgttttttatttaaggtttgggagtattttttaattattttcgttacgtttattttattttttatcgcggttcggattgtagtaaaatcgggtagcgcgagggttaaaaagtggaaaggagagcgttttttcgtgtcgtgtagttagttcgttaattttttttttttagtttcgattttcgtaattttaaatgtaatttttttttttcggtttcggtttttttcgggttgcggttagcgggcgtcgcgttgcgaggcgtggagcgggcgggttgtcgcgaggttgcgggtggcggtgtcggttatagtcgcgagttggcgagtgggtgggtgggtgggtggggaggagggagaggataggcggggagagagacgggtgtggggaggggagggagggggagatttcgtttttttgtcgtttttagttcgggcggggggcggggggaggaggtcgcgatgagggaggggaggagggagggaggaagggagggagggagtcgaggaagacgtttcgataattcgtgcgtttcgtaaggttcggagtatttgtatatttttgtagtcgcgcggcgagttattcgcggcggttgttgtagtttttattgtatttttttttttttttttttttcgggtttcgggtgtgtgtatgtgtgagagtgagtgtgtgtgttttgtaggtgcgtggtgtgttcgttttaattttgtttagtaggtgggatttggtgattttagtattattttttttttttttttttttttttttgtttttttatcgtttgttgtaattttgtaaagtttcggagtcggagagcgcgtttcgtttttagagttttcggattcggcgagttagcgatcgtcgagtcggttattatgttcggtagatcgcgttattaggcgtttttcgcggtttttattcggcggcggcggcggcggcggcggcgttcgcgatggttttagacgttgaaggattttgtatttgatcgttcggcgt

SEQ ID NO: 7453 - DNA, 5820 bp, Artificial Sequence; identical to SEQ ID NO: 7206
  Description of Artificial Sequence: Synthetic polynucleotide

SEQ ID NO: 7454 - DNA, 699 bp, Artificial Sequence
  Description of Artificial Sequence: Synthetic polynucleotide
cgtcgcggtttttaaaggtcgttgttgtgggtgcgtatattcgggttggagaaatttcggcggttttgtatcgcgcggtttcgtttgggttttggagggcgtattcgtttcgtttgggttgtttcgcggtttatggttaagcgttttttgtttagttcggaatcgggcgttcgagttagcgaataggtcggttcgttttagttggtcgagttcgattcgtcgcgcgttcgggttaggcgagcgcggcgcggcggattagttttgagttcgtagtttcgagggcgcggggcgggcgcgtttggggtatgagggcggggcgggcggcggtcgcgtttttaatttcggcgttgcgtgtgggagcggtcggattagggaattagcgttgtaatttcggattagtaacgttcgttaaatgagtgtttaatttcgattttttatgttttttagcgtcgcggttgagttttaggaggttttttggttaggtttttttcgcgttttggttttatttttcgggaggttcggtcgcggtcggtagagaatttttcggtttgtggagattcggttttaggtcgcgtcgtagttttttttcggtagcgtattttattggttcgggtagaggtttatgtagttttatagcgttcggagttgggagttcgtggattagagaaaaggaagtttcggatgtttcgtttattacgg

SEQ ID NO: 7455 - DNA, 1845 bp, Artificial Sequence
  Description of Artificial Sequence: Synthetic polynucleotide
cgtacgcggcgcgggattcgagaagagcgtttggtagagtataaattttatagaagaagagattttttgttttttttgagattttattttttttttgtttagggttaggaagtttttttcgggtttttttagaatttcggttgtttttttatttgtcgtttatcgttttttggaggtttcggagaggggttcggttcggcgagtcgaaggttgcggggcggggcgcgagttttagtttttgggatatatagtcggtgcgtttcgcgttttaagtgcgtattttaggaagttcggagtcgggaggattcgggttcgcggttttattttatttttggcgaggtcgggagaaaaaaagcgttagatcgttcgtttgagggtttagaagtttatcgggcggcggtatagattttttcgaaatgttttcgttttcgcgttgcgagcgtataggaatttagggtcgtcggggttgtcgtggtttggttgaacgtttaaagttaggcgagggcggggggttttagtttagttatgcgagtttttttttagtggtgttagtttttacgtcgggttttcgggtcggcgggaggcgcgtgtgtttgtttgtgtgtgtaggggatatttcgttttttagtagtttatgtagaatttcgtttttcgtttcggttttaggaattttttttttagtttagagatttttgcgcgttttttgtttattttgttaaggcgagaaagcggtcgtgttggagataaagaaatttttgtttttttttattttcggttttttcgttcgttcgagatatttttcggcgttttttttcgatttcggcgatattgcgtttggatacgttaggtaggggggtagggtgggcgagttcgtttttcgacgcgggttagttgggggtttttcgtgaatttcgttcggggatattttatagtagtcgcgtttttatttttttttttttaaatcgtttcgggtttttgtcgtcgttattttttgttaaatcgtttttatttttttagcggagttatagcggggcgcggcgtatataaagggggtcggagggtggagagtatagaaggagggagagatttcgttagggttcgtggtacgggtttgggagtagttatttattcgatttttttttcgatttttgagatgtttgcgaagatgaggaagattacgagtagcgtgagcgcggttagtatttagtttcggaattgtagttgtatggtgggttcgcgttcgtcgggatttacgcgggtcggcgcgaggagtaggggtcggagggcgtagcggcggacgtcggagttttcgcgcgtcgcgcgtagttgggtagatattttgcgtttcggacgagttcgggtcggcggcggtagcggtagcggtagcggtagcgataggtaggggttgtttaggcgcggcgagttcgttcgttttttttcggttttcgtttgtttttttttttttttttttttttttttcgttttgcgttcggtttcgcgcgtagtttgatagttttgtttcgcgtttttgttcgtttttttttattaattttagcgtttaggcgttagtttttgtttttttcgtttggttttatttagttttcgagggcgcggggatgtagtcggacgttatttttggtttagagagattgggttttggttatcgcgagcgatcgggtacggagttgagtttagggaagtgcgcgtatcgttcggcgtattttttaggttggtaaacgttttttttcgttcgttttttgtttagttttttcgttttttcgtaaagttttttcgatataaagattaatatttggggatagtttttagcgcgcggcgagaaggcgg

SEQ ID NO: 7456 - DNA, 1844 bp, Artificial Sequence
  Description of Artificial Sequence: Synthetic polynucleotide
cgattagagattcggcgtacggagcggagtttttggtttttatttgtattaatttagttcgcggtcgtagtttttgttaaagaagtggggtttcgtgtttaaggttcgtacgttcgggtgtattcggataaattttagtacggttcgggtgttttttttttttacgtttataatgagggtttggggtaatcgtttggtatttagtttgggtgagtcggagtggttggaatcggagaggcgaggggcgggtacggcggcggcgggcgcgttgggagcgttgggttcgttgggcgtcggttcggagggattataggggcgggatttttggagaagtttttggtcgttcgcgttggggtcgcggaggtagcgaggcgcgtcgaggaggcggtttcgatttaggtcgtcgtagtagtataggaagttgtaatataggtaagtgtaggagagcgagagcgtgaaggcgaagagtagtttgcgcgtttttcgcggttgaggtggtttcgcgcggtttaggattttataggttatggttttatgggttcgcgtcgggggttatggttttcgagggggtatcggcggttgagttgttgtggttttgcggtcgtttagagggttcgcgtggcgttgttacggttacgcgggtcgggcgttgggggcgtcgtttttttcgggggttgttgattagggtgcgtatagtgttagggggtttcgggggtagcggtttttcggggaataggcggttgtatttttagtatttttcggttttaggcgatggggtttcgggtagtcgggcggttcgggcgtttttaggtttttacgtgcgtcgggttcggagcgcgtttagcgttcgaagttttatttttgattttcggagcgtcgtttacgaaacgttcggcggcggcgcggttgtgcgggttggcgggtggatcggacggtggcgttggcgtcggtcgcgatttggtttttcgggaaatgtcgagcggagcgcgttgtcggttttatttaaggagtggtttgacgttagtcgcgcgggtttttcgagttcgcgtcgcgtttagggatttggttcgttttttgcgtttttatttttttattttttttagaaatatagtacgcgggttttttttatgtaggttattttttacggagttttaggttagttttggggcggtgaaacgaaggtgttaaggtatagtattttttcgggaggttggatatttttattacgttggtttttcgatatttagggatacgaatttaggtcgagatcgcgtcgatatgtagattagatagatttagacgtagacgtaggtattttgttttgatgcgcggttttattattttgattcgtatacgtacgtataggtatagaagtatacgcgttttagttcggatatatttttatatttacgcgggggtggggaggagaagttttttaatttgggtttagatatatcgataaggatatttttttcgttttcgatatttcgttaaatggatatatatagttcggaatcggatatcgagcgtacgtacgttttggattgggatacgcgttgtagacgggatgggtggaggagtcgagcgtgagtgagatttcgtgattatttatttagttttttagtttttagcgcgttgatttatatttcggcggttcgttttgtttcgtatttatgaggtacgcgcgtattttaatttattgttattttattttttttcgggtttgtcggagagcgagtttcggagcggtagatttcgcgttaggagggttttttttttagtagtcgtcgtttagcggtagattgtttttcggggagttgtttagggtattagagggtcgtcga

SEQ ID NO: 7457 - DNA, 1480 bp, Artificial Sequence
  Description of Artificial Sequence: Synthetic polynucleotide
cgttttcggcgggttttgttgttttacgttcgtcgtggggatttttttttaggagcgttttgtttgggattttttttgcgttttagatttttattttggttcggatttttttcgggggcgtttttttatttttaggttttcgttcgcgttcggcgtggcggtttttttttttcgtgcgggcgggtttcggaatagtgtcgtcggtcgtttgtaggtgtttttttacggaggggcgcgcgtttttgcgtcgtggtcgttgttaggcgttagcggtttttagtcgaggtgtattcgcgtttcgggtttcgggcgcgtcgtagtcgtttttttatcgtcgttcgtttcgttagttcgtttcgtacgtttttcgcgtcgcgtttttatttcggggttggggggggtatgggttcgcgtcgcgttcgtcgtcgtcgattttaggtattcgagtttcggggcgcggcgggtagcggtcgttgacgcggggcgttagttgttaatttcgcgcgcggagtttttcggcggtgtagtttcgtttcggcggcgcgggcggtatgaagattagtcgtcgcggtcgagcgtttttggtcgtggttttgaatttgttggcgttgttgttcgttattatcgttttttttattacgtattggtgttagggtacgtagcgggtttttaagtcgggttgcggttagggcgggcgcgttaattgttttaattcgggcgttaacgttacggttaacggtatcgtcgttttcgtcgtcgtcgtcgtcgtcgttatcgtttcggggaacggtttttttggcggcgcgttttatagttgggagatcggcgacgatcgttttttttttaggaatttttatatcggtatttggtattcgtgcgaggaggagtttagcgggtttggtgagtgcgcgcgggcggcggttagttcggtttcggttttttcggggcggcgcggttatcgaggttcgagtttcggattcgttcgtttttttttcgtcgtttgggtttagtttttagcgtttcgtttggttaggggcgacgtttcggggtagggggcgcgcgtcgtttcggggtcggggattagtatggggggacgtgcgggacgtttcgtcgtggagaggtgtaaggtagagtttttattcgttgcggacgtttcgcggttttggggacgttttcgcgtttcgggaaggcgtttattttcgttgtcggtcggaggggcgcgcgttgtttttcgtttttgaatttatttttacgttcgttttttttttttttttttttcgcggggtattagatgtttttatttatttcggaacgtttttgggggtgggggtgatgtagggatttttgttattagtcgttttttttgtcgtagatttatagattcgggagttttttatttttatcgttaatttacgtcgaattttttagacgggagtggggagtgggggagtttcgcgggttttcggaaagtcgtattcgt

SEQ ID NO: 7458 - DNA, 5065 bp, Artificial Sequence
  Description of Artificial Sequence: Synthetic polynucleotide
cgttaagcgtttttttcgggtgcggttttttttcgttagtgaggtcgcgatttcggcgtagttgtcgttttatttcgggttatttttattcgttattgcggattagtttttaagtattaggttttttggcggaatttgtaagtttaaatttcgttattcggattttttagtagttttttttttattttatttttatttagagttaggagggtgttatcgtacgtagagcgcgtaggtttttggggtgagtagggcgcgtggagggattttaggagtggtattttattttcgttcgtcgtttattttcgattcgtataaaaataaagaataatttttattttgtttttgtttttattgatgtatttttttgtatcgcggtacgcggagtttcgttagcgttttgatattgtagcgttcgtattagcgaattacggaatttgggatcgagataatggttcgtaattgatgtattgttattaataataaagattaattttttttttttcgttatttcgattatttttttttttttattttttttttttttattttttattttttttttcggggttatcgagggaaagaaaataaataagaaattagcgggggacgttaagcgtagatcgaaacgttcgtttttacgtcgtcgaggacgtaaaaaaacgaaaaaagttattaaagtttggattttttaatttattcgtttttgttcgtttatttttaattaagtatcgcgtagttgtttttcgtatgtttatttcgtttggttgtttgttgtggtgtttttttggggggggggaattttttttttttttatatttaattttaaattatacgtagattaagtaataaatacgtgtgaagttattttcgggagttttttgttgcgtacgcggcgcgtattaggagaaaagttttgcgggatcgttagtttcgttaggtttttggttgtatgcggtgttcgggaggttcggatttttaagaagttaagattgttagagaaggatgcgggcggttttaaatacgggtatatttcgggaaaggagtgtgtaagtgtatataaacgcgttcgtgtatttgggatagtgtggattggtgggtgtgcgaggatttttgtttgtgagatggaggcgggtgcgggatttatacgtgttttcgtatacgtttttcggggtttgggagatgcgagtcgtttatattttaggagtgcgtagatttatttttgtcgagggatttttttaaatatttagtgagaaataatggtatttgaagtattatttatggaaatattattatttttattttttaatattagttttattgatagtttcgtttgtttttttattaaaatttattgtatttattaggatttggcgagaacgggagagcgaggcggagagggtgtgaatgtgtgtgttagggagtgagcgagggtagaagataagtaagagaaaaggtggaaaacggacgagtagggagagagaagggagaagttatattaataaaaaaaaataaagttagtagatgaaaaatagaaatatttatcggtatatatatatatttatattttaaaagaaaagatttaagaagttaagagaaagggaagggttttttatcggagcgtagtataggttcggagtatacgaagtcggttcgggagatcggtgtttatttcgcgcgaatcgatcgtggtatcggttagatttaagggcgttcgcgaattggggcgtttttatgagttttttttttttttgatcgtgagatagggtagggattgtgtatttgtatttttttttttttttattatttagtcgaagtttagtttagtttagtttttcgggcgtaagatttcgagaattttggagcgaggagatttcgaggcgcgaggggaaagagttaggttgagtcgcgtatcgagttttaggttcgcgggcgtttgagttcggtagagggatcgggtttttggttttgggttttggggcgagggtagggaggttgtattttagtttgagggagatggtgatagagcgaaaagttcgggcgtcgcgttcggtaagtgtttaaaaagtggaggcgagtttcggcgtcgttaggtagtttcggatagaatatttttttatcgttttttttttatttcgtttttcggttttgcgtcgttatttcgtttcggaaggttggggcgcggttttttttttagggcggggtgtttaggggttttagggattggtttagtttagtgtcgggttcgttcgggttgtgtttttttaggtcggtgttcgttgttgcgtttagtgtgagtcgtagtttttttttttttttcggtcggagttgaattcggagtttaggtcggttttcgtttttcgttcgttcggggttttgcggcgttatcgttgtcgtcgttttttcgcggagtgacgcgttttgtagttaatcggggtagtcgggggggaggttcgggaggggttttgggcggagtcgggtcgtttttttattttacgggttcggggttgtttttttcgaaaattttagttttaattgttttgggaatgttcgaggtagagaaagggagcgagggagtaagtaagaagttggaggattagtgtttttggcggggaggggatggggtggcgggagaattgtttttttttttagttataaatttattaggtttttaaattttttttggattttttttttcgcgttttcgcgagttcgggatttaggggatggagaattcggggcggaggagcgtcgagttaggcgggagggaggtcgagtcgtgggcgggaggcggatcggcgtggggttggtttttttttattcgtttatttttttttttaatgggggtgggggtgggttgttttttggtagtttttaaagaaacgaagaaatatttacgaaacgggacgtttttttttttgatttcgtcgcgggatttttttttttcgcgggtcggcgcgtttcgttttcgagttgggaagttcgtagcgcgtcggtagttcgggtttttagttttcgtcgttcggttttattttttattcggggcggtttaatttcggggagggtatgttaatttgggtcggtttagttcgggattgtgggggggggcgaaggagggagggaagagggaggggagagggagagagcggggggcgtttgtcggggcgtcgggttcgtagtggagaggaggtcggttttcggcggtcgggtcgcggagtttcgggcggtcgtaaagagggttaatttagtgtcgggcggcgcggcgcgtagagttagtttcgcggtcggtttattgggttagcgcgcggagagataggggtttgtagtaaattacgaattaattgattaaggcgagcgggtttgaatagcgttggttcggtgttaatcgttttttaaagagtttttttatgattaatcgtaatgtattattgataattataattatagtaggatatatgcgcgttgcgttcggggtcggggagtcggggagggggcgggcgggtcggcgggcggggggagtcgtcgtcgtcgtcgtcgttcgattttcgtaattttgagaagatttttttttagtaattttttattttgttttagttgatgtttgagttagtatgtcgcggaggaagtaagcgaagttttaatatttttaattcgatttcgaagtggtttcgttttttcggcgagatggtgagtgtttcggttcgcgtcgtggatatatatatacgtatttatatttacgtatattcggatttatttatacgcggttggttttcgcgttttttattttatcgtcgtcgcggtttcgattgttttttttattcggcgtaattttttttttttttttaatttttaatgtgtttttgttgggttttttttcgttgtttcggggaaagcgagtatatttttcggtaggattttttcggagttgttgggttttttcgggggaaggagggcgggtatgtcggtttggttttttcgtttttgttttttcggggattttagtcgcggttaagattcgggagttttatgaggcgtgggtgcgggtggaggtcgtttcggtttgatcgtacggggtttttagcgttttcggcgtcggttttagggtattcggttcggttttcgtcgttcggttttgttgttagcggtaaggaagtttatttcgggcgttgggttgaatttcgagcgtgggggagttcgttgcgtttttttgtttttacgtatattttttttcggtttgcgaggtagaatcgggtgtttttggaggtttagagttgtaagaagatggggattggtgtcggggcgttagcgtttgattcgttggggttgcggtcggggtggagagtgttgttggtcgttagttgtttcggagacggtgtaaacggacggggaaagtgtcggggtttggttcgtaaaatttattttcgtatttttttttataatatttgtattttttgttttttaaaatttttttggtcggtatgcgttttttgcggatcgtggtgttttttatttttaggggggttagggaagaagttatagaatagttttttaggtttgcgggtggttagttagagtggaattttttttgaaataggggtatttgtttttttcgatggaggcgataattgtgggtttcgaaggggttgaataagtttagaataaagtttgtgtgtgggggttatggtagagagtggaagagattcgggtagggagttggggtataaagggaggatatttggaatttttttttgtttttaaaggtgttttacggtatcggttttaaagtttttaggtttagcgttcgaggcggtgtagcggcgttcggattcgggttttcgggtcgtttcggtacgatgttggtttttcggttgtgggaggacgtataaggagtaatttcggcggggttttagcggtttcggatgttattcgggatgtttacgttttaggcggtattttggggtgtgaaggagggagttgggtttcgatagagtttcgaagcgtgattttgatcggtattttagtttattaagttgcggtcgttcgggtttttaggttttcggttcgt

SEQ ID NO: 7459 - DNA, 2372 bp, Artificial Sequence
  Description of Artificial Sequence: Synthetic polynucleotide
cgagggacgtaggatgaaagaagttaagagtgtcgttagggtttgcgttagcgtcgttagattttcgggatgggggagttttagggtacggcgttagcggatttacggagaaggagaaaagttttattgtcgtgtagaagtttaggttcgggtgagacgtttgcgaaggttgttagtagcggaagagaaggggcgtttttcgtgttgcgtagtattcgttcgcggtaggtgggcgcggagtttagagttgggagttaaacgtaaacgttggcgagaagttttagtttttttcggtagtttattcgttgcggggaggggttttttacgtttttagtttttgggagattgtatcggaggtcggaagtaagtcgggcgaggatgaattatttcgtttaatttttttttttcggttttttagttttcgtacgtcggttttttttagagattttgtagtcgcgagcgaagattgttttatttttagattttatcgaattttttgtggtttgcggagacgaggagacggacgggtttggtggttaatgagagtttcgattttttgtttttcgtttaatgggtcgttgtttatgggtcggggcgggattaggagggtaggtaggggcggttcgggttggcgcgcggcgcggcggttacgcggttgcggtttatagagttagcgtttttttgggtgttcgtgttagtgttgcgcgggaaggtattattattatagtcgtcgtcgttggttagggtgttggataagacgggttcgtcggttatttcgttagtttaggtattcgttgtagtcgtcgttgtttttttttagatcggtttttatggaggagatggaagaggagttgaaatgtttcgtgtgcggttttttttatcgggagtttattattttgttttgtttttataatttgtgttaggcgtgcgttcgtaatattttggtgtagattttagagtttgaatttttttagagttatcgggtcgcgggtttcggggttttcgattatgattatttggatttggataagatgagtttatatagcgaggcggatagcggttatggtttttacggggggttcgttagcgtttttattatttcgtgttagaagttttttaacggcgttcgcgtgtttttttcggttatgtcgttatcggttatttatttgttatcggttttggtttcggtgtttcgtaatttttgtattatttgtttttagtgttatcgtagttttattttggatgatcgggggtttcgcggtttttttaagaatcgcgtattggaaggggtaattgatcgttattagtagagtaaagtcgcggtttttaagtgttagttttgcgagaaggcgtttaaggaagttatcgttatgtgcgaatagtgcgatgttttttattgcgattcgtgtcgtttgcgttgttattcgtttcgggggtttttagttaagtatcgtttggtgttttcggtttagggtcgtgtgagtcggaggttgagtttacgtaaggtttttatttgtatagattacgagttggagaattatagtatgtattgcgtgtaatgtaagatgttcgtgtgttattagtgtttggaggagggtaaatattttagttacgaagttaaggttttgggggttatgtggaaattatataaggtgagttttaagaaaatttatttttaattttttgcgttttcgattattcggttttgtagtagacggttttcgttttttgcgtatagcgtattttagtgggggcgtaatgtaggtgttttcgatgtttatttttttggtttggtgtattgtaggaggtatgggggaattttaatcggcgtacgggggagttgaatgtttttatagagttgttgcggggatgttttagagcgggtttttcggggcgcgttgtttgcgagcgggatttagggcgtttttttttcgcggcgggtttgtagttagtggtcgcggttagtgtgtgggaaagtattgtatagttgggtagagtcgcgttagtgtttagggtcgttaggtacgttcgagggtagggcgggttgcgaattttcggggagggattgggatgggggcggtggggtcgcgcggacggcgggagtttgtcgttgttggataggcggatttggtgaggtacggcggagggtcggggagacgtcgtaggcggaatattgatgagttcggttttgggttagatttggttttcgagttggagagaacgcggggttttggtgttacgtgtttaaaagatagagcggagagggtagttagcggtcgttatggtaacgcgacgtgtaggtttgggtttgaattttttcggagttgggatttgagattagagtgttaggatcggagtttgcgtagtcgcgg

SEQ ID NO: 7460 - DNA, 2372 bp, Artificial Sequence; identical to SEQ ID NO: 7459
  Description of Artificial Sequence: Synthetic polynucleotide

SEQ ID NO: 7461 - DNA, 2372 bp, Artificial Sequence; identical to SEQ ID NO: 7459
  Description of Artificial Sequence: Synthetic polynucleotide

SEQ ID NO: 7462 - DNA, 2142 bp, Artificial Sequence
  Description of Artificial Sequence: Synthetic polynucleotide
cgtagttggtttcgaggttgtgcggtttttagttttgcggagtagtttaggttatcgttttcgtggtcgcgggggagggtattttcgacggtcgtagtaatgggtaagagattagggtttttttattttcgcgattcgtttttttttgtttggtaattaagcgggatgttttattttattttttaaacggagcggattatatatagtagtattttatggttttttttgttgcggttttttcgggggaaggtatttttagagggtggttaagttttttttagcggtcggttttcgggagggggatagaatttaggagttagttttttgttttcgtataaaggttcgtttttttttagggcgtttttgggtggagcgaagcggtcgaggggattacgataatgtttttttgtttttcggatcgatggttaggtttttagagttaggagcgttcgggattttagggtagggagtaaagtttatatcgtaatttcgttattcgttcgcgttttgttagtttgttggggttatagcgcgtaggttagtagtcgtattcgtcgttgcggggttttttttgcgttgagtttattttttgtaacgtcgttgttttaaattttgcgggttatttggtttcgggggtggggttttttgggggtcgcggggtagttcggatgagaggatgattcgggagttttttgggggcggagtggaaggggtagttttaggtagttttggttaggagtttttatttcgttagtttcgttgttttagcggtcgttgttttagaaaagttaacgagaattagatgtggtggttattgtcgaatttttttagagtcggtgattggtttttagtcgagggttttagttaattagtttgttgggtgggtttggagtttcgtttcgtttaggcgttcgcggagatttaggttcgaggttggcgcggcgcggagagtgggttggaggtcggggcgggacgcgttgtgtagcgggtaagcgtacggtcgagcgagtatggagggggatcgggtggtcgggcggtcggtgttgtcgtcgttattagtgttattgttgttgtcgttgttaatgttgcgggtcgcggcgttgtatttagacgagttttttttatacggggagtcgtggggggattagtttttgtaggaaggcgacgacgaaagtttagtcgtggtgaagttggcgaattttttgtatttttacgaagttcgatttagtaatttttacgtaagtttagtttttttttggtatttttttcgtagttttttttttggggtcggttttacggaaattttgtttttagaggggaggaaatagattttatttttggagttttttagtatttttgcggtggtattcggttagagagcgatgtcgttgtttgtttcgttgttgtaggggagtaagaatgatttggaggggagagtaagaattgttcgtagttacgtacgcgttttaggtagaaaaggtggcgttgttagggcggttagcgggttttgtagttaggatcgcgagaaggttgtgttcgtttgcggagttggggtgttttttttttagatttggaggtttttttttcgaggatatggggtttcggggttgtgaggggagtgagaagataggtgaacgagttttagggtttttggatttattgtagcgcggagttgggatagtcgtaaaagttgcgtttgtttttttgaatttagattttttggttagtggggaaggagagagaggttttttgtttaagttagtttttttttttttttgcgcgaaagggtagcgtttttgggtttgagcgattgttatttttttgtttttttttttttttaggtgggtattaacggtattatttttatttaggatttttttagggaaacgtagtatgtggattatgatttttttatcgatttttcggttatcgttttttttttggcggatatcgatacgagttacggtagaggtcgagttttgtatcgagaggatatttttttcgtagtgttgggtttggtcgttcgttatgtgcgcgttggtttttcgcgttttgcgcgttttatttttatttacgtttttttggttatttgggagtaggtaggcgtttacgaggaggttaagcgcggggcgttgttttcgg

SEQ ID NO: 7463 - DNA, 544 bp, Artificial Sequence
  Description of Artificial Sequence: Synthetic polynucleotide
cggtttttagtcggttttgtgttgttcgttgcgaatatagttcgtgggttatcgggtagtcgagttatgtaagttattttgatttttaaaaggtagacgtataaattcgatttagaattcgaggcgaattttgaatttatagcgttaaaaacgcgtagtgttttcgtttgttcggttcgttgaaggttggttttgggtttgggggtagtgttcgcgaagggttgcgatggtaggtttcgttgttatacggtatcgagggttttttcgtttcggcgttaggcgtacgtttttttgttatatttttcgcggggcgcgtcgttagggttatttgtttttttaagtttcgttaggtagttaagggtgaggagcggagagggattcggtcgttgttgtcgcgagttagtataaaggtagcgtttgaaatcgaattttttattttgggtatcgcggtttttttttatttttggttttcgcggtcggagcgtatttattgttagtcgttatggtcggacgagggggttgttcgacggtcgtttaggttcgg

SEQ ID NO: 7464 - DNA, 2002 bp, Artificial Sequence
  Description of Artificial Sequence: Synthetic polynucleotide
cgttttcgtttcgtgttaagcgggtttaaggttcgaggttttttcgtttataatttcggtgttcggaatacgttttcgaggggtcgtgttgtcggggttattattcgcgattggatttcgcgtcgtgttgtttttttcgggtttcgagttcgtttagcggtttgtacggtttaggtttgagttgcgggttttttttgtggggcgcgttgggagtgagttttatttttaaagtttattttaacgttttaggtatgattacgacggtagaggtcggtcgtttattttcgttttttttttcggttagagcgtttttgtcgggagtcgacgatcgcggtttgatttcgggttttatcgtttattttcggttttcgttttttttttacggttaggggttatatatagcggacgtttcgtttttagtcgtttttttgatttttgaatttgggagttagcgtgttcgttggggtatgtattgttacgggtattgggatttttttgttgttgcggggaggagtttcgacggtaggtgggaagatttagtttgttcgcgttttcgttttttagtttttgcgattcgggtcgaggtttttagtttttgggttttttcgtttcgggtttgagggaggggtcgggttttcgggtttgtagattcgttatcgcgcgtgcgtatgcgtcggtcgcgagttttcgggtgtaggtttgggcggtttcggttcgcgtatttgtttaggcgttgcggtttagcgcgttttaatttttagttcgggcggagagcgggggcgggattgaagtatcgtgttttttaaagtattttttcgtcgtcggtagttttggtttcgtaaatgttttagcgcgtttaggcgtacgtagagattggcgcggtagttttcgggttaacggtacgcgagtaaagttggttggcgatttgggatacgtagtagaagttgaggttgtatcgattttcgtcgtttcgggggaggtatgggttcgggtaggtttaggaggaagttgtatagttcgaggttcgggcgggagtggcgggtcgcgggtaagggaacgtatatttggaaggggttaggatttcggttggagtttggttttttatggcgaggaagtcgattgggaagggttttttggcgaggtttttttgttgtgttattttttttcggtagcgtcgggcgcggggaacgcggggttgtatcggggcgggggagggggttttattcggcggtttcgaggattcgattttggggtcgggttcggcgggtaggtttgtttaggagttagttggtaaatgtagcggattgttacgttattttattgttattatttattgtaaattattgttttaagttttcgggagaattcgtcgaatttgagaggggggagggggatgggggtgggcgcgtaggaagttttataggtattagggattggtgatttaggatattagtttttcgagttttttttgggaatttttagtatttagattgtttttgattgtagggattacggtggggcgttttttttttaagtttttttcgggatatcgggcgcgtttttttcgtttttgggttagcgtatatttttttacgcgatgattagtatagttattgtgaggttcggttttggtcgcgtttgttttttgcgagtgataataataaaaattattggaattgtaaggaagtttttggtttcggttttttagtcgttgttgttttgggtgtttcggttgcggaaagatttcgtagtcgggttcgatttacgagtggaatatcgggttgcggatttagtcgggtttataggattggcgcggggtttcggggataggtttcgtagggtttttttgcgtatcgtttgggacgtcgattttgttaatttggaggataatttttgtttttattttattagtagatttttaaaaatttagtcgtcgttgaaacgtgttttttattcgttcggtttgtttgtagtttttgacgagtttcggtatagttttcgg

SEQ ID NO: 7465 - DNA, 983 bp, Artificial Sequence
  Description of Artificial Sequence: Synthetic polynucleotide
cggtgtcgcgcgttcgtttgttgtttggagtttttaattcggcggaatttaggttaggacgcgtcgtcgttttgacgtgttgtcggtcgggaggcgcgggcgttaggttttaacgattagggtgggtggtcgcggggtaggggttggatttgaattcgtttttcgggggttttggatgcgggatgcgggatgcgggatgcgggttcgattttttcgttgttggtcgaggagcgttttgagagtttttttttcgcgcgcgaggataaatatgcgcggtttgttagttagtgcggcgttgttttttagttgatagggtgacgtttcgtttggaggtttggagattggttttttgatttggtttttttcggtagtttaatgggtaaagtttttcgttcgtttagaaattagttttttcgcgcgttttttttgcgcgcggcgaggtcgagacgtttttcgcggtgatagcgtgtaaggcggagattcggcgcgtttttagtttagggaaagtttaggcgacgcgatcgtaagttcgagtttaggtttttcggagtcgttagggcgcgtcgggttgtttgtttttttgtttttttttgtaggaatttttcgtcgttcgcggtcgggatttcgggtttttttcgggcgtagattttagttatcgttttgggtcggggtttttttttttttgaaattcgtgcggaaggatttttttcggggtttttcgttttggttttagatatttttttttttagatttcgcgttttagatgcgttgtttcgtagttttttgatagttgcgagtttacgaatttcggcgggagggcggcggcggcggattgatatgtttcggacgcggttgcggtcggcgggtagttcgcgggggcgatgagtcgttgcgatcggtgaggcgtcgggcggcgggggtatcgcgtattttttttattttttttttttgtttatttcgttcgggaggtcgagaggaaacgg

SEQ ID NO: 7466 - DNA, 947 bp, Artificial Sequence
  Description of Artificial Sequence: Synthetic polynucleotide
cgttcggtgtttattttcgggattttgaatttcgttttttttttattttttgttagattcgcgagggttaggaagggttttgggaggaagcgggagcgtagcggcggggtatggaagaagagggttgggggcgcgcgttatttgtaaaggttttcgaggtttttttttagttttggtggtaatttcgtttagcgtcgcgtttttttttagatttaaatttttgttgggtttttcgggtggcggcggcggcgacggcggcggttgttggagttaagttttgtcgttcgtagcgtcggggcgcgggggtgcggaggtcggagttttagagcggcgcgcgttttttcgtagcgggtcggggtcggggcgtttagttcgtttcgtttgttttcgtttacgttttttacggagttgcggtatcgttttttttcgtttttcgttattatcgtttttagggttcgggtatgttatttttttttggtttcggtcgtcgcgattttcgtttttttttttttttcgttttttttttttcgtttcgttaagttaacgaattttaaaagaagtatagcgagcggggaaggcggtagaaagttgtttcgcggcgtcggagtttttcggatttggaggatttcgggattcggcgggagagttaggcgggttttttttcgacgcgtgtgtgcggatagttcggagtcgggcgtgcggcgttgcgcgggggcgggcgtagggttcgttttaagtgttgcgttcgttcggcgtgggtttggaggttgtttagattatattattgttttaattcgacgcggtcgggttaatgtaggcgtcgcggtttttatttttattttttttgatattttcggatatgtttatagtaatgaattcgcgggatcgttttcgtagttttcgcgtttttttttttttttcgtttttcgcgttttggcgcgtttcgt

SEQ ID NO: 7467 - DNA, 1362 bp, Artificial Sequence
  Description of Artificial Sequence: Synthetic polynucleotide
cggttttcgggttttgcgaagggagttttgttcgcgaggcggagggtttggtttatcgagaagcgtattcggaggcggttgaggggcgcgcggggtacgtagtagagtcgtagttcggttcggattcggagcgtcggagtcgtaggaaggcgaggagaaggaaaaaaaggaggttgtcgtcggtttttgttttattttttcgggtagcgttgattcgttggtcgtcgtcggatagggttggtcgtcgggcgcgggatttcgtgcgcgttgtttatgttttcgtttgtcgttggttaggtgtgcgcgtagtttgttggtttttgggcggtattcgggggttttttatgtttcgcgtcggggttcggcgggaggatttcggagaggtagcgcggagggaaagagagagagatagtatgagaacgcgtagagttgtatttcgcgggggtcgggcgttagtagtatcgcgttgttttatttacggcgcgtttgtttttcgcgttgcgcgtttagcggggcgtcgagttttagaaattttagtatatggtcggttcggcggttacggtggtcgtagttgttttgtttttcgagcgttttttattgttttttgttttaagttttagagcgtagtttattagcggcgatcgcgatcgtagcggcggggcgtttattcggtcgtaagtatagtagtgcgtatttgcgggaaaggaggaaggggttggcggcgtcggggtttttataggggaggggtatttcggcggtagtaatcggcgtaggttaaggtattttgggtcggggttgcgcgcgagttaggtggtggtaggtcgggattggggagggtttttgcgtttttcgtttcgcggcgtcgttgttgatgacgcgcgcgggttttttcggtttcgcgtttgcggagttagtttcgttatttagcgattcgtttcggggagttttcgttgacgcgcgttgcgagtcgggttgcggtagtcgaggggcggggagggaggggagggggagttttagtgcggggagggtcggcggttgcgggttaagttttttttttcgttttttttttcgcgttggggagggggttcgggaaagacgtggttttcgtttggttttggaggatgggaggttttcgcggggcgggggggacggagggaggtattgagtgtttttgttttcgtagtggggatgtagtagtaggtggcggttatgtggtttgtggaggttcggtatttagaggcgcgcggtgagttcgtttcggcgggagcgtggcgaatgtggttttgggcgcgcgggtgtgtgggatacgtttttatttacgtggcgtatatggggatttggggacgcgggtgaaagaggcgt

SEQ ID NO: 7468 - DNA, 1092 bp, Artificial Sequence
  Description of Artificial Sequence: Synthetic polynucleotide
cgatcgcggcgcgtcgacgtttggcgggttacggttataaagcgggttttagagttttttttaggcggcggtaaagggggcgttcgaggttatcggtaagagatagattattggcgtttcgggaaaatagagtggggaagggcgagattgtgtgtttatttacgttcgcgcgggtttgagttggttcggttttggagggtttcgggattttagaagggggatagtagtgggggatgggtagaagggggcgattcgggttgtttaggtttttcgtagtttttttgttaacgagaggggttcgggcgggaatagttcgagtcgcgggggtgcggggcgcgtagttcgttttatttcgggagagtcgcgatcgtcgttttcgacgcgtgtattaagtgggggtgttcggttcgggataaaggatcgggacgcggatcgcgggcgggcgttattgtttagttttagcgtggagggcgagatcgtggtttcgaatttttttaaatttggcggttcggggcgcgtgggggggacgtttcgttatttgcgcggttataaaggagagatttatggtgtcgttgtagttagcgttcgagttttcgttgttgtcgttgtcgttgcgggttagtcgtttgtatagttggcggggatcgggttgagtagcgagcgttcggagatcgtacggcgtattcggttgtttttgggtttttggttttagatttttattaggcggagggtttcgagtgcgggggcgggcggggcggggtggggcggggttcggcggacggggcgtttttttacgtgattatttttcgttttattttcggggcggggttcgttagaaattttaagcgttcgtaatcgttttttttcgtgggcgggatggggaaattgaggttcgaggtcgtttcgttggttggtgtaagaattagtttgtaatttaagttttgagttgttggcgtttcgtttcgtgtagttgaatttaatttattcggggttgtgggtagcgtttttttggggttgatacgttatttcgagtttgaggattaagatcggagtgatttggttttttacgttaacgttttttttagagttcgg

SEQ ID NO: 7469 - DNA, 1092 bp, Artificial Sequence; identical to SEQ ID NO: 7468
  Description of Artificial Sequence: Synthetic polynucleotide

SEQ ID NO: 7470 - DNA, 1092 bp, Artificial Sequence; identical to SEQ ID NO: 7468
  Description of Artificial Sequence: Synthetic polynucleotide

SEQ ID NO: 7471 - DNA, 580 bp, Artificial Sequence
  Description of Artificial Sequence: Synthetic polynucleotide
cgtgtttaggggagttcgatagagtacgcgggaaaagtcgggtgtttacgttttcgcgatttaggttgtagagataagagaaggttaggttttgggaggacgcgaggtcgtttaggaatggtagggaggttcgttggggtttgattttggttttaatggattaaagtttcgacggagtaaggtcgggtgttcgtggtggtattttttattagtggacgttggcgaatgattatggaaataatatttaatagtagtgttttttatgttaggtatataatcgttttggcgtgggttgataattatgtttattttatcgcgtggtattgagtcgatcgtatatttagggtttcggtttttagggttcgtttattcgtttattgcgtgaagtatttattttcgtaggagtcggagtaggaatagggttgggttttggggcgcgcgtatgcgtaggtcgtgttttaggaagggcggggtattgagtcgagggtcggcgcggggcggagggtagggggtggtcgtattttttagggtatttgtgcggtgattgagaatcgattcggtaattcgcgggttcgggcgg

SEQ ID NO: 7472 - DNA, 888 bp, Artificial Sequence
  Description of Artificial Sequence: Synthetic polynucleotide
cgattcgttttttggtcgtttttttcgcggttaggcgtattttgtagcgtttagatcgtcgcgtttttattcgcgtttttaatcgcgagcgttcgtttgggtcgggtcgggcgttcgagattcgggagagattaggggttcgtaaagtagaagagtagatttagaaagaaaaaaaaaaaagcgagaagtgcgagaaaaatatattgaatttagttaaatatacggtagatgaaaaaaatattttgtttagaagttaaaaacgagttttcgagtcgtgagatattgttgcgttttcgttaggcgtgtaggtcggatgttaggggggtaatttcgaggttcgatggtggtttcgattttagggcggatttgcgtttatttttagtttttgtaattgcgggttaggagaaagggatttgttatggcgaagaaaatcgaattttttttaattaggtttttttttaaagagagaaaaagtaggtagttgggtaatttaatttaatttgggattcgggacgtgtgtttgggcgtttttcgggtagttggtcggagcgtgtgggttcggagtttttagcgttggtttcgcgttgtttttcgatgttattagtaaattcgtagggcgttttggcgtaggttcgcgtttgtagagtcggtttgggaagcggaatttttttcggtttcgatgattaggtttttttagggttttggtttaggttgtttttgtgggatagagttttatgaagggatatagaaatagagatagtttttgggcggcgttttcgggatgtggcgtttttgtgtttcggggagggggtattatttttgtttatgcggagcgattcggacgttgtaggggtgacgtcgggtagcgttcgttttgattttttacgg

SEQ ID NO: 7473 - DNA, 1483 bp, Artificial Sequence
  Description of Artificial Sequence: Synthetic polynucleotide
cgcggttttgggcgttggtagggggaggtttcggtaacgtttgggggttttaggttagtttttttcgggttggaaggtatcgtataggggttttcgttaatttcggttttcgcgcggtcgggatacggttatatttgttcgcgggggtttgttttttaggtcgtcgtaggtttttcggagtttaagaggattttataagtagttaaagttagcgtcgtttgttttttgtagaatattgttttttataagttttgtagattttttcggttttttagacgtttttacggttttcgcgaagttattttcgcgttttgaatgttttcgaatttttgtagagttttcgcggttttttggaagttttcgcgttcgtggagtttttttttcgttttcgggggtatcgcgggtttttagtttagttttttcgacgttggtcgttgttattttttacgaggcgtcggtttcgatttattttattgtcgttgtcggggacgggcgcgtcgggttaggggcgattcggcggcggcggcggcggcggcggggcgcgggacgcgggcgttagcgggggagtcggtttcgggcgcggcggtttcgcgtttgattgggttgcggggggtagcgggggtttatttttttcgggtgggcgtcggggtcgttagttgcggggaagggtcgcggcggcggcgattgatagttgggtttcggtttttgttattttggcgggcgcgtgttcgggtcggcgtgtgcgcgggcgcgtgtttgggggtcgtcgtcgggggatgggggggcggggggcgagtcggttggggttcgggcggcgggaacgcgtgcgcgttcgtttgagattcggggcggcggtttttggcgagtgcgcgggcggtttcgagttttcgagggagaggcgcgcgggcgcgcgggttagttttagtatagtagttaagagttagggtacgcgcgttgttgttcgttttatcgtttttcgaggggattgcgcgcgcgtgcgttttttcgttcgcggtcgttgaggtgaatgagcgcgcgcggcggttaaagttcgatataaaaggcgcggggttttatcgttcgcgttttcgggagcgttgagtttgaggttgcgaggggcggggcggacgagagtggcggggttgaggggcggggttttgagggaagcgcgaggggcgtggtcggggtgggggcggggcgtcgggcgggtacgtggcgcggtgcgttttttttcggcgcggacgtttttttagttttcgtttgattttagagtttatagaggttatcgggggagttagggttcgtgttcgatggttttatgatttttattatttggttttgttgagtattttgttcgttcggattcggggtatttttgattcgagggtcgtcgaggttatcggcgattgattttttttttttgtatataaggagtcgtggcggggtcggagagttgtagttttggggcgatattagtattcga

SEQ ID NO: 7474 - DNA, 3714 bp, Artificial Sequence
  Description of Artificial Sequence: Synthetic polynucleotide
cggcgtggttttgttcggaggggtcggtttaaggaagtgttatttattcggagggtggtttcgggttcgttgattagtttttacgtttgtcgtttgagttttattagtttcgtgtggtagtggcggtattagtcgttttcgtcggtcgagtggttttgttttgggtcggtttcggcgttttcgggagtagggcggttgtcgtatgggttttggtcgggttcggcgggtagtttttttcggggggatatttttagtagcggcggcggttcgcgggtcgggtcgttttcggttatttgtagggtgtgggggcggaagcggatagtgagtttgggacgttcgtcggatttagatttttgcgcgttttgttttagcgtgacgtttttgttaaagttaggagttttgggtacgattttggcgtttatttattttttttattttcggaggtttcgtttgcgggttcgttatttttagtaggaggttcggtttttagggatttagcgtatatcgcgagtattttcgtcgtttcgggttttcgtcgttcgtttttttttttaggtcgggtcgcgcgtatcgcgggttgcgtagcgtatagagggacgtcgcggtcgattatggtcggggcgcgggaagagttcggtaggcgttttcggttacgttggtttttcgggggcgtcgcggttacgtgattcggtttcgaggcgtttttatggttcggtttagtcgttcggaagttcgtagagtttgcgagtgtcgcgaggagcgcggtggtttcggtgggcgcgttcgggaggcgagggcggggtcggggaagggcggggttcgggttttcggggcgggcggcgaggggcgggagtttagagagtgtttcgtttttgtttagtgttgggcggcgcgtggggggggtagggttttcgtttttttacgcggtttcgcgtattttaaggattttaatttgttaggtgagtttttgtttcggggaggggcgttgggggcggcggcgaggatttagttgcgcgcgcgtatgcgtttttcgtttttttttcgggatattagggttgcgcgttttttaggaggcgtcgacgtttttttttttataggcgggaaaattgaggttgcggaggggacgtttttgtttaaggtttacggcgaggtgggtcgaggaaggggcgggatttcggtttcgagatttttaggcgtttttttagtaagtttagcgtattttgtgtgtcgcgggttattttaggtttaattgtcgcgcgtgggttagtgtcgtcgcggtgtgcgtttcgagtcgggtagcgatcgcgtcggcgtatttgtgtttcggcgcgtttgcgaacggtacgtgtttttatagtcgcgcgtgtgttcgtaagtgggtgtgcgcgtcgtgtcgttcgggaagcgggaggttttgcgggcgtgcgtcggatttgttgttagtaggtttggtagatgggaatttagtttcggaattaattgtttgtttgttttcggttgggaggtcgttttttcgtttttttttggcgattagttgttttgtgtttagtcgggttttaaatgtcgtcggtattcgcggtcgtaggtagtttcgggttaggtttcgggttagttttaaagttcgggttaagttaggcgggcgcggcgggcgggtttttcgtgacgcgagtgttttttgtcggtcgttgcgtatacggtttcgagattggggagatagcgtcgcgcgttttaggtttgaggcgtattcggaaatttcgaaggtcgtgattcggcggagattaggatacgcggttgtcggtatatacggtgaggttttcgtagagatttagtacgttaaagtgatttttttcgttttgtttatttttttttatttggataagttttttcgtttacgtacgtattttttagaaagtggggtgggtgattttttttcggtttttcgggtcgttgatgattttaggggttcgaaaacgtaagggggtatggaataaagtggtaggggttttttattttttttgagattcgtaagtttgtagtcgttttttatttagtttggggggtcggaagcgttttttttattcgttttttcgtagtttggagaatgaaaacgggcgttagtttatatttggatttgggtattgaggataatatttaaattttatttcgtattgtcggtagatagtatcgtttttcgtcgttttattgtttcgggatatatattttttatatttcgtttttttatttatatacgtaatatagaagtacgtagcggtcgggagtatcggttttgcgtttttggttagttatattcgtaattttagcgtttttatcgtcgcggcgtttcgggaagtataagtttatattttatattcgtagaatacggggtgtataaggttggagttatttcgggggtttacgattagttaggggtttcgattttttatttcgtttattttagtaaggcgtaaggtgagttcgagaatttttgcgttgcgtttttcgttttagttatagttttcgggtgggttcggttgggatatagttttgaaggtagagggagatttggataacgttaatgggggaaagtgcggtagcgagttttagttcgggttgcgggacgcggtttcggatttgtcgtttttttttcggcgtagtattttcggtcgcgcgagtcgcgcggtaaagtaacgggacggcgtttacgtcgttcgtttttttttcgatagtttttattttgtttcgtcgtcgtaggaggtggttggtgaagtttaggatgattttcgagtttaggtagagcgtttttatttttagtaggttgggagttttgcggggcgcgtcgcggggcggttcgggcggttggggtagcgttatggaagagggaagcgcggggagcggtttttagtgtttttcgttatcgtcgtttcgttcgcgcgtttattggtcgcgcgttcgtcgtcgtcgcgtttcgtatcgcgtagggtcgttcgttaagttttcggtttttcgcgtttcgcgttttcgagttttgcgttcgtttcgcgtcgcgcgttttcgcgtttcggtttcgtttgtttgcgtcgatagcgtttttttcgtttcggcggcgagttagatattagttacgcggattggaggtgtggggcgacggtttcgcgcgttattgggcggaggttggaagttagaatcgggtcgcggttcgcgtttatttgtttcgttagtttttagacgtcggtgtttattgtcgggtattcggtagggagagggtagcgcggttgttgtaaaattttttcgattggggtataatcgtagttttttttttttttaatttgttttgaggatacggcgcgttggggttttggtttatggaaacgtttagagtttagtgatttgtgtattttatttcgtttacgttttagagttttcgtttaattttggtttatggatttttaaggtttattttaatcggattacggagcgtgcgtagcgggattcgtagtttgcgtttttattttaggatttcgattgtgtcgttattcgtggttttttttgtttcgatttcgattttttgagggttggaagattcgggttggttgtcgggtacgacgattttatttttagggttcgaagttaggggcgggggtgggcgttttgtttgggtgtaaatttaagttcgggtttcgcgttttttttgtgggttgttttagtttcgcgcgt

SEQ ID NO: 7475 - DNA, 1266 bp, Artificial Sequence
  Description of Artificial Sequence: Synthetic polynucleotide
cggttcgggcgttaggtagaattttagttcgatgttgtcgtcgtcgggggagagggaattcgttgggagggatagtcgggggttggggaaggaagagcgggtgttgggagggtttaatattggcggagttttaggtggcgacgcgggcggcgagagttgtttcgaggcgggggtttcgggtaggtcgttttttacgtagtatacggagtagaagatttgttttttggcgagggacgggcgtcgttgatttagtacgtttaggattagttcgtcggcggtttttacgcgggttttgggttttagtttttcgtcggggggcgttttttgttgtttatttttttttttttttcgatttttagttttttttttttttttttttagttttaattgtagtggtaaggtttggggattgagaggttcggtgagtgttagtttcgtaggttgcgtcggtgttcggtttttattttagttcgggggttttaggtttttcgcgggttttggggcgttggtgttcgcgtagttttagtcgttttcgtagttatcgtcgttcggtttcgcggaggcggcgcgtagcgggggcgttcgggcgttgtttttttgaggtttcgggggtttagggtggttcgtagtgttattggttagggtttgcgatttttggggttcgtcgtcgtcgtttatcgtgttttgtttttcgtttatcgtcgttcgcggttcgcgtcgtcgttgtttatttagtcgtcgggatttttattcggcgttcgcgggtagcgggggtagtggttcggttcgattcgcggtttcgtttttgttttcgggtttttttttttgggttgggacgttttaagtttttttcggggagttcgtgtttcgaggttgcggcgcgtggggagtttggttcggttcgtcgttttttttcgtattttggcgcggcggggtatcgtttcgggggcgtcgagggtcgttcgttttgggttcgggcgcgttcgttttatatgtagttcggggcggcgtcgtagttttagcgagttttaggcgggatagaggggtttgggaggagacggtcgttagtttcgcgttattatcggtttcggttgtcggacgcgcggttcgagggcggtggttaaagggtcgaggggtttgtggcgtcgtcgcggcgcgtattaggaggtgtagtcggagcgttggttagtcgtagggtttttgggggagaggtcggagcgggcgattttttttttttcgcgttttatttatagtttttttcgtcgt

SEQ ID NO: 7476 - DNA, 1316 bp, Artificial Sequence; identical to SEQ ID NO: 7353
  Description of Artificial Sequence: Synthetic polynucleotide

SEQ ID NO: 7477 - DNA, 10783 bp, Artificial Sequence
  Description of Artificial Sequence: Synthetic polynucleotide
cgagtcgggataaaggtttttaacgggagcgggatatttgtttatatttcgtttattgttcgtagtttagtaatcggtttgtatttgtgtttgttcgggttcgattatttaggacgcgtcgacgaggggtttgttttaatttgggttattgttatttacgttatatattgggggcgaggtagttagggttgtagaaagtcgtcgagcggttcggggagaggtgtttttatttagcgttggtaattcgggggtagttggggcgcggcggcgttcgttgtagttgcgcgcgaggaggattcggtgttcgcgcgtttagtttggttcgcgcggaggagtttaggttgtgggaagattagatttggatttcgtaggggtggttttttgtgttttttttcgtttttagataaagtttttttttgatatttttttggggcgaacgagtattaggtagttaatttatatttttgtattttttttttaaaaaagttttaattagaagaaggggtggtaaatgcggcgtggttttttttaattttagcgtcgaggaggaagtgtaagtttcgggaaagtttagtttttagagtcgagagtggttggaaattttatattaatttgatttaatttggaaacgtggagcgcgtatttcgaacgtatttaaggcgtttaaaaagagattatattaaagaattcgcgtgggagaagaaaattggggagaaaacgaggtatcgtcgggttatttagcgatttttttttttcgtagttttttgggtttttatttaggttggagatataatttttatttttattttcgtaatttcgtttcgtcgttttttcgttgttttatttttagttagaggttggagagggagggggtcggagagggagggataatagagggtaggaaagagtagggtcgtttgtttttttttttattcggggaaagaggttcgtagagtttagaggtagtagggttagggttcgattttagacgaagttggagttttttatttttatttcgtttttttcgggatcgttcgtaaagtagaaagtgaattgcgcgttttttttggtcgtagagaggtggaggcggggggttgggggtgggaggtggggggaggcggagtgaaggaaataaatgagtttttagtaaataaagggcggttggaagggggcgggtcgtttggtggtggttttggtcggttcggagcggagtttttttttgggttttgggttttttcgcggttaattggaattaattatttgttttgttatttttagtatttatttttaagttttaattaaaatattgatttaggaggtttatagaagttgggtttttgttatttgaatcggattttgtttaggtaattattaacgatggaaaggagagattttcgtagttcggttttcgtttttttttttttttttaaaggcgttataaatcgttaatttttcggtttgtcgggggtgggcgcgcgggggcggggaggtaggaatcggtgaatgttaaagaggattttttttttttttttggtttttgttttgtttttttttttttttttttttatttttattttttttaagatgtaatttgttaaaacggtttttttaagtgtgtggattcgcgagcgacgcggtggttttttgtatgtaaatattgggtttaaaaaaaaaaaggttcgtttcgtttttgtaattaattgatacgttatattttttattttgttttagagggtcgttggttgggagcgcggagttttttaaaatttataattttatatttgtaaatattgtttttatttatttgatttttaagattcgtttatacgtggttaatttttgcgtttttaatgtttttttttttttttttttatttttttttcgttttttttttcgtttttttttttttttttttttttttttttttttttttttttttttttttttttttcgtttttttaggttcgtgagtggagtttagttttatatggattgatcgttcgggtaatggtttatttttttttcgttattagtcgttatcgcgcgtcgagcggtcgtcggagttcgagttgacgtcgttttggtattttttttggagttagaaattaaggtcggggttcgcggcgttcggcgcgtaggtcgttcggttttttgcgtttattttcgcgtgtttttaaagaagatagagagaggtattgggttgggttttattttttttttttttatttttagtttttttttttttttaaaaataataattattttaataattaaagttaatttttttttttttttttttagtttttttttttaatttttttttttttcgttcgttggggtaggggagcgttacgaattgattaagtgaagttataattttgcgatataaattttggggtttcgaattatgtcgttgattaatataaagacggggttttcggttaaggatattttagatttgtcggatattaacgatgaggagggttttgtggtcgaaggttcggaggaagagaacgaggggttcgagttagttaagagggtcgggtcgttggggtagggcgttttggacgcggtgtagagtttgtttttgaagaattttttttacgatagtagcgataattcgtatacgcgttggttggttagtatcgagggtttttagtattttcgtaagtagtaaaatttggttgtcgaggtcgtggttttttttatttttgtagtcgtagttcgggttggacgttgggagtgaaaggggaaggggttatgtaagttcggatttttttattcggattcgtagaaagatttttaatatttgtataggatgttttttgtttttttttttaagtttttttagtttcgggaaagaatttggtttttaaaattttttttaatgcgagaagttaaggagaaagagggagaagggttatattttttaggggttggtatatgatgttaattcggatcgatggttttagtcgtagttttcggatttcggtcgttgggagggattggtttggcgttttggaggtagttagcgagtttcgttcgggtacgggtggagggtggggaggtttcgggtggttcgggtataaatagtttattttgttttttgcgcgattatagaggacgttttgtgtagtgtagggggtgtttagaaggttcgaaagtagaaacgaaagtttttaaaaatttgttttaaatggtcgagtcgattaatgttgggattgtggggtattttttttaaaaatttgtttacgtttcgtcggagaggaaatcgtttaagggcgtcggagtttttaattcgcgatgatttttagtgttatttttttttttaaatttttatttatattatgtgagttttttgaaaggcgagtttttagtttttatttttacggatttttttttttattttgggaggtttcgacgttttcgttaggcgtagaggaaggtaggggttatggtaaaggtagcggggttgggttgttaggcgcggaggtttagggtcgtacggaggatttagggtgtttcgagtttggtgtaggttgcgcgcggtttttagacgtttgacgcgtttttttttttttttttttttagtgtacggtttggttgtcggggcgtttttttaggatttaagttttaagttttcggagttttcggtcgacgagttatcggataatgataaggagatttcgggcggcgggggggacgtcggtaagaagcgaaagcggcgagtgtttttttttaaggcgtagatttacgagttggagcggcgttttcggtagtagcggtatttgtcggcgttcgagcgcgaatatttggttagttttattcgttttacgtttacgtaggttaagatttggttttagaattatcgttataagatgaagcgcgttcgggtcgagaaaggtatggaggtgacgtttttgttttcgtcgcgtcgggtggtcgtgttcgttttggttagggacggtaaattatgttacgcgtttaaagtttaggatttggtagtcgttattttttaggcgggtatttttttttttgtttatagcgcgtagtcgttgtagtatatgtagtataacgtttagtatagttcggttagtattttttagtattcgatagtatattttttggtttaggtttagtagtggatttggtgagcgtcgttttaacgagattcgcggttttaggtttaggttttatttcggcggcggtggcggcgaggaggtttcggtttttatggtggttattattattattataattattattatggagtcgagttgattttcggttttattagggaggcgtcgggaggttgtttgcgtttttttggagtggtagattttatttatttagttttgtttatgtttttttttttgaattttgggagagggttgaattttacgtcgtgtttatagaatgtttgcgtagtttcgtttttttgttttttttcggggggattaaatcgttttagcgttaatgtcgttatttgaaaacgagaaaaagatcgattttttatttttgttttcgtgtattttgtaaaatatgtttgtgtgagtagcgatattgttagtcgttttttaaagtaagtggagaatattttaaaaatatagagaatttttttttttttttaaaaaaaaataagaaaatgttaaatatttatggttatgtaaacgttttgataattggtggtagatttcgtttttcgttgtaaatatcggtggtgattgttgttaaaatgatttttaggatcggtttgtttttcgtttgggtttaatttttttttttgtggtttgtttgggtttgttttttgttttgtttttgtttttgcgtttttttttgttttttttttttttttttttattttattgtgtaaatattttttaaatatggaaaagaaaattttgtaggtagggagttttttgttttgtttttcgggtttttagtttcgaatttggagtttagttattcggcgcggttttttaatagcgtcgggcgtagaaagttttcgattttttaaataagaattttaataaaaattttgtgtttaaaaaagaaaaaaagaaaaaatttttgttttttcgtttgttttattgcgtcgggtcggaggtttgggtttgggagtcgggttcggtcgttcgcggggtttttataggcggtttttttcgggcggggaggtcgggggtatcggggttttggggcgggcggggttttcggtgtaggttttttcgattataggttgtatttcgcgtttaggattggggcggggaggagaacgttcggttttcggtttgcgagcggtcggtcggaagtttagggtcgtttattttttttcgtattttttttggtttcgcgcgttgtttgaatttcgggcggtagcgttcggttacgggaggaaaagtgatttcgggagtcgtaaaggcgaggagagtaaatttttttcgttggtttaaatttatgagtggtttttttagtttgagaagttgttgaagttattatattcgatgatttttattttgttatatttgatttattttacgttaagaaagtgggtgggtgggggtttgaggttaagattggttgttttttttttattttttatttttttttaaaatttgcgggttggtgttgatttaggagatcgttaaggttgggggtgggaacggttagggcgcgcgaggttttggtttagggggtttgggggaagtacgcggggttttgggttcgggggagggaggggatattgtagttttttttaggatttttggttttaggaagttagggagcgagaatttttggtaattttagtaaattatgtttttttttttttttacgtttttatttttttcgggtttttaggttttttttcggggattggatttcgggtttttttttttttagcgttcggcggttcgaattagggtgtgcggtttttttaggttagtttttgagcgtggaattgggtggattgttaggaagtagaggtttgggggtggggtgagtttttcggatgggaagtgggtatatagtttcgggtacgttcgggaagggcgtatttattttttcggcggggaacggatttcgttttatttttgttgttggaggaagatttttttggtagatgttggcgtatatttggttacgcgggggagcgttttaggaagtttggttaattggaggatgagttttttttttttatttcgcgggtttttaaaaatatttgggattttagtttagagtttagcgggtgttgtagacgttgagggattgaacgtcggcgtatttggaaattgtatttttgtttttttcgaagttgtattattaaggttggggggttgggtggtagtgaggaggtcgggtaaaaggagcggttttagttgattttttcgttttttgtagttgatgattaggtttaatttaatatttaaagtaaatatgattattcgtgcgattaaatttgtgcgtcgatagtattttgcgtagtagtttagggacgcgatgatattttattttcgcgttttatatcgtttttggataattgagggttcggaagtttttttaatattttagtaaaggtttttttttattttcgggtttattttcggggaaagggtagtttttttaaatgttaaaaggtttttttttgttttttatattagtttggtaatgtttgggggtttatgttttattgtttttaaaggttaacgaattttttttaaatagtttgttgtgtaataattgaacgtttaatttgttttggtattaattatttaatatttatttgtaattttttttaattttaaaatttttttgggaggaaaggtgagggttttaagttttttggagcggagttgttagaaggtttgaggttattttgatttttttaggttttagggtttttagggtgagaatgattataagagatttttaggtttttagagaggaagggggaagcgtggaaggtttttattttggtaggtttttattatttgtttattgaggataaatttggagttgtggttaggatcgcgggtttgtaatttgggtgtgcgtttttgtggtcggtcgggagttcgggaggtggattcggcgttcgtttttttttgttttcgggtttttatggagttaataaaagcgtttgcggagttttgtgtggttttaattttagcgttttgggagcgtattcggcgcggggttcgttttagtagtttattttcgtttaatttatagcgggcggtataaaatcgtataatgggaaagttgggagtcggagatgttagaggcgtgtatattaaaaagggatagagaaaggatcgcggggatagagagaggggaagaaggagaaggggttcgttttttatttttcgttttatttcgtattatttagcgcgtttatcgtcggtagtgaatttcggagttaggtagaagtttttttggggttttgttgggtttgttattgggtttttttgttatttacgggttttatgttggattttatatggttagttgggtcgagggagcgcgaggagggattcgtataaaatttaaattgtgttcggtttttaaattttgtattgttgtttgtgaaaggaagacgtattaaaaattcgtgttatatttattggggaggaggttggaggaggggagaaaaagttatttttgtttttgatggtttcggagggcgtttgtttcgtttaggtttcgtgatattgaaagttggattttttttattttgttttttttttttaaaatttttttttttttttttttttataatttcgtttttataatttttttttttatttttataattttttttttttataattttttttttttttttatttttttttttttttttttttgtttttttgattttaacgttgggatgggagttcgcgaatttgcgtttttagggtttggtttatttgtgcgtattttgtttattgttgtgtgtgtattaggaaattaatttttgtttgggagttttgtattatcggatcgttttggggtttaggaggtaatttagggtatttagggtttgggtgatgttcggttttttacgggtttagcggtttttgggtagatgaaaatttattttttgatttcgtaatcgatcggtttcgaagcgttcgcgcgcggagtcgtttttttatttatcgcgagaaaggttttgagaggttaagggtgtcgtttagtttcgggtttagttagatttgggttgtagtcggttttaaggcgatttgcgttcggtcggattatttggttattaatttcgaagagttaaagacgcgcgcgtttttttgaattatgcgcggggatttattttattggttttttggtgcgatgggaaattattttagaaattttttttaatagcgtttttttttatgttggaggagggagatattttttttttaatttttaatgttttttgtatcgcgtgtttataaaatttagtattagggagatatagtagggtttttaaggaatttgtttattttttgttttttttaagcggtttaaattggcgcgaggtagtcggaaataatttgggttatgtttttttttttgtaattgttaggttaaaatttttataagtagtttttaaataaattatatgtattaaataaaaatagtttatgttgagttttgtggaaataaaaattggaatttagatatgttttttataaagttattcggtttttaatgagtagaattgagttggtggaaatttcgattaatgggaaatttggatgcgtttttttttttatttagtataacggttatatttagtagaattagataatttggtaagagtggaagtttttttttttaatattttttattttagatggggaaataatttatttttttatttattgattgttgggtttagttgagatttggtgtgtatttttcgagtttttttaagagtttggttattgaaaagttaatttaatatttatcgagtataaggatagtttttagacgtatttattaaggtttatcgttaagtgattatttggattgaagataaaggttaggggagggggcgtttaggtatattagattttttttatttgggttttttttatttagaattaggaaatcgggagcgcgtttgtgcgttgttgaagtttttttttcggtgttaagtggcgggcggattagatattgtgttgggcggtattttaggaaatatgtatttgtggttttttgagaggttaagcgtagtgatattttaaatcgtgtcgatatattattttttatttaggatttgtaaataaatttttgattttttcggcgtattatagtcgtcgttatttcgttaaggaagcgatttgagttttattgtttttattaacgtttcgagatatatatatatatatatatatatatatatatatatatttttttttcgtattttgatttttaaaggttttattttttttttttcgaggtatcgttattaataaagaggcgaataggttttagcgtcgttattcgagtaagcggggaaatgtgggttagtagtttaggttcgcgcgcggatttcgcgtacgttttacgcgttttttcgggtcggagaatcgagcgtgtgtcgcgtgttgtcgtcgttaggaggcgttcgagtttagcgttttcgagcgtttttgcgcgcgggttcgggtagagttcgggagtcgtcggaggtagttgcgtattagcggattcgcggttcgggtcggagttcggtgagtggtgttaagaggtggcggcgagtcggaattttggggagagtcgcgagttagacggcggcgggtgtttgggaggtgcgagtcgatttgtgttcggttgtggttttttcgttatgtttttttttttttacgtgcgtattatcgttcgttttagtttcggtttttatcgtgtttgggtatagattatagtcgattggtttaggagcgttttggttattgggagggttttattaggcgttagggcgcgttgttttcgcgattttagggtttttggcggcgtcggtcgcgcgggtggacgcggagagggcggtgttgcgagggttcggagagtgggtgttcgcgtggggaggcggttcgggagcgcgggagcgatgcggaggagggattcggtttggttgtaggttttcggggcgggggtttcgggaaggagagattttcgtttttcgttcgttttggattcgggtttcgtcggattttcggtttttgtcgttcgtcgtttggaagcggggtaggcgtatagtttagacgttagggagagacgtttcgtcgatttagatcgtggggttagggttcgggaggtaagaacgttttatatatagtagggtattttaggtaatttttatttcgtgttgaggtttcggttagggtgtaaaggtgttcgggaatggaagggatacgagggtgtggacgtttcgtattttatttacgtttggtgttttttgagaggttgggcgtggggtagagggtaggggataagggggtgatattttttaaggttttttttttaataaaagtagggtttgtagttttagtttgattcgttgattgttgggtggaatcgttttatattaaaggtatcgtggttttaaatattgttttttttatttttttaagttttcgttttaaaattagttgtcggtgggtcggtgagggcgtttgtagtatttaggtttttcgcggggcggcgcggttggataagaaaaggtttttcggttggggcgcgtagcgtagtttagatatttgcgggattcgagatgttttcgcga

SEQ ID NO: 7478 - DNA, 810 bp, Artificial Sequence
  Description of Artificial Sequence: Synthetic polynucleotide
cgagtgtcgattcgtttgggcgggattttttgagcgtatttttttcgagcgcgttagtgtttttgggagaggtttgtttgggtgagggattggacgtcggttttttcgtaagtcggtcggttgagggtgggggtcgaggcggggtcgggaatagttttcggattagggtttagataatttcgttcggcgtttgttttttcgcgcgtatttgtcgggttcgggggttgttagaagaggtcgtagttcgcgtttttcgggtttttacgtttcgtagcggcgttttttttttcggcggtacggattggttgcggcgtcgttttaagttcgtttcgcgttgtcggcggggggcgtcgcggattagagcgcgttgcgtcgttatcgtcgtcgttatcgtcgtcgtcgtcgtcgtcgttagtagtatagcgcgtttcgggtttcgcgcgtcgttagtttttggttcgttcgtcggtttcgtcgcgttcgttagtttcgtagcggagtttcggttcggtttcgggtcgtcgttattacgtcgcgcgtcgtatttcgcgttaagaatggggcggttaagttgtttaagtcgttcgtcgtcgtcgtcgtcgtcgcggtcgaggcgttcggcgtcggcgcgggtatggagcgttcgtagagtcgttttagtttgttcgtttttttcgaggcgttcgttatttatttttcgtgtatgaattttttcgacgacgaggacgtaggtaagcgcgcggttcgttttttagattttcggggtgtttcgggatttaggttcggtagtttttttttcgattcgtgcgt

SEQ ID NO: 7479 - DNA, 1142 bp, Artificial Sequence
  Description of Artificial Sequence: Synthetic polynucleotide
cgcgtggagcgcggtttcggggtagcggagagtggggttttaatatttagtatatgtagattttggggcggtgttgttaggggcgcggattcgggattatcggagtatttgtatcgcggggaaagttgatagggcgcgcgattttaggaggttgtcgcgtcgtttggtgcgtgaagttttagggtagcggagcgcggggattttgaaggttgtcgcgtgtaggcgaaggggtcgtagggtggtcgtttttgggagagtagacggggaagaaggtaacgggagggagggcgtagcgcgagtagtttcggacgcgggtttaggaattggtcgcgaggagcgtaatttagtaggcgcgttagggttttcggatttaaggtgcggggtttcgattgggcgtttggacgtttcgtgacggtggcgtcgttgttattgtttcgaagcgaggcgaggttaggcgttgcgttttcggttgttcgtttttttttttcgtttcgcgtttagtttttttttttcgtttcgttttttgtttcgttttttttttcggcggttgttgcgtcgcgttttcggcgtattcggagttcggcggggatcgggaggtagagacggggcggtcgtggtttcgagggcgggagttgagtcgggtttcgggatcgaagtttggcggcggtttcgggaggtagagcgggtttttcgggcgatttttaggtttttttcgcgttttcgtttcggattcgtgggtagtcggggggaacggaagtcgcggtcgggttaatttcgaggcggggacgtcgcgacgggaatttgaggtgggaattttgcgcgttgtagtttcgtcgggcgttattaaagcgcgaatcggatttcgagtttgtaaattcgggttcgggggcggttgtacgtggtcgtggttttgaattttttgcgggggtttcgaaattcgtttgcggggaggttagggcgatagaggattcgggagttatcgttggtgcgtggcggcgtggagcgcgtttgttacggttaaggtgcgggttcggtttcggtttattttaaggggttatcgggatgcgaagttcgggacgttcgtcgtcgcggtgatttcggcgggggcgtatttcggttgtgggtcgaggtttttttttcga

SEQ ID NO: 7480 - DNA, 2885 bp, Artificial Sequence
  Description of Artificial Sequence: Synthetic polynucleotide
cggaggtttcgggaaagtttattaagttttacgcgtttcgttgatagatgtttaggaagcggttggtagggaagaggcggttttgtagtttatagagttttttttttattttcggggagttttaggtcgcgttgttttttattttttcgtttttttcggtttgtaacgttcgtggcgttttttaataggttttagaaatttttttttattttgttttttaagtttggttatagggcgtttcgagtagggagtgtgcgggtttcgggtatacgttgcgtcgcggttgtattagagcgtttacgattttgatttcgattcgaagcggttttttagcgggatagggtgttggcgttggcgttgttgttattgcggcgcgttttttcgttttggtttttgcgtgtcgttagggatttttgcgttagggttagatttaaagacggatcgaggcgggtgtttatttgggacgcgtgcgtttggtggcggaattttcggggcggtcggaggcggcggtcggggagtcgagaagtaagtattagcgttttaggatcgcgcgcgtcgtttcgcgtcgtttcgcgtcgtttttcggtttagagtttttattttcggtttgtgagtttgcggcgttggtggagttcggttttaggaagaggagtttattcggttttttttgattggatagtagcgaggttttatcgggcgttttcgcggtttaaaatcgaagcgggggcgagggggaggtagagttcgttttttgcgcgtcgcggttgggagggagaggaggtgggagagaaggaagaggcggaggaggtagcgggcgtcgaggttttgggattcgtaggtaagttagatcgacgcgtagagtcgggagttttatcgtagcggtagcggtagcggcgggttcgggtcggtttcgggggttgtttatttatatgagtattcgtttattcggcgagttttcgagtttaggcggcgcggttatggtcgagtttaagtcgttgtcgggggacgcgtatttggtattaagttacggttacgcggcggcggttgcgggtttcgtttacggggcggcgcgagaattcgaagcggttcgcggttacggtatttcgggttcgggcggcgattttttcgcggcgtttgtatttcgcgttttagtttaggcggcggagagtagcggcgaatagagcggggacgaggacgacgttttcgagtagcggcggcggcggcgcgggttagggagcgcggcggacgggcggcggcggtcgcgagagtagcggtttttgcggtttagtattaacgcgcgcgagcggcggcgtatgtacgatttaaacgacgcgttggacgggttgcgagtcgttattttttacgcgtatagttcgtcggtgcgtaagttttttaagatcgttacgttgttgttcgttaagaattatatttttatgtaggcgtaggttttggacgagatgcggcgtttggtggttttttttaattagggttagggtttggtcgcgttcgtaaacgtcgcgtttttgacgtttttcggttaggttattgtgtgtttttttttcgtaggcgtcgttttggggttttgttttgataagtgcgtcgtttttttcgggacgtttttcgcgttttgtaaatattgttacgagaagtcgtgatcgcgcgggttttcggttttttcgtacgcgtttttcgatcgtttttgtgattgtttttttgttcggataggaaaggtttggagggattttgtagattaggaggagggggttcgatttcgtttttagtttgtgcgcggtggatagtttagcgtagcgggaagcgttaaggtcgtcggggcgcgggattgagttcgagagtcggacgttggattttgcgttcgggaattcgcggtatttattgggtattgtcgggatttagtaagtttaggaacgggggtgggtagagtatttttcgggtattgtcgttcgtttttaaaagaagattatcgcggggttttagggttacggcgaggacgggtattggttagatttcggataggcggttttggtttcgggcgtacgaaaggtggagacgaagaaaagtcggatttattggtttttgatttttttgtagtgggtttcgcgttttcgttttagtcggtttttcgtgttaaattgtagggtagtgttttgtttttgaggacgcgcgtggtcggtattttttatttcggtgatttcgagatttcgtagttttgcggagagtttacgatggtcgtttgtagaggagttggatcgcgggcgtaggaagatttcggggaaggttttttttaagtaggagtttgttttatttatttgggaattggacgtcgtcgtcggttgtttcgaagtttgaggaatttgttttttaaatgttttttggtttttttttttcgtcgttattcgttgtttgggacgttcgcggggtggagttggatggagatcgttttgcgggttttttgtttcggggggttgcgtggaggagggtttttatagttcgcgttttatttaattttgacggttaggggagggtttcgtttagttttggtgtttagtaaattttttttttatcgattttttttttttttcgagggaggaggtcgggttacgggtgagtaagttgttgcgggtttcgtgtttcgtcgggtgtgaacggagatgcgttgcgtagtgttcgttttgcgtagtttttagttttgttattattcgggatttagggagtcgggtagggtgttttcggggatttatttgttcgcgtcggtttgcgtttcgcggtttcgtcgtagtattcggttttattaatttaattttttcggttgtcggtaatgttaaggggagagggtcgtcgttttgtaacgcgtttgtttatagcgt

SEQ ID NO: 7481 - DNA, 1460 bp, Artificial Sequence
  Description of Artificial Sequence: Synthetic polynucleotide
cgcgtttagttggaatgtagagatcgtcgttcggttacggcgtataggacgattcgttcgttcgtcgcgattgtgtatgggtttcgggatacggggtcgtcgttgatacgcgcggtttcgtcgtcggtttcgtcgttttcgtcgcgttcgtcgcgttcgtttcgtcgtttagttcgtagcgtagtttttcgcgtagtttcgagtcggggcgttatggttttagttcggtcggtcgcggggaacgttaggcggtagacgagtcgcgtattcggcggtttatgaacgtttttatggtgtgggtaaaggacgagcgtaagcggttggtttagtagaattcggatttgtataacgcggtgtttagtaagatgttgggtgagcggcgggagggcggtagagaagggggagagggcggggggggttcgggtcggggtggggcggggggggtaggggtttcgggtcgcggggtgcgggggttgcgttaaattttcgcggggcgtttcgggcgtacggagggttcggcgtttattcgttcgacggcgttttatttattggcgtttacggttcgtaggtaaagcgtggaaggagttgaacgcggcggagaagcggtttttcgtggaggaagtcgaacggttgcgcgtgtagtatttgcgcgattattttaattataagtatcggtcgcgtcgtaagaagtaggcgcgtaaggttcggcggttggagttcggttttttgttttcgggattagcgttttcgtagttatcgttcgagttttttttcgcggcgtttggttcggttcgcgtttttcgcgagttgttttcgttgggcgtcgagttcgacggtttggggttgtttacgttcgagcgttcgtttttggacggtttggagttcggcgaggttgttttttttttatcgttcgcggcgttcgaggattgcgcgttgcggttttttcgcgcgttttacgcgtttatcgagttgtcgcgggatttcggcggttgttacggggtttttttggcggaggcgtttaggatcgcgtttttcgcggcgtcgttcgttggtttgtattacggtattttgggtacgttcggttcgtatttcggttcgttgtcgtcgtcgttcgaggtttcgtcgttggagagcgtcgagtcgttggggttcgtcgtcgatttgtgggtcgacgtggattttatcgagttcgattagtattttaattgtagtcggattcggttcgacgttttcgggttttcgtattacgtggtattggttaaattgggttcgcgcgttatgttttgtttagaggagagtagtttgattttcgcgttgtcggacgttagtagcgcggtttattatagcgcgtgtattttcggttaggtcgtcggcgtcgttcgggtttttgtagcgttttttttcgtagttttcgcgatcgattcgatcgcgtcgttgtcgttttgtttttttatacgcgt

SEQ ID NO: 7482 - DNA, 1560 bp, Artificial Sequence
  Description of Artificial Sequence: Synthetic polynucleotide
cgttttttaatcgaatttttttttttgggaatcgtagtttagcgcggtaattgagttatcgtaatcgggcggtggggaggaagggtggtttaggaaatcggcgagggagaaaagcggtggaagggagagttttttttttggagcggttttagtagtataaagtgttggttatagcgtttttttcgtttttagattgacgagtagtggcgtggagttagcgcggaggttgttttttttttttttcgagttcgtagcgcggagcgcggtttagtattaacggagtcgggggcggcgtttttgggatggaaaagggttaaaggggaggagtggggtgggggtgggggttttattggtttattataaaaggatcgttcggttgttcggtttttgtattcgttggaaagcggtttcgagttaggggttattgtaaagttagggtgcgttatcggacggagaggggagagttttgagtagagtgagtaatatcgtagttaaggcggaggtcgaagaggggcgttaggtattaattttcgcgttgttttagtttcggaggcgttttagagcgttttttgttttagtagagttattttgtttgcgtttgttttttagtgtttttaattttgcgttggaagaaaaatttttcgcgcgtcggtagaattgtagcgtttttttttagtgatttcgggagtttcggttgtagtcggttttgcgcgtttttttaacgaataatagaaattgttaattttaataatttagagtaggttaacgaggttttgttttttcgattcgaattaaaggtttttcgtttcgtgcgttgttacgagcggtgttttttggggttttaatgtagcgagttgtgttcgaggggttcggaaggcgtaagttgggtagcgatatggggaacgcggagcgggtttcggggtttcggagttttgggttagtatttacgttgttgttgttcgtcgcggcgttattggtcgtgtcggacgtattcgggcgttttttcgaggaggacgaggagttagtggtgtcggagttggagcgcgtttcgggatacgggattacgcgttttcgtttgtacgtttttgattagtagttggatttggagttgcggttcgatagtagttttttggcgttcggttttacgttttagaacgtggggcgtaaattcgggttcgagacgtcgttttcggaaatcgatttggcgtattgtttttatttcggtatcgtgaatggcgattttagttcggttgtcgtttttagtttttgcgagggcgtgcgcggcgttttttatttgttgggggaggcgtattttatttagtcgttgttcgtcgttagcgagcgtttcgttatcgtcgttttaggggagaagtcgtcggtattattatagttttattttttgcggcggaatcggtagggcgacgtcggcggtacgtgcggggtcgtggacgacgagtttcggtcgattgggaaagcggagatcgaagacgaggacgaagggattgagggcgaggacgaaggggtttagtggtcgtcgtaggattcggtattgtaaggcgt

SEQ ID NO: 7483 - DNA, 5118 bp, Artificial Sequence
  Description of Artificial Sequence: Synthetic polynucleotide
cgttttttttcgcgatagagttttcgagtttagcgtaggttagttttcgttttttcgcggtttttggtttttttgtcgttagaacgcgtcggcgttagtcggtttatttggcgtcggaggtgaggcgcggtaggttgtcggcgtttatagtcgatacgtggtggtgcggcggcggtatttggtatatgttgtaggggtagggtatgtcgttttagtgttggaagttttcgttcgttttattgtcgtcgttttcgttttttagcggggcggtcgcggtagtagacggagatttgagtaggtcgtgcggtggacggatggagtcgatcgacggtagttcggattcgggtagagaggcgttggatatagtcgcggttgtagcggcggtagtagtcgttgcggcggcgggcggtaggatggggtggtgtatcgcggggtgatgtgcggcgtgcgttgttgttgtcgggtgcgcggtggcggcgggtaggggcgcggagtgcgttaggtcgtcgtaggtcgacgggtggaagttagcgtggtggttttcgtagatttcgtttattagtcgttttattttttttagcgagttggtgagtatgaggatgtagttgcgcgttagtagtagcgtggcgattttggaaagtttgcgtatcgaagggtcgtgtgcgtacggtatgatttcgcggaggttatttatggcgatgttgaggtcgtgtatgcgtttgcgttcgcggttgttgattttgagacgtagttgttgtagtttcggttttgttatttgttttttgttttttttggtggacgacgtagtcgtcgacgacgtagacgacgaggtgttggacgaggatgatttgaagttattgttttttagtttgtttttaggatgcgcgttcgtagagtttatagcgtcgcgtagttcggcgtttagtttcggcgggtagttattcggggtggacgaggatacggtgtttttagtgaaggcgttgtcgttgttgtttttatttcgggtcggtagaaaaaggttatcgggttttggcgacgacgggcggttggatattaggttggcgttcgagtttatggttttaggggaagatagtcgtcgtagttttcgtagggttttttttttttcggattcgaaaatttttaggagaggaggagaaaagagagagaatgagagagagagagagggagagagagagagagtgagttagtgagagatagaaaagttgttttcgtttgtatcgtagtattatagcgcggggtttcggtataggtggttcgtggtttttcgtttttttcgttattatttttggttttttttttagttgtacgcgggtatttataattaagttttttttattttttttttgtttttatgtaataggttattttagggagcgttggtgattttcggggtgcgggtggtattttagaggtttcgggtttttagttaggtgtgggaaaattgagttttcgggttggaataaacgagtgggaagtgagggtttttttttggggagaatggagatttagatagagaattaatgatttggttttttaaacggatttattttatttttatcgatattacgtagtaaatatacgtatacgtatatgtatttagagtcggcgcggggtttagagtttatgtgttgtatttggagattacggggagtttattagttgattggggtttgggtagaaagagttgttgtcgtttcgatttttcgtttttggtgagggagatgtagcggtgagtgtggggaggatagaagagtaaagtcgttttggagaaatggttcgtagagtagggatttagattttttgtatcggagtattttgggttatagtcgagttgaggagagtttgtttttgggatttaggttgcggttgttgtggggcggggatatttattttggatgcgatttgaggagttcgtttcgaaaagttttaggggagaatttggtatcgggcgttggtgtcgcgtcgatttataataagtattcgtatttttaggggttcggtcggtttttatagttcggtggtagcggcgacggcggtagcggtggcgggggcgggggcggggaataatgtgcgtgttttggaggggttgtttcgttaatgagttgggttcgtcggggggttgggaagttgatgttattcgggttaatttcgtttaatgaaattcgttaggtcgggtatacgttttttttttgcgtataattaatgggcgttcgtggtcgggagatttttggggagggattggaggagggattcgaggaggcgagggggaggagaagggcggtttaagggggatggagggagggttgagcgcgtttgggattaagggagaaagggaacgtggttaaatttttgtaaaaaatacggttattatagagttaggttgggggatgggatggtttggagattttgtagagtttaataaattaatttgatgttttacgtagtcgtattttttgggatgcgcgcggaaaattttggcgatttaggattcggggttggggttttttttttagttttttttttgtttggtttttcgtcgtttgtttttattttattggttttattaatacgtgggtatttggcgttttaaatgtaaacgatgtttaggtataaagtttttattattttggtgttttattcgcgcgtttaggagatggtcgtggttgtagtttcgacggtagtcggtagcgtttttagttgggggtagggatttgaggggtagagggcgggtaaggagggaggggacggattttagaagagtgttttgaaagaatttataatttttttttaggttgaggatggtgtgggtatagggacgagttattttcgtacggtaatcgcgttagtataagggtagggtcgtgtttgtagttaaatatttttttatttattagtaggggagtcggatgatagtaagtatttttagtgtcgtttttgtgattattatacgttttggggtaggggtaacgttggtatttgtagtttaagtagggtttcgttgtaaaaggttagtaaagagtttttcgttttagtcgtttgttttttggaattgtaaagagaagttttaggtttgggtaaggtttttttacgttgtgggttagatagcgagatggaattattcgcgatcgcgttgggatatgttttatcgattgtaggttggttttgaaatttgaaaatttttgacgatgaggaattaagttcgaattggagaagtattttacggaggtagttgaggtacggatgtatttatttattttatagatgggaaaagttagagatcgtgtgtagtaagtttatagaaaaaattgttaagtttttatagagtagttttgtttggattatagatgttggcgttggcggttttttatagtataggtagttatttgttttttttagtttttaatttttttttcgagttgaattttttatatttatatatttcgaatttagatatttgtttttgtagatttcggatgttagtatttgatattgtgagcgtacgcgcgggtatatacgtatatagttttttagggagtgtgaggaacgtcgggttattttcgttgttggggaatttttattgtgtaagtacggttttaaaaataagtaaataaattagtatagtaaataattggtttttaagtagtaaagttataaaataaataaatataaagagaaatttacgttattgtttttagttttgagatatgtttttttttgcggttttcgttagaagtttagttcgttttcgttttcgttttagtttcgtgttttttggagtattattttttaattcgcgtgttttttagttggttttgtagttattcgttaaatatgtatttaaaatatgaagaattgaagcgtggtgttatgtcgtttaacggttataaggatgatttataatcgtttaattagtagaatttgttattcggacgacgtagggagcgggggggtggggattagaaagggttcgggtatttgtagatgtttttttcgggtttatttcgttaatagtagcgaggttatgtgtggtgcgcgttgtggggttattagtcggggcgcggagttgtgcgtttgttagtgtagttaataaatattagtaggcgtaacgtgcgcgttttttggttgtagtcgttgaggttagtttagtcgtcggtacgtgtttcggaattcggtttttttttttgttgttgtttattggtgtttgttttgcgatcgatttgcggcggtgagagtaagcggttttaggttttttgcgcgttcggtttagtggttggagttgggagttaggggtgaaagtcgaggggttcgttttggtatggcgcgagtttagagtttggaaggtaaagtcggaagttttgtgttgttgttggttttttttttatttggtaggttttttttaatattttttcgtcgtcggagtagtttgggaggtcggggaggtttgtgtcgtttttgggtttttttggttttggtgttaatcggatgttgagtatttttcggtgtgttttttatgtttttttatttcgttttaggaataattagaaattagatttcggtgtttaagtttgttttggtgcgttttggaggcgtttttaggatttgttcgggttttgcgttcggcgttcggggtgggcgatttgggcgggttttaggtattgcggtttttattagcgcgcgtagttggggtttttttttggggaatggagtgtttatttgtagaggttaatgggtttcggtttcgggagtttttggttggttttcgcgttttggtgttgttggtttttttcgtgttttttttttttttttgtgttttttttttataaaagatcgggtgcgtgtcggggtcggtttttgttggatcgtcgggcggttcgggaggagttcgtgttaaatcggcgggttttcgcggggttttagggcgtagattttttattgtttttcgggtttttttcgggttttttttttgatttttttttttttttttttcgagtttttgtttatatttaggttgcgtttcggtttggttgttaaatagaacgacgtttttgcgtagagttgattaggggtggcggcgggaggtaaggttttcggtatcgg

SEQ ID NO: 7484 - DNA, 1423 bp, Artificial Sequence
  Description of Artificial Sequence: Synthetic polynucleotide
cgttgcgggataggtttttagagatcgtttcgggacggtcgtgacggttttcgagggatatgagagaagaggagcggcgtttaggtaagttggattttgcggtcggaattcgcgtagaaacgaaaatttttggaaggggtttagtttcgagtttcggaggcggataagttgagttttttggttgtattttttggaggttgttggttgtagacgtcgtcgttttttaagggcggttgttatcgcgtgcgtcggttagattaggtcgcggtgttttcggtattttcgcgtttcggcggttgtattcggtttttttttacgatcgaggtttcgggtatcgcgttttttttttcggacgttttgcgcgacgtcgttttagtttttattagtatcgagggtagttcgcggttattttataaacgttttagtgtcgtaatcgtttttatttttattatttttaatgtttgtaacggtttttaatgaggttggaaaaatattatttttcgttaaaagcgatttcgagttaggaggagcgcgtattttcgcggtttttttttttatatttttttttttttgattttttttttttttttttggttttttttttgtttttcgtttttttagtagtcgcgtgttgggttttttttttgttggggtcggattttttttttcggtcgttttagtttttgttttttcgttttttttttttttttttttttttttcgtttttttttttttttttttttttttttttcggagtcgttagtcgcgttttaaattcgagtagggcgcgtagtgtttaaatttgttcgcgcggttcgcgtttttggtttcgagggcgcgcgtacggatacgcgagtatatttatatttacgcgtatacggatacgcgcgtattcgaagattttcgcgcgttcgtatttacgcgtatttggttacgcgcgtgtattttcgtttacgcgtttttgtttcgttttcggcgcgtatttcgggttcgtaagtcgcgcgtcggggcggtcgttttgtttcgcgattggcgggagtcggagtttttttgaattcggcgtttatattatgggttgagttcgtcggcgtcgagggagttagtgcgattcggttcggcgcgtacggttaaggtacgcgcgttggtatacgcgggcgcggatacgcgcggatatatacgtgcgggatacgttttttttcgacggcggcgttaatttttcggtaagtttagcgttttacgcgatttgttcggtttttacgttggttatagcggttgcggggacggggaggaaggtagcggggtggttttaggggtttattttgtagggttttttcgacggcgtcgggataggtggggcgtttagcgtcgggagggacggttcgttagtgcggggttttagggaggcgcgtgtagtcgggtgcgg

SEQ ID NO: 7485 - DNA, 1384 bp, Artificial Sequence
  Description of Artificial Sequence: Synthetic polynucleotide
cgagcgttttttgaagtgacggggtcgggacgcgtagggaggcggtttaagaagcgcgttttaggttagtttagaatgcgttcggtcgcgattaggataacggcgggtggggttgggggcggttgtcgggcggggagcggtttcgcgtttttagttattttttaagagtcgttgtttttttaattttagttgttagaggttttgtgattggttgcggtacgatgattcgcgtacggattggttgtttcgggtcggggggtcgggttcgggggatagaattcgttttcgaatttttaaagagggtatttttcggtaggagttggtagatttaggaggtgcgatagattcgcggggtaaacggattggggttaagagtcgggagcgcgggcgtaaaggtattagggttcgtttagggcgtcgcgtagtacggttttgggggttttgcgggttttcgggtgcgcgtttcgtttttagttatggggttcgtagcgttggagattttgggtttggtgttgtgtttggtgggttgggggggtttgattttggcgtgcgggttgtttatgtggtaggtgatcgtttttttggattataatatcgtgacggcgtagattatttggaaggggttgtggatgtcgtgcgtggtgtagagtatcgggtatatgtagtgtaaagtgtacgattcggtgttggttttgagtatcgaggtgtaggcggcgcgggcgtttatcgtgagcgtcgtgttgttggcgttcgttgcgtttttcgtgattttggcgggcgcgtagtgtattatttgcgtggtttcgggttcggttaaggcgcgtgtggtttttacgggaggcgtgttttatttgttttgcgggttgttggcgttcgtgttattttgttggttcgttaatattgtcgttcgcgagttttacgattcgtttgtgttcgtgtcgtagaagtacgagttgggcgtagcgttgtatatcggttgggcggttatcgcgttgtttatggtaggcggttgttttttgtgttgcggcgtttgggtttgtatcggtcgtttcgattttagttttttcgtgaagtatttagcgtcgcggcggtttacggttatcggcgattacgataagaagaattacgtttgagggcgttgggtacggtcgggttttttttgttagttacgtttgcgaggcgttggataagtttggggagtttcgtatggatcgcggttttcgtcgggtagcgcggcgcgtaggtttttcggaacgttcggttttgcgtttcgacgcggtttttggattcgtttttgtttgcgttcgtagttgatttttttttgttattagttcggttttgtttttaatagacggaatgaagtttttttttttgtgcgcggcgt

SEQ ID NO: 7486 - DNA, 1361 bp, Artificial Sequence
  Description of Artificial Sequence: Synthetic polynucleotide
cgtcgaggatgtggttttcgtttttcgtagtcgtcgtaggagtttttgtttttaaagcggtaggtaggggttttagcgggtttattttaatttgggaaggtcggtgcgtttttttatagatttcgtagggcgttttttttggggattattgaagttttggtatttttaattttagttttttcgcgttacgggaaacgaagacgatatttttttgaataatttcggatgtgttattatagaggggtattttatattggtttttattttaatttttatttagtatattgtttgtttattttttaaatttcgtgcggattgcggtatttagtttcgggggattttttagttttgttttttcgattcgcgtaggtgcgttcgtttatttaagggtagggaggtatgttttttcgggttttttcggtcgtatggtttgtttgtttttttggtttttttttttcgtattaggaggggcgtgagatagttaggtcgatttttatttcggtagtttgcggcgatcggtcgtttcgagcgtagcgttagatatttgggttggggggtgttagtttgacgcgtaggaagggcgtagcggcgggagggggttttattttagatttgggaggtttgtttggcgtcggttttcgttcgtttttcgtcggtggaggtcgcggttggcggagatcgttaagttagaggaggggattcgaggtttcggttgggcgaaggttttggagggggagaagacggtcgaggcgtggaggggtagtcgcggcggggcgatttttatttgtttattgcggggtttgttcgtggggtcggggtagatttcgtaaaggacgcgtagtttgtaagttcgcggttcgcgcggcgcggggatggggagcgtgtgcgtcgaggagcgcgcgtcgagtcgggttttcgcgtttgtgtggtcggttggcggtcggggttcgtgtgtttttgcgcggcggcgtgtgcgtgtgcgtacgcggggattacgttcgttcggagtcgtcgtcgtcgtcgttattttttgttcggggtcgagcgtagcgttttttttgttcgtttcgcgcggcgcggtagtttagtttggtttcgttttgcgggagaggcgtcgttttcgtcgcgaagttaggttgggcgttggagggaggcgatcgattatcgtttttttttgtttattttataggttggggagggggtgttgtaggttaatgagcgttcgggggcggggttagatcgagggcggtgcggtggggggcgcggtggggggcgtcgggttgtttaattcgattttattcgtagtatagattggagtaggagttgcggcgggaaattttagcggcgggggtcgggggcgt

SEQ ID NO: 7487 - DNA, 1175 bp, Artificial Sequence
  Description of Artificial Sequence: Synthetic polynucleotide
cggagagtcgggatttcgaagtttttattgtttttgtcgaggcgtcggcgtcgttttttgtgtttttgattacgttagttttcgtcgaggaggcgatattttttttcgcgtttttcgatagcgagcggtcggcgtttagcgtggaggggttcggaggggttttgtacgcgcgcgtggttcgacgcgaggttcggtcggttcgggttcggggcgagattgggggtttgtcgttgtcgttatcgttcgagcgtaggaaatcgtcgttatttgatttcgttattaagtttaaggtgttttggatttacggtaagtatagcgtcgttgtagttggtcgtgcgtttttattatcgtcgttaggtttcgaggtcgcgtttagttttagtaagaggaaacggacgtttagcgataaatcggcgtatacggtcgaatacggtagttttcggattcgcgatttaacgtcgcgtttttcggggttgttcgaggaggcgatagttttcgttgcgttttcgtcgtttagggttcgagcgcgcgtcgcgtttcggttttttggagtttacggacgtcggcggtttttcgcgaagcgcgtcgaggttgtttttatgttggtcgttgacgtgcgcggtaagattcgtagtttgggtcgcgtcgaggtggttttgggcgcgtagggttttagggaaaagtcggcgtttttatagaaagttaagcgtttcgtgtcgttagtttcgttcgttcgcgcgtttttagcgatcgaaatttcggggtttgagaaggcggcgatcgatttgttcgcgtttgagatttttcggaagaagatttttatttagaagtcgtcgcgtaagaagagtcgggaggcggcgggcgagttgggtagggcgggcgtatttattttgtagtaggttgtggttcgttcgcgcgtagtttttttagtttcgtagcgtcgttcgttattttatattttttacgttatcgggtacgggcggttttttattggtcgggtatcgcgcggttagcggaggttgcgttttattggtttaggttttgtagtcgtttttggattggagtagtgtgttttggcgggaagggtttatttcgttggtcgaggtttgataggcgtttagcgggcgattttttttttattggtcgagttatggagcgtttcgattagatagcgt

SEQ ID NO: 7488 - DNA, 1087 bp, Artificial Sequence
  Description of Artificial Sequence: Synthetic polynucleotide
cgtttgtagttcggtcgcgtggaggtgatcgggcggaatttcgagggggcgcggggagagttgggcgggtttatcgttttagcggttgttgttaggggtcgcgaggttttttttgaagatgtagcgtagtatattttgtatatgagtttagaggaagaggaagtgtagtcggcggacgcgcggcggcggcggcgggggcgcgtcggggttggagtcggagcgcgtcgggcgttgggcgtagcgagcgagagcgcggcggtcgcgggtttcggcgagggatagacgtatcgatcgtcggagggatagatatacgattacgcggcgttatcgtttacgtttttatttatcggcgtttaagtttttttcgcgtcgttttttttgtatggtataaatttttttttcgggacggaatacgttgttttagggagttcgcgatcgcgttttttttttcgtcggttttatacggtaggcggcggggggggcgcgatagggtttggggtgtcgatcggtataggttttttcgtttggttttatggatcgggtttttggcgggtagtgggaatcgcgcgtggcgtttttttgtaggttgttttttgtcggggtttcggagttgttagagtagtattttttggttcgcgtcggatggggatttgggttgatttttgggacgtttggattttgggttaatttttttttgcggggaacgggtgtaggggagttatttttggagcgatgtagggagaggtatttcggagtagtttgttgggggtcgtaggttttgtaggtttagaagcgtttaggaaggacgtagaggtgggggagtttggaggttataggtgggtttaggatatattgtcgttggggttttcggaaaagaataggagggagttggtcgcggagtttaggttttcggggtgcgcgcggtttgggtggggtagggtggaggcggtgtttgattgtttttttgcgtgtgttttgggaggtgggtttgttttggggatagaggtgttggacgtgtaggagtagatatgtcgcgcgtttcgaggaagcgtcggaattattagaagtatagggacgcgggtgtcga

SEQ ID NO: 7489 - DNA, 693 bp, Artificial Sequence
  Description of Artificial Sequence: Synthetic polynucleotide
cggtttaggtattcgggtagagggatgatttcgcgttttgcgaaaagtaataggcggttgtattttattttgcgttagtttcgggtcggggtggttgttttattttcgtggtttagggaggaggcgttgggtgcgtatgtttaggggtgtgttcgttgttagggttgtagcggtcgttatttttaattagttgtaagtcgagttgtttatttgggatcgggtcggttcggcgggtttggttttcggcgaaggcggcggcgttggtgcgcggcggttggggcgcgggacgtaggtagtgcgtggcgcggttggcgttttcgggcgtcgttatcgagcgagggtgcggtttcgggcggtcgtgcggggtacgatttggttcgcgttgttgcggcggtcgttgtagattttgttttaggcgtcgtagttttgtaggaagagtagataaagataggagagaggtaaagcgtcgtttgtttagagatgtagtcggtttagttaatagagggaaatcgtttttaaatttaggttgggaatgagggaggaggggcgaggcggttggggattagaaaaagtagtagggaattaacgtgatagttagagtttagttagtgtttcgtcggcgttgttttttcgtttcgcggttgcggggttcggaatggagagaggaggcgggggttgagcgttggttgtcgg

SEQ ID NO: 7490 - DNA, 5065 bp, Artificial Sequence; identical to SEQ ID NO: 7458
  Description of Artificial Sequence: Synthetic polynucleotide

SEQ ID NO: 7491 - DNA, 307 bp, Artificial Sequence
  Description of Artificial Sequence: Synthetic polynucleotide
cgttttgggggcgatatcgtcggggaatttgatgatgggcgacggcgcggcggcggcgtggtttagtaggtagtttaggagatagagcgtttttaggggattcgtgagcgcgtttcgggttattagcgtttttatcgtagcgttttttggtttcgcgcgtcgttcgggggtcgttggttcggtgcgtgtggtcgtttcgtcgtttggttggagtttgtttcgcggcgtagggttgcgtttcgagggttcgttggttcggtggtttggggtttgttcggtttagcggtttatggttcggttttcgcgt

SEQ ID NO: 7492 - DNA, 1563 bp, Artificial Sequence
  Description of Artificial Sequence: Synthetic polynucleotide
cggtgttttcgtagttcggacgttagcgttagggattcgttataattttaagttttttttcggggttgggtttcgtatataaataggtagtataaaattaggatttagttggggttcgtatttttttttgtttagattcgagtcgttttagttttcggtcgtcgcgttcggagttcgttttaattcggaaagtggcggtcggttgcggggtaggcgggcggtatttgtgagtagttttagtcggtgttttagtatttttatttcggcgttcggcgcggttcggttttgggtggcggcgtcggggtagcgcgttcggtcgagtcggggagaggagcgcgggagattcggagcggagcggtaggagagcgcggagcgaagcggtaggagtagtttatagttaggagcgttttttcgtttttaacgtcgcgtttttttttttaaaacggtttaaaaaaatttattaattgtatggtcgcgtatttttaaaaaggtattcgtcgttatttggtttcggtgaattttaggaggcggaggaagggcgcggggtgggtgcggtgatatcgtgggaggtggtttttcgtgttcgtcgttcgaataaagagatttcgtcgttttcgggcgtcgcggtggggggtcgcggacggcggttgggggtttttagcgcggtcgggaaggcgaggaaggagagcgggagtcgcggggaggagggggcgtcgttttcgcggaggcgaaatggggcgggagcgagtcggtgcgggattcgcggggttagggtcgtgcgtggggttggggtcgtgttcggggttgggttgggttgggcggggacgcgcgtagtagtcgcggcggcgagagaagttggttttgggtttaggggcgagggcgtcgtcgatttatcgcggagatgcggacgagatagacgcgtaggcggggagcggggtttcggcgtcgtcgacgcgcgggtgtaggtgcgggtagttaggagttttttcgcgtgttcgcggttgtaggggcggaggtcgggttgggggcggtgcgtcgcgggggcgtgttcgcgtgggtttggcgggtgtgggcgttcggttcgcggggcggtgtcgggtttggggttagtttcggacggatcgcggtttttcgcgcgtggttttcgttttttgcgcggttggggtgttcggtgggcgggcgggagggcgagcggggatcgcgacgcggagtttgggggatatttcggtcgattcgcgttttcgtcgattttttattcgtttcgtcgcgcggattgtgttgggtgcgttgcgaggttttgttcgtttttttaggttttttgtggtcgcgcggcgtcgggttttcgggggaggggacggcgttgtcgtagtttttgtttagatttttaaggggaattttagatttgtagagatatttttattttagcgtttttgcgtttgttgtttcgcgttattcgtcgtcgtcgtttgggaatcgagggagaaaagtttttagggtcgggaagaattaggggtttaggggtttttggggcgtcgttttttttttttcgttttcggagttcga

SEQ ID NO: 7493 - DNA, 512 bp, Artificial Sequence
  Description of Artificial Sequence: Synthetic polynucleotide
cgattcgaggttgtttattcggtttggtatgtttcggcgtttttggggtttttgtatttcgttggtttttcgttgtggtgtttcgtagttcgattatttttgtgtttttaggagtttattttgggcggtagggaggcgttgcgtggggtttacgagttttacgttgttatttttattagtttttattttttaggcgtttgttttttcgtattgttaggttttgttttcgtagtatttggtagatttgagttcggtttttgttattttttcgcgggagttttatagtgattttggaggagaagtagtaggagtttataggttatcgcgttcggtcgcgcgtgaagtttgtgtagtcgtatggtcggttcgttggtttcggttttttgtcgacggatacgttgttgtttatttagaggttgtttcgggtcggtttagtcgtggatttagtgttttgtttagtttcggagtttggattgggtagggagtcggcggggtgcgttgatttgggtcgg

SEQ ID NO: 7494 - DNA, 1070 bp, Artificial Sequence
  Description of Artificial Sequence: Synthetic polynucleotide
cggcgttcggggttcgattggtgggaggggttcggtagaggtttcgtttcgagattttagtacgtttcgtttcgttttacggtgtagtatagatttcgcggagaacgcgagtatggtcggaaattatcgtttttattttttggcgggtttcgagggaaggtcgggaacgggcgggttttgttggtttagagggcgttaggggtagttatcggcggttcgggatttttttcgtcgcgagcgcgggggagtttaggttcggtttgtcgggggttgggtgaggttgcggattaggtttttacgtttttcgcgttcgttcgcgtttgttttaggtttttatcgcggttttttttgttttcggggtcgttttgttttttatagattttattttcgggggtcgtttttaggattttcgttcgtttttttttgattcggtttttgttcgtttcgtttttttttttcgggttttttatttttttttcgtcggtttcgatttcgggggcgtttcggatttgtttttcgaatatttttagtttcgtttttagtttgcggagaaggggtcgaggagataggaggaagagagcgagagtttaggggacgaggaggaagttatcgagacgcggagattcgacgacgtcgagggaggtataggtcggggaagcggtagtcgggggcggagcgggggatttgggcgggttttttttcgttttgtttttgtttttttcgtttattttttttttttttttttattcgttatttatcgttatggcgttttcgattttaggcggcgagtgtagtcgtcgttttatttttcgtagtttggcgcgtattagtttttttgtcggtgggcgggcgttaggggtagggtcgaggttcgggtatattttttttttttcgtttatttggcgcgggaggtttatttttcgagagtagttgttttttgtttttttttagggtacggatttttcgggttagtcgttgttttagtatttgcgaggataaagaggaggttttttcgtttggtcgtttttttggttatacggttcgtttttttttttttgtgtttttcgcga

SEQ ID NO: 7495 - DNA, 766 bp, Artificial Sequence
  Description of Artificial Sequence: Synthetic polynucleotide
cgggaattttacgtttttgtattagttcgggggttcggacgagttcgggagtcgttggtcgttaattatcgcgcggtggagaggcgggcgttcggtttcggcgcgttgggggagttagttggcgttgttttttttatcgttttagacgtttatatcgatatagatagacgtatagacgggcgggtagatatcgatagttttttaatcgtttgcgttttagtttcggtttagggagtttttcgtattttttggggtgtcgtaaattgtagttcggtaggttcgcgtcgggagaagggagggcgcgtaggcggtcggaggaggggaggttttagcgcgttttcgttgcgatgtgaacggcggcggtttttatttggagtcgtatttggggcgtcgagtttcggggtcgcggaaagaatgcgcgtcgttcgtgcgtttcgtttgtcgcgtttggttattcgtagtcgtcgcgttcgtatttgattatggagtgcgtttttttgttcgcgtgtgttttttcggttgcgggttcgggttcgtcgaggggtttggcgggattggggcgcgtggttaaggtaggtgtcgtcgagcggagtttcgagagcgggtggtagggggcgttcgacgttagtttcgtcgcgttttttacgcgcgatgttatttttttttttgtaggcgttttagttgtgttgtttttgttgtgcgtcggtcgtcgcggttttagttagtgatagtagtagcggcgttagcggattaaatgatggttcgt

SEQ ID NO: 7496 - DNA, 363 bp, Artificial Sequence; identical to SEQ ID NO: 7269
  Description of Artificial Sequence: Synthetic polynucleotide

SEQ ID NO: 7497 - DNA, 2919 bp, Artificial Sequence
  Description of Artificial Sequence: Synthetic polynucleotide
cgagcgcgtaatatgagttttaaaggttaaatttcggttagttaggagtcggaaggttgagttcggttgatttgattttgagttttttcggagttatttcgtataggcgttcgttttgtttaagggtacgcgacgttagcgggtagtcggttttcgtgaagaatggtttttaaataatttattttatttcgttgtaaagagagggataaaatgggttttttttttttacggatgtttagttttttgggtaggcgtatggtcgggcggcgtttagttcgtagtttcgattcggatattttattgtattttttttttttcggtttttttttcgtacgggcgttcgagagacggataaagagttggggttaagtttgagcgtcgggtacggttaggtttagggaaggaaggttttcggtagatatttgggtattagagttggtgcgaggaggaaaagttgggaggcgaatttataattttgggggtggagggtaggtaggggaggggaattaggttaattttagtcgagtgagtttttagcgagttggggtttcggatgggaggtttgtttcgcgttttaaagaaaagtaaatcgtttttttaggttcgttcggattgtcgaagtttttttggaaaaattttttttttttttatattaaattttgcgtcgggtttcgttttttttcgggtaggtagcggcgtaggaagggttaagttagttcgttttagttgatagttagttgattgggttttgattgatagtttcgaaaagtttttttgtttttatattattatgttaatcgcggtcgttttcgtcgttttttattggttcggagtgttagttaattttttatttggatttgacgttacgagtgttataaaatttagtaattgttttaaattttttttgttggattagaggttttaaaatttttttttattttttagttgtagttcgggttgtttgtcggtttggttttttttttttttttttgttttttgtttcgtttttttttaggatttcgttattttgtttttttaaaaaaaggtaagaaagaattaaattttttttttttttttttttagtcgggttgtatttttgttttgtattttgtatagaggtagagagcgcgcgagggagagagaggaaagaaaaaaaataataaagagagttaagtagaagaggaggcgagaagtatgaagtgttaattttttcgtgttaaggttcgcgtcgttcggatagacgttcgtcgcgtttttagtttcgagcggacgtcgcgcgcgttttgtttgtagttcgggtcggcgaggcgagtttttttttatgtaaagcgcgtagcggagcggcgagcgggggacgtcgcgtatcgggtcgggtttttttagtttcgtcgtcgtagttattatcgtcgttatcgtagttcgcggaggattttttcgagtttgaagtcgtcggtttggcgcgtaaggaggcgagcgagtaaggaggggtcggggcgagcgagggagtatattggcgtgagtaggggggagggagggcgggcgcggggggcgcgggtagggcgggggggtgtgtgtgtgagcgcgttcggaggtttcgggttagttatcgtcgcgtaagttagaagcgttttagttcggtaagttggtttattcgttggttatttagtatagttcgttggttttttttttgtagtttatttggcggagcggcggcggcggcggcggcggcggtaggagaatggtattagaattggtaatgagtaatttcgatttgtttattagttttttggttatggaatatgttaatgatttcgatttgatgaagtttgaagtgaaaaaggaatcggtggagatcgatcgtattattagttagtgcggtcgttttatcgtcgggggttcgttgttttttatttttatgagtacgtcgtgtagttcggtgttttttttttttagtttttcggcgtttagttcgggttcgggtagcgagtagaaggcgtatttggaagattattattggatgatcggttattcgtagtagttgaatttcgaggcgttgggttttagtttcgaggacgcggtcgaggcgtttattagtaatagttattagttttagggcggtttcgatggttacgcgcgcggggcgtagtagttggtcgcggcggtcggggtcggtgtcggcgtttttttgggcggtagcggcgaggagatgggtttcgtcgtcgtcgtggtgttcgtcgtgatcgtcgcggtcgtcgcgtagagcggcgcgggttcgtattattattattattattattacgtcgtcggttattattattattcgacggtcggcgcgttcggcgtcgcgggtagcgcggtcgtttcggtcggtggcgttgggggcgcgggcggcggtggttcggttagcgttgggggcggcggcggcggcggcggcggcggaggcggcgggggcgcggcgggggcggggggcgttttgtattcgtattacgtcgtcggcggtttgtatttcgacgatcgttttttcgacgagtagttggtgattatgtttgtgcgcgagttgaatcggtagttgcgcggggttagtaaggaggaggtgattcggttgaagtagaagaggcggattttgaaaaatcgcggttatgtttagttttgtcgttttaagagggtgtagtagagatacgttttggagtcggagaagaattagttgttgtagtaagtcgattattttaagtaggagatttttaggttggtgcgcgagagggacgcgtataaggagaaatacgagaagttggtgagtagcggttttcgagaaaacggttcgagtagcgataattcgttttttttcgagttttttatgtgagtttgatacgcgattttagttagttattttgataagtgtttcgcgggggttcggttcgg

SEQ ID NO: 7498 - DNA, 2267 bp, Artificial Sequence
  Description of Artificial Sequence: Synthetic polynucleotide
cgggcgggggagggggtttgtcggtagagaaagtgcggagagggtagagtagcggttcggggcgtttttgtaggtggatatgaaacgtacgatatgtaaatgaatgtaaagtgtatgtaaatgatttggtttcgggattcgcgggaagcgagggtttcgtatcggattcgttcgggaggttgagcggggggagcgcgatttttgtcggttacgtacggaggtggttttgggtcgggttaggcgtcgcgttgggggcgagcgcggggtagggggcgggggcggcggtcgaaggagcgattttttttttaattttttatttttttattttttttatattttttaattttcgtttagtttttcgcgcggtcgttagaagtcgcggttttaaagttgcgaggttcgcggtcgtcgattgttgcgaggtgggtgtgcgcggtttgcggagggggagagggtgggcgtaggcgggggtcgttttttagagtcgcgttttttttacggcgttcgtattttttaattttttcgttcgttttcgtttgcgttttttcgcgtcgtttttcgtaggaggcggcgcgttcgtcgtttttttttcgcgttttttttttttttttttgttttcggcgtttcgtatagtttcggtttttatggttagtttttagggcgtcgtttcggtggcggaggcgttgggggcggttttcggcggcggggagtttttttttaggtcggcgtttcggggcggagttgagcgttatgggcgtcgggcgggaggtaggtggcgtagcggcggcggcggggggtaggaggcggaggcggagcgcgcggggcgggggtcgcggggtttcgtgagattttcgggcgagcgcgcggcgttggagttataggcgcggcggttggattcggcgcgggtcgcggaggtcggagatcgtttcgggcggggtgcgcgttttgttttcgcgcggggtggtcggagtcgagttttcggtatggtttaggcggtcgtttcgcgcgttttagtttcgtcgcgcgtttgagttcggtgcggcgttagaagatagcgcgtagtcgtttttgagtcgtggaggcggggattaagttggaaggagtagcgattttcggatcgagtcgcgagtgtgcgtcgttcgtcgttcgtcggatttttcggatttttcgatcgtaagtgtcgtgttcgtttcgcgcgtcgtcgtcgttttatttcgatttcgttcgcggttgtcgttttcggatttgcgtcgtagtcgcgtcgagcgtacgggtcgtttttaaagttggtgtttacggtagggtggagttaattcgtttagcgtttatttattcgggttgagcgtagtttttcgtgagtagagtttgatttgcgggggttgcggcgaaatttcgaggggaacgacgcgttcgggcgttgggagtttcgcgggtttttttggggtcgttcggtttttttaataaaggtttcgcggttcgcgtgacggagattcgggagtggggaggtcgagggcggttttgggagaggtagaggtggcggcggtcggtttggggaggggggtttagagtttttttttgttttttttttttttgttcgggttttcggcgttgtttcgtaggttaaaggtggttcgcgttgggggttttggattttgtttggtatgcggtttttggggttttgacggtcgcgggtttcggtatagtcgggtggtagcgatggcgcgtatagtttttgggaagcgtttatttgtgttgggtaggtttcgagttaggttgtgggaatagcggggagggaggtgtgagtttttgtggagggatagatggttggaaacgtagttttagacggttgattttatttacgtggagtagaaggcggttaggttggtggcggcgatttagagtcgttgggtttcgaatatattgcggggttggcgttttttcgtttttgcgttcgttcgtgtgtgttggggtcgcggtcgggttgtgtttattttttatttattttgtgggttgaggtcggttgattttaggtttattttagggtttaggaagaaaaattttttttttgaaaagagagtacgtcgcgtgtttttgtgggtgggggtttgtcggtagttgttaggtttgtggttttagttagggtgcggtttttgtgcgttcggttcgggtgtgcgtttttttttttggacgaggaataggaggtttttagggtagttatttcggcggacgggtcggtcggggataaggggcgggggtcggtttttcgg

SEQ ID NO: 7499 - DNA, 265 bp, Artificial Sequence
  Description of Artificial Sequence: Synthetic polynucleotide
cgtagtttgcgatcgatggagtaggaggcgcgggtgttgagagttgcgggcggttttggtcgggttcggcgtttgttggttttcgtttcgtgggtattttgtatagtgttggggttggtgttgagtttcgaggagttgtttatcgcgtagttcgcgttttattgtcgatcggattttacgttgttgtttttagcgttgcgcgttttgcgcggattcgcgttgttggacgtcgttatttcgcgtttggggtttacgcgagtcgcga

SEQ ID NO: 7500 - DNA, 374 bp, Artificial Sequence
  Description of Artificial Sequence: Synthetic polynucleotide
cgaatagcgttttgaaacgtagaaacgtgtttattcgaattgttaacgcgagcgtagagtttattgataaagtaaaataagataaatcgggagttagaaaatttagcgatttataggatttatcgtgatgttttttataaatgttatcgcgaaaatagtcggatttgaaaataaacgcgatttatttggttttcggaaggggagaaggattcgggcgaaaggcgttagttttttttcgttcgtttcgtagacgtagcgtaggtttcgagttttcgagcggcggttttagaattcgcgggttattcgggagtttttttcgtagtattagtcgaaagtttttagcgtcgaggagggcgggcggttgtttttttcga

SEQ ID NO: 7501 - DNA, 1133 bp, Artificial Sequence
  Description of Artificial Sequence: Synthetic polynucleotide
cgaatagcgtttttaaatttagaaacgtgtttattcgaattgttaacgcgagcgtagagtttattgataaagtaaaataagataaatcgggagttagaaaatttagcgatttataggatttatcgtgatgttttttataaatgttatcgcgaaaatagtcggatttgaaaataaacgcgatttatttggttttcggaaggggagaaggattcgagcgaaaggcgttagttttttttcgttcgtttcgtagacgtcgcgtaggtttcgagttttcgagcggcggttttagaattcgcgggttattcgggagtttttttcgtagtattagtcgaaagtttttagtgtcgaggagggcgggtagttgtttttttcgatttcgtttcgttcgcgcggacgttttcggttttacgcggggattatttcgggattttcgtcggatttcgcgcgttcgcggttaatttgcgtgtatttgcgtttcgcgttacgttttcggcgttttacgtttagtttttattgggtttcgttttttagtggttttaagtttcgttttttcgttggttatcgtaagtttcgtttttcgaggtttcgtttttgtaaggttcgtttttttacgatttaggtttcgtttattacggttagttcgggtttaggtttcgtttcgatacgatttaggtttcgttttcggttagtttcgtttttcgcgcgtttcgtttagtaattttcgttgaattcggcgcggtttttttagcgttgttttacgtcgtagtttagcgtttggagttcgcgcgtttcgagtttttgttcgtttatgcgtagttgggttatttaggtgtatttatttttttgttgtttcgtcgttttttttgtttttatttcgtttaggttttgggtgttttttttttattttttttggcgtttttgttttaggttatttggtcgtttttttgggtttttcgttcgggggcggtttttggttcgacggtgtcgtagacgcgcgcgtataggttagtttcgcggagaggttgtttttaggggttaggcggggggttgagttagaggttggggtttgttaggagcggggcggtttggggcgtagtagtattggagttgaaggcgagggcggttcgcgtcgg

SEQ ID NO: 7502 - DNA, 2358 bp, Artificial Sequence
  Description of Artificial Sequence: Synthetic polynucleotide
cgggattcgttttttaagcggcgttttttttatttttcgcgaatttttcggcggggtttgtgtggattaagggagattagagatttttcgtcgttattttatttaggcggagacggtttattcgaattcgtacgggtttttttttttttttggaatttgtagttggtttttttcgaatgtttgttttttttttttttttacgaaagaatagtgttttgggattcggggtgcggggtagtcgggttcgttggagttgtttagtgcggggaagagtcgtcgagattgggagaaggggcgttggttagggaggagacggggtagggagcggattcgcgattcgtattttgggcggcggttttcgcgttttagtcgcgtttttcgatgatttttagtcgcgaagggcgagcgggcgggggttgggttgcgggttcgggttttaggaggtttgcggggtcggggaggggcgtggagtggttcgaggatcggtttggggattgggggtaggtgtttggacggacgcgggtcgagtatttttttcgggggcgggcgtagtgaaaatattttgggaggcggcgtcgcgcggttgagcgttgttgttttgggaataggacggcgttcggtattgcgagttgagagtatttttataaattttgtatgggaggcgtttcgtgagcgggggcggggagcggagcgagagggagggagttagagagtaagggagggagggaggaggagaggagggggaagtcggggggaggaagggaggcgtttcgtttcgtcgatcgttcggttttgtaaacgcgcgtcgggcgtttttttcggagttcggcggtgcgtgcgagcgtttttttgttgtagtcgcggcggcggtggttcgagggggcggagaggagggggttgcggtcggtcggttagggggcggcgtttttttttaaaatcgtttgcgaagtgtttcgggtggtagaagtaggtcgtcggtttcgcggagtaagtcgttcgtttcggggttgagtaagcgcgcggggttgtcgggtagtattacggttgtttgcgggcgtcggtgttttcggcgcggggttggagtttattatgtttttgcggggtcgggttatcgggtacgagcggattttcggtttgttttcgtttcgacgcgttcggattagttgtagttggcgtttagggatttgaatttggatttcgggagggagtgcgtttaggtcgatttcggagcggcggtttcgtggttaatatgtttcgtaaaggtgagttggagtcgtaggggtaagttgaagttgaatgcgtttcggaaagagtcgcgagttcgggcgtcgttcggcgtcggggttttcggtttgggaagtagttttcggcgggttggtgggttttgtcgggcgtattcgtcgaggggttgttgttggggtttagttttcgttagcggttagttgtgagatacggggttttttttatggatcgagtggttaggtttagagattcggttcggaggggttagtcggagattagagtgagcggtcggtggtggaaggggagtcggttttttgggatttttgttttgttgggataaagttttgtatttgtagtttttattttttgcgcgggtatacgtttttgtttttgtcgttttgtggaggtcgagttcgtacggcgttttcgtgtagttagcggttagtgatcgcgcggttcgggcgtttttcgcgcgttttagttttttagacggggttcggacgcggacgttttttttgtagttttgttttgatcgttagggatgggttttgggtatttagcggttgagggtggggagcggttagcgtttgatgtttagttttttaaatttttattatgttgggagcggagggacgcgaaagtcgtgtcgttagtgtgcgcgatcggtgtatagtttaatttgaggatagttggtttcgcgattatcgtagttagacgttttagtagttcggttcggtacggagcgcggtaaagttggtgcgggtatcggggaagtttcgtcgcgtttttacgtggttgttacgcggggcgtcgtttttcgggttttgggagggtaggtgattacgtcgggagtttacgggtttcgttattagttgttttagtttttgcgtttgtttttttttttttaggttcgagtaggttgtggcgtttcgtcgggatttttttcgcgtttggttcggttaggaggttgagaagtcgcggcgtttgcggttggttgtttcggttttgcgggagcggttgaggcgggagtttaggtagtcgaggggtttgatttttgcgttttacgttttagttttaattcgtttttgtttttatggtaatagatcgaggtgtcgt

SEQ ID NO: 7503 - DNA, 1050 bp, Artificial Sequence
  Description of Artificial Sequence: Synthetic polynucleotide
cgggcgggtagttgcggttgttgaggttcggtggggtttttttaagacgcgtgttcgtatttgttcgtcgggcgtttgcggggtgtagcgtttattggagcgcgatagtttttgggatagaggaggatagtggtttcgtttttttgtgcgatcgtttaggagtttcgggtcggagagtgcgagcggggaaaaggggttttgtatttagagtggggcggacgtggcgaggaagttaggggggatcgggaagcgaggttcgcggtgcggagggcgcggggcgtggggggatatttttcggagagatatcggaggggcggaagtaaggagatggaaaggagagggagatcggggagatagatttgagagatttagaggtttgtagagagttttattcgggattttttagagtttaggaaagagtagatgcggacgcgggagggcgttttacgttaaagcgggtagtattagtgattaaaatacgtttcgtttggtagtttcgggacgtatttttgtttcggtagcgtaggagaggtttggatagcgcgagatgttagggtttaggttgtttttagagggttggttcgaagcgttggagtttaaagacgttttttatcgtcgtcgggtggtagaattgggggtaggcgcgttttatagatttcgaggggtggtttcgttttagggtcgcggggaggcgttttcgtgcggggcggagttgttatcgttttttttttaattttcggggattgtggtttttttttaagttcgcggcgtttttagttgttttttattcgtttcgttcgttagtttttttttcgcgcgatggtttcggcgttgagttatgtttttaagtttaagtttttcgtgattttgttcgttatttcgtttttgttgttgttattcgttattttgatgttcgttaaggttagttgtatttttaggtagtttttcggatattcggcgttttgtgtttattaacgggtatcgatttcgggagttttgagttggagcgtacggatttcgcggggagtatagttttttcggggcgcgcgt

SEQ ID NO: 7504 - DNA, 1731 bp, Artificial Sequence
  Description of Artificial Sequence: Synthetic polynucleotide
cggtcggttttagttgttatttaggtaatttcggagtcgtcgtagatatcggatttattggaagggggcgaagtcgcggggaggaatgggggatattggggaaggggcgtcgtttttgtcgttttcgttttttttagtgttattgggcggttgttgcggagttcgcgttattttttttttattttatttcgttcgtttggtttcgtttggtcgttggttcgcgtttcgttgcgttcgttcgggggttggttcggttcgggtttttgacgttattagtaagtttgttgttttcggcgttttacgtgtggcggcggttagcggcggtttaggaggtagtcggtgagcgtttgcgagtagagtggcgggggtcgttgataggtttcgcgtagtttagtttagtttagttacgcggtttataggtggggtttaagagtagtttggagtaattcggcgttacggagaggggtggacggttttgtacgggttttttgtttttcgttcgggtagagggattcggggggatttcgttttttggttgagagaatttgaattcgggcggagagaacgcgtttaggcgggtaaggggattagagaaagtcggggttggaagttattgtcgttcgttattgtttggagcgtacggagcgtagaggttcggtagtcgcgcgtgtttttacggggatcgagttagtgatgtaggatcgttgagcggagattcgcgtcgagaagtttttcggggtcggggttgagacgtacgttttcgatatcgttgttaagatttcgatttcggcgatttttgcggggaatcgaggggttaaggttgttttaagtttaggatttgggcgagtttaagacgatggttttttaagtacggattcgcgttttttttttcgttttttcgattggaggtagggattttgcgcggggttttcgggatttcgttttttcgcggagtttcggtcgttgtttttcgggatagttcgtacggttataggggcgtacggcgatgtggttttcgtttagcgcgttggttcgtcggggggatgttttggtatttgtcggggtttaggtttagtatggtcggcgcgttgttcgacgtcgttttcggttaggatggttttttcgggttcggttagtgttttttttatttcggtcgagtcgttgtttcgtagtatttttcggaagtttttgttgatgttttgttttttgtttacgtttttttacgttttttattgtttggtcgagcgttgttagattttgttcggtttcgtcgtggggttgttcggcggcggcgaggaggcgggggtttttggtggcggcgttttggtcggaggttcgagggagttggcggtgtggtcggcggcggtatagagaaagcgttttttgtaattgtcgtagtggcggaggcgtcggtcgttcgcgtttcgcgacgacggcgaggaggcggtttgggaagaagagttttttggtttgttagggggttcgggcggtttcggggtcggaagtatcgtggtcgaggtttcgtcggggattttggcgttgtttttggacgaaggtagtaagtagttgtcgtaggttattattatcggagtgaagaagggcggtacgcgggcgttgttggagtttttgcgcgtgtatttcgacgtgcgcgtcgtgggcgtcgagttttattttttcgatcgtagttacgataagggtttcgtttggtatcggtgagcggggcgggttcgg

SEQ ID NO: 7505 - DNA, 3535 bp, Artificial Sequence
  Description of Artificial Sequence: Synthetic polynucleotide
cggtcgcgttaggagttgttggtgtagtttaggaacgtagtgtttggggttagttgcggtatttatagtgggttttttcggtagttcgattcgtcgggttatcgtttcgggttttgtgttttttggattcgggagttttgtttgttagtttagggagatggttcgggaggacgaagaatttttcgtttttcgcggtttagttaagtttttgcggtcgttcgggtttagtcgttatgcgtggtcgttcgtagcgtagttttcgggcgtaagtcggtagtcgaatttttcgggttgcgttgttcgttgtaggcgcgcggcgagggtttttacgcgatttcgttttttatttagcgttttttagttaattaaaaagaacgtggtaggtggagggtagtcgtttaagagattgcgtgagtttttttgtggggatttttatagtttgttttaggtgttttaaaatcgtttgatattaagggtttagttttttttttgttagttttttttaattcggtttaagtgtgtttgattttagaaaattttaggttgtttcggggttttggcgggttttatttggaagggcgttagttatagtttgtcgtttggttttggaattattattttaggaggagggggagtggtggtggtagaagttataataatataatcggtgataatagttaacgattagagaggtttttacgtgtttgcgaggtattttatcgtattagcgtatttattttttttatttttgtttagaatttgtattatttttattgtatagatgagagtattaaggtttacgcgattagttaggacgtgaatttaggcgtcggattttagagattttatttttatttattagtgtttcgagaatgggttatagttcgggaacggtgggaaagatgattgttacggttggttaaatttcgagatttgggtaatttttgataataataaaaaattattaaggataaaggggaaggggtaggacgaggttgggaagggagtcgttttaattcgcggggttagtttttttttattttttaatttatttaggtttcgatagtggggtgggtatagggagaggggtttagttattttttttttttttgtttttttaagttttgagcgtttgtgaagttaattgggtttggaggggtgtttgaatgtcgtgttggttggggttacgggtggagattttaacgaaaatgtgggggtcgttatttgggtttttagtcgaagatagttatcggaggtcgaaatttagattttttgtttattcgcgttttattcgaagttcgggtaatttaatagtttattttaaagattagtagttgcggaaagtagtgggtagaggtagtgattgtgatttcggggttattgtttttttggaatttgattcgtaattcgattcgagaatagaattttcggaagtcgcgatttcgaagtaatttttattttttaattaatgggtttcgaatattttttgtttcggacgtgtaaaagtttcgcggagatacgcgtttttgttttttttattttagtatcgagggtagggaggcggaaacgggcggcggtgttcggaggttcggacgtttttaaagtttcgcgtcgttttagtcggttgtagtgcgcgtttttgttcgatagggattagtatagttttacgtttcgcgcgtcgttcgttcgttaggcggaggcgtcgggttattcgttcggtttattttttcgagtttaggcggttcgcgagcgaggcgggtttgatatttttggggtttcggtaattaggcggattgtaataaaaagttaatagattttgcggtttcgtcgggacgtcgcggtttttattttttttttttatttgggaagtagaagttgttttagaagttttttgagggcggagatcgattaaaggggtttagaatatttttagcgtttcgggtttcgggaggaaaaaatttaaaacgagttataaaatacgattcgagtcggatatttttatggttagagggtggttcgttttgttgagggcggttttagtcgttgttttttttttttgcggcgaggtcgtttgatgaatttaagggtattagtgtttcgcgagaattttttgtgggttgtgacgagaattaagcggagcgtaatttttatcgtattcggataggatgcgttgcgtaatttgtcgtagtttttttgttttatttcgggtggttcgaagttgtaattttgttaattttttattatacgttatgttttttttagtttagggtttgaatcgacgatggagattttgtttttggtagggaaatttatcggtattaagcgaggtttttgtcgtagttgcgatcgaagaaatggggttcggcgtttacggcgcgtacgtcggggtgtacgcgtagaaattttagtagcgttcgcgtgtcgtttttttttacgtcgatgatgatggtttgcggtagttgtttgtttttagatttattgaaaaagttggagatggggtttggggagttcggtatttcgggattttgttttttcgggttcgtagcgttttcggttatttttttgtttgaagttagtggggtggttggcggcgttcggaacggtagtttggggggcgtttcgttcggagttgtggttagggttggcgggtcgtgtgcggcgcgggatttagagtttaggagtagtagtttcggcgcggcggcgtaggagtcggcgtacgagtataggaatatatagagttagacgtagagtatggcgaagagtagcgcgagttttttttttatcggcggcgggggcggcggcggttgcggtaggagtcggtcggggatatcgaggtaagatttgtcgttatttaggcgttgttttatgcgttgttcgcgggcgcggttagggatatggtttagtatatggcgtgggtttcgtcgggtagtgagcgtagagagggtttttcggtacgttggacgttcgggtggttcggtttattgttttcgtgtgttcgcggtcgtcgttgttgttgttgtttttttttaggtggcggcggtagttgtagcggcggcggtttttgatatgttgttcggtaggagttgtaattggaacggaaagtcgggacggcggtaattgttgggcgagggtttgttttcggggcgcgacgacgcgttcggggttaggaggacgttgtattttcgcgttttggttattttagattgtgcgtatcgtcgtacgtcggggttgtttttttgtagttttaagaattgagtttcgagtagtttcggtattttttcgtagaggttgtagaggcgaattgcgtaggaagagagttgtggatcgaggtggagtgggcggtttcggttttttagagtgacgggttgttttatttattaaaaatttcgaacgttatgtaaatataggcgttttttcgagagtttagtagttaattcgtttttaggacgagggggtgtggaaaggtttttgggcggtgtagggcggttaggggttgttattggtttcggaataaggggcgggtttaaaggggcgg

SEQ ID NO: 7506 - DNA, 2896 bp, Artificial Sequence
  Description of Artificial Sequence: Synthetic polynucleotide
cgattttcggtcgcgaatttaagtttgtcgttttcgtcgcgtttattttttagttttttttttgtttcggcgttattttaggtcgacgtttttaattaaaataagttttttttttaggagttttttttttttgttcgaggtttagggttagtagttttaggagggattttttttttattttatttttttcggtagaggtgcgagattttattgttagtttggttattcgatcgcgcgtgagattggggcgtagggtaggggggttattgggtaggttttcgtgcggggagtggggaggggtttttaggggaagtgtttgaagttatttttgtagttttgtttagattcggaagtcgtcgaggaagggaggaaggcgggggtggggagagcgcgattttaagcgttggcgggcggcgaggaggggtcgtagcggttcgaggaagcgtttggaggcgttaggggcgtcgagtttttagggaggtcgcgttttcgggaagttttttatcggttgttcggagtaggatcggacgcgcggatcgtttttttcggttcgattagtttcggggcgtagattgcgaatttgaatagaattttttttttttttggtatttttcgtttttttattcgtggttattagtttcgttattttagttttatgtttttcgttaatattatattcgttaagatcgtttattaatgttttgtggaggaaaggggaggggggaatttttagtataattaaattgtggttaaaagcggttaaaaaaaaaaaaaaaaaaaggaaagaaagaaatttttttttttgagatcgatttttttaattagcgtggaaaatttttaaatatgtaaattcgtaattttagttaagattttggcgtcgcgggaggggtgttcgcggcgggcggcgattttagtttgtagtttcggatttcgggtaggtttgcgcgcggcggcgggtcgggggttcggggagttttggcgtttatagtagttcgtcgaaaatataaagtttcgtcgttaataatatttgcgggttttttttgggtttttcgggcgtcggcgttgcgcgtttcgtcgtttttttttttttcgtcgttttttttttttcgcgtacgttttttttttcgttttttttagaacgcggtggttagatgagatttttgggagaaataaatgtgagcgttcgtacgaattttttttttcgttagtcgtttgtaacggttttaggttcgtttttttttttcgcgttttcgcgcgcgtcgcgtttttcgcgtttcgcgttttttttttagtagtttttgcgagcgtttttagtagttattatttataggtcgtcgggggttaggaggtaattagagacggtttcgtggtcgtatttattcggtaagcgcgatgttggcgcggggcgcgcgcggggaggggcgcgcgatgagggggtttggttgcgcgtagttcgcgttttagatttgggggaagggaggaggaggagggggtagggaaggaggaggcgggcgggggggcgagagatgagttcgggaagggagcgggaggagggggcgtcggggagacgtttttttggtttttatcgcggggtttcggggttattcgttgcgaggtttcgacgcgtttagggacggggggtgtgagtgtaagagtgcgcgcgcgcgtaggcgtgtgtatgttaaagatagaggaggggagggagggaacgttttaatatttttttagtgatttacgagtttgcgggtgaggttttggttgtgcgtttaggttcgtgtgtgtattaatgtggttgtatatttttggtttgttttacgagtgaatgttacggggtttgggggggggggtttggatataagttagtgaatgtgtttttgggttttagtttgattgaatgatgtggcgttgcgtggggttgtgtttgtgcgattgtttataggggggttgtgtgatttcgtgaggtattgcgtgggtgggattgcgtttgtgtgcggttgtgtgtatatgggattgtgtttgcgtggggttgagtgtttagagggtagttgtgtggttatgtgggtttgtttgcgagtgggttggtgggtgtgtggggtcgtggggttgcgtatgtaggggtagtgcgtttgtacggggttttgggttaatttaaagggttgtggtgggtatttgtaggcggttgcgtgtgtggttggatttgcgtggggtttgaggtttggcgggtgggggttagtttttttggcgtcggggatcgtatcgcggtagaagagtcgtttaaggcgttaataggtagcgtcggggtcgcggcgtagcgcgacgtgtagtagcggtggggcgtagagagaaggcggagaagaggggggtttttatcgcgcgttttttttagtcgtattagagacgtagtttggagattttgtcgtttgtcggtttcgcggttttagaagtatagggtttgggggattttttttagttgggggagacgtttattggtcgggaaggtagcgagaattgagattcgatgattttggcgtagtatagaagtatgcggtaaggatcgttaggagaggtgggtcgcggttcggagatagtcgagaattaggtcgagataaagaagagcgggatcggggattttggggttaaatcgcgtttttaggtttttcggcggtcgaggggagcgtatttaaggtcggcgcgtggagtttggcggaggtggcgcgggttttttttcgttgtagttttagtagtcgttttagagttttgggggtacgtaattaggcgttatagggtagggttacggtgaggggggttttgagtgtagttggcgggcgtcgagtttcggggttgtgattgagcgtttagttggttcgtttttttttcggtcgtttatcgtttacgt

SEQ ID NO: 7507 - DNA, 1017 bp, Homo sapiens; identical to SEQ ID NO: 1

SEQ ID NO: 7508 - DNA, 166 bp, Homo sapiens; identical to SEQ ID NO: 2

SEQ ID NO: 7509 - DNA, 125 bp, Homo sapiens; identical to SEQ ID NO: 13

SEQ ID NO: 7510 - DNA, 508 bp, Homo sapiens; identical to SEQ ID NO: 24

SEQ ID NO: 7511 - DNA, 396 bp, Homo sapiens; identical to SEQ ID NO: 35

SEQ ID NO: 7512 - DNA, 173 bp, Homo sapiens; identical to SEQ ID NO: 46

SEQ ID NO: 7513 - DNA, 97 bp, Homo sapiens; identical to SEQ ID NO: 57

SEQ ID NO: 7514 - DNA, 208 bp, Homo sapiens; identical to SEQ ID NO: 68

SEQ ID NO: 7515 - DNA, 647 bp, Homo sapiens; identical to SEQ ID NO: 79

SEQ ID NO: 7516 - DNA, 282 bp, Homo sapiens; identical to SEQ ID NO: 90

SEQ ID NO: 7517 - DNA, 32 bp, Homo sapiens; identical to SEQ ID NO: 101

SEQ ID NO: 7518 - DNA, 56 bp, Homo sapiens; identical to SEQ ID NO: 112

SEQ ID NO: 7519 - DNA, 44 bp, Homo sapiens; identical to SEQ ID NO: 113

SEQ ID NO: 7520 - DNA, 211 bp, Homo sapiens; identical to SEQ ID NO: 124

SEQ ID NO: 7521 - DNA, 141 bp, Homo sapiens; identical to SEQ ID NO: 135

SEQ ID NO: 7522 - DNA, 25 bp, Homo sapiens
cgtgcaccctgaggtctggttggcg

SEQ ID NO: 7523 - DNA, 498 bp, Homo sapiens; identical to SEQ ID NO: 157

SEQ ID NO: 7524 - DNA, 186 bp, Homo sapiens; identical to SEQ ID NO: 168

SEQ ID NO: 7525 - DNA, 97 bp, Homo sapiens; identical to SEQ ID NO: 179

SEQ ID NO: 7526 - DNA, 82 bp, Homo sapiens; identical to SEQ ID NO: 223

SEQ ID NO: 7527 - DNA, 51 bp, Homo sapiens; identical to SEQ ID NO: 334

SEQ ID NO: 7528 - DNA, 431 bp, Homo sapiens; identical to SEQ ID NO: 374

SEQ ID NO: 7529 - DNA, 258 bp, Homo sapiens; identical to SEQ ID NO: 385

SEQ ID NO: 7530 - DNA, 84 bp, Homo sapiens; identical to SEQ ID NO: 396

SEQ ID NO: 7531 - DNA, 62 bp, Homo sapiens; identical to SEQ ID NO: 407

SEQ ID NO: 7532 - DNA, 50 bp, Homo sapiens; identical to SEQ ID NO: 418

SEQ ID NO: 7533 - DNA, 1017 bp, Homo sapiens; identical to SEQ ID NO: 429

SEQ ID NO: 7534 - DNA, 166 bp, Homo sapiens; identical to SEQ ID NO: 430

SEQ ID NO: 7535 - DNA, 125 bp, Homo sapiens; identical to SEQ ID NO: 441

SEQ ID NO: 7536 - DNA, 508 bp, Homo sapiens; identical to SEQ ID NO: 452

SEQ ID NO: 7537 - DNA, 396 bp, Homo sapiens; identical to SEQ ID NO: 463

SEQ ID NO: 7538 - DNA, 173 bp, Homo sapiens; identical to SEQ ID NO: 474

SEQ ID NO: 7539 - DNA, 97 bp, Homo sapiens; identical to SEQ ID NO: 485

SEQ ID NO: 7540 - DNA, 208 bp, Homo sapiens; identical to SEQ ID NO: 496

SEQ ID NO: 7541 - DNA, 647 bp, Homo sapiens; identical to SEQ ID NO: 507

SEQ ID NO: 7542 - DNA, 282 bp, Homo sapiens; identical to SEQ ID NO: 518

SEQ ID NO: 7543 - DNA, 32 bp, Homo sapiens; identical to SEQ ID NO: 529

SEQ ID NO: 7544 - DNA, 56 bp, Homo sapiens; identical to SEQ ID NO: 540

SEQ ID NO: 7545 - DNA, 44 bp, Homo sapiens; identical to SEQ ID NO: 541

SEQ ID NO: 7546 - DNA, 211 bp, Homo sapiens; identical to SEQ ID NO: 552

SEQ ID NO: 7547 - DNA, 141 bp, Homo sapiens; identical to SEQ ID NO: 563

SEQ ID NO: 7548 - DNA, 25 bp, Homo sapiens
cgccaaccagacctcagggtgcacg

SEQ ID NO: 7549 - DNA, 498 bp, Homo sapiens; identical to SEQ ID NO: 585

SEQ ID NO: 7550 - DNA, 186 bp, Homo sapiens; identical to SEQ ID NO: 596

SEQ ID NO: 7551 - DNA, 97 bp, Homo sapiens; identical to SEQ ID NO: 607

SEQ ID NO: 7552 - DNA, 82 bp, Homo sapiens; identical to SEQ ID NO: 651

SEQ ID NO: 7553 - DNA, 51 bp, Homo sapiens; identical to SEQ ID NO: 762

SEQ ID NO: 7554 - DNA, 431 bp, Homo sapiens; identical to SEQ ID NO: 802

SEQ ID NO: 7555 - DNA, 258 bp, Homo sapiens; identical to SEQ ID NO: 813

SEQ ID NO: 7556 - DNA, 84 bp, Homo sapiens; identical to SEQ ID NO: 824

SEQ ID NO: 7557 - DNA, 62 bp, Homo sapiens; identical to SEQ ID NO: 835

SEQ ID NO: 7558 - DNA, 50 bp, Homo sapiens; identical to SEQ ID NO: 846

SEQ ID NO: 7559 - DNA, 1017 bp, Artificial Sequence; identical to SEQ ID NO: 857
  Description of Artificial Sequence: Synthetic polynucleotide

SEQ ID NO: 7560 - DNA, 166 bp, Artificial Sequence; identical to SEQ ID NO: 858
  Description of Artificial Sequence: Synthetic polynucleotide

SEQ ID NO: 7561 - DNA, 125 bp, Artificial Sequence; identical to SEQ ID NO: 869
  Description of Artificial Sequence: Synthetic polynucleotide

SEQ ID NO: 7562 - DNA, 508 bp, Artificial Sequence; identical to SEQ ID NO: 880
  Description of Artificial Sequence: Synthetic polynucleotide

SEQ ID NO: 7563 - DNA, 396 bp, Artificial Sequence; identical to SEQ ID NO: 891
  Description of Artificial Sequence: Synthetic polynucleotide

SEQ ID NO: 7564 - DNA, 173 bp, Artificial Sequence; identical to SEQ ID NO: 902
  Description of Artificial Sequence: Synthetic polynucleotide

SEQ ID NO: 7565 - DNA, 97 bp, Artificial Sequence; identical to SEQ ID NO: 913
  Description of Artificial Sequence: Synthetic oligonucleotide

SEQ ID NO: 7566 - DNA, 208 bp, Artificial Sequence; identical to SEQ ID NO: 924
  Description of Artificial Sequence: Synthetic polynucleotide

SEQ ID NO: 7567 - DNA, 647 bp, Artificial Sequence; identical to SEQ ID NO: 935
  Description of Artificial Sequence: Synthetic polynucleotide

SEQ ID NO: 7568 - DNA, 282 bp, Artificial Sequence; identical to SEQ ID NO: 946
  Description of Artificial Sequence: Synthetic polynucleotide

SEQ ID NO: 7569 - DNA, 32 bp, Artificial Sequence; identical to SEQ ID NO: 957
  Description of Artificial Sequence: Synthetic oligonucleotide

SEQ ID NO: 7570 - DNA, 56 bp, Artificial Sequence; identical to SEQ ID NO: 968
  Description of Artificial Sequence: Synthetic oligonucleotide

SEQ ID NO: 7571 - DNA, 44 bp, Artificial Sequence; identical to SEQ ID NO: 969
  Description of Artificial Sequence: Synthetic oligonucleotide

SEQ ID NO: 7572 - DNA, 211 bp, Artificial Sequence; identical to SEQ ID NO: 980
  Description of Artificial Sequence: Synthetic polynucleotide

SEQ ID NO: 7573 - DNA, 141 bp, Artificial Sequence; identical to SEQ ID NO: 991
  Description of Artificial Sequence: Synthetic polynucleotide

SEQ ID NO: 7574 - DNA, 25 bp, Artificial Sequence
  Description of Artificial Sequence: Synthetic oligonucleotide
ygtgtattttgaggtttggttggyg

SEQ ID NO: 7575 - DNA, 498 bp, Artificial Sequence; identical to SEQ ID NO: 1013
  Description of Artificial Sequence: Synthetic polynucleotide

SEQ ID NO: 7576 - DNA, 186 bp, Artificial Sequence; identical to SEQ ID NO: 1024
  Description of Artificial Sequence: Synthetic polynucleotide

SEQ ID NO: 7577 - DNA, 97 bp, Artificial Sequence; identical to SEQ ID NO: 1035
  Description of Artificial Sequence: Synthetic oligonucleotide

SEQ ID NO: 7578 - DNA, 82 bp, Artificial Sequence; identical to SEQ ID NO: 1079
  Description of Artificial Sequence: Synthetic oligonucleotide

SEQ ID NO: 7579 - DNA, 51 bp, Artificial Sequence; identical to SEQ ID NO: 1190
  Description of Artificial Sequence: Synthetic oligonucleotide

SEQ ID NO: 7580 - DNA, 431 bp, Artificial Sequence; identical to SEQ ID NO: 1230
  Description of Artificial Sequence: Synthetic polynucleotide

SEQ ID NO: 7581 - DNA, 258 bp, Artificial Sequence; identical to SEQ ID NO: 1241
  Description of Artificial Sequence: Synthetic polynucleotide

SEQ ID NO: 7582 - DNA, 84 bp, Artificial Sequence; identical to SEQ ID NO: 1252
  Description of Artificial Sequence: Synthetic oligonucleotide

SEQ ID NO: 7583 - DNA, 62 bp, Artificial Sequence; identical to SEQ ID NO: 1263
  Description of Artificial Sequence: Synthetic oligonucleotide

SEQ ID NO: 7584 - DNA, 50 bp, Artificial Sequence; identical to SEQ ID NO: 1274
  Description of Artificial Sequence: Synthetic oligonucleotide

SEQ ID NO: 7585 - DNA, 1017 bp, Artificial Sequence; identical to SEQ ID NO: 1285
  Description of Artificial Sequence: Synthetic polynucleotide

SEQ ID NO: 7586 - DNA, 166 bp, Artificial Sequence; identical to SEQ ID NO: 1286
  Description of Artificial Sequence: Synthetic polynucleotide

SEQ ID NO: 7587 - DNA, 125 bp, Artificial Sequence; identical to SEQ ID NO: 1297
  Description of Artificial Sequence: Synthetic polynucleotide

SEQ ID NO: 7588 - DNA, 508 bp, Artificial Sequence; identical to SEQ ID NO: 1308
  Description of Artificial Sequence: Synthetic polynucleotide

SEQ ID NO: 7589 - DNA, 396 bp, Artificial Sequence; identical to SEQ ID NO: 1319
  Description of Artificial Sequence: Synthetic polynucleotide

SEQ ID NO: 7590 - DNA, 173 bp, Artificial Sequence; identical to SEQ ID NO: 1330
  Description of Artificial Sequence: Synthetic polynucleotide

SEQ ID NO: 7591 - DNA, 97 bp, Artificial Sequence; identical to SEQ ID NO: 1341
  Description of Artificial Sequence: Synthetic oligonucleotide

SEQ ID NO: 7592 - DNA, 208 bp, Artificial Sequence; identical to SEQ ID NO: 1352
  Description of Artificial Sequence: Synthetic polynucleotide

SEQ ID NO: 7593 - DNA, 647 bp, Artificial Sequence; identical to SEQ ID NO: 1363
  Description of Artificial Sequence: Synthetic polynucleotide

SEQ ID NO: 7594 - DNA, 282 bp, Artificial Sequence; identical to SEQ ID NO: 1374
  Description of Artificial Sequence: Synthetic polynucleotide

SEQ ID NO: 7595 - DNA, 32 bp, Artificial Sequence; identical to SEQ ID NO: 1385
  Description of Artificial Sequence: Synthetic oligonucleotide

SEQ ID NO: 7596 - DNA, 56 bp, Artificial Sequence; identical to SEQ ID NO: 1396
  Description of Artificial Sequence: Synthetic oligonucleotide

SEQ ID NO: 7597 - DNA, 44 bp, Artificial Sequence; identical to SEQ ID NO: 113
  Description of Artificial Sequence: Synthetic oligonucleotide

SEQ ID NO: 7598 - DNA, 211 bp, Artificial Sequence; identical to SEQ ID NO: 1408
  Description of Artificial Sequence: Synthetic polynucleotide

SEQ ID NO: 7599 - DNA, 141 bp, Artificial Sequence; identical to SEQ ID NO: 1419
  Description of Artificial Sequence: Synthetic polynucleotide

SEQ ID NO: 7600 - DNA, 25 bp, Artificial Sequence
  Description of Artificial Sequence: Synthetic oligonucleotide
cgtgtattttgaggtttggttggcg

SEQ ID NO: 7601 - DNA, 498 bp, Artificial Sequence; identical to SEQ ID NO: 1441
  Description of Artificial Sequence: Synthetic polynucleotide

SEQ ID NO: 7602 - DNA, 186 bp, Artificial Sequence; identical to SEQ ID NO: 1452
  Description of Artificial Sequence: Synthetic polynucleotide

SEQ ID NO: 7603 - DNA, 97 bp, Artificial Sequence; identical to SEQ ID NO: 1463
  Description of Artificial Sequence: Synthetic oligonucleotide

SEQ ID NO: 7604 - DNA, 82 bp, Artificial Sequence; identical to SEQ ID NO: 1507
  Description of Artificial Sequence: Synthetic oligonucleotide

SEQ ID NO: 7605 - DNA, 51 bp, Artificial Sequence; identical to SEQ ID NO: 1618
  Description of Artificial Sequence: Synthetic oligonucleotide

SEQ ID NO: 7606 - DNA, 431 bp, Artificial Sequence; identical to SEQ ID NO: 1658
  Description of Artificial Sequence: Synthetic polynucleotide

SEQ ID NO: 7607 - DNA, 258 bp, Artificial Sequence; identical to SEQ ID NO: 1669
  Description of Artificial Sequence: Synthetic polynucleotide

SEQ ID NO: 7608 - DNA, 84 bp, Artificial Sequence; identical to SEQ ID NO: 1680
  Description of Artificial Sequence: Synthetic oligonucleotide

SEQ ID NO: 7609 - DNA, 62 bp, Artificial Sequence; identical to SEQ ID NO: 1691
  Description of Artificial Sequence: Synthetic oligonucleotide

SEQ ID NO: 7610 - DNA, 50 bp, Artificial Sequence; identical to SEQ ID NO: 1702
  Description of Artificial Sequence: Synthetic oligonucleotide

SEQ ID NO: 7611 - DNA, 1017 bp, Artificial Sequence; identical to SEQ ID NO: 1713
  Description of Artificial Sequence: Synthetic polynucleotide

SEQ ID NO: 7612 - DNA, 166 bp, Artificial Sequence; identical to SEQ ID NO: 1714
  Description of Artificial Sequence: Synthetic polynucleotide

SEQ ID NO: 7613 - DNA, 125 bp, Artificial Sequence; identical to SEQ ID NO: 1725
  Description of Artificial Sequence: Synthetic polynucleotide

SEQ ID NO: 7614 - DNA, 508 bp, Artificial Sequence; identical to SEQ ID NO: 1736
  Description of Artificial Sequence: Synthetic polynucleotide

SEQ ID NO: 7615 - DNA, 396 bp, Artificial Sequence; identical to SEQ ID NO: 1747
  Description of Artificial Sequence: Synthetic polynucleotide

SEQ ID NO: 7616 - DNA, 173 bp, Artificial Sequence; identical to SEQ ID NO: 1758
  Description of Artificial Sequence: Synthetic polynucleotide

SEQ ID NO: 7617 - DNA, 97 bp, Artificial Sequence; identical to SEQ ID NO: 1769
  Description of Artificial Sequence: Synthetic oligonucleotide

SEQ ID NO: 7618 - DNA, 208 bp, Artificial Sequence; identical to SEQ ID NO: 1780
  Description of Artificial Sequence: Synthetic polynucleotide

SEQ ID NO: 7619 - DNA, 647 bp, Artificial Sequence; identical to SEQ ID NO: 1791
  Description of Artificial Sequence: Synthetic polynucleotide

SEQ ID NO: 7620 - DNA, 282 bp, Artificial Sequence; identical to SEQ ID NO: 1802
  Description of Artificial Sequence: Synthetic polynucleotide

SEQ ID NO: 7621 - DNA, 32 bp, Artificial Sequence; identical to SEQ ID NO: 1813
  Description of Artificial Sequence: Synthetic oligonucleotide

SEQ ID NO: 7622 - DNA, 56 bp, Artificial Sequence; identical to SEQ ID NO: 1824
  Description of Artificial Sequence: Synthetic oligonucleotide

SEQ ID NO: 7623 - DNA, 44 bp, Artificial Sequence; identical to SEQ ID NO: 1825
  Description of Artificial Sequence: Synthetic oligonucleotide

SEQ ID NO: 7624 - DNA, 211 bp, Artificial Sequence; identical to SEQ ID NO: 1836
  Description of Artificial Sequence: Synthetic polynucleotide

SEQ ID NO: 7625 - DNA, 141 bp, Artificial Sequence; identical to SEQ ID NO: 1847
  Description of Artificial Sequence: Synthetic polynucleotide

SEQ ID NO: 7626 - DNA, 25 bp, Artificial Sequence
  Description of Artificial Sequence: Synthetic oligonucleotide
ygttaattagattttagggtgtayg

SEQ ID NO: 7627 - DNA, 498 bp, Artificial Sequence; identical to SEQ ID NO: 1869
  Description of Artificial Sequence: Synthetic polynucleotide

SEQ ID NO: 7628 - DNA, 186 bp, Artificial Sequence; identical to SEQ ID NO: 1880
  Description of Artificial Sequence: Synthetic polynucleotide

SEQ ID NO: 7629 - DNA, 97 bp, Artificial Sequence; identical to SEQ ID NO: 1891
  Description of Artificial Sequence: Synthetic oligonucleotide

SEQ ID NO: 7630 - DNA, 82 bp, Artificial Sequence; identical to SEQ ID NO: 1935
  Description of Artificial Sequence: Synthetic oligonucleotide

SEQ ID NO: 7631 - DNA, 51 bp, Artificial Sequence; identical to SEQ ID NO: 2046
  Description of Artificial Sequence: Synthetic oligonucleotide

SEQ ID NO: 7632 - DNA, 431 bp, Artificial Sequence; identical to SEQ ID NO: 2086
  Description of Artificial Sequence: Synthetic polynucleotide

SEQ ID NO: 7633 - DNA, 258 bp, Artificial Sequence; identical to SEQ ID NO: 2097
  Description of Artificial Sequence: Synthetic polynucleotide

SEQ ID NO: 7634 - DNA, 84 bp, Artificial Sequence; identical to SEQ ID NO: 2108
  Description of Artificial Sequence: Synthetic oligonucleotide

SEQ ID NO: 7635 - DNA, 62 bp, Artificial Sequence; identical to SEQ ID NO: 2119
  Description of Artificial Sequence: Synthetic oligonucleotide

SEQ ID NO: 7636 - DNA, 50 bp, Artificial Sequence; identical to SEQ ID NO: 2130
  Description of Artificial Sequence: Synthetic oligonucleotide

SEQ ID NO: 7637 - DNA, 1017 bp, Artificial Sequence; identical to SEQ ID NO: 2141
  Description of Artificial Sequence: Synthetic polynucleotide

SEQ ID NO: 7638 - DNA, 166 bp, Artificial Sequence; identical to SEQ ID NO: 2142
  Description of Artificial Sequence: Synthetic polynucleotide

SEQ ID NO: 7639 - DNA, 125 bp, Artificial Sequence; identical to SEQ ID NO: 2153
  Description of Artificial Sequence: Synthetic polynucleotide

SEQ ID NO: 7640 - DNA, 508 bp, Artificial Sequence; identical to SEQ ID NO: 2164
  Description of Artificial Sequence: Synthetic polynucleotide

SEQ ID NO: 7641 - DNA, 396 bp, Artificial Sequence; identical to SEQ ID NO: 2175
  Description of Artificial Sequence: Synthetic polynucleotide

SEQ ID NO: 7642 - DNA, 173 bp, Artificial Sequence; identical to SEQ ID NO: 2186
  Description of Artificial Sequence: Synthetic polynucleotide

SEQ ID NO: 7643 - DNA, 97 bp, Artificial Sequence; identical to SEQ ID NO: 2197
  Description of Artificial Sequence: Synthetic oligonucleotide

SEQ ID NO: 7644 - DNA, 208 bp, Artificial Sequence; identical to SEQ ID NO: 2208
  Description of Artificial Sequence: Synthetic polynucleotide

SEQ ID NO: 7645 - DNA, 647 bp, Artificial Sequence; identical to SEQ ID NO: 2219
  Description of Artificial Sequence: Synthetic polynucleotide

SEQ ID NO: 7646 - DNA, 282 bp, Artificial Sequence; identical to SEQ ID NO: 2230
  Description of Artificial Sequence: Synthetic polynucleotide

SEQ ID NO: 7647 - DNA, 32 bp, Artificial Sequence; identical to SEQ ID NO: 2241
  Description of Artificial Sequence: Synthetic oligonucleotide

SEQ ID NO: 7648 - DNA, 56 bp, Artificial Sequence; identical to SEQ ID NO: 2252
  Description of Artificial Sequence: Synthetic oligonucleotide

SEQ ID NO: 7649 - DNA, 44 bp, Artificial Sequence; identical to SEQ ID NO: 2253
  Description of Artificial Sequence: Synthetic oligonucleotide

SEQ ID NO: 7650 - DNA, 211 bp, Artificial Sequence; identical to SEQ ID NO: 2264
  Description of Artificial Sequence: Synthetic polynucleotide

SEQ ID NO: 7651 - DNA, 141 bp, Artificial Sequence; identical to SEQ ID NO: 2275
  Description of Artificial Sequence: Synthetic polynucleotide

SEQ ID NO: 7652 - DNA, 25 bp, Artificial Sequence
  Description of Artificial Sequence: Synthetic oligonucleotide
cgttaattagattttagggtgtacg

SEQ ID NO: 7653 - DNA, 498 bp, Artificial Sequence; identical to SEQ ID NO: 2297
  Description of Artificial Sequence: Synthetic polynucleotide

SEQ ID NO: 7654 - DNA, 186 bp, Artificial Sequence; identical to SEQ ID NO: 2308
  Description of Artificial Sequence: Synthetic polynucleotide

SEQ ID NO: 7655 - DNA, 97 bp, Artificial Sequence; identical to SEQ ID NO: 2319
  Description of Artificial Sequence: Synthetic oligonucleotide

SEQ ID NO: 7656 - DNA, 82 bp, Artificial Sequence; identical to SEQ ID NO: 2363
  Description of Artificial Sequence: Synthetic oligonucleotide

SEQ ID NO: 7657 - DNA, 51 bp, Artificial Sequence; identical to SEQ ID NO: 2474
  Description of Artificial Sequence: Synthetic oligonucleotide

SEQ ID NO: 7658 - DNA, 431 bp, Artificial Sequence; identical to SEQ ID NO: 2514
  Description of Artificial Sequence: Synthetic polynucleotide

SEQ ID NO: 7659 - DNA, 258 bp, Artificial Sequence; identical to SEQ ID NO: 2525
  Description of Artificial Sequence: Synthetic polynucleotide

SEQ ID NO: 7660 - DNA, 84 bp, Artificial Sequence; identical to SEQ ID NO: 2536
  Description of Artificial Sequence: Synthetic oligonucleotide

SEQ ID NO: 7661 - DNA, 62 bp, Artificial Sequence; identical to SEQ ID NO: 2547
  Description of Artificial Sequence: Synthetic oligonucleotide

SEQ ID NO: 7662 - DNA, 50 bp, Artificial Sequence; identical to SEQ ID NO: 2558
  Description of Artificial Sequence: Synthetic oligonucleotide

SEQ ID NO: 7663 - DNA, 1216 bp, Homo sapiens; identical to SEQ ID NO: 2569

SEQ ID NO: 7664 - DNA, 365 bp, Homo sapiens; identical to SEQ ID NO: 2570

SEQ ID NO: 7665 - DNA, 324 bp, Homo sapiens; identical to SEQ ID NO: 2581

SEQ ID NO: 7666 - DNA, 707 bp, Homo sapiens; identical to SEQ ID NO: 2592

SEQ ID NO: 7667 - DNA, 595 bp, Homo sapiens; identical to SEQ ID NO: 2603

SEQ ID NO: 7668 - DNA, 372 bp, Homo sapiens; identical to SEQ ID NO: 2614

SEQ ID NO: 7669 - DNA, 296 bp, Homo sapiens; identical to SEQ ID NO: 2625

SEQ ID NO: 7670 - DNA, 407 bp, Homo sapiens; identical to SEQ ID NO: 2636

SEQ ID NO: 7671 - DNA, 846 bp, Homo sapiens; identical to SEQ ID NO: 2647

SEQ ID NO: 7672 - DNA, 481 bp, Homo sapiens; identical to SEQ ID NO: 2658

SEQ ID NO: 7673 - DNA, 231 bp, Homo sapiens; identical to SEQ ID NO: 2669

SEQ ID NO: 7674 - DNA, 255 bp, Homo sapiens; identical to SEQ ID NO: 2680

SEQ ID NO: 7675 - DNA, 243 bp, Homo sapiens; identical to SEQ ID NO: 2681

SEQ ID NO: 7676 - DNA, 410 bp, Homo sapiens; identical to SEQ ID NO: 2692

SEQ ID NO: 7677 - DNA, 340 bp, Homo sapiens; identical to SEQ ID NO: 2703

SEQ ID NO: 7678 - DNA, 224 bp, Homo sapiens; identical to SEQ ID NO: 2714

SEQ ID NO: 7679 - DNA, 697 bp, Homo sapiens; identical to SEQ ID NO: 2725

SEQ ID NO: 7680 - DNA, 385 bp, Homo sapiens; identical to SEQ ID NO: 2736

SEQ ID NO: 7681 - DNA, 296 bp, Homo sapiens; identical to SEQ ID NO: 2747

SEQ ID NO: 7682 - DNA, 281 bp, Homo sapiens; identical to SEQ ID NO: 2791

SEQ ID NO: 7683 - DNA, 250 bp, Homo sapiens; identical to SEQ ID NO: 2902

SEQ ID NO: 7684 - DNA, 630 bp, Homo sapiens; identical to SEQ ID NO: 2942

SEQ ID NO: 7685 - DNA, 457 bp, Homo sapiens; identical to SEQ ID NO: 2953

SEQ ID NO: 7686 - DNA, 283 bp, Homo sapiens; identical to SEQ ID NO: 2964

SEQ ID NO: 7687 - DNA, 261 bp, Homo sapiens; identical to SEQ ID NO: 2975

SEQ ID NO: 7688 - DNA, 249 bp, Homo sapiens; identical to SEQ ID NO: 2986

SEQ ID NO: 7689 - DNA, 1216 bp, Homo sapiens; identical to SEQ ID NO: 2997

SEQ ID NO: 7690 - DNA, 365 bp, Homo sapiens; identical to SEQ ID NO: 2998

SEQ ID NO: 7691 - DNA, 324 bp, Homo sapiens; identical to SEQ ID NO: 3009

SEQ ID NO: 7692 - DNA, 707 bp, Homo sapiens; identical to SEQ ID NO: 3020

SEQ ID NO: 7693 - DNA, 595 bp, Homo sapiens; identical to SEQ ID NO: 3031

SEQ ID NO: 7694 - DNA, 372 bp, Homo sapiens; identical to SEQ ID NO: 3042

SEQ ID NO: 7695 - DNA, 296 bp, Homo sapiens; identical to SEQ ID NO: 3053

SEQ ID NO: 7696 - DNA, 407 bp, Homo sapiens; identical to SEQ ID NO: 3064

SEQ ID NO: 7697 - DNA, 846 bp, Homo sapiens; identical to SEQ ID NO: 3075

SEQ ID NO: 7698 - DNA, 481 bp, Homo sapiens; identical to SEQ ID NO: 3086

SEQ ID NO: 7699 - DNA, 231 bp, Homo sapiens; identical to SEQ ID NO: 3097

SEQ ID NO: 7700 - DNA, 255 bp, Homo sapiens; identical to SEQ ID NO: 3108

SEQ ID NO: 7701 - DNA, 243 bp, Homo sapiens; identical to SEQ ID NO: 3109

SEQ ID NO: 7702 - DNA, 410 bp, Homo sapiens; identical to SEQ ID NO: 3120

SEQ ID NO: 7703 - DNA, 340 bp, Homo sapiens; identical to SEQ ID NO: 3131

SEQ ID NO: 7704 - DNA, 224 bp, Homo sapiens; identical to SEQ ID NO: 3142

SEQ ID NO: 7705 - DNA, 697 bp, Homo sapiens; identical to SEQ ID NO: 3153

SEQ ID NO: 7706 - DNA, 385 bp, Homo sapiens; identical to SEQ ID NO: 3164

SEQ ID NO: 7707 - DNA, 296 bp, Homo sapiens; identical to SEQ ID NO: 3175

SEQ ID NO: 7708 - DNA, 281 bp, Homo sapiens; identical to SEQ ID NO: 3219

SEQ ID NO: 7709 - DNA, 250 bp, Homo sapiens; identical to SEQ ID NO: 3330

SEQ ID NO: 7710 - DNA, 630 bp, Homo sapiens; identical to SEQ ID NO: 3370

SEQ ID NO: 7711 - DNA, 457 bp, Homo sapiens; identical to SEQ ID NO: 3381

SEQ ID NO: 7712 - DNA, 283 bp, Homo sapiens; identical to SEQ ID NO: 3392

SEQ ID NO: 7713 - DNA, 261 bp, Homo sapiens; identical to SEQ ID NO: 3403

SEQ ID NO: 7714 - DNA, 249 bp, Homo sapiens; identical to SEQ ID NO: 3414

SEQ ID NO: 7715 - DNA, 1216 bp, Artificial Sequence; identical to SEQ ID NO: 3425
  Description of Artificial Sequence: Synthetic polynucleotide

SEQ ID NO: 7716 - DNA, 365 bp, Artificial Sequence; identical to SEQ ID NO: 3426
  Description of Artificial Sequence: Synthetic polynucleotide

SEQ ID NO: 7717 - DNA, 324 bp, Artificial Sequence; identical to SEQ ID NO: 3437
  Description of Artificial Sequence: Synthetic polynucleotide

SEQ ID NO: 7718 - DNA, 707 bp, Artificial Sequence; identical to SEQ ID NO: 3448
  Description of Artificial Sequence: Synthetic polynucleotide

SEQ ID NO: 7719 - DNA, 595 bp, Artificial Sequence; identical to SEQ ID NO: 3459
  Description of Artificial Sequence: Synthetic polynucleotide

SEQ ID NO: 7720 - DNA, 372 bp, Artificial Sequence; identical to SEQ ID NO: 3470
  Description of Artificial Sequence: Synthetic polynucleotide

SEQ ID NO: 7721 - DNA, 296 bp, Artificial Sequence; identical to SEQ ID NO: 3481
  Description of Artificial Sequence: Synthetic polynucleotide

SEQ ID NO: 7722 - DNA, 407 bp, Artificial Sequence; identical to SEQ ID NO: 3492
  Description of Artificial Sequence: Synthetic polynucleotide

SEQ ID NO: 7723 - DNA, 846 bp, Artificial Sequence; identical to SEQ ID NO: 3503
  Description of Artificial Sequence: Synthetic polynucleotide

SEQ ID NO: 7724 - DNA, 481 bp, Artificial Sequence; identical to SEQ ID NO: 3514
  Description of Artificial Sequence: Synthetic polynucleotide

SEQ ID NO: 7725 - DNA, 231 bp, Artificial Sequence; identical to SEQ ID NO: 3525
  Description of Artificial Sequence: Synthetic polynucleotide

SEQ ID NO: 7726 - DNA, 255 bp, Artificial Sequence; identical to SEQ ID NO: 3536
  Description of Artificial Sequence: Synthetic polynucleotide

SEQ ID NO: 7727 - DNA, 243 bp, Artificial Sequence; identical to SEQ ID NO: 3537
  Description of Artificial Sequence: Synthetic polynucleotide

SEQ ID NO: 7728 - DNA, 410 bp, Artificial Sequence; identical to SEQ ID NO: 3548
  Description of Artificial Sequence: Synthetic polynucleotide

SEQ ID NO: 7729 - DNA, 340 bp, Artificial Sequence; identical to SEQ ID NO: 3559
  Description of Artificial Sequence: Synthetic polynucleotide

SEQ ID NO: 7730 - DNA, 224 bp, Artificial Sequence; identical to SEQ ID NO: 3570
  Description of Artificial Sequence: Synthetic polynucleotide

SEQ ID NO: 7731 - DNA, 697 bp, Artificial Sequence; identical to SEQ ID NO: 3581
  Description of Artificial Sequence: Synthetic polynucleotide

SEQ ID NO: 7732 - DNA, 385 bp, Artificial Sequence; identical to SEQ ID NO: 3592
  Description of Artificial Sequence: Synthetic polynucleotide

SEQ ID NO: 7733 - DNA, 296 bp, Artificial Sequence; identical to SEQ ID NO: 3603
  Description of Artificial Sequence: Synthetic polynucleotide

SEQ ID NO: 7734 - DNA, 281 bp, Artificial Sequence; identical to SEQ ID NO: 3647
  Description of Artificial Sequence: Synthetic polynucleotide

SEQ ID NO: 7735 - DNA, 250 bp, Artificial Sequence; identical to SEQ ID NO: 3758
  Description of Artificial Sequence: Synthetic polynucleotide

SEQ ID NO: 7736 - DNA, 630 bp, Artificial Sequence; identical to SEQ ID NO: 3798
  Description of Artificial Sequence: Synthetic polynucleotide

SEQ ID NO: 7737 - DNA, 457 bp, Artificial Sequence; identical to SEQ ID NO: 3809
  Description of Artificial Sequence: Synthetic polynucleotide

SEQ ID NO: 7738 - DNA, 283 bp, Artificial Sequence; identical to SEQ ID NO: 3820
  Description of Artificial Sequence: Synthetic polynucleotide

SEQ ID NO: 7739 - DNA, 261 bp, Artificial Sequence; identical to SEQ ID NO: 3831
  Description of Artificial Sequence: Synthetic polynucleotide

SEQ ID NO: 7740 - DNA, 249 bp, Artificial Sequence; identical to SEQ ID NO: 3842
  Description of Artificial Sequence: Synthetic polynucleotide

SEQ ID NO: 7741 - DNA, 1216 bp, Artificial Sequence; identical to SEQ ID NO: 3853
  Description of Artificial Sequence: Synthetic polynucleotide

SEQ ID NO: 7742 - DNA, 365 bp, Artificial Sequence; identical to SEQ ID NO: 3854
  Description of Artificial Sequence: Synthetic polynucleotide

SEQ ID NO: 7743 - DNA, 324 bp, Artificial Sequence; identical to SEQ ID NO: 3865
  Description of Artificial Sequence: Synthetic polynucleotide

SEQ ID NO: 7744 - DNA, 707 bp, Artificial Sequence; identical to SEQ ID NO: 3876
  Description of Artificial Sequence: Synthetic polynucleotide

SEQ ID NO: 7745 - DNA, 595 bp, Artificial Sequence; identical to SEQ ID NO: 3887
  Description of Artificial Sequence: Synthetic polynucleotide

SEQ ID NO: 7746 - DNA, 372 bp, Artificial Sequence; identical to SEQ ID NO: 3898
  Description of Artificial Sequence: Synthetic polynucleotide

SEQ ID NO: 7747 - DNA, 296 bp, Artificial Sequence; identical to SEQ ID NO: 3909
  Description of Artificial Sequence: Synthetic polynucleotide

SEQ ID NO: 7748 - DNA, 407 bp, Artificial Sequence; identical to SEQ ID NO: 3920
  Description of Artificial Sequence: Synthetic polynucleotide

SEQ ID NO: 7749 - DNA, 846 bp, Artificial Sequence; identical to SEQ ID NO: 3931
  Description of Artificial Sequence: Synthetic polynucleotide

SEQ ID NO: 7750 - DNA, 481 bp, Artificial Sequence; identical to SEQ ID NO: 3942
  Description of Artificial Sequence: Synthetic polynucleotide

SEQ ID NO: 7751 - DNA, 231 bp, Artificial Sequence; identical to SEQ ID NO: 3953
  Description of Artificial Sequence: Synthetic polynucleotide

SEQ ID NO: 7752 - DNA, 255 bp, Artificial Sequence; identical to SEQ ID NO: 3964
  Description of Artificial Sequence: Synthetic polynucleotide

SEQ ID NO: 7753 - DNA, 243 bp, Artificial Sequence; identical to SEQ ID NO: 3965
  Description of Artificial Sequence: Synthetic polynucleotide

SEQ ID NO: 7754 - DNA, 410 bp, Artificial Sequence; identical to SEQ ID NO: 3976
  Description of Artificial Sequence: Synthetic polynucleotide

SEQ ID NO: 7755 - DNA, 340 bp, Artificial Sequence; identical to SEQ ID NO: 3987
  Description of Artificial Sequence: Synthetic polynucleotide

SEQ ID NO: 7756 - DNA, 224 bp, Artificial Sequence; identical to SEQ ID NO: 3998
  Description of Artificial Sequence: Synthetic polynucleotide

SEQ ID NO: 7757 - DNA, 697 bp, Artificial Sequence; identical to SEQ ID NO: 4009
  Description of Artificial Sequence: Synthetic polynucleotide

SEQ ID NO: 7758 - DNA, 385 bp, Artificial Sequence; identical to SEQ ID NO: 4020
  Description of Artificial Sequence: Synthetic polynucleotide

SEQ ID NO: 7759 - DNA, 296 bp, Artificial Sequence; identical to SEQ ID NO: 4031
  Description of Artificial Sequence: Synthetic polynucleotide

SEQ ID NO: 7760 - DNA, 281 bp, Artificial Sequence; identical to SEQ ID NO: 4075
  Description of Artificial Sequence: Synthetic polynucleotide

SEQ ID NO: 7761 - DNA, 250 bp, Artificial Sequence; identical to SEQ ID NO: 4186
  Description of Artificial Sequence: Synthetic polynucleotide

SEQ ID NO: 7762 - DNA, 630 bp, Artificial Sequence; identical to SEQ ID NO: 4226
  Description of Artificial Sequence: Synthetic polynucleotide

SEQ ID NO: 7763 - DNA, 457 bp, Artificial Sequence; identical to SEQ ID NO: 4237
  Description of Artificial Sequence: Synthetic polynucleotide

SEQ ID NO: 7764 - DNA, 283 bp, Artificial Sequence; identical to SEQ ID NO: 4248
  Description of Artificial Sequence: Synthetic polynucleotide

SEQ ID NO: 7765 - DNA, 261 bp, Artificial Sequence; identical to SEQ ID NO: 4259
  Description of Artificial Sequence: Synthetic polynucleotide

SEQ ID NO: 7766 - DNA, 249 bp, Artificial Sequence; identical to SEQ ID NO: 4270
  Description of Artificial Sequence: Synthetic polynucleotide

SEQ ID NO: 7767 - DNA, 1216 bp, Artificial Sequence; identical to SEQ ID NO: 4281
  Description of Artificial Sequence: Synthetic polynucleotide

SEQ ID NO: 7768 - DNA, 365 bp, Artificial Sequence; identical to SEQ ID NO: 4282
  Description of Artificial Sequence: Synthetic polynucleotide

SEQ ID NO: 7769 - DNA, 324 bp, Artificial Sequence; identical to SEQ ID NO: 4293
  Description of Artificial Sequence: Synthetic polynucleotide

SEQ ID NO: 7770 - DNA, 707 bp, Artificial Sequence; identical to SEQ ID NO: 4304
  Description of Artificial Sequence: Synthetic polynucleotide

SEQ ID NO: 7771 - DNA, 595 bp, Artificial Sequence; identical to SEQ ID NO: 4315
  Description of Artificial Sequence: Synthetic polynucleotide

SEQ ID NO: 7772 - DNA, 372 bp, Artificial Sequence; identical to SEQ ID NO: 4326
  Description of Artificial Sequence: Synthetic polynucleotide

SEQ ID NO: 7773 - DNA, 296 bp, Artificial Sequence; identical to SEQ ID NO: 4337
  Description of Artificial Sequence: Synthetic polynucleotide

SEQ ID NO: 7774 - DNA, 407 bp, Artificial Sequence; identical to SEQ ID NO: 4348
  Description of Artificial Sequence: Synthetic polynucleotide

SEQ ID NO: 7775 - DNA, 846 bp, Artificial Sequence; identical to SEQ ID NO: 4359
  Description of Artificial Sequence: Synthetic polynucleotide

SEQ ID NO: 7776 - DNA, 481 bp, Artificial Sequence; identical to SEQ ID NO: 4370
  Description of Artificial Sequence: Synthetic polynucleotide

SEQ ID NO: 7777 - DNA, 231 bp, Artificial Sequence; identical to SEQ ID NO: 4381
  Description of Artificial Sequence: Synthetic polynucleotide

SEQ ID NO: 7778 - DNA, 255 bp, Artificial Sequence; identical to SEQ ID NO: 4392
  Description of Artificial Sequence: Synthetic polynucleotide

SEQ ID NO: 7779 - DNA, 243 bp, Artificial Sequence; identical to SEQ ID NO: 4393
  Description of Artificial Sequence: Synthetic polynucleotide

SEQ ID NO: 7780 - DNA, 410 bp, Artificial Sequence; identical to SEQ ID NO: 4404
  Description of Artificial Sequence: Synthetic polynucleotide

SEQ ID NO: 7781 - DNA, 340 bp, Artificial Sequence; identical to SEQ ID NO: 4415
  Description of Artificial Sequence: Synthetic polynucleotide

SEQ ID NO: 7782 - DNA, 224 bp, Artificial Sequence; identical to SEQ ID NO: 4426
  Description of Artificial Sequence: Synthetic polynucleotide

SEQ ID NO: 7783 - DNA, 697 bp, Artificial Sequence; identical to SEQ ID NO: 4437
  Description of Artificial Sequence: Synthetic polynucleotide

SEQ ID NO: 7784 - DNA, 385 bp, Artificial Sequence; identical to SEQ ID NO: 4448
  Description of Artificial Sequence: Synthetic polynucleotide

SEQ ID NO: 7785 - DNA, 296 bp, Artificial Sequence; identical to SEQ ID NO: 4459
  Description of Artificial Sequence: Synthetic polynucleotide

SEQ ID NO: 7786 - DNA, 281 bp, Artificial Sequence; identical to SEQ ID NO: 4503
  Description of Artificial Sequence: Synthetic polynucleotide

SEQ ID NO: 7787 - DNA, 250 bp, Artificial Sequence; identical to SEQ ID NO: 4614
  Description of Artificial Sequence: Synthetic polynucleotide

SEQ ID NO: 7788 - DNA, 630 bp, Artificial Sequence; identical to SEQ ID NO: 4654
  Description of Artificial Sequence: Synthetic polynucleotide

SEQ ID NO: 7789 - DNA, 457 bp, Artificial Sequence; identical to SEQ ID NO: 4665
  Description of Artificial Sequence: Synthetic polynucleotide

SEQ ID NO: 7790 - DNA, 283 bp, Artificial Sequence; identical to SEQ ID NO: 4676
  Description of Artificial Sequence: Synthetic polynucleotide

SEQ ID NO: 7791 - DNA, 261 bp, Artificial Sequence; identical to SEQ ID NO: 4687
  Description of Artificial Sequence: Synthetic polynucleotide

SEQ ID NO: 7792 - DNA, 249 bp, Artificial Sequence; identical to SEQ ID NO: 4698
  Description of Artificial Sequence: Synthetic polynucleotide

SEQ ID NO: 7793 - DNA, 1216 bp, Artificial Sequence; identical to SEQ ID NO: 4709
  Description of Artificial Sequence: Synthetic polynucleotide

SEQ ID NO: 7794 - DNA, 365 bp, Artificial Sequence; identical to SEQ ID NO: 4710
  Description of Artificial Sequence: Synthetic polynucleotide

SEQ ID NO: 7795 - DNA, 324 bp, Artificial Sequence; identical to SEQ ID NO: 4721
  Description of Artificial Sequence: Synthetic polynucleotide

SEQ ID NO: 7796 - DNA, 707 bp, Artificial Sequence; identical to SEQ ID NO: 4732
  Description of Artificial Sequence: Synthetic polynucleotide

SEQ ID NO: 7797 - DNA, 595 bp, Artificial Sequence; identical to SEQ ID NO: 4743
  Description of Artificial Sequence: Synthetic polynucleotide

SEQ ID NO: 7798 - DNA, 372 bp, Artificial Sequence; identical to SEQ ID NO: 4754
  Description of Artificial Sequence: Synthetic polynucleotide

SEQ ID NO: 7799 - DNA, 296 bp, Artificial Sequence; identical to SEQ ID NO: 4765
  Description of Artificial Sequence: Synthetic polynucleotide

SEQ ID NO: 7800 - DNA, 407 bp, Artificial Sequence; identical to SEQ ID NO: 4776
  Description of Artificial Sequence: Synthetic polynucleotide

SEQ ID NO: 7801 - DNA, 846 bp, Artificial Sequence; identical to SEQ ID NO: 4787
  Description of Artificial Sequence: Synthetic polynucleotide

SEQ ID NO: 7802 - DNA, 481 bp, Artificial Sequence; identical to SEQ ID NO: 4798
  Description of Artificial Sequence: Synthetic polynucleotide

SEQ ID NO: 7803 - DNA, 231 bp, Artificial Sequence; identical to SEQ ID NO: 4809
  Description of Artificial Sequence: Synthetic polynucleotide

SEQ ID NO: 7804 - DNA, 255 bp, Artificial Sequence; identical to SEQ ID NO: 4820
  Description of Artificial Sequence: Synthetic polynucleotide

SEQ ID NO: 7805 - DNA, 243 bp, Artificial Sequence; identical to SEQ ID NO: 4821
  Description of Artificial Sequence: Synthetic polynucleotide

SEQ ID NO: 7806 - DNA, 410 bp, Artificial Sequence; identical to SEQ ID NO: 4832
  Description of Artificial Sequence: Synthetic polynucleotide

SEQ ID NO: 7807 - DNA, 340 bp, Artificial Sequence; identical to SEQ ID NO: 4843
  Description of Artificial Sequence: Synthetic polynucleotide

SEQ ID NO: 7808 - DNA, 224 bp, Artificial Sequence; identical to SEQ ID NO: 4854
  Description of Artificial Sequence: Synthetic polynucleotide

SEQ ID NO: 7809 - DNA, 697 bp, Artificial Sequence; identical to SEQ ID NO: 4865
  Description of Artificial Sequence: Synthetic polynucleotide

SEQ ID NO: 7810 - DNA, 385 bp, Artificial Sequence; identical to SEQ ID NO: 4876
  Description of Artificial Sequence: Synthetic polynucleotide

SEQ ID NO: 7811 - DNA, 296 bp, Artificial Sequence; identical to SEQ ID NO: 4887
  Description of Artificial Sequence: Synthetic polynucleotide

SEQ ID NO: 7812 - DNA, 281 bp, Artificial Sequence; identical to SEQ ID NO: 4931
  Description of Artificial Sequence: Synthetic polynucleotide

SEQ ID NO: 7813 - DNA, 250 bp, Artificial Sequence; identical to SEQ ID NO: 5042
  Description of Artificial Sequence: Synthetic polynucleotide

SEQ ID NO: 7814 - DNA, 630 bp, Artificial Sequence; identical to SEQ ID NO: 5082
  Description of Artificial Sequence: Synthetic polynucleotide

SEQ ID NO: 7815 - DNA, 457 bp, Artificial Sequence; identical to SEQ ID NO: 5093
  Description of Artificial Sequence: Synthetic polynucleotide

SEQ ID NO: 7816 - DNA, 283 bp, Artificial Sequence; identical to SEQ ID NO: 5104
  Description of Artificial Sequence: Synthetic polynucleotide

SEQ ID NO: 7817 - DNA, 261 bp, Artificial Sequence; identical to SEQ ID NO: 5115
  Description of Artificial Sequence: Synthetic polynucleotide

SEQ ID NO: 7818 - DNA, 249 bp, Artificial Sequence; identical to SEQ ID NO: 5126
  Description of Artificial Sequence: Synthetic polynucleotide

SEQ ID NO: 7819 - DNA, 2566 bp, Homo sapiens
cgctgggcgatgagggaccgttgggtaattgggggcataggaccgggcttcgctgggttcggggcagaagcgccgaagctccgacccggaacgcggtgacttcatcaacgcagaagcccgcgcagccgagcagaggagtccctcgtaggcgaccctcggacagacgctcctgcgcggcccgcgtggctcagctccgccccaggaaacttttcgcgcagcccccgctccatgcgcccccacccagtccttcttcggggccgccccctccccaaagtagctctccgggtccactgggcgcccccgtaaccgggtcggaacctcgaacggcttcgcgtgccatccggttaccctggcaacaccatccggcggcgcccggcggtccaatcctagcctgcggcctctctcgagcctttcgcaaggtggggaccgggacgcgaccggggatggggaagggggctgcaggaggccccgcctgcgctgtcgcccctgctgggcacagcgccccccaccacccgcggcgaccccggcccccgcaaggtggggcggcgagcaggagccggggccaggccaggggctcgagctcccgttcgaggggcggggaaggcgggtgacgtgagccgggccgggcgggcggagttgggaccggctccgggaggcgggggcgagcgcgcggagaggcagacgcgaggagggaggcggctgagcagcgcgggcggctctgcggcgggcgcggtgggcgcgggcggcggggccccgggatccccgcgcgcctcctccgcgcggcgccgccgccgcgcgtccccacgccccgcgctccacggcgccctcgccccgcgcgcctctcgtgcccgcctcctgccagtctccgggccgcggccgtctgcagagcgagcgctcagacggagcccccgggcaacttgagtggcgccgatcggcggcggagcctctggcagagccccccgacccggcagcgcggaggggactcgcgtccgtccgcgtcgcgtcaccccaaaccctaagcagcgccgccccatcggcgcggagctccggctggaggcaagagccgcgcgccgggagacacgcaccgtgagcggcagcgccgccggcctccctcctcgccgccccggagggcgaagccgcggctccccagccctttgctgcgccgcgacagcgccggaacacgccccgcctcgctgccgccttcgctgtgccgccggcggagggggccgcgagccccgcgccccggccggaggatgtgcgcccccgcgggccgcccagcctgagccatgcgccccaacggcggcggcgcgccggccggcatggagccccgcgcggccgcgctctgactcgctgtgcgccccgcggccggcgggcggcgggaggcggcggaccgagagccggagaccggcgccgcgggacggaagcgagcgggcgcgggcgccgcgcagatggcctgggcgagccaggtctgaggccccgctccccgaaacgtgaccatgtggattcaacagcttttaggactcaggtgagcgacccggccggcgccgggtgcgtgtgggcgcgtgggtgccaggctgggcggaagcggcgctttcctctatgttgcaaatcaagggacccctcttcgcttcccgcaagcgggcaacggggtgcaccggtagccggaaaggggcgcccgcccggagcctggagcagcaccgcggccctggcggggagcggccgggtctccagggttccgcgcgtccggggtcggggcagcggcgcccgccccagcaacccgggaagtggggccggccaggcgcgcccgcagctctaggagccagcagcgcagtgtcctggccggctgccccggcgcgcctcctccccggggcccggggcgaggcgccggccgctgggcgcggcgggcgcgggggccggggctgccggggaaagctaaagctccgggctcccagcgagagcttcgcaggcggagttggaggaaaccacagccaaacagccactccgctcccccttctcctttctcggggccccggggctgagcaggggcctcccaggctcccagctgccgacccagctgtttgcgggtgacctccgggcccgacgggcgctcacagctggcgggcagctggggcgggagagctggggttcttggggagctccggcggccaccccgctgtaaacacacacgcacatacgcccgccggcgcgcccggggcttgtctgtgtctgggactccagggccagatggaagagggggttcgagcctagagcccgtggtgggggtgtccagaaagacccttctcggcaaactttgccagcccgccggggttctcgggcttctctggcttctgcctggggtggcccagggcccaccagagcacagctgtcgtttttgctgggcaggctgcctctgagccctcgccctcctgccggggcattcaccgagctcgtgcatttgggtcccgggttggaaccgcgagcggggaggacagaggtggaggcggagagcagcgtgcggttctcgagtttgtccactgggatgcactgcgctcccgcgttggggacg

SEQ ID NO: 7820 - DNA, 572 bp, Homo sapiens
cgcccaagaagtcggggtcctccctggccacgcgcctccgggggcgctcgcgctctccaggccctggctgcctgggcgccgattcccgggacgcgccggccgacagcaggggaggcggcagcagggaccgcagcagcccccgcttccgcacggcccgccgggtcgcggtgagcaaggcgggcaggcgcggcgggaggcgtccgacgcccaccccgggcttggcgtccccttccggccaccacgcggcgccgccccccgggatcctccagtccccggagccccgcgcgcccagagccgctcggagcgcgggcggggtcagcttgggcagccgcgggtcgctgctgcgtcggaagtctccgtcgccagggagccccttgggcgccaggtcctgggcccctgggcgaagtcgacgccagaacatgcttggccccgcactcagctcaccgcaccctcagcgcgcgtgggtggggggcgccggctgaggtggggagggcatagtccagccccaggccatagtgccccgggcggggcagcgcggtgcggggtgaacgccaccggcccggcggacagcg

SEQ ID NO: 7821 - DNA, 989 bp, Homo sapiens
cgtggtgtgtgtgtgcgcgcgcgagtgtgtgagcgccaggggccgcccgcccgccgcggctccccgtgggctggccgggccaatgagcgcgcggctgtaggggcggcgggcggggagggggcgccgagccctgcggatggaggcgcgggcagcgcggcgcgctcattccgcgcgggcgttgctggcggggggcggcgcagccactggacccggaccggggccgcgacccggggtggcgggtggcgtgggcggcgcccggggctgggatgcgccgggggctcagtggcggcggcggcgttggcggtggcgtcggcggctgcagggggacgagctagcgccgcggcgctgggagccagttgagcccggccggcgagcggaggcggcagcgcaggcagagcggcggcggcagcgggagcccgagcgctgcgcgcccaccatggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtaggcatccctcgtgttctcggactctccgactgagcctctaactccttttcggacatccccaccgcgcgctccggcgcccgctactccagcctacggccggccggtttagctccaggcccgctcccccgcggagccggaggacacccagggactggagacttcgcgggactccccacccttccacgcctctcagatttccaggcgctgggggccctgtgcgaacttgactggcttcagaaaagccgaaggccgagtttgtactggcgcgcccaagttgcgttctggactttggagatgccaactttagcccggacacctgggctgtgccatccggaccactcgggccgcacagagtatgcg

SEQ ID NO: 7822 - DNA, 2400 bp, Homo sapiens
cgaaggtgtcgccagcctcagtgccggtgggcgtctgcaccaggaatagctaaagccgacgacatctagccacctcgagcgccagggaagacgctccgcgtaaaaccgcggcctcaggcggactcccgctccagctccgcgctgctggtggcatttccggggacccaaagtgggtggcctgggggcaaaggaacagaggccgaagaacttggggtatgttccactagagcacctaagggacggagtgggaggttacatcagatatgcgacctcgacacattccaaaagtggcagccccgtgggctacccccaatagtgggatggatctccccaacttctctcgcccctcgaagtccccctgttatctcgggccatgctcctcccccgggattcccttgtgcaaaattattctctcccttgcccaaaggatttttcccttctttctgaccccacgaactcatctccccaacaggttcctaaagtatgggcggatgtgctccctctcgcccaccgccaggagccgagccccggcaggtgagcggtgcaaaacacgcacccagctgcccccagcttcctccgtccccgctgagttggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccgcccgggggggagggggatggagtgcgcgggcagctccccctccccggcccgcgccccgctcgccccgggctgcgctggccccgagcgccgagagccagggggcgccgcgggccgcccgcgcccggggtctgcgccgcccccgggcccgccccggctccgcgcgcggtcccgggtgtcctcggcgccgcgccgcccgccgtgcgccacgggtgtgcgctgcgctcggccggtgacccccttccccgagcgcctcccgcgcggctaacgagccgctctccgcttattaggtggtaactcgttaataatggataatcggccccctccgcccgggcgcccctgcgccagccctcctcccccggctgcgctcggctccggctcgccgcgccagtgcgcgcccggccgcggcaggttcaccgcgtccggccgccggcccgtggccgcctgctagcccatgttctcgggaccccctagtcctgtcgccacgccgctgagcccctcggcctccgctcgctcttcctccttgccgcctccgactcctcctcgtccccgtcctcgccgcccaagcctcttcggcgcgcgccccgcgctccccgcagccgccagcagcagcagctgcagcaactggagcgggcgcggactcaggacgacccaggcgggaggggaggaggctcgccgcgctggctcgcctgggctccgggctgggcaggggtgggcagggcccctcggcagcggcccggcaagcgcccctgacccccagggcgcaaggtagagcgcccccagcccaggcgcggggccaggcgcctctctccaaggtgctgcgcccccagccgagagcggtggggtacactgggaggacggcggggcgccccggtcaggccg

SEQ ID NO: 7823 - DNA, 1859 bp, Homo sapiens
cgcgatgtcagccacggcccgcggcggtcacggagccacttcagcacctcgcgatggacagtgacccccggcgtggcgcgagttccctgcggtccccacgcgggcctgggcggcgggtccctccacggctccgtccagacacccggaggcacctgccaaagctgcggaggtggacgaccgggcgtccaagcacgaactttctcgccgaggcacggctgccgggctccgtcctgagggtttggggcggcgaggaccgccggggaggagggcgcgcgagccggaggccagagccgggccgggcagggcgcgcccaggagcaggggagacggcgacccgggccgaggcgggacggggacacgttacctgcccgtggagcgcggggaaggggtgcgcggcggcggcggcggcggagtctggcgcagagggcagcggcagcagcgggagcaccggctcgctcggggccggccagccggggagaccggggagcagcggggccgcgggcggcggggccgaggcgagcagcaccgggggaaccacgacccccgcgctgagccggagcagcccggccgagcccggcaccatccagacccagggcggcggcggcggcggctctgcgtccatcggccagaggagaggctgccgccgccggggctgctgctgctgcagctgccgccgccgccgctggaacctggcgcccgcctgcatcctacatccccgcgctgacggcggcggcgggggcggcgggcgcccgagatgctgggccggcggcggcgcggctccggagcgaactcacttggctccgcggcgcggccgctcgctccgcccctgccccgcgcgggaagctcctcctcctcccgcccgcgccgccgccgcccccggacccggcccccgccccggtccccgcccgcccgcgcccctccccgccggaccccgccccgccctcgcgctccccggccctggccggggtctcctccccgctgcgcccctggacccgggcggccgcggaggacgtgggtgggagagggccgagggcgcgcccggctgggctcccgccgatgccggccccctggtggcctctggccctctgggacccagcgcaccgcgagggaggctccgggctccgcactcaagggcaagcggaagccgaggtggcggcgccggagccaggcatgtcccgctgcccagcgcggggctgagggcgcagacggggaccgcgcgagccgctctctacctggcctcctcggagtccagggcgcggagggtactgggctgcggatccggcgcaggcggccccggacgctgctaggcgcgggcggatttctgttgcacaaatgggccaaacaggttcgtaaggcccccgcgggtcccctggcccggaagttgagccgcgggtgcctggtctgaagttccgcgccccacagtggcccgcgggcctcggcggctcctgccctacgccctccaaggcaccaggcaggtggccccagggcctttgcccacgacaccccctgggtggggcaggaccacccctctgtgaattcgtcctggatgcccccaggcacagtctgtactcctccctcccccagcacacgcggcctctgacgctgcacgccgagcttcctgggacccaggacgaaccgggctccaaggaccctcgctccgcccggaccacacgcaggcagcgccggccgagccgagcctgggtccgcactggccacgcgcagccaccgccagacggcgctagccctcccccgctgtagaccctgcttcggaggccgccagcctcctccccatcccgggtccacagcttcagtgcagcccctggcgacgcgcgctgacagctgggcagagacttccgtgcg

SEQ ID NO: 7824 - DNA, 902 bp, Homo sapiens
cgatcccagaactcgttccccaccccgagcccgtttcccgccgcctcctcgcccctgggagggcggccccattaaccctcgcgacccgggccgctcctggcggtcctgaccccgccaccccgtcccgcggcgggggtttgggggtgaggggcgcgccctggggcagaggattgcgcggcagggtctgccacagggcagaggccagggctctccgggaaaaaggcaggcgcatatatgcccccctttctgggaaaagacggggaggggggcttctcctgggagactccaggcttcgaaattcctcgttccctatcctccggcccccgcacccctcctcctccccgccacgcaccctctcccctccccagccatctgttccactccgcagcgccgcgacaaacacggctccagctcgcttccgcccctgcccagccccctccccaagccccggggagtgggggagtgagcagacgcccttctcctaggaggccggaatttctgcctccatctcccaccggggtccggctggccagaggcaagcttcgagaccccccaccaaccaccaccaccgttgcgagggccggtgaggctgcagataacgcttgcaaggacgggagtcggggagggtgtagggcgagtttaaaggacgggcagagcaagccccgggaagaggcaggggttttccctcccgggtcgccgccccccgcaccctcggagccagccgcagccacgcagcgccgcctgccgggcacaccaaggacctggcgcgcacgtggcgcttacccccacccccgggtccgctcctggctcgcgctcagcctccccagactattcgcaaattgaggatcccggacacagagtgcagagaccccggcaagcctactgaaagccagccgaacccg

SEQ ID NO: 7825 - DNA, 2044 bp, Homo sapiens
cgaaacggcagaggccggcagcccgcggcccacgtgcacttgctcagggaaccgttccagcgaaacctgacccggatcggaatcctcccgcagcacagcggccgtgtttatcggaatggaacgctacaagttgtcacctgcatccctctcccagctttgacagggaacacgcgctgcccccacgcccacaccgacacccggatccctatccagcccggccagagtcccaggggccagggaccagtgcagggagaaggtcccccacctcagccctcaggacccccaaccacagcccacccgcccccaccctgctcggttctaggcccagccgaacctacatgtccccgtagtgtcgagcgttatcatccacagtcgcccctcaaactgtgacccccacctgggagacccggaatcatccaggaccctggtgtggggggcagtactccccatatctgccccccgaaaactgctatggagcagccgcgcctcggcgggcaggtgagggggccgagcccaccagcgccgcagccccgctgcctaccttcttcagcgccggctgccgctcccgggcagacatcgccggccctgactttggggctgacaccgccaaagggcagtcagtgctcgcccaggccacttcgggaggcccaggggcacggcgaggggtcggggaaaggcgatcgcccactacagcccgcgcgcctagactgagggaggagccgggctgcagaaccggcggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggccgcgagcctcgagcgtcaaattcccgcggcgtccgcctagcgcgctgctgtggcgggcgcggagggcgcgcgccggcagtgggggctgcggcggcggagggcacgggcccccgctcagcgtcctcaccttcttggtgcagctgcctcccgcgagccgagacactcctgtcagggaagaggagcgccccggctgtccccctagagtctcctgctggggggacatcgcttccatgaagaaaatcttcaaacaaatcccagcccaggaggaggctacacgatcatgtccgcgggctgccggccggaggggcgaggacgcgcgggcggaggcgcggctgccgtgctcaggcagggagccgagctccgggtgctcgccgcgcgcctcccgtcggggccatgtacctccgcctgcgctcgacaccgcgggctggaggcgagtgcagcggcgacagcccgtcagcgccgcggcccgccccgcctcgggcccgccccctccgctccgggcgccctgcgccggggcccgcccccgcagccctcctcagccctcctccagcctgggccctcctagcctcgtcccagcctgcggcgcgcctggcgggcgtctctctatatatgttagcacaccggccaccggctgaccttttcggtctgtgactccgcgtgggtgcagcccgcaggagctcatcggcctgtgtcacgcacgggggcctctagtgcacggacacgcgcctctcccgccacctgcccactcccaccagaccccatcccttcccgcgccgtgcccgcggcggaaggcgcccctgcagcgcgtgcatccgcggagcggtggcgacctcagcctgagcagaggagttgcagtgattcctgcctcgctttcagcggactgcggagggaatcccccaccccaccccactggggatagggtggcacgtcgcagagtgtcgcagctgtacaaatttggaagcccacagcatcgcctgacctcttgtgcaatcccgaacgctagcctgttcgggtaaccctgagtgggcttctgcagccggtcatgtcagcggcccctgcacatttgcacccgcggtttccgctgtctgcaggctgcagagacgggggcattccaaacgtgaaagagcaatgaaggaaaatgcagacagagcgaggacgccg

SEQ ID NO: 7826 - DNA, 1152 bp, Homo sapiens
cgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctcggcagtcctcaacttgtgtgcgccg

SEQ ID NO: 7827 - DNA, 872 bp, Homo sapiens
cggagagctgccaccgaccccctcaacgtcccaagccccagctctgtcgcccgcgttccttcctcttcctgggccacaatcttggctttcccgggccggcttcacgcagttgcgcaggagcccgcgggggaagacctctcgtggggacctcgagcacgacgtgcgaccctaaatccccacatctcctctgccgcctcgcaggccacatgcaccgggagccgggcggggcaggcgcggcccgcaaggacccccgcgatggagacgcaacactgccgcgactgcacttggggcagccccgccgcgtcccagccgcctcccggcaggaagcgtaggtgtgtgagccgacccggagcgagccgcgccctcgggccagcgtgggcagggcgccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccgtcgcccgttgggccctcaggggcctgaacgcccaggggtcgcggcgagtccacccggagcgagtcaggtgagcaggtcgccatggcgatgcggccccggagagcgcacgcctgccgcggtcggcatggaaacgctcccgctaggtccgggggcgccgctgattggccgattcaacagacgcgggtgggcagctcagccgcatcgctaagcccggccg

SEQ ID NO: 7828 - DNA, 1070 bp, Homo sapiens
cgagcggtggctcgaccccgggtgtggcaggaaggggtgccccgcgttccagagccagtgccagtccctatcctcccgggaagccgagactcagggggaacaggtttcccagagcccagcctgcagggacgcggagggcaggagccgccggcgaggagcagccaacttgccatctctggcggctgcacttctcggcggctacaggttgcccgacagcggactccagggtccccgcgacggcacccagagtgctcagaagggaggccggggccggggtgggccgggaaaaccgagggagggaaggagcctggagaagctccgtttaggcggggagggggcgacccggggcgcatctcccgaccatgacccccacagaccttggcgccgcaacctgcgcttcttgaggccgaagatgcgcactttggagaagatatccaccaggttgccgttgcagagcccgcggttcttgctggggctgctccgcctcctgctggcagacggccggtcccagtgctgctcccgcgcctgccgcttctggcggatcaagccgctagcgatggccgcggccatggtggccccgggaacgggtccggggagggagggcgcgggaggacggcgagccgggggcaccggaggggaaggcggcggcgcagaccgtggctcgccctcggggcagaggagggggtgccaggcgggactggggagaggggaaggggggctcagtcctgaccgggacccatcgccctctccgcggggcgcggggccaggcgcgcagatgcgcccagggcgcagccggacgatcccgggaagccggacgtcgtggccgccgccgcttggccacgtccgagtggagagcgggaccgcggctgcgggcgctgctggtcaccgctcgtcgcaggaaccccggcgggggtcgccaccgccactcgcgctgccttctcgccctgcccggctcccgggcgggaggtagagccggccggcggctccccgggcgccggctggagggcgggtcccggcagggtctctgcgcgtccgtcggtccgggtcgcgctgggcaggactcagcgccg

SEQ ID NO: 7829 - DNA, 395 bp, Homo sapiens
cgctgggaagggaaaaacggcccacatcgaactggatgccggatggaaacctctctgcgctattagactgcgtccagtacagcagatggcacgagcacgtgcggcgctcagcttaggctctcggaggcagctgagttggaaatcccgacggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggtcgggggttcgagcggccaagggatgggggtgggggcggggagagtggggggagggcgaaagaccgccg

SEQ ID NO: 7830 - DNA, 265 bp, Homo sapiens
cggggacacctaggcgcggggcaggtgcaggggagggggcgcggggcaggggcgcaggggccgccgggttcgggctggaggtgtccgggccgcgggagggagggagggaaggagggagggaggacggcgagggagggaggcaggggcgggcggcgggggatggggccagcggggaggtggaagcgatacccaccgcccgtattggtcctcttggtgctgccggcttcagggggggcttccagcggccttttccgcgagtccggcg

SEQ ID NO: 7831 - DNA, 1169 bp, Homo sapiens
cgggctggcgggcactgagctggggccatcacgcctttctagagcgcctgcggaggtggcgaaggcttggagagcatacgaggcggaatccggatcgagtgagttccttgagccgcttgcgtgggacgcagggagagggcgaataacgccctcaggcgctgaatgcaggggcaaggagccagcgagggtggctggagcaggccttgccagctgttaccaagtctctccacaggcttgggggcttggggcctcctggaaagatccctccgccgcgctgaccagtacggggctcgctcccgcactttgaaggctgccgcggtctttcgtcatttataatcaagcccaagatcaaggttgcaagctgaggtcggggtactgacaacgggaatgaagccataggggaagaggataactgggacgggctggacccatacttgatacccgggaaactcctagagcgtgtggtgctcctgccagcggcagttactggtggagctgaggccaccgctactgtcgtcgttggcgctttgcttctggaacctcccagcaagatggcactcactgtctgttcccttccgattagcacccccagccgcgctccctcctccccgggatacgtattagtcacatactgtggggagaagatgggctatgtaaatgtaagtcaacgcgctttcccagccacctttgcataatgcaacaggaacagcgacccgcgcgcacgaaccgggtagtgtgcgcgtgtgtgtgctcgcgtgtgtgagcgcgtgtgccagcgtgcgtctccgcgcgggcgtgcgtctgggtggatccttgcgtggcttgggaggcaaatcgggcgtttctccaagtcgtcttaacatgatttaggctctcaaatacgtgaaagcggtagacacaacagggatgcgaaggaaataaaaaacaattggggaagtggtgccaagtcactcaggctttgaactgaggacgagtagtgcggtcgcgcctggggcgcgtccggaaatcatcctcagcctgtggcggccactgccccacttaaactcttctgcggggagagttgagcggatccctggggggttggtcctgggctagttttaaactctccggttgcatctcgcgtggccccaccgacggcgcgtctcggcgtagctcttggcgcgggctcg

SEQ ID NO: 7832 - DNA, 1743 bp, Homo sapiens
cggtgggtcgggggcgtggcgagaccctgtttcagtggagggagggcttatgcattgccgagacgccgattatcagaccttgaccctgtcgctttcagaaaaaccactggcagaagatccggaccatggtcaatctgccggtcataagccctttcaagaagcgctacgcctgggtgcagctggcagggcacactggtgagcagtggggcgggtgggcgggtgcccgcgacgggaaggggctgggcggcgctgacggatgccggtcctcagggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggtatgcgtgccctgccaggtcggttggggggatcaagtaggggtccggggccgggacagctgcttgagggggacccggggcgagtgctcgaaggggtctccgtgtgcgccccctcatgccctggccgctgcctgcgcccccacaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaaggtgaggcaggcgcgcttcgctggcaccgccgcagccccactgcgcgctgtctttcccgatcccccgctcccgccccgcctgcccctccgccctctcccaccgcctcgccgtcccctgcaactgggaggtaccgctgctctacgctgtcctcttccccactggcgggcccggggcccctgacactcctgtcccacatccagaaagcggacggctcctgcagcaccgacttcaagactacgcgaagccgagagcaggtgcttcgcgtctttgaagagtttgtgcaaggagatgaggaagtgctggtgagagcgggatcccaaaccctgaggtgttggggagcctgaagccgaggactgcccctgtcatctggcccagtgccctcggctgtgtccccaccatggccctcaccgcgctggctcgcaactgctctacgctccttcccttctgggccacgctgggcggggccctgggtcctcctcctggcggcatttgccaagcacagcgtgggtcccggctcctcatcgttagcaggggctcatttggcgtttagttaatttgccctcctctcccaccccaccctctgcagaggcggtatctgaaccgcctgcagcagatccgggacaccctggaggtatccgagttcttcaggaggcacgaggtaagcggcggctgcccgggtgcccgggccgcgagggctagggcgggaacccggcaagggcgtctctgggcagggccgcggcctgacggtgcggggctcgcaggtgatcggcagctcgctcctctttgtgcacgatcactgccatcgcgccggcgtgtggctcatcgacttcggcaagaccacgcccctccccgatggccagatcctggaccaccggcggccctgggaggagggcaaccgcgaggacg

SEQ ID NO: 7833 - DNA, 2405 bp, Homo sapiens
cgcagcgctatagccgcgactgcggcggcggcggcggcgcagggggcgggggaggagagaagcgcccacttcgtcccgctgcctccgcagcagccctggccctagccccggcgcatcagagcggtccttgggaatctttgggcttgttgctccggcggccgccagctgggagcccaccaccgctcgatggtaccgaaccgacccgtgtagccccataaccccagcccaactccgaggagctagcgcagaccgctctccgccctcagctgcggcgaggcaagggctggcagcgctcggacgcctccgtcttgcccttcccatgcctaagcgcggggaattacacgttcccggtgtagaacagacgatcggggctattagggctgggcggtgggagtgggggttgggagcaccatttttggctggacgtgtgtccagactcatcgtctctggtccttaggaccccatcttcctctgcatctccaggtgtcggcccctctgtacccgcctcccacggggctcgtccggcgaagggcagccgcagcccacatctactccccgccctcaatccctgccccctctgcccgccgcagtcactcgcctggctgggagcaagcctcccctctcgctgagggtgcagagagcgcctagggcgccaagagtagaggggccaaagttcaagcgccatcagccagccgaaggccctgagcccccagggccgcggccgggacgcagggaggtcaggacgcgacgctcgcctcacctgtttctccagcggctccttggccgacagcgccggcttgggggagggcgcgcggtcgcagacgcagccctccagcaggtaaagccccgagggccgcgagctcgagtcgctctcgaagtagaagagcaggttctgcagcagcgcgaaccacttggtttgccattttgtgttgtccgaactccgcttgctcaggtagcctttgcgcgtgccgtccttgcgcgccagcagtcccagggacgcgacgtggccatcattcagccggatccccttctgcatggtgctcagaggccagcgagaccccacgcgcttacatcttctccgcgcagcagccccccgtccgtgcgcgctgcgcgctgcctctctctggcgctcgctcgctcgctccctctagctctcccctccccccaaatatctacactccaggatctggcgccgagccgcggcttcttgaatccagatataccattccccgctggaacctcttctccgctccgcagagccccagtacccggaagatgccgcccgaccctcctccggtgccgggcaaactgagggactggcgatctgcgcgctggcgaggggcaggcggagtcatgtgacgccgatccctcgaagagcccgtttcagcagcgcggacagggacacacgcacgcagccccgccgaggcgcagagccgcgcgcaggctgcaacttggtgcctcctccccctccccagacacacacacacgcacacgcacacgcacacactcaaaccctgccctccctcccctcatctccccttctctccctcggatgttaaaaagcaaatcagatcaattttcgtttaacccaatgaaaccccgaaggctcgccatcccgggagtttgcgtctttgcgccccaccgcggcgcactgtagacctggggttaagtgccagttgtcattttctcctccaaaggctcgccccccccccccactttatttctaatacgaggtggaaggaggaaggtgggtggcgaaatagagctgcaaaagcgtccagtcctagtctttgcatagtcagccgggtcacattgaattccagcatccggctgcactcccggcggcttccccagctacctgaggacagtacagggggtgagatggggtggtggttggtgaacgttggttactttattttatattattttattttgagagttgccataattaccggcgccaccccccgtgcaccctgaggtctggttggcgagccgctgctgggagttttctgcaaataccccccaaagcctgaaggcgggcttcaaacgcaggcgccggggaccatgggagccttcaaatagctgcgctggcgcaatgataccttaatgatagattttccgttcttatttttagctctcattcgcctacacagttacacggcatttatccgagaacgtcacagcgcccgcatgctgcaccgggagggcgcgcgggccgccgggcgagccgggagctggggcggggagcgcgcatcgctgtctgccgcagagggcagcgagctcgccccgacccggagcaagccgcgcctggcccgggcgctttgcagcggggatgggtgcccgcgcagccctgtgaaggaaagacaccatctttccgcacggaaactgcgtatacccctcccccg

SEQ ID NO: 7834 - DNA, 1920 bp, Homo sapiens
cgcggacctgggcctggcgcccaccccatcgccaggactggacagaaaggccctggccgaggccaccaacggagaggccagagcggagcctctggcccagaatggaggcagcagcgagcccccggcggcccccaggagcatcaaggtggaggcggtggaggagccggaggcggcccccatcctgggccccggagagcctgggccccaggccccgtcgcggacgccgtcgccgcgcagccccgccccggccagggtcaaggccgagctgtccagccccacgccgggctccagcccggtgcccggcgagctgggcctggccggggccctgttccttccgcagtacgtgttcgggcccgacgcggcgccccccgcctcggagatcctggccaagatgtccgagctggtgcacagccggctgcagcagggcgcgggcgcgggcgccggcggcgcgcagaccgggctcttccccggggcccccaagggcgctacgtgcttcgagtgcgagatcaccttcagcaacgtcaacaactactacgtgcacaagcgcctctactgttcaggccgccgtgcgcccgaggacgcgcctgccgcgcgcaggcccaaggcgccccccggcccggcccgcgcgccccccggccagcccgccgaacccgacgcgccgcgctcgtccccgggccccggagcgcgcgaggagggggctgggggcgcggccacgcccgaggacggcgcgggcggccggggcagcgagggcagccagagcccgggtagctccgtggacgacgcggaggacgaccccagccgcacgctgtgcgaggcctgcaacatccgcttcagccgccacgagacctacaccgtgcacaagcggtactactgcgcctcgcgccacgacccgccgccgcgccgaccggccgcgcccccgggaccccctgggccggccgcgcccccggccccctctcccgccgcgcctgtgcgcacgcgcagacgccgcaagctctacgagctgcacgcggccggcgccccgccccccccgccgcccggccacgcccccgcgcccgagtcgccgcggcccggaagcggaagcggaagcggccccggcctcgcccctgcgcgctcgcccggccccgcggccgacggccccatcgacctgagcaagaagccgcggcgcccgctccccggagccccggcaccggcgctggccgactaccacgagtgcacggcctgccgcgtgagcttccacagcctcgaggcctacctggcgcacaagaagtactcgtgccccgctgcgccaccgcccggcgcgctcggcctgcccgccgccgcctgcccctactgccccccgaacggcccggtgcgcggggacctgctggagcatttccgcctggcgcacggcctgctgctcggcgcgcccctggccggcccgggggtcgaggcccggacgccggccgaccgcggcccctcgcccgctcccgcccccgccgcctccccgcagcccgggtcccgtggcccccgggacggcctcggcccggagccccaggagccgccgcccggcccgcccccgtccccggccgccgcgcccgaggccgtgccgcccccgccggcgcccccctcctactcggacaagggcgtccagactcccagcaagggcacgccggcgccgctgcccaacggcaaccaccggtactgccgtctttgcaacatcaagttcagcagcctgtccaccttcatcgcccacaagaagtattactgctcctcgcacgccgccgagcacgtgaagtgagcgcccacactacagccgcagacgctttgcacgccccgctgcgatgcggggagggggccgcccccaggccgcacggactgccgctcctgggaaccccgccacgcacaggcctcggcggagggggccgcagggggcagcgcccg

SEQ ID NO: 7835 - DNA, 1403 bp, Homo sapiens
cgcggggtccccgggaaccgccgcctttcttcctcgctcccgcgctcgcgcttcccctcccggggccccggcccacccacccctggtgcggccccgccggactcaggagccccggccgcccgggctgcggggagggggcgccccgggccggccctagaagttactttgcaaagaggcagggggcgcggggccgcgcggggcgagctcgggatccgcggggaagaagccctccgggaccgcgcctcggccgcccgagccccccgcgcccgccgccccccacctcggtcgggggcttacctgggagcccgctgcccccggccagccgcccgcgtgtgcccagggccagcagcacgcacaagtgccagcgcacggccgccgcgcccatgctcaatgcgggccccgctgggcgtgcgggcgtgcggggcgcggggacccgaccgaccggccgctcccgcaggcgctgctcgctgctcgccgctccgccaccgctcgggctcccgagccgcccagccagcccggctgatgagctgacagcgcgcgctcattggcccgtggcgtcggaggggcggggcgtcgcccagggccggccaatgggcgccggcctccggccctccgaggaagaggggggctcgggcgtcgtcggggggacccttcccctggggcgggcggcaggtggggggtgtgggcctggccggccggctcgctaggcgcggggtctaggccaggctggggctgcttggaggctgcgccctcccctgcccgcggcgccccggcccccgccgtcgagagtggacgcccctctggggtaacccctcccggcccagaggcagcctcgggggcggggatcctgcgaaccggggatcccgtgaggtcgcccgccatccgtgggcagtgaaacgcgccagcgcgcagagcagactcgcctgcgctgccgtttgctggacgtttcttgagcacctactggggaccgagtgcgggcgaggcagcagcgaaggaaccgggaggggaaacctcgtgaagatcacttgaaaattgacgttcaaaacaaacgaactttttagcactcgtcaaaggacagtggcccgtcagtgtgcttgtcacggggcggccgcaggacctgcgtctggaaccgggcgggcgcccgggacggacaatgccgcttggcggtcggtcccgcgggaggcccccgcacggggctaacctcggccggcgaagttcgctgcccggaatgcgaggccgaggcctccccctgtgacagaccgggcggggccaggaggaggggcagggcgggcatcccggtccgaagacccaggaactgctctggcctggcctggggtctacacctgacgcctggcgagggttggcttcgggtctggtcccaccgggcctgggagggacgggcg

SEQ ID NO: 7836 - DNA, 1088 bp, Homo sapiens
cgggaaacgccgtctcccctggcgtctgagatctggggtcccctccccacctggtctcctcgctcccgccccagccccgtgcgccccaggagggcaccgccgagcgccgggtccccgcagggttcgggagactccgcggaccggaggagggataggacccccgagctttgggggcgggaagggagggtggaaggaggaggggagcggggttggggaaagttggagcttcggtatcttttctccgggccaggccgtcctcggggccctgcgctgcgtctccaagtgctgggaagactccgcggggaaaggtctgaggacgcggccggctggcacaggtgtggcggcttcagagggccggggagaacccatggcttcgaggctgtggactagaaatgtccctgattagaagctgagaacctttggccagggaggtggggcggcggggaggggtcgtcaagccggtccagagcgcgcccacctgcgccacaagggagaagaggtgccccccgcccccctccgcccaccgccgccacgatgcgccgcggacctcggcgacccagcccgggtagaagcgcgcgctcccctcctccagcctcgtgcgccggcccctgccccgccagccccgctatggtcccccatccacccccgcgggagcgcccctgtccccccatcctgcacttcccccagagtcgcgcgccagtttcccgccccgtggaagcgcccctctcccgacttcggctgatccccgctcgccgccctccccgcgggtgcgcgcccggcccctccctcgcccggggcgggtctgcgtgggcggtgctccgggtcggcgggcggagctccggttccccagccctgcgccccggtggagcccgagccggagccggcagaggggcgcgggcgcggacgcggcgcctggcggggccctgggaggctcggacggggtcctggcgttgagctcggccggcccggagcgcggacccagccgcaggggcggcgatgggcaccgagggacccccgcccccggccgcctcccgcggacgccagggctgcctgctggtacctgcgcgggtgagtgcggcccctcagcg

SEQ ID NO: 7837 - DNA, 1812 bp, Homo sapiens
cgggcggcggaggagggctggcggttagatacagtatcgctggagctcagagagccgggcagaggctggcggagagccgaggctggcccagccttcaggagaccggcgagctggggtgtgtgggagcgggatgcttctaaggcgaaaagaagcgccagcctcgtaagcggcctctatctgggctgcccaggccggatgctcaggagcccacagcaggggggatggagcgaaggaccgaggggctgggaggcgaggccgcagcgcactgacgcaggccagcgaggccgctggccccgacgcagggcgcccggcaaggtgtctggcaccacgagagtcaatccttgcgcgccatctccggaggccagtgcgcccagggcgcgccggcccggcaggagggtgggtgccagcctttcttcccatctctcgagcctcctccccggcgcccacgtgggcggagcagcgcgagggtgtgcgtggcaggggccgcggcggcgtgtgccgtgcgtggggtggggtgcgggctgggcggcctcgccttcgggccccgcgccgccggggcgcggcccccagctccatcttctttgccacctgggcggagatctgggggactgtgacctaccctgcggaagacacggaggggacgggccggccacaccccccgcgccactccggcaggcaccgggtgggtccccctcccgctccttggcttgagggcggaatccggagaagagtggaaataggggtggcgtgaaggagagctgggggctgggggcgggaccgggagggggtgttgggggaagcgacgcagcggctgggagattttgcaagggggtctgaagaggagtgggggatgggtatggaagggtgggggaccactgaggtgggatgcgagagtggaagggggacccagagggggcgcgatggccggaggagggggagatggacgatggggcggggcggcaccggtcgccgcgtcccttgccgccaggtccgcccctcggtcgccgggtccacgggttccctctggccagcgctcgcctcccgccccccggcgcacctgtacccacctgctcggcgctcaggcccgagccgggcagcagcagcggacgtagcgagcgcagccccgcgccgcatcctccggccgccccctccccgctgcgagcttacgccgctgtcgccgccgccaccgccttaaaaaggacaaaacggaacagaaaatgaatgcatgcacaaaaaaaatcgtaaaaagcaattgaggaggatggcagtcgcgcgcgcggctcggcggggcgggagtcgagaggccgcggcactggtggccgcgatccgggcaggcggccggcgcgtgccgcacgcgggtggctgcagctccctcggtcgcccgcgcccggctcaggcacggcaccgcccctccccccggggagcccctccgattggtctgtcttcctgccagtcaggcaggagggcgcggcgcccgccccgccccgcccccgcccccgccccgggcagatgccgggagctctcctgccgccgtgggagggggagctgagctgccggagcgtgcgcactgggccagcgggcggccggggcagggctggggtcccggcgctgagcgcccccagccgcgccgggcagcctggcgcctcgctgagtcggagcaacccccggcaggagctttcaggctctggtcaagcctcgggacccgggaagctatccctgccctcgggggctcgagcctggagtggggcttgcaggtaaagcggggctggggccgtcctggccgtcagtggtcaggaagacgcagcgaccccg

SEQ ID NO: 7838 - DNA, 5819 bp, Homo sapiens
cgagtagaaggcggacgcctccgagccgtaggtcacgtagttgccatagccctgcgatccgccatagggacccccatagacgcccagcgccgcggccgagttgagctcgtggcgcgcggtggccagcagccggctctcgtagaccgggcagtagaccggcgcctgggccgaggcggcgggcccggagtccgccagcgtgcggcctccggactcgcagcacgtgctcagggagttggtggccatcaagaactgcagagagaggccgcgaggactggcgggaagccgggctggaggctggggccctgggccttgccaatcccgcgcgccgcccacgagggcgtgccccgagtacccccgggcctcccgccgtccacaccaggatgctcgcccctttccactagcttgtgcgcgtctggcctcctccgccacgtggggcccagccgagcacctacacccttccccggagggtttccaaggcctctgacgccatttgcgcgccaagcctccttccccaggggttccttggggtcctaggactcccctggggcacagcctgagccttgtggttcaaacatcagggaacccgggcccggcccgtcggattttcttagcgcctcggcctttccccgggggtttggggagcaggggttgggcgtgaggggcgcgcgacccaggccttgctagctcggaagccgcaggcagtcgtaggtcggacactccccaccccccgtccccgccccatccgccctaccggcacctgcggtggcctgggcggggcggggctccgcttacctggggagccgaggagtaggggtatccaaactgcgggtaggacatggcgggcgcggcccggggcggacgggcggggcctgcagggttctgcgcgctggggccggcgtggcgcggccactgctccggagctgcaggcttctaggcgctgggagggcgaagcaggagagccggttagtccatccccgcgctccgcaaacttttctaaccgggtaacaaagtgagcagcggtggccgccgcgattcctttaacttcgcattccggaggctcgagggggctctgggaccgagcggcctcgcagcggcgacagaaatacatattttacgaaaaagaaaaaaaaaaaaacgagtcgcgcgaacccgtcaagtcagatgtgcgcggcttgaagcggaggaggctctgacgtcagccccacctcgcgcagcccggcctggccgcagactcgccggtcactcgccggcggctcaggccgggaggggccaggacagtcccggccgcgcggtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacacgctgaagatgtaatcaacagttaaaattagcccggcgctgcgcaggcggccggcccggcctcgcgctggcgcgctctgctccgagtggcaggaaggggctcgcaggcgccccgcacgcgtctcgtcactattgtttaatcgagaatcagcaacgcctcccgccggtttccaccctacgccggaatggactttcagaacccactgcggccgcaagacagcccgcaagagctggtcaaaatgccctcaggtgcgtgggggcttcggggccttagttggagcccgacaccctgagactggcggcccgagggctgtagggccgccccgggcgtgcgcccaccggctttgcacctctgggcagccgagtgtcgcggagaacgccccatcttctccaccgcggtcttttaagttcccgctcagcccaccgcccccacctcgcctccccgactttcctccccgatcccctttccgccggccgtgctccgccggcttccccctgcccctcgcggctaagccggggactgccgggcggccctgcgcgctcggaagagcaggttcctcaacccaggccccggcccctcccgctaagctcgtccctcccggcgccccgcagggctggctgcgagggagggggcgttgggtgcctggcggaggcgccctcccctgtccattttgcccagctttctgtctggggcgcacggagcaatcggaagaggggaccgagcgcccaccccaggactccctcggccagtaccctccctgggaccttgcccaagttcaaagcggaggccagtgagcaggcggcaagggggcggcaagggggcgcccgggccatcccgaacccgttccccgccttctgcgccatcgccctccgggaccgggactcgccccggttgccctcgccccctgggccggcctcccgtggtaagttgggaaggaagccgtgcaaggcagcgttgtgcagacttgctcagaaagattcctgggttcagacctgtgaatcgccccagggtcaccctctaattaatgatgacgtcctcgccctctccccagctgcaagcctgcctcccagaaacgaaatctgcctgctcttttgacagctcggttgaaggtgattgatgactatctggagaccacagtacacatcatataatatctgctgcgtaattgctttaatttacagatgaaaatacgagttctccgatcgcgttggaccggagcgggccacgtccgagctgcttgcagagggaaaccatcggaaataatgaatagccgctccatgcaaattattcagacagtttagcgtcggtagccgcgagaaatatataaagaacacgagtcaaatgacattaataattgtttctgaattctgtattgatttcgcggcaggccgcgtttctttctttctcacctgaatcgctaatatcaccttcctgtaaataataagaaactagccaccggggtttctcgctagaaatgaatctctcaacccctttccctctcctcctgctcctcccctcccccaccctccttcctcccctctcccaccctccctcctccccactccttgcagttttctggtttttcccgagcatccttctacttcccattatttattgtttacaaactactcgctctctccaggtaatgaggcccggctgaaggaggggtgtgagcccagccgggccaagggctgggatggggagtagagacccccagaggggaggcattcagctgtggcttgtcctttcctcacctatactcggggacctggcctcggcgactgtgagcactccgccggctgagggggagagccagggcccaggggcccagccacctatgccctgcacctctgggctctagtgcaacagctcagcccacccagacctgaggctggtgcatttccttccttccagacccggcggggcttaactggagccgaagccccagaacaggcggccattcatcttctgagcagagtctgggagaagcagcctccacttcccagggcagccagtacgtgggggccctttcgggggcttcctttgaccaccaccgccaccttctcctgttctcttttgcctttccagcctgtgtgcataaatcgacgctccagtccccaccagcgggcgaccctttctccgtgacccagaaacctggcctctgaatcggctttcccaggccgccgcacacacacgctccacttcctgcccgccagcaggccccagcgcctggggtccgggcccagtcacagtcaccctgcctcgggaagctcgcaactgcccaggaggcctcctgacccgcccggcctcacccaggccccactactcattccaggacacagggtcaatccagcctgtggattggcgaccaccgggacatctcactgaaaccctgtagcctggcctaggcccgcctgcccaaaccggggattctcactgggccacccttctcccatagataatactggaatattttccaagtgccttcaccaaaaggccaagcctggagcggaggcacccagtgtccctttcaccaacgataggacgctcagcatctcaggtatcagctgaacgcgtctgcatagactcggagtgctgagccttcctccctctagggacccccggtactaaatacacccgtgagcaggtgggccagaagtcagccggctcccggagtacacagcaccggctcagcttcggggagatgaggtgctcccgctggcctggagcgctccgaagagcggaggaccagggccggagcaggccgcaggggaggcaggggatggtcagcccctaacgcgaagcgcaggcgggtcgcctattttgacggggttaccgttggccgtcggaaccatggaaggcctccggggagacaggccgggccctgacccttcttcggccagcctagccctggtgcttcaggagttaccctgggggccaccagttccccgcaccaagagctcgtccggagggagctccttccagcccagagaagttaactccagccaaaggcgaagccgggagcccggggcaccaggcaagggcctttctttctgagacctggggccagagaccttgggggcgcctgtgcccgcccaccgctcgggacacccggctggggtgtgggtttgagaggcctcacggtcgctgacgccgcactggcgaacctcgaggttggcaggtcatttcctcacagccccgaggccccctcggagccagtggtaggagaaggagccacagggacaagcggtgaatctctggattcccaaccgccctccatgggggcccgcggccctctccctcctctctcccgctgcgcccccgccgcttgctccctgggtacggcctgaggctggacggagcgccgtccgggcgtccaggactcaggcctggccactccgagccccccaccccccgccccgcgccggcccgcgcaccctgcttcccgcaacttgcagcaaacgcagcggcctctggagagcctagcgacgggtagcaaactttgtccccttaagcgcaagagcaatcctcgcaaagtttgtgcggcggagcccactccctacctgagctggggaagctcccgcccgcgccgtgtggctgccggggccgcggggagcagctcgcagcccgggacgcaccggggagtcgccgcagccgccgccgcccgctcccctcggcggccgcgcggagcctccgcctcctcggaaggggggaggggtctcggaaccccggggcgggggcgggagcgggggacctcacctacctgcggtggcgctgggccgctcccggcagcccgcgagggctccgcgcggaagctcggcgcgcgcgctccagcggggagccggcgacaactaatggagacatttccaggcggagcacctggcgagcggagcgcgccggcgtccccaggcgccgcggtcgtcagccgagcccgcaccggcgtgacgtgggcgagcgagcgcgctgctcccacccggccgcccattaacgctttctcccgcgggcgccgcgctcttgccaactttcccctccgtccggtctgcgcgcggcgcgccgggtgcaggagctggggtgagggcgccccgggtgccagcaggggcgctgggagctgtttgggcggggacgtagggctccgggaggtcacacagccctaacaggacagtgggaaggcgcgcgagccagatttggccaaacgctaagctcgctgcggcctcgggccctcggcccacggggcccctctccccgtttgggctgccccacccagggacgcttgggccgggcgcgaagagcccggaaatagccacccttgtcgtcggcccggtttccctccg

SEQ ID NO: 7839 - DNA, 2001 bp, Homo sapiens
cggaggctgtgccggggctcgtcaaaggctacaaacaaaccggacgggtgggaagcacgtttcagcggcgactggatttttaaaaatctgctggtagagtgaaaacaaaaattgtcctccaagttggcaaaatcggcgtcccagacggtgcgcaggagggccctgcgaggcctgtccccggagccccgcgccagtcctgtaggcccggctgggtccgcagcccggtgttccactcgtgggtcgggcccggctgcggggtctttccgcagccgggacacccaggacagcagcggctggggagccggggccaggggcttccttgcaattccaatgatttttattattatcactcgcaaaggacaaacgcggccaaggccgggcctcacagtggctgtgctggtcatcgcgtggaggagtgtgcgctaacccaggggcgaggggggcgcgcccggtgtcccggggagagcttagaaggaagacgccccaccgtggtccctacagtcagggacagtctgggtgctagaaattcccagagagaactcgaggggctgatgtcctgggtcaccagtccctggtgcctgtggggcttcctgcgcgcccacccccatccccctcccccctctcaggttcgacggattctcccggaggcttaggacagtgatttacagtaagtggtgacagtggaataacgtgacagtccgctgcatttgccagctggctcctgggcaggcctacccgccgggcccgaccccagagtcgagtcctcggagccgccgggtaaagccccctcccccgccccggtgcagccccgcgttccccgcgcccggcgctgccggggaaaagtggcacaacaggaaagcctcgccagagggcccttcccagtcggcttcctcgccataaaaagccagactccagccgaggtcctgaccccttccaaatatacgttcccttgcccgcggcccgccactcccgcccgggcctcgggctgtgcagcttcctcctaggcctgcccgggcccatgcctcccccgaagcggcgggagtcggtgcagcctcaacttctactgcgtgtcccaggtcgccaaccagctttgctcgcgtgccgttggcccggaggctgccgcgccagtctctgcgtgcgcctgagcgcgctggagcatttgcgaggccagggctgccgacggcgagaggatactttgaggaacacggtgcttcagtcccgcccccgctctccgcccgagctggaggttggggcgcgctgagccgcagcgcctggacaagtgcgcgggccggagccgcccaggcctgcacccgggggctcgcggccgacgcatgcgcacgcgcggtggcgggtctgcaggcccgaaggcccggcccctccctcaaacccggagcggggaagcccaggggctgagagcctcggcccgggtcgcaggagctggggagcggggacgcgggcaggctaggtcttcccacctgccgtcggggctcctccccgcagcagcaaaggggtcccagtgcccgtggcagtgcatgccccagcggacacgctggctcccaaattcagagatcagaggggcggctgagaacggggcgtccgctgtgtgtgacccctgaccgtggaggaagggcgggagccgggagtaggcggtggggcccggggtcaggccgcggtcgtcggctcccggcaaaggcgctctggccggggaagggggcgagggtgggcggccggcctctgccgtcgtagtcatacctgggacgttgaaatgggctttggggatagagctcactcccagcgcgccccacaggagaagcccgcagctcaggcctgggccgtgcagaccgctgggcgggctcggggcccgaggagagcaacacggcgcgaggtccagtcgcgagtaataaccccgacagcacggcccctcgaagacgtgttccgggcaccggggttgtgagcgggggagcctcgggccttgggcccgcttggcacggggcgggggcg

SEQ ID NO: 7840 - DNA, 1265 bp, Homo sapiens
cggcgaggagggctgtaggtgaagcgcggggagagggaggtcgcccgctccggcctctcccccaggggccctgcggctggccagcgctccggctgcacctcctggtgcgcgccgcggcggcgccacaggcccctcgaccctttgaccaccgccctcgggccgcgcgtccggcagccgggaccggtgatggcgcgggactgacggccgtctcctcccagacccctctgtcccgcctggggctcgctggggctgcggcgccgccccgagctgcatgtggggcgggcgcgcccgagcccagagcgagcggccctcggcgcccccgaggcggtgccccgccgcgccagagtacgaggaggagcggcgggccgggccaggctccccacgcgccgcagcctcggagcacgggctccccggaggggacttggggcgtcccagcccaggaggaaggacccggaagcagaagcggagccgcgagtcgagccgagccactgcccccgctgcccgcgggcgccgggtgggggtcccggcggctggatgggcagcggcggcgcgggccgcgggcggcgatgggcgaggagcagagcacggtgagcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgccaagagacaagtcttctgctccgtgtactgcgtggagagcgacctgcccgaggcccccgcctcggagcagctctcgccgcccgcgtcgccacctggggctccgccagtgttgaaccctcccagcacccgctcttccttccccagcccccgactgtccctcccaacggattccctctcccccgacggcggcagcatcgagctggagttctacctggcgcccgagccg

SEQ ID NO: 7841 - DNA, 1360 bp, Homo sapiens
cgcccccgacccccgccgctgggatttcccgccgcagctcctgctccagtctgtgctgcgggtggggtcgggttgagcagcccggcgccccccaccgcgccccccaccgcaccgccctcgatctaaccccgcccccgggcgctcattggcctgcagcaccccctccccagcctgtgaagtgagcagggggaggcggtggtcggtcgcctccctccagcgcccagcctggcttcgcggcggaggcggcgcctctcccgcaggacggagccaagctggactgccgcgccgcgcggggcgggcaaagggggcgctgcgctcggccccgggcagggagtgacggcggcggcggcggctccgggcgagcgtggtccccgcgtgcgcacacgcacacgccgccgcgcagggacacacggaccccggccgccagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcaggtaagggtcgccccgccgcggctgcccctccacgcctcggccgtcttctccccctccagaaccttcgcccagccgggacctcggatcccctcctctggcttggcggtctccgccagccgcgacctccaccgacggagagcgggcgagggccggcgccaggcaagcctcccagatctgaaatgaagccccctcccgccgctgcgcccttcctgcgcgtcaggctgacaccccccaacccaagtgtctggcgctgcgctcggggcggccgatcgccgcagactgccggggtgggggtcgacctagctatctcacgcccctcctgatgcggagaagggagaccaggggggcaggcaagccatgcggccggagggacccggagggacatgcctccctacccttaggtggacggacgcacctacgcggatcgggaaggcagggctggagggtcccccggggctaggtaccgcaatccgcacggggtttgaggggtgggcaagcaatgtgctaggtgggggttggggtaggggccagtgtagaatgcccctctgtggtgacacatccgggattgttcaaaagagtgtcgtcttcgtttcccgtggcgcggaggggctggggttggggatgccagggcttcagtggtccccagaagaaacgccctgcggggtctgtggggaaacgcaccggccttcccaggttgaagtgggcccgctgagacccctgcctgccgctttagaggcagaagctcctgcggcggctgcggggggcggaggccacatcctcggcg

SEQ ID NO: 7842 - DNA, 362 bp, Homo sapiens
cgctcagcacggcgggcagcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggtgagtgtccccggcagacgcagggggacgtccgggcggcgcggggcgcgggtcccggagtggctgcgggaaggacgcgcggcattgtctgtgcggggacccgggacgggtcggggcatcacaggcgcgggaatccacgtgtggactctgcgttcgcgggcgcggtgacccccgcg

SEQ ID NO: 7843 - DNA, 2566 bp, Homo sapiens
cgtccccaacgcgggagcgcagtgcatcccagtggacaaactcgagaaccgcacgctgctctccgcctccacctctgtcctccccgctcgcggttccaacccgggacccaaatgcacgagctcggtgaatgccccggcaggagggcgagggctcagaggcagcctgcccagcaaaaacgacagctgtgctctggtgggccctgggccaccccaggcagaagccagagaagcccgagaaccccggcgggctggcaaagtttgccgagaagggtctttctggacacccccaccacgggctctaggctcgaaccccctcttccatctggccctggagtcccagacacagacaagccccgggcgcgccggcgggcgtatgtgcgtgtgtgtttacagcggggtggccgccggagctccccaagaaccccagctctcccgccccagctgcccgccagctgtgagcgcccgtcgggcccggaggtcacccgcaaacagctgggtcggcagctgggagcctgggaggcccctgctcagccccggggccccgagaaaggagaagggggagcggagtggctgtttggctgtggtttcctccaactccgcctgcgaagctctcgctgggagcccggagctttagctttccccggcagccccggcccccgcgcccgccgcgcccagcggccggcgcctcgccccgggccccggggaggaggcgcgccggggcagccggccaggacactgcgctgctggctcctagagctgcgggcgcgcctggccggccccacttcccgggttgctggggcgggcgccgctgccccgaccccggacgcgcggaaccctggagacccggccgctccccgccagggccgcggtgctgctccaggctccgggcgggcgcccctttccggctaccggtgcaccccgttgcccgcttgcgggaagcgaagaggggtcccttgatttgcaacatagaggaaagcgccgcttccgcccagcctggcacccacgcgcccacacgcacccggcgccggccgggtcgctcacctgagtcctaaaagctgttgaatccacatggtcacgtttcggggagcggggcctcagacctggctcgcccaggccatctgcgcggcgcccgcgcccgctcgcttccgtcccgcggcgccggtctccggctctcggtccgccgcctcccgccgcccgccggccgcggggcgcacagcgagtcagagcgcggccgcgcggggctccatgccggccggcgcgccgccgccgttggggcgcatggctcaggctgggcggcccgcgggggcgcacatcctccggccggggcgcggggctcgcggccccctccgccggcggcacagcgaaggcggcagcgaggcggggcgtgttccggcgctgtcgcggcgcagcaaagggctggggagccgcggcttcgccctccggggcggcgaggagggaggccggcggcgctgccgctcacggtgcgtgtctcccggcgcgcggctcttgcctccagccggagctccgcgccgatggggcggcgctgcttagggtttggggtgacgcgacgcggacggacgcgagtcccctccgcgctgccgggtcggggggctctgccagaggctccgccgccgatcggcgccactcaagttgcccgggggctccgtctgagcgctcgctctgcagacggccgcggcccggagactggcaggaggcgggcacgagaggcgcgcggggcgagggcgccgtggagcgcggggcgtggggacgcgcggcggcggcgccgcgcggaggaggcgcgcggggatcccggggccccgccgcccgcgcccaccgcgcccgccgcagagccgcccgcgctgctcagccgcctccctcctcgcgtctgcctctccgcgcgctcgcccccgcctcccggagccggtcccaactccgcccgcccggcccggctcacgtcacccgccttccccgcccctcgaacgggagctcgagcccctggcctggccccggctcctgctcgccgccccaccttgcgggggccggggtcgccgcgggtggtggggggcgctgtgcccagcaggggcgacagcgcaggcggggcctcctgcagcccccttccccatccccggtcgcgtcccggtccccaccttgcgaaaggctcgagagaggccgcaggctaggattggaccgccgggcgccgccggatggtgttgccagggtaaccggatggcacgcgaagccgttcgaggttccgacccggttacgggggcgcccagtggacccggagagctactttggggagggggcggccccgaagaaggactgggtgggggcgcatggagcgggggctgcgcgaaaagtttcctggggcggagctgagccacgcgggccgcgcaggagcgtctgtccgagggtcgcctacgagggactcctctgctcggctgcgcgggcttctgcgttgatgaagtcaccgcgttccgggtcggagcttcggcgcttctgccccgaacccagcgaagcccggtcctatgcccccaattacccaacggtccctcatcgcccagcg

SEQ ID NO: 7844 - DNA, 572 bp, Homo sapiens
cgctgtccgccgggccggtggcgttcaccccgcaccgcgctgccccgcccggggcactatggcctggggctggactatgccctccccacctcagccggcgccccccacccacgcgcgctgagggtgcggtgagctgagtgcggggccaagcatgttctggcgtcgacttcgcccaggggcccaggacctggcgcccaaggggctccctggcgacggagacttccgacgcagcagcgacccgcggctgcccaagctgaccccgcccgcgctccgagcggctctgggcgcgcggggctccggggactggaggatcccggggggcggcgccgcgtggtggccggaaggggacgccaagcccggggtgggcgtcggacgcctcccgccgcgcctgcccgccttgctcaccgcgacccggcgggccgtgcggaagcgggggctgctgcggtccctgctgccgcctcccctgctgtcggccggcgcgtcccgggaatcggcgcccaggcagccagggcctggagagcgcgagcgcccccggaggcgcgtggccagggaggaccccgacttcttgggcg

SEQ ID NO: 7845 - DNA, 989 bp, Homo sapiens
cgcatactctgtgcggcccgagtggtccggatggcacagcccaggtgtccgggctaaagttggcatctccaaagtccagaacgcaacttgggcgcgccagtacaaactcggccttcggcttttctgaagccagtcaagttcgcacagggcccccagcgcctggaaatctgagaggcgtggaagggtggggagtcccgcgaagtctccagtccctgggtgtcctccggctccgcgggggagcgggcctggagctaaaccggccggccgtaggctggagtagcgggcgccggagcgcgcggtggggatgtccgaaaaggagttagaggctcagtcggagagtccgagaacacgagggatgcctaccttgtaacatggcctcaagtttcttcctgtccacgcggaagcgctcctcgctccactccgggctgtgcagggtcgccccggcgaccaagtcgtcctcggagccgggcactggggagtcggtgctgcgctcgctgttggagccggggtccgactgcgccgccaggtagccgggctctccctgggcggccatggtgggcgcgcagcgctcgggctcccgctgccgccgccgctctgcctgcgctgccgcctccgctcgccggccgggctcaactggctcccagcgccgcggcgctagctcgtccccctgcagccgccgacgccaccgccaacgccgccgccgccactgagcccccggcgcatcccagccccgggcgccgcccacgccacccgccaccccgggtcgcggccccggtccgggtccagtggctgcgccgccccccgccagcaacgcccgcgcggaatgagcgcgccgcgctgcccgcgcctccatccgcagggctcggcgccccctccccgcccgccgcccctacagccgcgcgctcattggcccggccagcccacggggagccgcggcgggcgggcggcccctggcgctcacacactcgcgcgcgcacacacacaccacg

SEQ ID NO: 7846 - DNA, 2400 bp, Homo sapiens
cggcctgaccggggcgccccgccgtcctcccagtgtaccccaccgctctcggctgggggcgcagcaccttggagagaggcgcctggccccgcgcctgggctgggggcgctctaccttgcgccctgggggtcaggggcgcttgccgggccgctgccgaggggccctgcccacccctgcccagcccggagcccaggcgagccagcgcggcgagcctcctcccctcccgcctgggtcgtcctgagtccgcgcccgctccagttgctgcagctgctgctgctggcggctgcggggagcgcggggcgcgcgccgaagaggcttgggcggcgaggacggggacgaggaggagtcggaggcggcaaggaggaagagcgagcggaggccgaggggctcagcggcgtggcgacaggactagggggtcccgagaacatgggctagcaggcggccacgggccggcggccggacgcggtgaacctgccgcggccgggcgcgcactggcgcggcgagccggagccgagcgcagccgggggaggagggctggcgcaggggcgcccgggcggagggggccgattatccattattaacgagttaccacctaataagcggagagcggctcgttagccgcgcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggtaacgcgcgccccgggcgcccgccctctgcgccagccccaccgcttctcggcgtcccctgcagcccacctcctcgctccgcgccgcgccgtgcctccctccatccccgcctgccttcccctcgccgccttcccttccctcggctctcccggtgctctcggatcggggcagcgggcggcgcgccgggggtgaggagttgcccccagccagtgcgctccgggacgcggacgctcaatcctgtcctcttgtttattgtagggttgttggcggctgcggctggggccggggtcggggactcacaggctcgggtgccgtggtgcggggtggggacagccaactcagcggggacggaggaagctgggggcagctgggtgcgtgttttgcaccgctcacctgccggggctcggctcctggcggtgggcgagagggagcacatccgcccatactttaggaacctgttggggagatgagttcgtggggtcagaaagaagggaaaaatcctttgggcaagggagagaataattttgcacaagggaatcccgggggaggagcatggcccgagataacagggggacttcgaggggcgagagaagttggggagatccatcccactattgggggtagcccacggggctgccacttttggaatgtgtcgaggtcgcatatctgatgtaacctcccactccgtcccttaggtgctctagtggaacataccccaagttcttcggcctctgttcctttgcccccaggccacccactttgggtccccggaaatgccaccagcagcgcggagctggagcgggagtccgcctgaggccgcggttttacgcggagcgtcttccctggcgctcgaggtggctagatgtcgtcggctttagctattcctggtgcagacgcccaccggcactgaggctggcgacaccttcg

SEQ ID NO: 7847 - DNA, 1859 bp, Homo sapiens
cgcacggaagtctctgcccagctgtcagcgcgcgtcgccaggggctgcactgaagctgtggacccgggatggggaggaggctggcggcctccgaagcagggtctacagcgggggagggctagcgccgtctggcggtggctgcgcgtggccagtgcggacccaggctcggctcggccggcgctgcctgcgtgtggtccgggcggagcgagggtccttggagcccggttcgtcctgggtcccaggaagctcggcgtgcagcgtcagaggccgcgtgtgctgggggagggaggagtacagactgtgcctgggggcatccaggacgaattcacagaggggtggtcctgccccacccagggggtgtcgtgggcaaaggccctggggccacctgcctggtgccttggagggcgtagggcaggagccgccgaggcccgcgggccactgtggggcgcggaacttcagaccaggcacccgcggctcaacttccgggccaggggacccgcgggggccttacgaacctgtttggcccatttgtgcaacagaaatccgcccgcgcctagcagcgtccggggccgcctgcgccggatccgcagcccagtaccctccgcgccctggactccgaggaggccaggtagagagcggctcgcgcggtccccgtctgcgccctcagccccgcgctgggcagcgggacatgcctggctccggcgccgccacctcggcttccgcttgcccttgagtgcggagcccggagcctccctcgcggtgcgctgggtcccagagggccagaggccaccagggggccggcatcggcgggagcccagccgggcgcgccctcggccctctcccacccacgtcctccgcggccgcccgggtccaggggcgcagcggggaggagaccccggccagggccggggagcgcgagggcggggcggggtccggcggggaggggcgcgggcgggcggggaccggggcgggggccgggtccgggggcggcggcggcgcgggcgggaggaggaggagcttcccgcgcggggcaggggcggagcgagcggccgcgccgcggagccaagtgagttcgctccggagccgcgccgccgccggcccagcatctcgggcgcccgccgcccccgccgccgccgtcagcgcggggatgtaggatgcaggcgggcgccaggttccagcggcggcggcggcagctgcagcagcagcagccccggcggcggcagcctctcctctggccgatggacgcagagccgccgccgccgccgccctgggtctggatggtgccgggctcggccgggctgctccggctcagcgcgggggtcgtggttcccccggtgctgctcgcctcggccccgccgcccgcggccccgctgctccccggtctccccggctggccggccccgagcgagccggtgctcccgctgctgccgctgccctctgcgccagactccgccgccgccgccgccgcgcaccccttccccgcgctccacgggcaggtaacgtgtccccgtcccgcctcggcccgggtcgccgtctcccctgctcctgggcgcgccctgcccggcccggctctggcctccggctcgcgcgccctcctccccggcggtcctcgccgccccaaaccctcaggacggagcccggcagccgtgcctcggcgagaaagttcgtgcttggacgcccggtcgtccacctccgcagctttggcaggtgcctccgggtgtctggacggagccgtggagggacccgccgcccaggcccgcgtggggaccgcagggaactcgcgccacgccgggggtcactgtccatcgcgaggtgctgaagtggctccgtgaccgccgcgggccgtggctgacatcgcg

SEQ ID NO: 7848 - DNA, 902 bp, Homo sapiens
cgggttcggctggctttcagtaggcttgccggggtctctgcactctgtgtccgggatcctcaatttgcgaatagtctggggaggctgagcgcgagccaggagcggacccgggggtgggggtaagcgccacgtgcgcgccaggtccttggtgtgcccggcaggcggcgctgcgtggctgcggctggctccgagggtgcggggggcggcgacccgggagggaaaacccctgcctcttcccggggcttgctctgcccgtcctttaaactcgccctacaccctccccgactcccgtccttgcaagcgttatctgcagcctcaccggccctcgcaacggtggtggtggttggtggggggtctcgaagcttgcctctggccagccggaccccggtgggagatggaggcagaaattccggcctcctaggagaagggcgtctgctcactcccccactccccggggcttggggagggggctgggcaggggcggaagcgagctggagccgtgtttgtcgcggcgctgcggagtggaacagatggctggggaggggagagggtgcgtggcggggaggaggaggggtgcgggggccggaggatagggaacgaggaatttcgaagcctggagtctcccaggagaagcccccctccccgtcttttcccagaaaggggggcatatatgcgcctgcctttttcccggagagccctggcctctgccctgtggcagaccctgccgcgcaatcctctgccccagggcgcgcccctcacccccaaacccccgccgcgggacggggtggcggggtcaggaccgccaggagcggcccgggtcgcgagggttaatggggccgccctcccaggggcgaggaggcggcgggaaacgggctcggggtggggaacgagttctgggatcg

SEQ ID NO: 7849 - DNA, 2044 bp, Homo sapiens
cggcgtcctcgctctgtctgcattttccttcattgctctttcacgtttggaatgcccccgtctctgcagcctgcagacagcggaaaccgcgggtgcaaatgtgcaggggccgctgacatgaccggctgcagaagcccactcagggttacccgaacaggctagcgttcgggattgcacaagaggtcaggcgatgctgtgggcttccaaatttgtacagctgcgacactctgcgacgtgccaccctatccccagtggggtggggtgggggattccctccgcagtccgctgaaagcgaggcaggaatcactgcaactcctctgctcaggctgaggtcgccaccgctccgcggatgcacgcgctgcaggggcgccttccgccgcgggcacggcgcgggaagggatggggtctggtgggagtgggcaggtggcgggagaggcgcgtgtccgtgcactagaggcccccgtgcgtgacacaggccgatgagctcctgcgggctgcacccacgcggagtcacagaccgaaaaggtcagccggtggccggtgtgctaacatatatagagagacgcccgccaggcgcgccgcaggctgggacgaggctaggagggcccaggctggaggagggctgaggagggctgcgggggcgggccccggcgcagggcgcccggagcggagggggcgggcccgaggcggggcgggccgcggcgctgacgggctgtcgccgctgcactcgcctccagcccgcggtgtcgagcgcaggcggaggtacatggccccgacgggaggcgcgcggcgagcacccggagctcggctccctgcctgagcacggcagccgcgcctccgcccgcgcgtcctcgcccctccggccggcagcccgcggacatgatcgtgtagcctcctcctgggctgggatttgtttgaagattttcttcatggaagcgatgtccccccagcaggagactctagggggacagccggggcgctcctcttccctgacaggagtgtctcggctcgcgggaggcagctgcaccaagaaggtgaggacgctgagcgggggcccgtgccctccgccgccgcagcccccactgccggcgcgcgccctccgcgcccgccacagcagcgcgctaggcggacgccgcgggaatttgacgctcgaggctcgcggcccctaatgagagtcccagaacacttcccgcccttgacggccagcggcagcgccgccgcctcccgcagagcgcccgcttctccgtttctagagccttagtctctcctcgagcgacctcgcagcctccctcccgtctccatccgccgccggttctgcagcccggctcctccctcagtctaggcgcgcgggctgtagtgggcgatcgcctttccccgacccctcgccgtgcccctgggcctcccgaagtggcctgggcgagcactgactgccctttggcggtgtcagccccaaagtcagggccggcgatgtctgcccgggagcggcagccggcgctgaagaaggtaggcagcggggctgcggcgctggtgggctcggccccctcacctgcccgccgaggcgcggctgctccatagcagttttcggggggcagatatggggagtactgccccccacaccagggtcctggatgattccgggtctcccaggtgggggtcacagtttgaggggcgactgtggatgataacgctcgacactacggggacatgtaggttcggctgggcctagaaccgagcagggtgggggcgggtgggctgtggttgggggtcctgagggctgaggtgggggaccttctccctgcactggtccctggcccctgggactctggccgggctggatagggatccgggtgtcggtgtgggcgtgggggcagcgcgtgttccctgtcaaagctgggagagggatgcaggtgacaacttgtagcgttccattccgataaacacggccgctgtgctgcgggaggattccgatccgggtcaggtttcgctggaacggttccctgagcaagtgcacgtgggccgcgggctgccggcctctgccgtttcg

SEQ ID NO: 7850 - DNA, 1152 bp, Homo sapiens
cggcgcacacaagttgaggactgccgaggcgtctcctgcgaggtaaacacgaagtcgcttggttagtgagaagaaacccgaggtggcctctggggcagacagagcaggacctgcttctgccccttgccctcctcgtcctcctctctccagcggcggcgaccgcagtaacagcggcagtggcggctgctgccactgctctgccgctgccgagccggtcacctgggcacccgcggagccgcgccgctgctaccgccccggcggcctcccggagtgcgcggagggggcggcggaggagcgagatatccatagtaaccgaggatgcgaggggcgcccagcagcagcgagtgcctgggagccaggaggaggcccccgcgcgccggcaacccccagtgctaggcgccctgcagcccccgcgcgccgcgcctgggcccgcatcgctctcgcagtgagggtccgcccgagcggtaagccctccccggcggccaagccgacacctcccccccgcctcgccgcccaccccgggcagcagccgcggaacaatggagagcgcagccagcagccctggagacggcgttcgggggaggacgcgccgccgccgccgccgctgccgccagggcaggcgcgcgccgcgtggagccgggcgggtgcgagggcgcgcggcggggggtggggggcacgcgccgcgcggggggcgggggcagtggggggcgcgcgcgcgggcccggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggtgagtagcggcacagcggccccctcgctccgcggcccccgctcgccgagacgtggctccaagaagtggtgccgcagccggggcagaggcggaggaagccgagtcgggcaagccgggaaggctgcggagacgctttgccggggcaggtgttgcagcctcagctagcggtctctacggagggggcg

SEQ ID NO: 7851 - DNA, 872 bp, Homo sapiens
cggccgggcttagcgatgcggctgagctgcccacccgcgtctgttgaatcggccaatcagcggcgcccccggacctagcgggagcgtttccatgccgaccgcggcaggcgtgcgctctccggggccgcatcgccatggcgacctgctcacctgactcgctccgggtggactcgccgcgacccctgggcgttcaggcccctgagggcccaacgggcgacggccctccagctccagctgtgcgtctccgcccgggcgaggtggggctgaccgcggccgtctgcacacgtcccctctggtccgcgcccccggcctgggagggcggactcgcccaccccacgatggccccggctttggaagggactgtttccgtgacccgttctcccaacagccgctaacaaccccctctaacgtctcctgcgcggcccgctcctgagaaccctggctcgggagagcgacgcggggtcctcggggctgcgcaggctgcggcgccctgcccacgctggcccgagggcgcggctcgctccgggtcggctcacacacctacgcttcctgccgggaggcggctgggacgcggcggggctgccccaagtgcagtcgcggcagtgttgcgtctccatcgcgggggtccttgcgggccgcgcctgccccgcccggctcccggtgcatgtggcctgcgaggcggcagaggagatgtggggatttagggtcgcacgtcgtgctcgaggtccccacgagaggtcttcccccgcgggctcctgcgcaactgcgtgaagccggcccgggaaagccaagattgtggcccaggaagaggaaggaacgcgggcgacagagctggggcttgggacgttgagggggtcggtggcagctctccg

SEQ ID NO: 7852 - DNA, 1070 bp, Homo sapiens
cggcgctgagtcctgcccagcgcgacccggaccgacggacgcgcagagaccctgccgggacccgccctccagccggcgcccggggagccgccggccggctctacctcccgcccgggagccgggcagggcgagaaggcagcgcgagtggcggtggcgacccccgccggggttcctgcgacgagcggtgaccagcagcgcccgcagccgcggtcccgctctccactcggacgtggccaagcggcggcggccacgacgtccggcttcccgggatcgtccggctgcgccctgggcgcatctgcgcgcctggccccgcgccccgcggagagggcgatgggtcccggtcaggactgagccccccttcccctctccccagtcccgcctggcaccccctcctctgccccgagggcgagccacggtctgcgccgccgccttcccctccggtgcccccggctcgccgtcctcccgcgccctccctccccggacccgttcccggggccaccatggccgcggccatcgctagcggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgcaggttgcggcgccaaggtctgtgggggtcatggtcgggagatgcgccccgggtcgccccctccccgcctaaacggagcttctccaggctccttccctccctcggttttcccggcccaccccggccccggcctcccttctgagcactctgggtgccgtcgcggggaccctggagtccgctgtcgggcaacctgtagccgccgagaagtgcagccgccagagatggcaagttggctgctcctcgccggcggctcctgccctccgcgtccctgcaggctgggctctgggaaacctgttccccctgagtctcggcttcccgggaggatagggactggcactggctctggaacgcggggcaccccttcctgccacacccggggtcgagccaccgctcg

SEQ ID NO: 7853 - DNA, 395 bp, Homo sapiens
cggcggtctttcgccctccccccactctccccgcccccacccccatcccttggccgctcgaacccccgaccgggagcccagagccctgccagcgccgcactgtgcgccgcgcaagtcgctcgatctccccagcggtaccggctctaagcagtaaacatctgtgcgcttctgagccagggacgcgcgtggggggtgggcgtgcacgcgggtgggccagcgcagagtgggagcttgtgggtgctttccgtcgggatttccaactcagctgcctccgagagcctaagctgagcgccgcacgtgctcgtgccatctgctgtactggacgcagtctaatagcgcagagaggtttccatccggcatccagttcgatgtgggccgtttttcccttcccagcg

SEQ ID NO: 7854 - DNA, 265 bp, Homo sapiens
cgccggactcgcggaaaaggccgctggaagccccccctgaagccggcagcaccaagaggaccaatacgggcggtgggtatcgcttccacctccccgctggccccatcccccgccgcccgcccctgcctccctccctcgccgtcctccctccctccttccctccctccctcccgcggcccggacacctccagcccgaacccggcggcccctgcgcccctgccccgcgccccctcccctgcacctgccccgcgcctaggtgtccccg

SEQ ID NO: 7855 - DNA, 1169 bp, Homo sapiens
cgagcccgcgccaagagctacgccgagacgcgccgtcggtggggccacgcgagatgcaaccggagagtttaaaactagcccaggaccaaccccccagggatccgctcaactctccccgcagaagagtttaagtggggcagtggccgccacaggctgaggatgatttccggacgcgccccaggcgcgaccgcactactcgtcctcagttcaaagcctgagtgacttggcaccacttccccaattgttttttatttccttcgcatccctgttgtgtctaccgctttcacgtatttgagagcctaaatcatgttaagacgacttggagaaacgcccgatttgcctcccaagccacgcaaggatccacccagacgcacgcccgcgcggagacgcacgctggcacacgcgctcacacacgcgagcacacacacgcgcacactacccggttcgtgcgcgcgggtcgctgttcctgttgcattatgcaaaggtggctgggaaagcgcgttgacttacatttacatagcccatcttctccccacagtatgtgactaatacgtatcccggggaggagggagcgcggctgggggtgctaatcggaagggaacagacagtgagtgccatcttgctgggaggttccagaagcaaagcgccaacgacgacagtagcggtggcctcagctccaccagtaactgccgctggcaggagcaccacacgctctaggagtttcccgggtatcaagtatgggtccagcccgtcccagttatcctcttcccctatggcttcattcccgttgtcagtaccccgacctcagcttgcaaccttgatcttgggcttgattataaatgacgaaagaccgcggcagccttcaaagtgcgggagcgagccccgtactggtcagcgcggcggagggatctttccaggaggccccaagcccccaagcctgtggagagacttggtaacagctggcaaggcctgctccagccaccctcgctggctccttgcccctgcattcagcgcctgagggcgttattcgccctctccctgcgtcccacgcaagcggctcaaggaactcactcgatccggattccgcctcgtatgctctccaagccttcgccacctccgcaggcgctctagaaaggcgtgatggccccagctcagtgcccgccagcccg

SEQ ID NO: 7856 - DNA, 1743 bp, Homo sapiens
cgtcctcgcggttgccctcctcccagggccgccggtggtccaggatctggccatcggggaggggcgtggtcttgccgaagtcgatgagccacacgccggcgcgatggcagtgatcgtgcacaaagaggagcgagctgccgatcacctgcgagccccgcaccgtcaggccgcggccctgcccagagacgcccttgccgggttcccgccctagccctcgcggcccgggcacccgggcagccgccgcttacctcgtgcctcctgaagaactcggatacctccagggtgtcccggatctgctgcaggcggttcagataccgcctctgcagagggtggggtgggagaggagggcaaattaactaaacgccaaatgagcccctgctaacgatgaggagccgggacccacgctgtgcttggcaaatgccgccaggaggaggacccagggccccgcccagcgtggcccagaagggaaggagcgtagagcagttgcgagccagcgcggtgagggccatggtggggacacagccgagggcactgggccagatgacaggggcagtcctcggcttcaggctccccaacacctcagggtttgggatcccgctctcaccagcacttcctcatctccttgcacaaactcttcaaagacgcgaagcacctgctctcggcttcgcgtagtcttgaagtcggtgctgcaggagccgtccgctttctggatgtgggacaggagtgtcaggggccccgggcccgccagtggggaagaggacagcgtagagcagcggtacctcccagttgcaggggacggcgaggcggtgggagagggcggaggggcaggcggggcgggagcgggggatcgggaaagacagcgcgcagtggggctgcggcggtgccagcgaagcgcgcctgcctcaccttgatgccctcgatgcggaagccgagggtggtgctggagctgatgccttcccgccactgcatgtagcgcggcttggtgacggcgcgctgcgcgtgctcctcctccgtgggagcttcaggatccaccgccagcattttcttgtacatgtccttccgcagcttgggccgctcacgggccttggtcagctcctcctctaggtaagtcctgtgggggcgcaggcagcggccagggcatgagggggcgcacacggagaccccttcgagcactcgccccgggtccccctcaagcagctgtcccggccccggacccctacttgatccccccaaccgacctggcagggcacgcatacctgacgcccattttgcagtcgagcacacaaggtccgtcgaagccatcgagcaggtcctgcagctgcaggtagctttcgccgtcgcgctccaccacgccgtggaaggcaggcacgcagccgcgcagcgcgtcagccatcagccgcgccaggcagtagcgctccggctccgagcagcgcttcaggatcagcccgctggtgcccgccgccttaaaactccctgaggaccggcatccgtcagcgccgcccagccccttcccgtcgcgggcacccgcccacccgccccactgctcaccagtgtgccctgccagctgcacccaggcgtagcgcttcttgaaagggcttatgaccggcagattgaccatggtccggatcttctgccagtggtttttctgaaagcgacagggtcaaggtctgataatcggcgtctcggcaatgcataagccctccctccactgaaacagggtctcgccacgcccccgacccaccg

SEQ ID NO: 7857 - DNA, 2405 bp, Homo sapiens
cgggggaggggtatacgcagtttccgtgcggaaagatggtgtctttccttcacagggctgcgcgggcacccatccccgctgcaaagcgcccgggccaggcgcggcttgctccgggtcggggcgagctcgctgccctctgcggcagacagcgatgcgcgctccccgccccagctcccggctcgcccggcggcccgcgcgccctcccggtgcagcatgcgggcgctgtgacgttctcggataaatgccgtgtaactgtgtaggcgaatgagagctaaaaataagaacggaaaatctatcattaaggtatcattgcgccagcgcagctatttgaaggctcccatggtccccggcgcctgcgtttgaagcccgccttcaggctttggggggtatttgcagaaaactcccagcagcggctcgccaaccagacctcagggtgcacggggggtggcgccggtaattatggcaactctcaaaataaaataatataaaataaagtaaccaacgttcaccaaccaccaccccatctcaccccctgtactgtcctcaggtagctggggaagccgccgggagtgcagccggatgctggaattcaatgtgacccggctgactatgcaaagactaggactggacgcttttgcagctctatttcgccacccaccttcctccttccacctcgtattagaaataaagtggggggggggggcgagcctttggaggagaaaatgacaactggcacttaaccccaggtctacagtgcgccgcggtggggcgcaaagacgcaaactcccgggatggcgagccttcggggtttcattgggttaaacgaaaattgatctgatttgctttttaacatccgagggagagaaggggagatgaggggagggagggcagggtttgagtgtgtgcgtgtgcgtgtgcgtgtgtgtgtgtctggggagggggaggaggcaccaagttgcagcctgcgcgcggctctgcgcctcggcggggctgcgtgcgtgtgtccctgtccgcgctgctgaaacgggctcttcgagggatcggcgtcacatgactccgcctgcccctcgccagcgcgcagatcgccagtccctcagtttgcccggcaccggaggagggtcgggcggcatcttccgggtactggggctctgcggagcggagaagaggttccagcggggaatggtatatctggattcaagaagccgcggctcggcgccagatcctggagtgtagatatttggggggaggggagagctagagggagcgagcgagcgagcgccagagagaggcagcgcgcagcgcgcacggacggggggctgctgcgcggagaagatgtaagcgcgtggggtctcgctggcctctgagcaccatgcagaaggggatccggctgaatgatggccacgtcgcgtccctgggactgctggcgcgcaaggacggcacgcgcaaaggctacctgagcaagcggagttcggacaacacaaaatggcaaaccaagtggttcgcgctgctgcagaacctgctcttctacttcgagagcgactcgagctcgcggccctcggggctttacctgctggagggctgcgtctgcgaccgcgcgccctcccccaagccggcgctgtcggccaaggagccgctggagaaacaggtgaggcgagcgtcgcgtcctgacctccctgcgtcccggccgcggccctgggggctcagggccttcggctggctgatggcgcttgaactttggcccctctactcttggcgccctaggcgctctctgcaccctcagcgagaggggaggcttgctcccagccaggcgagtgactgcggcgggcagagggggcagggattgagggcggggagtagatgtgggctgcggctgcccttcgccggacgagccccgtgggaggcgggtacagaggggccgacacctggagatgcagaggaagatggggtcctaaggaccagagacgatgagtctggacacacgtccagccaaaaatggtgctcccaacccccactcccaccgcccagccctaatagccccgatcgtctgttctacaccgggaacgtgtaattccccgcgcttaggcatgggaagggcaagacggaggcgtccgagcgctgccagcccttgcctcgccgcagctgagggcggagagcggtctgcgctagctcctcggagttgggctggggttatggggctacacgggtcggttcggtaccatcgagcggtggtgggctcccagctggcggccgccggagcaacaagcccaaagattcccaaggaccgctctgatgcgccggggctagggccagggctgctgcggaggcagcgggacgaagtgggcgcttctctcctcccccgccccctgcgccgccgccgccgccgcagtcgcggctatagcgctgcg

SEQ ID NO: 7858 - DNA, 1920 bp, Homo sapiens
cgggcgctgccccctgcggccccctccgccgaggcctgtgcgtggcggggttcccaggagcggcagtccgtgcggcctgggggcggccccctccccgcatcgcagcggggcgtgcaaagcgtctgcggctgtagtgtgggcgctcacttcacgtgctcggcggcgtgcgaggagcagtaatacttcttgtgggcgatgaaggtggacaggctgctgaacttgatgttgcaaagacggcagtaccggtggttgccgttgggcagcggcgccggcgtgcccttgctgggagtctggacgcccttgtccgagtaggaggggggcgccggcgggggcggcacggcctcgggcgcggcggccggggacgggggcgggccgggcggcggctcctggggctccgggccgaggccgtcccgggggccacgggacccgggctgcggggaggcggcgggggcgggagcgggcgaggggccgcggtcggccggcgtccgggcctcgacccccgggccggccaggggcgcgccgagcagcaggccgtgcgccaggcggaaatgctccagcaggtccccgcgcaccgggccgttcggggggcagtaggggcaggcggcggcgggcaggccgagcgcgccgggcggtggcgcagcggggcacgagtacttcttgtgcgccaggtaggcctcgaggctgtggaagctcacgcggcaggccgtgcactcgtggtagtcggccagcgccggtgccggggctccggggagcgggcgccgcggcttcttgctcaggtcgatggggccgtcggccgcggggccgggcgagcgcgcaggggcgaggccggggccgcttccgcttccgcttccgggccgcggcgactcgggcgcgggggcgtggccgggcggcggggggggcggggcgccggccgcgtgcagctcgtagagcttgcggcgtctgcgcgtgcgcacaggcgcggcgggagagggggccgggggcgcggccggcccagggggtcccgggggcgcggccggtcggcgcggcggcgggtcgtggcgcgaggcgcagtagtaccgcttgtgcacggtgtaggtctcgtggcggctgaagcggatgttgcaggcctcgcacagcgtgcggctggggtcgtcctccgcgtcgtccacggagctacccgggctctggctgccctcgctgccccggccgcccgcgccgtcctcgggcgtggccgcgcccccagccccctcctcgcgcgctccggggcccggggacgagcgcggcgcgtcgggttcggcgggctggccggggggcgcgcgggccgggccggggggcgccttgggcctgcgcgcggcaggcgcgtcctcgggcgcacggcggcctgaacagtagaggcgcttgtgcacgtagtagttgttgacgttgctgaaggtgatctcgcactcgaagcacgtagcgcccttgggggccccggggaagagcccggtctgcgcgccgccggcgcccgcgcccgcgccctgctgcagccggctgtgcaccagctcggacatcttggccaggatctccgaggcggggggcgccgcgtcgggcccgaacacgtactgcggaaggaacagggccccggccaggcccagctcgccgggcaccgggctggagcccggcgtggggctggacagctcggccttgaccctggccggggcggggctgcgcggcgacggcgtccgcgacggggcctggggcccaggctctccggggcccaggatgggggccgcctccggctcctccaccgcctccaccttgatgctcctgggggccgccgggggctcgctgctgcctccattctgggccagaggctccgctctggcctctccgttggtggcctcggccagggcctttctgtccagtcctggcgatggggtgggcgccaggcccaggtccgcg

SEQ ID NO: 7859 - DNA, 1403 bp, Homo sapiens
cgcccgtccctcccaggcccggtgggaccagacccgaagccaaccctcgccaggcgtcaggtgtagaccccaggccaggccagagcagttcctgggtcttcggaccgggatgcccgccctgcccctcctcctggccccgcccggtctgtcacagggggaggcctcggcctcgcattccgggcagcgaacttcgccggccgaggttagccccgtgcgggggcctcccgcgggaccgaccgccaagcggcattgtccgtcccgggcgcccgcccggttccagacgcaggtcctgcggccgccccgtgacaagcacactgacgggccactgtcctttgacgagtgctaaaaagttcgtttgttttgaacgtcaattttcaagtgatcttcacgaggtttcccctcccggttccttcgctgctgcctcgcccgcactcggtccccagtaggtgctcaagaaacgtccagcaaacggcagcgcaggcgagtctgctctgcgcgctggcgcgtttcactgcccacggatggcgggcgacctcacgggatccccggttcgcaggatccccgcccccgaggctgcctctgggccgggaggggttaccccagaggggcgtccactctcgacggcgggggccggggcgccgcgggcaggggagggcgcagcctccaagcagccccagcctggcctagaccccgcgcctagcgagccggccggccaggcccacaccccccacctgccgcccgccccaggggaagggtccccccgacgacgcccgagcccccctcttcctcggagggccggaggccggcgcccattggccggccctgggcgacgccccgcccctccgacgccacgggccaatgagcgcgcgctgtcagctcatcagccgggctggctgggcggctcgggagcccgagcggtggcggagcggcgagcagcgagcagcgcctgcgggagcggccggtcggtcgggtccccgcgccccgcacgcccgcacgcccagcggggcccgcattgagcatgggcgcggcggccgtgcgctggcacttgtgcgtgctgctggccctgggcacacgcgggcggctggccgggggcagcgggctcccaggtaagcccccgaccgaggtggggggcggcgggcgcggggggctcgggcggccgaggcgcggtcccggagggcttcttccccgcggatcccgagctcgccccgcgcggccccgcgccccctgcctctttgcaaagtaacttctagggccggcccggggcgccccctccccgcagcccgggcggccggggctcctgagtccggcggggccgcaccaggggtgggtgggccggggccccgggaggggaagcgcgagcgcgggagcgaggaagaaaggcggcggttcccggggaccccgcg

SEQ ID NO: 7860 - DNA, 1088 bp, Homo sapiens
cgctgaggggccgcactcacccgcgcaggtaccagcaggcagccctggcgtccgcgggaggcggccgggggcgggggtccctcggtgcccatcgccgcccctgcggctgggtccgcgctccgggccggccgagctcaacgccaggaccccgtccgagcctcccagggccccgccaggcgccgcgtccgcgcccgcgcccctctgccggctccggctcgggctccaccggggcgcagggctggggaaccggagctccgcccgccgacccggagcaccgcccacgcagacccgccccgggcgagggaggggccgggcgcgcacccgcggggagggcggcgagcggggatcagccgaagtcgggagaggggcgcttccacggggcgggaaactggcgcgcgactctgggggaagtgcaggatggggggacaggggcgctcccgcgggggtggatgggggaccatagcggggctggcggggcaggggccggcgcacgaggctggaggaggggagcgcgcgcttctacccgggctgggtcgccgaggtccgcggcgcatcgtggcggcggtgggcggaggggggcggggggcacctcttctcccttgtggcgcaggtgggcgcgctctggaccggcttgacgacccctccccgccgccccacctccctggccaaaggttctcagcttctaatcagggacatttctagtccacagcctcgaagccatgggttctccccggccctctgaagccgccacacctgtgccagccggccgcgtcctcagacctttccccgcggagtcttcccagcacttggagacgcagcgcagggccccgaggacggcctggcccggagaaaagataccgaagctccaactttccccaaccccgctcccctcctccttccaccctcccttcccgcccccaaagctcgggggtcctatccctcctccggtccgcggagtctcccgaaccctgcggggacccggcgctcggcggtgccctcctggggcgcacggggctggggcgggagcgaggagaccaggtggggaggggaccccagatctcagacgccaggggagacggcgtttcccg

SEQ ID NO: 7861 - DNA, 1812 bp, Homo sapiens
cggggtcgctgcgtcttcctgaccactgacggccaggacggccccagccccgctttacctgcaagccccactccaggctcgagcccccgagggcagggatagcttcccgggtcccgaggcttgaccagagcctgaaagctcctgccgggggttgctccgactcagcgaggcgccaggctgcccggcgcggctgggggcgctcagcgccgggaccccagccctgccccggccgcccgctggcccagtgcgcacgctccggcagctcagctccccctcccacggcggcaggagagctcccggcatctgcccggggcgggggcgggggcggggcggggcgggcgccgcgccctcctgcctgactggcaggaagacagaccaatcggaggggctccccggggggaggggcggtgccgtgcctgagccgggcgcgggcgaccgagggagctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggtgggtacaggtgcgccggggggcgggaggcgagcgctggccagagggaacccgtggacccggcgaccgaggggcggacctggcggcaagggacgcggcgaccggtgccgccccgccccatcgtccatctccccctcctccggccatcgcgccccctctgggtcccccttccactctcgcatcccacctcagtggtcccccacccttccatacccatcccccactcctcttcagacccccttgcaaaatctcccagccgctgcgtcgcttcccccaacaccccctcccggtcccgcccccagcccccagctctccttcacgccacccctatttccactcttctccggattccgccctcaagccaaggagcgggagggggacccacccggtgcctgccggagtggcgcggggggtgtggccggcccgtcccctccgtgtcttccgcagggtaggtcacagtcccccagatctccgcccaggtggcaaagaagatggagctgggggccgcgccccggcggcgcggggcccgaaggcgaggccgcccagcccgcaccccaccccacgcacggcacacgccgccgcggcccctgccacgcacaccctcgcgctgctccgcccacgtgggcgccggggaggaggctcgagagatgggaagaaaggctggcacccaccctcctgccgggccggcgcgccctgggcgcactggcctccggagatggcgcgcaaggattgactctcgtggtgccagacaccttgccgggcgccctgcgtcggggccagcggcctcgctggcctgcgtcagtgcgctgcggcctcgcctcccagcccctcggtccttcgctccatcccccctgctgtgggctcctgagcatccggcctgggcagcccagatagaggccgcttacgaggctggcgcttcttttcgccttagaagcatcccgctcccacacaccccagctcgccggtctcctgaaggctgggccagcctcggctctccgccagcctctgcccggctctctgagctccagcgatactgtatctaaccgccagccctcctccgccgcccg

SEQ ID NO: 7862 - DNA, 5819 bp, Homo sapiens
cggagggaaaccgggccgacgacaagggtggctatttccgggctcttcgcgcccggcccaagcgtccctgggtggggcagcccaaacggggagaggggccccgtgggccgagggcccgaggccgcagcgagcttagcgtttggccaaatctggctcgcgcgccttcccactgtcctgttagggctgtgtgacctcccggagccctacgtccccgcccaaacagctcccagcgcccctgctggcacccggggcgccctcaccccagctcctgcacccggcgcgccgcgcgcagaccggacggaggggaaagttggcaagagcgcggcgcccgcgggagaaagcgttaatgggcggccgggtgggagcagcgcgctcgctcgcccacgtcacgccggtgcgggctcggctgacgaccgcggcgcctggggacgccggcgcgctccgctcgccaggtgctccgcctggaaatgtctccattagttgtcgccggctccccgctggagcgcgcgcgccgagcttccgcgcggagccctcgcgggctgccgggagcggcccagcgccaccgcaggtaggtgaggtcccccgctcccgcccccgccccggggttccgagacccctccccccttccgaggaggcggaggctccgcgcggccgccgaggggagcgggcggcggcggctgcggcgactccccggtgcgtcccgggctgcgagctgctccccgcggccccggcagccacacggcgcgggcgggagcttccccagctcaggtagggagtgggctccgccgcacaaactttgcgaggattgctcttgcgcttaaggggacaaagtttgctacccgtcgctaggctctccagaggccgctgcgtttgctgcaagttgcgggaagcagggtgcgcgggccggcgcggggcggggggtggggggctcggagtggccaggcctgagtcctggacgcccggacggcgctccgtccagcctcaggccgtacccagggagcaagcggcgggggcgcagcgggagagaggagggagagggccgcgggcccccatggagggcggttgggaatccagagattcaccgcttgtccctgtggctccttctcctaccactggctccgagggggcctcggggctgtgaggaaatgacctgccaacctcgaggttcgccagtgcggcgtcagcgaccgtgaggcctctcaaacccacaccccagccgggtgtcccgagcggtgggcgggcacaggcgcccccaaggtctctggccccaggtctcagaaagaaaggcccttgcctggtgccccgggctcccggcttcgcctttggctggagttaacttctctgggctggaaggagctccctccggacgagctcttggtgcggggaactggtggcccccagggtaactcctgaagcaccagggctaggctggccgaagaagggtcagggcccggcctgtctccccggaggccttccatggttccgacggccaacggtaaccccgtcaaaataggcgacccgcctgcgcttcgcgttaggggctgaccatcccctgcctcccctgcggcctgctccggccctggtcctccgctcttcggagcgctccaggccagcgggagcacctcatctccccgaagctgagccggtgctgtgtactccgggagccggctgacttctggcccacctgctcacgggtgtatttagtaccgggggtccctagagggaggaaggctcagcactccgagtctatgcagacgcgttcagctgatacctgagatgctgagcgtcctatcgttggtgaaagggacactgggtgcctccgctccaggcttggccttttggtgaaggcacttggaaaatattccagtattatctatgggagaagggtggcccagtgagaatccccggtttgggcaggcgggcctaggccaggctacagggtttcagtgagatgtcccggtggtcgccaatccacaggctggattgaccctgtgtcctggaatgagtagtggggcctgggtgaggccgggcgggtcaggaggcctcctgggcagttgcgagcttcccgaggcagggtgactgtgactgggcccggaccccaggcgctggggcctgctggcgggcaggaagtggagcgtgtgtgtgcggcggcctgggaaagccgattcagaggccaggtttctgggtcacggagaaagggtcgcccgctggtggggactggagcgtcgatttatgcacacaggctggaaaggcaaaagagaacaggagaaggtggcggtggtggtcaaaggaagcccccgaaagggcccccacgtactggctgccctgggaagtggaggctgcttctcccagactctgctcagaagatgaatggccgcctgttctggggcttcggctccagttaagccccgccgggtctggaaggaaggaaatgcaccagcctcaggtctgggtgggctgagctgttgcactagagcccagaggtgcagggcataggtggctgggcccctgggccctggctctccccctcagccggcggagtgctcacagtcgccgaggccaggtccccgagtataggtgaggaaaggacaagccacagctgaatgcctcccctctgggggtctctactccccatcccagcccttggcccggctgggctcacacccctccttcagccgggcctcattacctggagagagcgagtagtttgtaaacaataaataatgggaagtagaaggatgctcgggaaaaaccagaaaactgcaaggagtggggaggagggagggtgggagaggggaggaaggagggtgggggaggggaggagcaggaggagagggaaaggggttgagagattcatttctagcgagaaaccccggtggctagtttcttattatttacaggaaggtgatattagcgattcaggtgagaaagaaagaaacgcggcctgccgcgaaatcaatacagaattcagaaacaattattaatgtcatttgactcgtgttctttatatatttctcgcggctaccgacgctaaactgtctgaataatttgcatggagcggctattcattatttccgatggtttccctctgcaagcagctcggacgtggcccgctccggtccaacgcgatcggagaactcgtattttcatctgtaaattaaagcaattacgcagcagatattatatgatgtgtactgtggtctccagatagtcatcaatcaccttcaaccgagctgtcaaaagagcaggcagatttcgtttctgggaggcaggcttgcagctggggagagggcgaggacgtcatcattaattagagggtgaccctggggcgattcacaggtctgaacccaggaatctttctgagcaagtctgcacaacgctgccttgcacggcttccttcccaacttaccacgggaggccggcccagggggcgagggcaaccggggcgagtcccggtcccggagggcgatggcgcagaaggcggggaacgggttcgggatggcccgggcgcccccttgccgcccccttgccgcctgctcactggcctccgctttgaacttgggcaaggtcccagggagggtactggccgagggagtcctggggtgggcgctcggtcccctcttccgattgctccgtgcgccccagacagaaagctgggcaaaatggacaggggagggcgcctccgccaggcacccaacgccccctccctcgcagccagccctgcggggcgccgggagggacgagcttagcgggaggggccggggcctgggttgaggaacctgctcttccgagcgcgcagggccgcccggcagtccccggcttagccgcgaggggcagggggaagccggcggagcacggccggcggaaaggggatcggggaggaaagtcggggaggcgaggtgggggcggtgggctgagcgggaacttaaaagaccgcggtggagaagatggggcgttctccgcgacactcggctgcccagaggtgcaaagccggtgggcgcacgcccggggcggccctacagccctcgggccgccagtctcagggtgtcgggctccaactaaggccccgaagcccccacgcacctgagggcattttgaccagctcttgcgggctgtcttgcggccgcagtgggttctgaaagtccattccggcgtagggtggaaaccggcgggaggcgttgctgattctcgattaaacaatagtgacgagacgcgtgcggggcgcctgcgagccccttcctgccactcggagcagagcgcgccagcgcgaggccgggccggccgcctgcgcagcgccgggctaattttaactgttgattacatcttcagcgtgtcctttcataggtctcatttgtaattgagacgaatgattacagtggggcgggaaggagcagctgctcattaattaatttctaattaaaagtgcctctcgttctcgggtgactaaagagaaacaccgttcgctgggcgatattgactcggatggaatttatttgctaacgcccggaggaatggcccctccgtccaccgcgcggccgggactgtcctggcccctcccggcctgagccgccggcgagtgaccggcgagtctgcggccaggccgggctgcgcgaggtggggctgacgtcagagcctcctccgcttcaagccgcgcacatctgacttgacgggttcgcgcgactcgtttttttttttttctttttcgtaaaatatgtatttctgtcgccgctgcgaggccgctcggtcccagagccccctcgagcctccggaatgcgaagttaaaggaatcgcggcggccaccgctgctcactttgttacccggttagaaaagtttgcggagcgcggggatggactaaccggctctcctgcttcgccctcccagcgcctagaagcctgcagctccggagcagtggccgcgccacgccggccccagcgcgcagaaccctgcaggccccgcccgtccgccccgggccgcgcccgccatgtcctacccgcagtttggatacccctactcctcggctccccaggtaagcggagccccgccccgcccaggccaccgcaggtgccggtagggcggatggggcggggacggggggtggggagtgtccgacctacgactgcctgcggcttccgagctagcaaggcctgggtcgcgcgcccctcacgcccaacccctgctccccaaacccccggggaaaggccgaggcgctaagaaaatccgacgggccgggcccgggttccctgatgtttgaaccacaaggctcaggctgtgccccaggggagtcctaggaccccaaggaacccctggggaaggaggcttggcgcgcaaatggcgtcagaggccttggaaaccctccggggaagggtgtaggtgctcggctgggccccacgtggcggaggaggccagacgcgcacaagctagtggaaaggggcgagcatcctggtgtggacggcgggaggcccgggggtactcggggcacgccctcgtgggcggcgcgcgggattggcaaggcccagggccccagcctccagcccggcttcccgccagtcctcgcggcctctctctgcagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcg

SEQ ID NO: 7863 - DNA, 2001 bp, Homo sapiens
cgcccccgccccgtgccaagcgggcccaaggcccgaggctcccccgctcacaaccccggtgcccggaacacgtcttcgaggggccgtgctgtcggggttattactcgcgactggacctcgcgccgtgttgctctcctcgggccccgagcccgcccagcggtctgcacggcccaggcctgagctgcgggcttctcctgtggggcgcgctgggagtgagctctatccccaaagcccatttcaacgtcccaggtatgactacgacggcagaggccggccgcccaccctcgcccccttccccggccagagcgcctttgccgggagccgacgaccgcggcctgaccccgggccccaccgcctactcccggctcccgcccttcctccacggtcaggggtcacacacagcggacgccccgttctcagccgcccctctgatctctgaatttgggagccagcgtgtccgctggggcatgcactgccacgggcactgggacccctttgctgctgcggggaggagccccgacggcaggtgggaagacctagcctgcccgcgtccccgctccccagctcctgcgacccgggccgaggctctcagcccctgggcttccccgctccgggtttgagggaggggccgggccttcgggcctgcagacccgccaccgcgcgtgcgcatgcgtcggccgcgagcccccgggtgcaggcctgggcggctccggcccgcgcacttgtccaggcgctgcggctcagcgcgccccaacctccagctcgggcggagagcgggggcgggactgaagcaccgtgttcctcaaagtatcctctcgccgtcggcagccctggcctcgcaaatgctccagcgcgctcaggcgcacgcagagactggcgcggcagcctccgggccaacggcacgcgagcaaagctggttggcgacctgggacacgcagtagaagttgaggctgcaccgactcccgccgcttcgggggaggcatgggcccgggcaggcctaggaggaagctgcacagcccgaggcccgggcgggagtggcgggccgcgggcaagggaacgtatatttggaaggggtcaggacctcggctggagtctggctttttatggcgaggaagccgactgggaagggccctctggcgaggctttcctgttgtgccacttttccccggcagcgccgggcgcggggaacgcggggctgcaccggggcgggggagggggctttacccggcggctccgaggactcgactctggggtcgggcccggcgggtaggcctgcccaggagccagctggcaaatgcagcggactgtcacgttattccactgtcaccacttactgtaaatcactgtcctaagcctccgggagaatccgtcgaacctgagaggggggagggggatgggggtgggcgcgcaggaagccccacaggcaccagggactggtgacccaggacatcagcccctcgagttctctctgggaatttctagcacccagactgtccctgactgtagggaccacggtggggcgtcttccttctaagctctccccgggacaccgggcgcgcccccctcgcccctgggttagcgcacactcctccacgcgatgaccagcacagccactgtgaggcccggccttggccgcgtttgtcctttgcgagtgataataataaaaatcattggaattgcaaggaagcccctggccccggctccccagccgctgctgtcctgggtgtcccggctgcggaaagaccccgcagccgggcccgacccacgagtggaacaccgggctgcggacccagccgggcctacaggactggcgcggggctccggggacaggcctcgcagggccctcctgcgcaccgtctgggacgccgattttgccaacttggaggacaatttttgttttcactctaccagcagatttttaaaaatccagtcgccgctgaaacgtgcttcccacccgtccggtttgtttgtagcctttgacgagccccggcacagcctccg

SEQ ID NO: 7864 - DNA, 1265 bp, Homo sapiens
cggctcgggcgccaggtagaactccagctcgatgctgccgccgtcgggggagagggaatccgttgggagggacagtcgggggctggggaaggaagagcgggtgctgggagggttcaacactggcggagccccaggtggcgacgcgggcggcgagagctgctccgaggcgggggcctcgggcaggtcgctctccacgcagtacacggagcagaagacttgtctcttggcgagggacgggcgccgctgacccagcacgtccaggaccagtccgtcggcggcccccacgcgggtcctgggctccagctcttcgccggggggcgcctcctgctgttcatcccctccctcttttcgatccccagcttcctcctcttcctcctccagctccaactgcagtggcaaggtctggggattgagaggcccggtgagtgccagtcccgcaggctgcgccggtgctcggctcttactccagcccgggggccccaggctcctcgcgggctctggggcgctggtgtccgcgcagccccagtcgcttccgcagccaccgccgctcggctccgcggaggcggcgcgcagcgggggcgcccgggcgctgtccccctgaggcctcgggggctcagggtggcccgcagtgccactggccagggtctgcgactcctggggcccgccgccgccgctcaccgtgctctgctcctcgcccatcgccgcccgcggcccgcgccgccgctgcccatccagccgccgggacccccacccggcgcccgcgggcagcgggggcagtggctcggctcgactcgcggctccgcttctgcttccgggtccttcctcctgggctgggacgccccaagtcccctccggggagcccgtgctccgaggctgcggcgcgtggggagcctggcccggcccgccgctcctcctcgtactctggcgcggcggggcaccgcctcgggggcgccgagggccgctcgctctgggctcgggcgcgcccgccccacatgcagctcggggcggcgccgcagccccagcgagccccaggcgggacagaggggtctgggaggagacggccgtcagtcccgcgccatcaccggtcccggctgccggacgcgcggcccgagggcggtggtcaaagggtcgaggggcctgtggcgccgccgcggcgcgcaccaggaggtgcagccggagcgctggccagccgcagggcccctgggggagaggccggagcgggcgacctccctctccccgcgcttcacctacagccctcctcgccg

SEQ ID NO: 7865 - DNA, 1360 bp, Homo sapiens
cgccgaggatgtggcctccgccccccgcagccgccgcaggagcttctgcctctaaagcggcaggcaggggtctcagcgggcccacttcaacctgggaaggccggtgcgtttccccacagaccccgcagggcgtttcttctggggaccactgaagccctggcatccccaaccccagcccctccgcgccacgggaaacgaagacgacactcttttgaacaatcccggatgtgtcaccacagaggggcattctacactggcccctaccccaacccccacctagcacattgcttgcccacccctcaaaccccgtgcggattgcggtacctagccccgggggaccctccagccctgccttcccgatccgcgtaggtgcgtccgtccacctaagggtagggaggcatgtccctccgggtccctccggccgcatggcttgcctgcccccctggtctcccttctccgcatcaggaggggcgtgagatagctaggtcgacccccaccccggcagtctgcggcgatcggccgccccgagcgcagcgccagacacttgggttggggggtgtcagcctgacgcgcaggaagggcgcagcggcgggagggggcttcatttcagatctgggaggcttgcctggcgccggccctcgcccgctctccgtcggtggaggtcgcggctggcggagaccgccaagccagaggaggggatccgaggtcccggctgggcgaaggttctggagggggagaagacggccgaggcgtggaggggcagccgcggcggggcgacccttacctgctcactgcggggcctgtccgtggggccggggcagactccgcaaaggacgcgcagcctgcaagtccgcggcccgcgcggcgcggggatggggagcgtgtgcgccgaggagcgcgcgccgagccgggtctccgcgcctgtgtggccggctggcggccggggtccgtgtgtccctgcgcggcggcgtgtgcgtgtgcgcacgcggggaccacgctcgcccggagccgccgccgccgccgtcactccctgcccggggccgagcgcagcgccccctttgcccgccccgcgcggcgcggcagtccagcttggctccgtcctgcgggagaggcgccgcctccgccgcgaagccaggctgggcgctggagggaggcgaccgaccaccgcctccccctgctcacttcacaggctggggagggggtgctgcaggccaatgagcgcccgggggcggggttagatcgagggcggtgcggtggggggcgcggtggggggcgccgggctgctcaacccgaccccacccgcagcacagactggagcaggagctgcggcgggaaatcccagcggcgggggtcgggggcg

SEQ ID NO: 7866 - DNA, 362 bp, Homo sapiens
cgcgggggtcaccgcgcccgcgaacgcagagtccacacgtggattcccgcgcctgtgatgccccgacccgtcccgggtccccgcacagacaatgccgcgcgtccttcccgcagccactccgggacccgcgccccgcgccgcccggacgtccccctgcgtctgccggggacactcaccgacaccaggaactccagcgtgcccacatagtcccgctcggtcttctggagctcgctgagcacgcacacgcgcaggcgaagctgcttctccaggtccttggcgctctcggcgcggctgtctccgcggctgtcctcgctcatggtcggcggcggtgcgcagcgcggcgctgcccgccgtgctgagcg

SEQ ID NO: 7867 - DNA, 2566 bp, Artificial Sequence
  Description of Artificial Sequence: Synthetic polynucleotide
ygttgggygatgagggatygttgggtaattgggggtataggatygggtttygttgggttyggggtagaagygtygaagtttygattyggaaygyggtgattttattaaygtagaagttygygtagtygagtagaggagtttttygtaggygattttyggatagaygtttttgygyggttygygtggtttagtttygttttaggaaatttttygygtagttttygttttatgygtttttatttagttttttttyggggtygttttttttttaaagtagtttttygggtttattgggygttttygtaatygggtyggaatttygaayggtttygygtgttattyggttattttggtaatattattyggyggygttyggyggtttaattttagtttgyggtttttttygagtttttygtaaggtggggatygggaygygatyggggatggggaagggggttgtaggaggtttygtttgygttgtygtttttgttgggtatagygttttttattattygyggygatttyggttttygtaaggtggggyggygagtaggagtyggggttaggttaggggttygagttttygttygaggggyggggaaggygggtgaygtgagtygggtygggygggyggagttgggatyggtttygggaggygggggygagygygyggagaggtagaygygaggagggaggyggttgagtagygygggyggttttgyggygggygyggtgggygygggyggyggggtttygggattttygygygtttttttygygyggygtygtygtygygygtttttaygtttygygttttayggygttttygtttygygygtttttygtgttygttttttgttagttttygggtygyggtygtttgtagagygagygtttagayggagttttygggtaatttgagtggygtygatyggyggyggagtttttggtagagtttttygattyggtagygyggaggggattygygttygttygygtygygttattttaaattttaagtagygtygttttatyggygyggagtttyggttggaggtaagagtygygygtygggagataygtatygtgagyggtagygtygtyggttttttttttygtygtttyggagggygaagtygyggttttttagttttttgttgygtygygatagygtyggaataygtttygtttygttgtygttttygttgtgtygtyggyggagggggtygygagtttygygtttyggtyggaggatgtgygttttygygggtygtttagtttgagttatgygttttaayggyggyggygygtyggtyggtatggagtttygygyggtygygttttgattygttgtgygtttygyggtyggygggyggygggaggyggyggatygagagtyggagatyggygtygygggayggaagygagygggygygggygtygygtagatggtttgggygagttaggtttgaggtttygtttttygaaaygtgattatgtggatttaatagtttttaggatttaggtgagygattyggtyggygtygggtgygtgtgggygygtgggtgttaggttgggyggaagyggygtttttttttatgttgtaaattaagggattttttttygtttttygtaagygggtaayggggtgtatyggtagtyggaaaggggygttygttyggagtttggagtagtatygyggttttggyggggagyggtygggtttttagggtttygygygttyggggtyggggtagyggygttygttttagtaattygggaagtggggtyggttaggygygttygtagttttaggagttagtagygtagtgttttggtyggttgtttyggygygtttttttttyggggttyggggygaggygtyggtygttgggygyggygggygygggggtyggggttgtyggggaaagttaaagtttygggtttttagygagagtttygtaggyggagttggaggaaattatagttaaatagttatttygttttttttttttttttttyggggtttyggggttgagtaggggttttttaggtttttagttgtygatttagttgtttgygggtgattttygggttygaygggygtttatagttggygggtagttggggygggagagttggggtttttggggagtttyggyggttatttygttgtaaatatataygtatataygttygtyggygygttyggggtttgtttgtgtttgggattttagggttagatggaagagggggttygagtttagagttygtggtgggggtgtttagaaagatttttttyggtaaattttgttagttygtyggggttttygggtttttttggtttttgtttggggtggtttagggtttattagagtatagttgtygtttttgttgggtaggttgtttttgagttttygtttttttgtyggggtatttatygagttygtgtatttgggtttygggttggaatygygagyggggaggatagaggtggaggyggagagtagygtgyggttttygagtttgtttattgggatgtattgygttttygygttggggayg

SEQ ID NO: 7868 - DNA, 572 bp, Artificial Sequence
  Description of Artificial Sequence: Synthetic polynucleotide
ygtttaagaagtyggggttttttttggttaygygttttygggggygttygygttttttaggttttggttgtttgggygtygattttygggaygygtyggtygatagtaggggaggyggtagtagggatygtagtagttttygttttygtayggttygtygggtygyggtgagtaaggygggtaggygyggygggaggygttygaygtttatttygggtttggygttttttttyggttattaygyggygtygtttttygggattttttagttttyggagtttygygygtttagagtygttyggagygygggyggggttagtttgggtagtygygggtygttgttgygtyggaagttttygtygttagggagttttttgggygttaggttttgggtttttgggygaagtygaygttagaatatgtttggtttygtatttagtttatygtatttttagygygygtgggtggggggygtyggttgaggtggggagggtatagtttagttttaggttatagtgtttygggyggggtagygyggtgyggggtgaaygttatyggttyggyggatagyg

SEQ ID NO: 7869 - DNA, 989 bp, Artificial Sequence
  Description of Artificial Sequence: Synthetic polynucleotide
ygtggtgtgtgtgtgygygygygagtgtgtgagygttaggggtygttygttygtygyggtttttygtgggttggtygggttaatgagygygyggttgtaggggyggygggyggggagggggygtygagttttgyggatggaggygygggtagygyggygygtttatttygygygggygttgttggyggggggyggygtagttattggattyggatyggggtygygattyggggtggygggtggygtgggyggygttyggggttgggatgygtygggggtttagtggyggyggyggygttggyggtggygtyggyggttgtagggggaygagttagygtygyggygttgggagttagttgagttyggtyggygagyggaggyggtagygtaggtagagyggyggyggtagygggagttygagygttgygygtttattatggtygtttagggagagttyggttatttggyggygtagtyggatttyggttttaatagygagygtagtatygattttttagtgttyggtttygaggaygatttggtygtyggggygattttgtatagttyggagtggagygaggagygttttygygtggataggaagaaatttgaggttatgttataaggtaggtatttttygtgttttyggatttttygattgagtttttaattttttttyggatatttttatygygygtttyggygttygttattttagtttayggtyggtyggtttagttttaggttygttttttygyggagtyggaggatatttagggattggagatttygygggattttttatttttttaygttttttagatttttaggygttgggggttttgtgygaatttgattggttttagaaaagtygaaggtygagtttgtattggygygtttaagttgygttttggattttggagatgttaattttagttyggatatttgggttgtgttattyggattattygggtygtatagagtatgyg

SEQ ID NO: 7870 - DNA, 2400 bp, Artificial Sequence
  Description of Artificial Sequence: Synthetic polynucleotide
ygaaggtgtygttagttttagtgtyggtgggygtttgtattaggaatagttaaagtygaygatatttagttatttygagygttagggaagaygtttygygtaaaatygyggttttaggyggattttygttttagtttygygttgttggtggtattttyggggatttaaagtgggtggtttgggggtaaaggaatagaggtygaagaatttggggtatgttttattagagtatttaagggayggagtgggaggttatattagatatgygatttygatatattttaaaagtggtagtttygtgggttatttttaatagtgggatggatttttttaatttttttygtttttygaagtttttttgttatttygggttatgtttttttttygggatttttttgtgtaaaattatttttttttttgtttaaaggattttttttttttttttgattttaygaatttatttttttaataggtttttaaagtatgggyggatgtgttttttttygtttatygttaggagtygagtttyggtaggtgagyggtgtaaaataygtatttagttgtttttagtttttttygttttygttgagttggttgtttttatttygtattayggtattygagtttgtgagttttygatttyggttttagtygtagtygttaataattttataataaataagaggataggattgagygttygygtttyggagygtattggttgggggtaattttttattttyggygygtygttygttgtttygattygagagtatygggagagtygagggaagggaaggyggygaggggaaggtaggyggggatggagggaggtayggygyggygyggagygaggaggtgggttgtaggggaygtygagaagyggtggggttggygtagagggygggygttyggggygygygttattttygttttgttttygtagtggtagtatayggtttataggtatttgagygttygttagagtaagatgatgaagaggttttygaagaaagttattatggaggaggttaggaaagtttattatatgygttggtttyggttgtygtayggtatttttatggttatygggatgatgagygtatttattttgggttygtggattgaggaygaggaggaagaggaggaggaagaagaagaagaggaagaggaggaggaggaggaggaggaygygtttaggttgagatggttygygtggatattgttatttattttaagattgttgttttygtygtygtygtygtygtygttgttgtygtygtygtygtygttattatttgttatagttagtaaygggtagtyggygtaggggttygggggagtttttttygtygttagygttattttaaatatttattaatagttatattgttgttattgttgtygtygtygtygtygtygtggagygygggaggggggyggggaggygtttgggttyggggygttgtgygygatttggyggggtgygtygagatatatatagygagtygtygtygttygttygggggggagggggatggagtgygygggtagtttttttttttyggttygygtttygttygtttygggttgygttggtttygagygtygagagttagggggygtygygggtygttygygttyggggtttgygtygttttygggttygtttyggtttygygygyggtttygggtgttttyggygtygygtygttygtygtgygttaygggtgtgygttgygttyggtyggtgattttttttttygagygtttttygygyggttaaygagtygtttttygtttattaggtggtaattygttaataatggataatyggtttttttygttygggygtttttgygttagtttttttttttyggttgygttyggtttyggttygtygygttagtgygygttyggtygyggtaggtttatygygttyggtygtyggttygtggtygtttgttagtttatgttttygggattttttagttttgtygttaygtygttgagtttttyggttttygttygttttttttttttgtygttttygattttttttygttttygttttygtygtttaagttttttyggygygygtttygygtttttygtagtygttagtagtagtagttgtagtaattggagygggygyggatttaggaygatttaggygggaggggaggaggttygtygygttggttygtttgggtttygggttgggtaggggtgggtagggtttttyggtagyggttyggtaagygtttttgatttttagggygtaaggtagagygtttttagtttaggygyggggttaggygtttttttttaaggtgttgygtttttagtygagagyggtggggtatattgggaggayggyggggygtttyggttaggtyg

SEQ ID NO: 7871 - DNA, 1859 bp, Artificial Sequence
  Description of Artificial Sequence: Synthetic polynucleotide
ygygatgttagttayggttygyggyggttayggagttattttagtatttygygatggatagtgattttyggygtggygygagttttttgyggtttttaygygggtttgggyggygggtttttttayggtttygtttagatattyggaggtatttgttaaagttgyggaggtggaygatygggygtttaagtaygaattttttygtygaggtayggttgtygggtttygttttgagggtttggggyggygaggatygtyggggaggagggygygygagtyggaggttagagtygggtygggtagggygygtttaggagtaggggagayggygattygggtygaggygggayggggataygttatttgttygtggagygyggggaaggggtgygyggyggyggyggyggyggagtttggygtagagggtagyggtagtagygggagtatyggttygttyggggtyggttagtyggggagatyggggagtagyggggtygygggyggyggggtygaggygagtagtatygggggaattaygattttygygttgagtyggagtagttyggtygagttyggtattatttagatttagggyggyggyggyggyggttttgygtttatyggttagaggagaggttgtygtygtyggggttgttgttgttgtagttgtygtygtygtygttggaatttggygttygtttgtattttatattttygygttgayggyggyggygggggyggygggygttygagatgttgggtyggyggyggygyggtttyggagygaatttatttggtttygyggygyggtygttygtttygtttttgtttygygygggaagtttttttttttttygttygygtygtygtygttttyggattyggttttygtttyggttttygttygttygygttttttttygtyggatttygtttygttttygygtttttyggttttggtyggggtttttttttygttgygtttttggattygggyggtygyggaggaygtgggtgggagagggtygagggygygttyggttgggttttygtygatgtyggttttttggtggtttttggttttttgggatttagygtatygygagggaggtttygggtttygtatttaagggtaagyggaagtygaggtggyggygtyggagttaggtatgtttygttgtttagygyggggttgagggygtagayggggatygygygagtygttttttatttggttttttyggagtttagggygyggagggtattgggttgyggattyggygtaggyggtttyggaygttgttaggygygggyggatttttgttgtataaatgggttaaataggttygtaaggttttygygggttttttggttyggaagttgagtygygggtgtttggtttgaagtttygygttttatagtggttygygggtttyggyggtttttgttttaygttttttaaggtattaggtaggtggttttagggtttttgtttaygatattttttgggtggggtaggattatttttttgtgaattygttttggatgtttttaggtatagtttgtattttttttttttttagtataygyggtttttgaygttgtaygtygagttttttgggatttaggaygaatygggttttaaggattttygtttygttyggattataygtaggtagygtyggtygagtygagtttgggttygtattggttaygygtagttatygttagayggygttagttttttttygttgtagattttgtttyggaggtygttagttttttttttatttygggtttatagttttagtgtagtttttggygaygygygttgatagttgggtagagattttygtgyg

SEQ ID NO: 7872 - DNA, 902 bp, Artificial Sequence
  Description of Artificial Sequence: Synthetic polynucleotide
ygattttagaattygttttttatttygagttygtttttygtygttttttygtttttgggagggyggttttattaattttygygattygggtygtttttggyggttttgatttygttatttygtttygyggygggggtttgggggtgaggggygygttttggggtagaggattgygyggtagggtttgttatagggtagaggttagggtttttygggaaaaaggtaggygtatatatgtttttttttttgggaaaagayggggaggggggttttttttgggagattttaggtttygaaatttttygttttttatttttyggttttygtattttttttttttttygttaygtatttttttttttttttagttatttgttttatttygtagygtygygataaatayggttttagttygttttygtttttgtttagttttttttttaagtttyggggagtgggggagtgagtagaygttttttttttaggaggtyggaatttttgtttttattttttatyggggttyggttggttagaggtaagtttygagattttttattaattattattatygttgygagggtyggtgaggttgtagataaygtttgtaaggaygggagtyggggagggtgtagggygagtttaaaggaygggtagagtaagtttygggaagaggtaggggttttttttttygggtygtygtttttygtattttyggagttagtygtagttaygtagygtygtttgtygggtatattaaggatttggygygtaygtggygtttatttttattttygggttygtttttggttygygtttagtttttttagattattygtaaattgaggatttyggatatagagtgtagagatttyggtaagtttattgaaagttagtygaattyg

SEQ ID NO: 7873 - DNA, 2044 bp, Artificial Sequence
  Description of Artificial Sequence: Synthetic polynucleotide
ygaaayggtagaggtyggtagttygyggtttaygtgtatttgtttagggaatygttttagygaaatttgattyggatyggaattttttygtagtatagyggtygtgtttatyggaatggaaygttataagttgttatttgtattttttttttagttttgatagggaataygygttgtttttaygtttatatygatattyggatttttatttagttyggttagagttttaggggttagggattagtgtagggagaaggttttttattttagtttttaggatttttaattatagtttattygtttttattttgttyggttttaggtttagtygaatttatatgttttygtagtgtygagygttattatttatagtygttttttaaattgtgatttttatttgggagattyggaattatttaggattttggtgtggggggtagtattttttatatttgtttttygaaaattgttatggagtagtygygtttyggygggtaggtgagggggtygagtttattagygtygtagtttygttgtttattttttttagygtyggttgtygttttygggtagatatygtyggttttgattttggggttgatatygttaaagggtagttagtgttygtttaggttatttygggaggtttaggggtayggygaggggtyggggaaaggygatygtttattatagttygygygtttagattgagggaggagtygggttgtagaatyggyggyggatggagaygggagggaggttgygaggtygttygaggagagattaaggttttagaaayggagaagygggygttttgygggaggyggyggygttgtygttggtygttaagggygggaagtgttttgggatttttattaggggtygygagtttygagygttaaattttygyggygttygtttagygygttgttgtggygggygyggagggygygygtyggtagtgggggttgyggyggyggagggtaygggttttygtttagygtttttatttttttggtgtagttgtttttygygagtygagatatttttgttagggaagaggagygtttyggttgtttttttagagttttttgttggggggatatygtttttatgaagaaaatttttaaataaattttagtttaggaggaggttataygattatgttygygggttgtyggtyggaggggygaggaygygygggyggaggygyggttgtygtgtttaggtagggagtygagtttygggtgttygtygygygtttttygtyggggttatgtattttygtttgygttygatatygygggttggaggygagtgtagyggygatagttygttagygtygyggttygtttygtttygggttygtttttttygtttygggygttttgygtyggggttygttttygtagttttttttagtttttttttagtttgggtttttttagtttygttttagtttgtggygygtttggygggygtttttttatatatgttagtatatyggttatyggttgattttttyggtttgtgatttygygtgggtgtagttygtaggagtttatyggtttgtgttaygtaygggggtttttagtgtayggataygygtttttttygttatttgtttatttttattagattttattttttttygygtygtgttygyggyggaaggygtttttgtagygygtgtattygyggagyggtggygattttagtttgagtagaggagttgtagtgatttttgtttygtttttagyggattgyggagggaattttttattttattttattggggatagggtggtaygtygtagagtgtygtagttgtataaatttggaagtttatagtatygtttgattttttgtgtaatttygaaygttagtttgttygggtaattttgagtgggtttttgtagtyggttatgttagyggtttttgtatatttgtattygyggttttygttgtttgtaggttgtagagaygggggtattttaaaygtgaaagagtaatgaaggaaaatgtagatagagygaggaygtyg

SEQ ID NO: 7874 - DNA, 1152 bp, Artificial Sequence
  Description of Artificial Sequence: Synthetic polynucleotide
ygtttttttygtagagatygttagttgaggttgtaatatttgtttyggtaaagygttttygtagttttttyggtttgttygattyggtttttttygtttttgtttyggttgyggtattattttttggagttaygtttyggygagygggggtygyggagygagggggtygttgtgtygttatttattygagtygttygggttggtygygagtygggattygygagggttggygggttttggttttygaggaygtagatatgtggtttgaattttygtttttttagtygttgtttttgtgtatttttttgggygtttttagygaatgygagyggygaggygagggygagygygtygaggaagggygggagaggygyggagtttggtygygtygygttgygtygagygtygggtttttttygygagtttttygggttygygygygygttttttattgttttygtttttygygyggygygtgttttttatttttygtygygygttttygtattygttyggttttaygyggygygygtttgttttggyggtagyggyggyggyggyggygygttttttttygaaygtygtttttagggttgttggttgygttttttattgtttygyggttgttgttyggggtgggyggygaggygggggggaggtgtyggtttggtygtyggggagggtttatygttygggyggatttttattgygagagygatgygggtttaggygyggygygygggggttgtagggygtttagtattgggggttgtyggygygygggggtttttttttggtttttaggtattygttgttgttgggygtttttygtattttyggttattatggatatttygttttttygtygtttttttygygtatttygggaggtygtyggggyggtagtagyggygyggtttygygggtgtttaggtgatyggttyggtagyggtagagtagtggtagtagtygttattgtygttgttattgyggtygtygtygttggagagaggaggaygaggagggtaaggggtagaagtaggttttgttttgtttgttttagaggttatttygggtttttttttattaattaagygatttygtgtttatttygtaggagaygtttyggtagtttttaatttgtgtgygtyg

SEQ ID NO: 7875 - DNA, 872 bp, Artificial Sequence
  Description of Artificial Sequence: Synthetic polynucleotide
yggagagttgttatygatttttttaaygttttaagttttagttttgtygttygygtttttttttttttttgggttataattttggttttttygggtyggttttaygtagttgygtaggagttygygggggaagatttttygtggggatttygagtaygaygtgygattttaaatttttatattttttttgtygtttygtaggttatatgtatygggagtygggyggggtaggygyggttygtaaggattttygygatggagaygtaatattgtygygattgtatttggggtagtttygtygygttttagtygtttttyggtaggaagygtaggtgtgtgagtygattyggagygagtygygttttygggttagygtgggtagggygtygtagtttgygtagtttygaggatttygygtygttttttygagttagggtttttaggagygggtygygtaggagaygttagagggggttgttagyggttgttgggagaaygggttayggaaatagttttttttaaagtyggggttatygtggggtgggygagttygtttttttaggtygggggygyggattagaggggaygtgtgtagayggtygyggttagttttatttygttygggyggagaygtatagttggagttggagggtygtygttygttgggtttttaggggtttgaaygtttaggggtygyggygagtttattyggagygagttaggtgagtaggtygttatggygatgyggtttyggagagygtaygtttgtygyggtyggtatggaaaygttttygttaggttygggggygtygttgattggtygatttaatagaygygggtgggtagtttagtygtatygttaagttyggtyg

SEQ ID NO: 7876 - DNA, 1070 bp, Artificial Sequence
  Description of Artificial Sequence: Synthetic polynucleotide
ygagyggtggttygatttygggtgtggtaggaaggggtgtttygygttttagagttagtgttagtttttattttttygggaagtygagatttagggggaataggttttttagagtttagtttgtagggaygyggagggtaggagtygtyggygaggagtagttaatttgttatttttggyggttgtatttttyggyggttataggttgttygatagyggattttagggttttygygayggtatttagagtgtttagaagggaggtyggggtyggggtgggtygggaaaatygagggagggaaggagtttggagaagtttygtttaggyggggagggggygattyggggygtatttttygattatgatttttatagattttggygtygtaatttgygttttttgaggtygaagatgygtattttggagaagatatttattaggttgtygttgtagagttygyggtttttgttggggttgtttygttttttgttggtagayggtyggttttagtgttgttttygygtttgtygtttttggyggattaagtygttagygatggtygyggttatggtggtttygggaaygggttyggggagggagggygygggaggayggygagtygggggtatyggaggggaaggyggyggygtagatygtggttygttttyggggtagaggagggggtgttaggygggattggggagaggggaaggggggtttagttttgatygggatttatygtttttttygyggggygyggggttaggygygtagatgygtttagggygtagtyggaygatttygggaagtyggaygtygtggtygtygtygtttggttaygttygagtggagagygggatygyggttgygggygttgttggttatygttygtygtaggaatttyggygggggtygttatygttattygygttgttttttygttttgttyggttttygggygggaggtagagtyggtyggyggtttttygggygtyggttggagggygggtttyggtagggtttttgygygttygtyggttygggtygygttgggtaggatttagygtyg

SEQ ID NO: 7877 - DNA, 395 bp, Artificial Sequence
  Description of Artificial Sequence: Synthetic polynucleotide
ygttgggaagggaaaaayggtttatatygaattggatgtyggatggaaatttttttgygttattagattgygtttagtatagtagatggtaygagtaygtgyggygtttagtttaggttttyggaggtagttgagttggaaatttygayggaaagtatttataagtttttattttgygttggtttattygygtgtaygtttattttttaygygygtttttggtttagaagygtatagatgtttattgtttagagtyggtatygttggggagatygagygatttgygyggygtatagtgyggygttggtagggttttgggttttyggtygggggttygagyggttaagggatgggggtgggggyggggagagtggggggagggygaaagatygtyg

SEQ ID NO: 7878 - DNA, 265 bp, Artificial Sequence
  Description of Artificial Sequence: Synthetic polynucleotide
yggggatatttaggygyggggtaggtgtaggggagggggygyggggtaggggygtaggggtygtygggttygggttggaggtgttygggtygtgggagggagggagggaaggagggagggaggayggygagggagggaggtaggggygggyggygggggatggggttagyggggaggtggaagygatatttatygttygtattggtttttttggtgttgtyggttttagggggggtttttagyggtttttttygygagttyggyg

SEQ ID NO: 7879 - DNA, 1169 bp, Artificial Sequence
  Description of Artificial Sequence: Synthetic polynucleotide
ygggttggygggtattgagttggggttattaygtttttttagagygtttgyggaggtggygaaggtttggagagtataygaggyggaattyggatygagtgagttttttgagtygtttgygtgggaygtagggagagggygaataaygtttttaggygttgaatgtaggggtaaggagttagygagggtggttggagtaggttttgttagttgttattaagtttttttataggtttgggggtttggggttttttggaaagattttttygtygygttgattagtayggggttygttttygtattttgaaggttgtygyggtttttygttatttataattaagtttaagattaaggttgtaagttgaggtyggggtattgataaygggaatgaagttataggggaagaggataattgggaygggttggatttatatttgatattygggaaatttttagagygtgtggtgtttttgttagyggtagttattggtggagttgaggttatygttattgtygtygttggygttttgtttttggaattttttagtaagatggtatttattgtttgttttttttygattagtatttttagtygygttttttttttttygggataygtattagttatatattgtggggagaagatgggttatgtaaatgtaagttaaygygtttttttagttatttttgtataatgtaataggaatagygattygygygtaygaatygggtagtgtgygygtgtgtgtgttygygtgtgtgagygygtgtgttagygtgygttttygygygggygtgygtttgggtggatttttgygtggtttgggaggtaaatygggygtttttttaagtygttttaatatgatttaggtttttaaataygtgaaagyggtagatataatagggatgygaaggaaataaaaaataattggggaagtggtgttaagttatttaggttttgaattgaggaygagtagtgyggtygygtttggggygygttyggaaattatttttagtttgtggyggttattgttttatttaaatttttttgyggggagagttgagyggatttttggggggttggttttgggttagttttaaatttttyggttgtatttygygtggttttatygayggygygtttyggygtagtttttggygygggttyg

SEQ ID NO: 7880 - DNA, 1743 bp, Artificial Sequence
  Description of Artificial Sequence: Synthetic polynucleotide
yggtgggtygggggygtggygagattttgttttagtggagggagggtttatgtattgtygagaygtygattattagattttgattttgtygtttttagaaaaattattggtagaagattyggattatggttaatttgtyggttataagtttttttaagaagygttaygtttgggtgtagttggtagggtatattggtgagtagtggggygggtgggygggtgttygygaygggaaggggttgggyggygttgayggatgtyggtttttagggagttttaaggyggygggtattagygggttgattttgaagygttgttyggagtyggagygttattgtttggygyggttgatggttgaygygttgygyggttgygtgtttgttttttayggygtggtggagygygayggygaaagttatttgtagttgtaggatttgttygatggtttygayggattttgtgtgttygattgtaaaatgggygttaggtatgygtgttttgttaggtyggttggggggattaagtaggggttyggggtygggatagttgtttgagggggattyggggygagtgttygaaggggttttygtgtgygtttttttatgttttggtygttgtttgygtttttataggatttatttagaggaggagttgattaaggttygtgagyggtttaagttgyggaaggatatgtataagaaaatgttggyggtggattttgaagtttttayggaggaggagtaygygtagygygtygttattaagtygygttatatgtagtggygggaaggtattagttttagtattattttyggttttygtatygagggtattaaggtgaggtaggygygtttygttggtatygtygtagttttattgygygttgtttttttygatttttygttttygtttygtttgttttttygtttttttttatygtttygtygttttttgtaattgggaggtatygttgttttaygttgtttttttttttattggygggttyggggtttttgatatttttgttttatatttagaaagyggayggtttttgtagtatygattttaagattaygygaagtygagagtaggtgtttygygtttttgaagagtttgtgtaaggagatgaggaagtgttggtgagagygggattttaaattttgaggtgttggggagtttgaagtygaggattgtttttgttatttggtttagtgttttyggttgtgtttttattatggtttttatygygttggttygtaattgttttaygtttttttttttttgggttaygttgggyggggttttgggttttttttttggyggtatttgttaagtatagygtgggtttyggttttttatygttagtaggggtttatttggygtttagttaatttgttttttttttttattttattttttgtagaggyggtatttgaatygtttgtagtagattygggatattttggaggtattygagttttttaggaggtaygaggtaagyggyggttgttygggtgttygggtygygagggttagggygggaattyggtaagggygtttttgggtagggtygyggtttgayggtgyggggttygtaggtgatyggtagttygtttttttttgtgtaygattattgttatygygtyggygtgtggtttatygatttyggtaagattaygttttttttygatggttagattttggattatyggyggttttgggaggagggtaatygygaggayg

SEQ ID NO: 7881 - DNA, 2405 bp, Artificial Sequence
  Description of Artificial Sequence: Synthetic polynucleotide
ygtagygttatagtygygattgyggyggyggyggyggygtagggggygggggaggagagaagygtttatttygtttygttgttttygtagtagttttggttttagtttyggygtattagagyggtttttgggaatttttgggtttgttgtttyggyggtygttagttgggagtttattatygttygatggtatygaatygattygtgtagttttataattttagtttaatttygaggagttagygtagatygtttttygtttttagttgyggygaggtaagggttggtagygttyggaygttttygttttgttttttttatgtttaagygyggggaattataygttttyggtgtagaatagaygatyggggttattagggttgggyggtgggagtgggggttgggagtattatttttggttggaygtgtgtttagatttatygtttttggtttttaggattttatttttttttgtatttttaggtgtyggtttttttgtattygttttttayggggttygttyggygaagggtagtygtagtttatatttatttttygtttttaatttttgttttttttgttygtygtagttattygtttggttgggagtaagttttttttttygttgagggtgtagagagygtttagggygttaagagtagaggggttaaagtttaagygttattagttagtygaaggttttgagtttttagggtygyggtygggaygtagggaggttaggaygygaygttygttttatttgtttttttagyggttttttggtygatagygtyggtttgggggagggygygyggtygtagaygtagttttttagtaggtaaagtttygagggtygygagttygagtygttttygaagtagaagagtaggttttgtagtagygygaattatttggtttgttattttgtgttgttygaatttygtttgtttaggtagtttttgygygtgtygtttttgygygttagtagttttagggaygygaygtggttattatttagtyggatttttttttgtatggtgtttagaggttagygagattttaygygtttatatttttttygygtagtagtttttygttygtgygygttgygygttgtttttttttggygttygttygttygttttttttagtttttttttttttttaaatatttatattttaggatttggygtygagtygyggttttttgaatttagatatattatttttygttggaatttttttttygtttygtagagttttagtattyggaagatgtygttygattttttttyggtgtygggtaaattgagggattggygatttgygygttggygaggggtaggyggagttatgtgaygtygatttttygaagagttygttttagtagygyggatagggatataygtaygtagtttygtygaggygtagagtygygygtaggttgtaatttggtgttttttttttttttttagatatatatataygtataygtataygtatatatttaaattttgttttttttttttttatttttttttttttttttyggatgttaaaaagtaaattagattaattttygtttaatttaatgaaatttygaaggttygttatttygggagtttgygtttttgygttttatygyggygtattgtagatttggggttaagtgttagttgttatttttttttttaaaggttygttttttttttttattttatttttaataygaggtggaaggaggaaggtgggtggygaaatagagttgtaaaagygtttagttttagtttttgtatagttagtygggttatattgaattttagtattyggttgtattttyggyggtttttttagttatttgaggatagtatagggggtgagatggggtggtggttggtgaaygttggttattttattttatattattttattttgagagttgttataattatyggygttatttttygtgtattttgaggtttggttggygagtygttgttgggagttttttgtaaatattttttaaagtttgaaggygggttttaaaygtaggygtyggggattatgggagtttttaaatagttgygttggygtaatgatattttaatgatagatttttygtttttatttttagtttttattygtttatatagttatayggtatttattygagaaygttatagygttygtatgttgtatygggagggygygygggtygtygggygagtygggagttggggyggggagygygtatygttgtttgtygtagagggtagygagttygtttygattyggagtaagtygygtttggttygggygttttgtagyggggatgggtgttygygtagttttgtgaaggaaagatattattttttygtayggaaattgygtatatttttttttyg

SEQ ID NO: 7882 - DNA, 1920 bp, Artificial Sequence
  Description of Artificial Sequence: Synthetic polynucleotide
ygyggatttgggtttggygtttattttatygttaggattggatagaaaggttttggtygaggttattaayggagaggttagagyggagtttttggtttagaatggaggtagtagygagttttyggyggtttttaggagtattaaggtggaggyggtggaggagtyggaggyggtttttattttgggtttyggagagtttgggttttaggtttygtygyggaygtygtygtygygtagtttygtttyggttagggttaaggtygagttgtttagttttaygtygggttttagttyggtgttyggygagttgggtttggtyggggttttgtttttttygtagtaygtgttygggttygaygyggygtttttygtttyggagattttggttaagatgttygagttggtgtatagtyggttgtagtagggygygggygygggygtyggyggygygtagatygggttttttttyggggtttttaagggygttaygtgtttygagtgygagattatttttagtaaygttaataattattaygtgtataagygtttttattgtttaggtygtygtgygttygaggaygygtttgtygygygtaggtttaaggygtttttyggttyggttygygygtttttyggttagttygtygaattygaygygtygygttygttttygggtttyggagygygygaggagggggttgggggygyggttaygttygaggayggygygggyggtyggggtagygagggtagttagagttygggtagtttygtggaygaygyggaggaygattttagtygtaygttgtgygaggtttgtaatattygttttagtygttaygagatttatatygtgtataagyggtattattgygtttygygttaygattygtygtygygtygatyggtygygttttygggattttttgggtyggtygygttttyggttttttttttygtygygtttgtgygtaygygtagaygtygtaagttttaygagttgtaygyggtyggygtttygtttttttygtygttyggttaygttttygygttygagtygtygyggttyggaagyggaagyggaagyggtttyggtttygtttttgygygttygttyggtttygyggtygayggttttatygatttgagtaagaagtygyggygttygtttttyggagtttyggtatyggygttggtygattattaygagtgtayggtttgtygygtgagtttttatagtttygaggtttatttggygtataagaagtattygtgtttygttgygttatygttyggygygttyggtttgttygtygtygtttgtttttattgtttttygaayggttyggtgygyggggatttgttggagtattttygtttggygtayggtttgttgttyggygygtttttggtyggttygggggtygaggttyggaygtyggtygatygyggtttttygttygttttygttttygtygttttttygtagttygggtttygtggttttygggayggtttyggttyggagttttaggagtygtygttyggttygttttygttttyggtygtygygttygaggtygtgtygttttygtyggygttttttttttattyggataagggygtttagatttttagtaagggtaygtyggygtygttgtttaayggtaattatyggtattgtygtttttgtaatattaagtttagtagtttgtttatttttatygtttataagaagtattattgtttttygtaygtygtygagtaygtgaagtgagygtttatattatagtygtagaygttttgtaygtttygttgygatgyggggagggggtygtttttaggtygtayggattgtygtttttgggaatttygttaygtataggtttyggyggagggggtygtagggggtagygttyg

SEQ ID NO: 7883 - DNA, 1403 bp, Artificial Sequence
  Description of Artificial Sequence: Synthetic polynucleotide
ygyggggttttygggaatygtygtttttttttttygttttygygttygygttttttttttyggggtttyggtttatttatttttggtgyggtttygtyggatttaggagtttyggtygttygggttgyggggagggggygtttygggtyggttttagaagttattttgtaaagaggtagggggygyggggtygygyggggygagttygggattygyggggaagaagtttttygggatygygtttyggtygttygagtttttygygttygtygttttttatttyggtygggggtttatttgggagttygttgttttyggttagtygttygygtgtgtttagggttagtagtaygtataagtgttagygtayggtygtygygtttatgtttaatgygggtttygttgggygtgygggygtgyggggygyggggattygatygatyggtygttttygtaggygttgttygttgttygtygtttygttatygttygggttttygagtygtttagttagttyggttgatgagttgatagygygygtttattggttygtggygtyggaggggyggggygtygtttagggtyggttaatgggygtyggttttyggtttttygaggaagaggggggttygggygtygtyggggggattttttttttggggygggyggtaggtggggggtgtgggtttggtyggtyggttygttaggygyggggtttaggttaggttggggttgtttggaggttgygtttttttttgttygyggygtttyggttttygtygtygagagtggaygtttttttggggtaatttttttyggtttagaggtagtttygggggyggggattttgygaatyggggatttygtgaggtygttygttattygtgggtagtgaaaygygttagygygtagagtagattygtttgygttgtygtttgttggaygttttttgagtatttattggggatygagtgygggygaggtagtagygaaggaatygggaggggaaatttygtgaagattatttgaaaattgaygtttaaaataaaygaattttttagtattygttaaaggatagtggttygttagtgtgtttgttayggggyggtygtaggatttgygtttggaatygggygggygttygggayggataatgtygtttggyggtyggtttygygggaggttttygtayggggttaatttyggtyggygaagttygttgttyggaatgygaggtygaggtttttttttgtgatagatygggyggggttaggaggaggggtagggygggtatttyggttygaagatttaggaattgttttggtttggtttggggtttatatttgaygtttggygagggttggtttygggtttggttttatygggtttgggagggaygggyg

SEQ ID NO: 7884 - DNA, 1088 bp, Artificial Sequence
  Description of Artificial Sequence: Synthetic polynucleotide
ygggaaaygtygttttttttggygtttgagatttggggttttttttttatttggttttttygttttygttttagtttygtgygttttaggagggtatygtygagygtygggttttygtagggttygggagatttygyggatyggaggagggataggattttygagttttgggggygggaagggagggtggaaggaggaggggagyggggttggggaaagttggagtttyggtatttttttttygggttaggtygttttyggggttttgygttgygtttttaagtgttgggaagatttygyggggaaaggtttgaggaygyggtyggttggtataggtgtggyggttttagagggtyggggagaatttatggtttygaggttgtggattagaaatgtttttgattagaagttgagaatttttggttagggaggtggggyggyggggaggggtygttaagtyggtttagagygygtttatttgygttataagggagaagaggtgtttttygttttttttygtttatygtygttaygatgygtygyggatttyggygatttagttygggtagaagygygygttttttttttttagtttygtgygtyggtttttgtttygttagtttygttatggttttttatttattttygygggagygtttttgtttttttattttgtattttttttagagtygygygttagtttttygtttygtggaagygtttttttttygatttyggttgattttygttygtygtttttttygygggtgygygttyggtttttttttygttyggggygggtttgygtgggyggtgtttygggtyggygggyggagtttyggttttttagttttgygtttyggtggagttygagtyggagtyggtagaggggygygggygyggaygyggygtttggyggggttttgggaggttyggayggggttttggygttgagttyggtyggttyggagygyggatttagtygtaggggyggygatgggtatygagggattttygttttyggtygtttttygyggaygttagggttgtttgttggtatttgygygggtgagtgyggttttttagyg

SEQ ID NO: 7885 - DNA, 1812 bp, Artificial Sequence
  Description of Artificial Sequence: Synthetic polynucleotide
ygggyggyggaggagggttggyggttagatatagtatygttggagtttagagagtygggtagaggttggyggagagtygaggttggtttagtttttaggagatyggygagttggggtgtgtgggagygggatgtttttaaggygaaaagaagygttagtttygtaagyggtttttatttgggttgtttaggtyggatgtttaggagtttatagtaggggggatggagygaaggatygaggggttgggaggygaggtygtagygtattgaygtaggttagygaggtygttggtttygaygtagggygttyggtaaggtgtttggtattaygagagttaatttttgygygttattttyggaggttagtgygtttagggygygtyggttyggtaggagggtgggtgttagtttttttttttatttttygagtttttttttyggygtttaygtgggyggagtagygygagggtgtgygtggtaggggtygyggyggygtgtgtygtgygtggggtggggtgygggttgggyggtttygttttygggtttygygtygtyggggygyggtttttagttttattttttttgttatttgggyggagatttgggggattgtgatttattttgyggaagatayggaggggaygggtyggttatatttttygygttatttyggtaggtatygggtgggtttttttttygttttttggtttgagggyggaattyggagaagagtggaaataggggtggygtgaaggagagttgggggttgggggygggatygggagggggtgttgggggaagygaygtagyggttgggagattttgtaagggggtttgaagaggagtgggggatgggtatggaagggtgggggattattgaggtgggatgygagagtggaagggggatttagagggggygygatggtyggaggagggggagatggaygatggggyggggyggtatyggtygtygygttttttgtygttaggttygtttttyggtygtygggtttaygggttttttttggttagygttygtttttygtttttyggygtatttgtatttatttgttyggygtttaggttygagtygggtagtagtagyggaygtagygagygtagtttygygtygtatttttyggtygtttttttttygttgygagtttaygtygttgtygtygtygttatygttttaaaaaggataaaayggaatagaaaatgaatgtatgtataaaaaaaatygtaaaaagtaattgaggaggatggtagtygygygygyggttyggyggggygggagtygagaggtygyggtattggtggtygygattygggtaggyggtyggygygtgtygtaygygggtggttgtagttttttyggtygttygygttyggtttaggtayggtatygttttttttttyggggagttttttygattggtttgtttttttgttagttaggtaggagggygyggygttygtttygtttygttttygttttygttttgggtagatgtygggagtttttttgtygtygtgggagggggagttgagttgtyggagygtgygtattgggttagygggyggtyggggtagggttggggtttyggygttgagygtttttagtygygtygggtagtttggygtttygttgagtyggagtaattttyggtaggagtttttaggttttggttaagtttygggattygggaagttatttttgttttygggggttygagtttggagtggggtttgtaggtaaagyggggttggggtygttttggtygttagtggttaggaagaygtagygatttyg

SEQ ID NO: 7886 - DNA, 5819 bp, Artificial Sequence
  Description of Artificial Sequence: Synthetic polynucleotide
ygagtagaaggyggaygttttygagtygtaggttaygtagttgttatagttttgygattygttatagggatttttatagaygtttagygtygyggtygagttgagttygtggygygyggtggttagtagtyggttttygtagatygggtagtagatyggygtttgggtygaggyggygggttyggagttygttagygtgyggttttyggattygtagtaygtgtttagggagttggtggttattaagaattgtagagagaggtygygaggattggygggaagtygggttggaggttggggttttgggttttgttaatttygygygtygtttaygagggygtgtttygagtattttygggtttttygtygtttatattaggatgttygtttttttttattagtttgtgygygtttggtttttttygttaygtggggtttagtygagtatttatattttttttyggagggtttttaaggtttttgaygttatttgygygttaagtttttttttttaggggttttttggggttttaggatttttttggggtatagtttgagttttgtggtttaaatattagggaattygggttyggttygtyggatttttttagygtttyggttttttttygggggtttggggagtaggggttgggygtgaggggygygygatttaggttttgttagttyggaagtygtaggtagtygtaggtyggatattttttatttttygttttygttttattygttttatyggtatttgyggtggtttgggyggggyggggtttygtttatttggggagtygaggagtaggggtatttaaattgygggtaggatatggygggygyggttyggggyggaygggyggggtttgtagggttttgygygttggggtyggygtggygyggttattgtttyggagttgtaggtttttaggygttgggagggygaagtaggagagtyggttagtttattttygygtttygtaaatttttttaatygggtaataaagtgagtagyggtggtygtygygatttttttaatttygtatttyggaggttygagggggttttgggatygagyggtttygtagyggygatagaaatatatattttaygaaaaagaaaaaaaaaaaaaygagtygygygaattygttaagttagatgtgygyggtttgaagyggaggaggttttgaygttagttttatttygygtagttyggtttggtygtagattygtyggttattygtyggyggtttaggtygggaggggttaggatagtttyggtygygyggtggayggaggggttattttttygggygttagtaaataaattttattygagttaatatygtttagygaayggtgtttttttttagttattygagaaygagaggtatttttaattagaaattaattaatgagtagttgttttttttygttttattgtaattattygttttaattataaatgagatttatgaaaggataygttgaagatgtaattaatagttaaaattagttyggygttgygtaggyggtyggttyggtttygygttggygygttttgtttygagtggtaggaaggggttygtaggygtttygtaygygtttygttattattgtttaatygagaattagtaaygtttttygtyggtttttattttaygtyggaatggatttttagaatttattgyggtygtaagatagttygtaagagttggttaaaatgtttttaggtgygtgggggtttyggggttttagttggagttygatattttgagattggyggttygagggttgtagggtygtttygggygtgygtttatyggttttgtatttttgggtagtygagtgtygyggagaaygttttattttttttatygyggttttttaagttttygtttagtttatygtttttatttygttttttygattttttttttygatttttttttygtyggtygtgtttygtyggtttttttttgtttttygyggttaagtyggggattgtygggyggttttgygygttyggaagagtaggttttttaatttaggtttyggtttttttygttaagttygtttttttyggygtttygtagggttggttgygagggagggggygttgggtgtttggyggaggygtttttttttgtttattttgtttagttttttgtttggggygtayggagtaatyggaagaggggatygagygtttattttaggattttttyggttagtattttttttgggattttgtttaagtttaaagyggaggttagtgagtaggyggtaagggggyggtaagggggygttygggttatttygaattygtttttygttttttgygttatygtttttygggatygggattygtttyggttgttttygttttttgggtyggtttttygtggtaagttgggaaggaagtygtgtaaggtagygttgtgtagatttgtttagaaagatttttgggtttagatttgtgaatygttttagggttattttttaattaatgatgaygttttygttttttttttagttgtaagtttgttttttagaaaygaaatttgtttgtttttttgatagttyggttgaaggtgattgatgattatttggagattatagtatatattatataatatttgttgygtaattgttttaatttatagatgaaaataygagtttttygatygygttggatyggagygggttaygttygagttgtttgtagagggaaattatyggaaataatgaatagtygttttatgtaaattatttagatagtttagygtyggtagtygygagaaatatataaagaataygagttaaatgatattaataattgtttttgaattttgtattgatttygyggtaggtygygttttttttttttttatttgaatygttaatattatttttttgtaaataataagaaattagttatyggggtttttygttagaaatgaattttttaatttttttttttttttttttgtttttttttttttttatttttttttttttttttttttatttttttttttttttattttttgtagttttttggtttttttygagtatttttttattttttattatttattgtttataaattattygttttttttaggtaatgaggttyggttgaaggaggggtgtgagtttagtygggttaagggttgggatggggagtagagatttttagaggggaggtatttagttgtggtttgttttttttttatttatattyggggatttggtttyggygattgtgagtatttygtyggttgagggggagagttagggtttaggggtttagttatttatgttttgtatttttgggttttagtgtaatagtttagtttatttagatttgaggttggtgtatttttttttttttagattyggyggggtttaattggagtygaagttttagaataggyggttatttattttttgagtagagtttgggagaagtagtttttattttttagggtagttagtaygtgggggttttttygggggttttttttgattattatygttatttttttttgtttttttttgtttttttagtttgtgtgtataaatygaygttttagtttttattagygggygatttttttttygtgatttagaaatttggtttttgaatyggtttttttaggtygtygtatatataygttttattttttgttygttagtaggttttagygtttggggttygggtttagttatagttattttgtttygggaagttygtaattgtttaggaggttttttgattygttyggttttatttaggttttattatttattttaggatatagggttaatttagtttgtggattggygattatygggatattttattgaaattttgtagtttggtttaggttygtttgtttaaatyggggatttttattgggttattttttttttatagataatattggaatattttttaagtgtttttattaaaaggttaagtttggagyggaggtatttagtgttttttttattaaygataggaygtttagtattttaggtattagttgaaygygtttgtatagattyggagtgttgagtttttttttttttagggattttyggtattaaatatattygtgagtaggtgggttagaagttagtyggttttyggagtatatagtatyggtttagtttyggggagatgaggtgttttygttggtttggagygtttygaagagyggaggattagggtyggagtaggtygtaggggaggtaggggatggttagtttttaaygygaagygtaggygggtygtttattttgayggggttatygttggtygtyggaattatggaaggttttyggggagataggtygggttttgattttttttyggttagtttagttttggtgttttaggagttattttgggggttattagtttttygtattaagagttygttyggagggagttttttttagtttagagaagttaattttagttaaaggygaagtygggagttyggggtattaggtaagggtttttttttttgagatttggggttagagattttgggggygtttgtgttygtttatygttygggatattyggttggggtgtgggtttgagaggttttayggtygttgaygtygtattggygaatttygaggttggtaggttatttttttatagtttygaggttttttyggagttagtggtaggagaaggagttatagggataagyggtgaatttttggatttttaatygttttttatgggggttygyggtttttttttttttttttttygttgygttttygtygtttgttttttgggtayggtttgaggttggayggagygtygttygggygtttaggatttaggtttggttatttygagttttttatttttygtttygygtyggttygygtattttgtttttygtaatttgtagtaaaygtagyggtttttggagagtttagygaygggtagtaaattttgtttttttaagygtaagagtaattttygtaaagtttgtgyggyggagtttattttttatttgagttggggaagttttygttygygtygtgtggttgtyggggtygyggggagtagttygtagttygggaygtatyggggagtygtygtagtygtygtygttygtttttttyggyggtygygyggagttttygttttttyggaaggggggaggggtttyggaatttyggggygggggygggagygggggattttatttatttgyggtggygttgggtygttttyggtagttygygagggtttygygyggaagttyggygygygygttttagyggggagtyggygataattaatggagatatttttaggyggagtatttggygagyggagygygtyggygtttttaggygtygyggtygttagtygagttygtatyggygtgaygtgggygagygagygygttgtttttattyggtygtttattaaygttttttttygygggygtygygtttttgttaattttttttttygttyggtttgygygyggygygtygggtgtaggagttggggtgagggygtttygggtgttagtaggggygttgggagttgtttgggyggggaygtagggtttygggaggttatatagttttaataggatagtgggaaggygygygagttagatttggttaaaygttaagttygttgyggtttygggttttyggtttayggggttttttttttygtttgggttgttttatttagggaygtttgggtygggygygaagagttyggaaatagttatttttgtygtyggttyggttttttttyg

SEQ ID NO: 7887 - DNA, 2001 bp, Artificial Sequence
  Description of Artificial Sequence: Synthetic polynucleotide
yggaggttgtgtyggggttygttaaaggttataaataaatyggaygggtgggaagtaygttttagyggygattggatttttaaaaatttgttggtagagtgaaaataaaaattgttttttaagttggtaaaatyggygttttagayggtgygtaggagggttttgygaggtttgttttyggagtttygygttagttttgtaggttyggttgggttygtagttyggtgttttattygtgggtygggttyggttgyggggttttttygtagtygggatatttaggatagtagyggttggggagtyggggttaggggtttttttgtaattttaatgatttttattattattattygtaaaggataaaygyggttaaggtygggttttatagtggttgtgttggttatygygtggaggagtgtgygttaatttaggggygaggggggygygttyggtgtttyggggagagtttagaaggaagaygttttatygtggtttttatagttagggatagtttgggtgttagaaatttttagagagaattygaggggttgatgttttgggttattagtttttggtgtttgtggggttttttgygygtttatttttatttttttttttttttttaggttygayggattttttyggaggtttaggatagtgatttatagtaagtggtgatagtggaataaygtgatagttygttgtatttgttagttggtttttgggtaggtttattygtygggttygattttagagtygagttttyggagtygtygggtaaagttttttttttygtttyggtgtagtttygygtttttygygttyggygttgtyggggaaaagtggtataataggaaagtttygttagagggttttttttagtyggttttttygttataaaaagttagattttagtygaggttttgattttttttaaatataygtttttttgttygyggttygttattttygttygggtttygggttgtgtagtttttttttaggtttgttygggtttatgtttttttygaagyggygggagtyggtgtagttttaatttttattgygtgttttaggtygttaattagttttgttygygtgtygttggttyggaggttgtygygttagtttttgygtgygtttgagygygttggagtatttgygaggttagggttgtygayggygagaggatattttgaggaatayggtgttttagtttygttttygtttttygttygagttggaggttggggygygttgagtygtagygtttggataagtgygygggtyggagtygtttaggtttgtattygggggttygyggtygaygtatgygtaygygyggtggygggtttgtaggttygaaggttyggttttttttttaaattyggagyggggaagtttaggggttgagagtttyggttygggtygtaggagttggggagyggggaygygggtaggttaggtttttttatttgtygtyggggttttttttygtagtagtaaaggggttttagtgttygtggtagtgtatgttttagyggataygttggtttttaaatttagagattagaggggyggttgagaayggggygttygttgtgtgtgatttttgatygtggaggaagggygggagtygggagtaggyggtggggttyggggttaggtygyggtygtyggttttyggtaaaggygttttggtyggggaagggggygagggtgggyggtyggtttttgtygtygtagttatatttgggaygttgaaatgggttttggggatagagtttatttttagygygttttataggagaagttygtagtttaggtttgggtygtgtagatygttgggygggttyggggttygaggagagtaatayggygygaggtttagtygygagtaataatttygatagtayggtttttygaagaygtgtttygggtatyggggttgtgagygggggagtttygggttttgggttygtttggtayggggygggggyg

SEQ ID NO: 7888 - DNA, 1265 bp, Artificial Sequence
  Description of Artificial Sequence: Synthetic polynucleotide
yggygaggagggttgtaggtgaagygyggggagagggaggtygttygtttyggttttttttttaggggttttgyggttggttagygtttyggttgtattttttggtgygygtygyggyggygttataggtttttygattttttgattatygttttygggtygygygttyggtagtygggatyggtgatggygygggattgayggtygtttttttttagatttttttgtttygtttggggttygttggggttgyggygtygtttygagttgtatgtggggygggygygttygagtttagagygagyggttttyggygttttygaggyggtgtttygtygygttagagtaygaggaggagyggygggtygggttaggttttttaygygtygtagtttyggagtaygggtttttyggaggggatttggggygttttagtttaggaggaaggattyggaagtagaagyggagtygygagtygagtygagttattgttttygttgttygygggygtygggtgggggtttyggyggttggatgggtagyggyggygygggtygygggyggygatgggygaggagtagagtayggtgagyggyggyggygggttttaggagtygtagattttggttagtggtattgygggttattttgagttttygaggttttagggggatagygttygggygttttygttgygygtygttttygyggagtygagyggyggtggttgyggaagygattggggttgygyggatattagygttttagagttygygaggagtttggggttttygggttggagtaagagtygagtatyggygtagtttgygggattggtatttatygggttttttaatttttagattttgttattgtagttggagttggaggaggaagaggaggaagttggggatygaaaagagggaggggatgaatagtaggaggygtttttyggygaagagttggagtttaggattygygtgggggtygtygayggattggttttggaygtgttgggttagyggygttygtttttygttaagagataagttttttgtttygtgtattgygtggagagygatttgttygaggttttygtttyggagtagttttygtygttygygtygttatttggggtttygttagtgttgaatttttttagtattygtttttttttttttagttttygattgttttttttaayggattttttttttttygayggyggtagtatygagttggagttttatttggygttygagtyg

SEQ ID NO: 7889 - DNA, 1360 bp, Artificial Sequence
  Description of Artificial Sequence: Synthetic polynucleotide
ygttttygattttygtygttgggatttttygtygtagtttttgttttagtttgtgttgygggtggggtygggttgagtagttyggygttttttatygygttttttatygtatygttttygatttaatttygttttygggygtttattggtttgtagtattttttttttagtttgtgaagtgagtagggggaggyggtggtyggtygtttttttttagygtttagtttggtttygyggyggaggyggygtttttttygtaggayggagttaagttggattgtygygtygygyggggygggtaaagggggygttgygttyggtttygggtagggagtgayggyggyggyggyggtttygggygagygtggttttygygtgygtataygtataygtygtygygtagggatatayggatttyggtygttagtyggttatataggygyggagattyggttyggygygygtttttyggygtataygttttttattttygygtygygygggtygyggatttgtaggttgygygttttttgyggagtttgtttyggttttayggataggtttygtagtgagtaggtaagggtygtttygtygyggttgtttttttaygtttyggtygttttttttttttttagaattttygtttagtygggatttyggatttttttttttggtttggyggttttygttagtygygatttttatygayggagagygggygagggtyggygttaggtaagttttttagatttgaaatgaagttttttttygtygttgygttttttttgygygttaggttgatattttttaatttaagtgtttggygttgygttyggggyggtygatygtygtagattgtyggggtgggggtygatttagttattttaygttttttttgatgyggagaagggagattaggggggtaggtaagttatgyggtyggagggattyggagggatatgtttttttatttttaggtggayggaygtatttaygyggatygggaaggtagggttggagggtttttyggggttaggtatygtaattygtayggggtttgaggggtgggtaagtaatgtgttaggtgggggttggggtaggggttagtgtagaatgtttttttgtggtgatatattygggattgtttaaaagagtgtygttttygtttttygtggygyggaggggttggggttggggatgttagggttttagtggtttttagaagaaaygttttgyggggtttgtggggaaaygtatyggtttttttaggttgaagtgggttygttgagatttttgtttgtygttttagaggtagaagtttttgyggyggttgyggggggyggaggttatattttyggyg

SEQ ID NO: 7890 - DNA, 362 bp, Artificial Sequence
  Description of Artificial Sequence: Synthetic polynucleotide
ygtttagtayggygggtagygtygygttgygtatygtygtygattatgagygaggatagtygyggagatagtygygtygagagygttaaggatttggagaagtagtttygtttgygygtgtgygtgtttagygagttttagaagatygagygggattatgtgggtaygttggagtttttggtgtyggtgagtgttttyggtagaygtagggggaygttygggyggygyggggygygggtttyggagtggttgygggaaggaygygyggtattgtttgtgyggggattygggaygggtyggggtattataggygygggaatttaygtgtggattttgygttygygggygyggtgattttygyg

SEQ ID NO: 7891 - DNA, 2566 bp, Artificial Sequence
  Description of Artificial Sequence: Synthetic polynucleotide
cgttgggcgatgagggatcgttgggtaattgggggtataggatcgggtttcgttgggttcggggtagaagcgtcgaagtttcgattcggaacgcggtgattttattaacgtagaagttcgcgtagtcgagtagaggagtttttcgtaggcgattttcggatagacgtttttgcgcggttcgcgtggtttagtttcgttttaggaaatttttcgcgtagttttcgttttatgcgtttttatttagttttttttcggggtcgttttttttttaaagtagtttttcgggtttattgggcgttttcgtaatcgggtcggaatttcgaacggtttcgcgtgttattcggttattttggtaatattattcggcggcgttcggcggtttaattttagtttgcggtttttttcgagtttttcgtaaggtggggatcgggacgcgatcggggatggggaagggggttgtaggaggtttcgtttgcgttgtcgtttttgttgggtatagcgttttttattattcgcggcgatttcggttttcgtaaggtggggcggcgagtaggagtcggggttaggttaggggttcgagttttcgttcgaggggcggggaaggcgggtgacgtgagtcgggtcgggcgggcggagttgggatcggtttcgggaggcgggggcgagcgcgcggagaggtagacgcgaggagggaggcggttgagtagcgcgggcggttttgcggcgggcgcggtgggcgcgggcggcggggtttcgggattttcgcgcgtttttttcgcgcggcgtcgtcgtcgcgcgtttttacgtttcgcgttttacggcgttttcgtttcgcgcgtttttcgtgttcgttttttgttagttttcgggtcgcggtcgtttgtagagcgagcgtttagacggagttttcgggtaatttgagtggcgtcgatcggcggcggagtttttggtagagtttttcgattcggtagcgcggaggggattcgcgttcgttcgcgtcgcgttattttaaattttaagtagcgtcgttttatcggcgcggagtttcggttggaggtaagagtcgcgcgtcgggagatacgtatcgtgagcggtagcgtcgtcggttttttttttcgtcgtttcggagggcgaagtcgcggttttttagttttttgttgcgtcgcgatagcgtcggaatacgtttcgtttcgttgtcgttttcgttgtgtcgtcggcggagggggtcgcgagtttcgcgtttcggtcggaggatgtgcgttttcgcgggtcgtttagtttgagttatgcgttttaacggcggcggcgcgtcggtcggtatggagtttcgcgcggtcgcgttttgattcgttgtgcgtttcgcggtcggcgggcggcgggaggcggcggatcgagagtcggagatcggcgtcgcgggacggaagcgagcgggcgcgggcgtcgcgtagatggtttgggcgagttaggtttgaggtttcgtttttcgaaacgtgattatgtggatttaatagtttttaggatttaggtgagcgattcggtcggcgtcgggtgcgtgtgggcgcgtgggtgttaggttgggcggaagcggcgtttttttttatgttgtaaattaagggattttttttcgtttttcgtaagcgggtaacggggtgtatcggtagtcggaaaggggcgttcgttcggagtttggagtagtatcgcggttttggcggggagcggtcgggtttttagggtttcgcgcgttcggggtcggggtagcggcgttcgttttagtaattcgggaagtggggtcggttaggcgcgttcgtagttttaggagttagtagcgtagtgttttggtcggttgtttcggcgcgtttttttttcggggttcggggcgaggcgtcggtcgttgggcgcggcgggcgcgggggtcggggttgtcggggaaagttaaagtttcgggtttttagcgagagtttcgtaggcggagttggaggaaattatagttaaatagttatttcgttttttttttttttttttcggggtttcggggttgagtaggggttttttaggtttttagttgtcgatttagttgtttgcgggtgattttcgggttcgacgggcgtttatagttggcgggtagttggggcgggagagttggggtttttggggagtttcggcggttatttcgttgtaaatatatacgtatatacgttcgtcggcgcgttcggggtttgtttgtgtttgggattttagggttagatggaagagggggttcgagtttagagttcgtggtgggggtgtttagaaagatttttttcggtaaattttgttagttcgtcggggttttcgggtttttttggtttttgtttggggtggtttagggtttattagagtatagttgtcgtttttgttgggtaggttgtttttgagttttcgtttttttgtcggggtatttatcgagttcgtgtatttgggtttcgggttggaatcgcgagcggggaggatagaggtggaggcggagagtagcgtgcggttttcgagtttgtttattgggatgtattgcgttttcgcgttggggacg

SEQ ID NO: 7892 - DNA, 572 bp, Artificial Sequence
  Description of Artificial Sequence: Synthetic polynucleotide
cgtttaagaagtcggggttttttttggttacgcgttttcgggggcgttcgcgttttttaggttttggttgtttgggcgtcgattttcgggacgcgtcggtcgatagtaggggaggcggtagtagggatcgtagtagttttcgttttcgtacggttcgtcgggtcgcggtgagtaaggcgggtaggcgcggcgggaggcgttcgacgtttatttcgggtttggcgttttttttcggttattacgcggcgtcgtttttcgggattttttagttttcggagtttcgcgcgtttagagtcgttcggagcgcgggcggggttagtttgggtagtcgcgggtcgttgttgcgtcggaagttttcgtcgttagggagttttttgggcgttaggttttgggtttttgggcgaagtcgacgttagaatatgtttggtttcgtatttagtttatcgtatttttagcgcgcgtgggtggggggcgtcggttgaggtggggagggtatagtttagttttaggttatagtgtttcgggcggggtagcgcggtgcggggtgaacgttatcggttcggcggatagcg

SEQ ID NO: 7893 - DNA, 989 bp, Artificial Sequence
  Description of Artificial Sequence: Synthetic polynucleotide
cgtggtgtgtgtgtgcgcgcgcgagtgtgtgagcgttaggggtcgttcgttcgtcgcggtttttcgtgggttggtcgggttaatgagcgcgcggttgtaggggcggcgggcggggagggggcgtcgagttttgcggatggaggcgcgggtagcgcggcgcgtttatttcgcgcgggcgttgttggcggggggcggcgtagttattggattcggatcggggtcgcgattcggggtggcgggtggcgtgggcggcgttcggggttgggatgcgtcgggggtttagtggcggcggcggcgttggcggtggcgtcggcggttgtagggggacgagttagcgtcgcggcgttgggagttagttgagttcggtcggcgagcggaggcggtagcgtaggtagagcggcggcggtagcgggagttcgagcgttgcgcgtttattatggtcgtttagggagagttcggttatttggcggcgtagtcggatttcggttttaatagcgagcgtagtatcgattttttagtgttcggtttcgaggacgatttggtcgtcggggcgattttgtatagttcggagtggagcgaggagcgttttcgcgtggataggaagaaatttgaggttatgttataaggtaggtatttttcgtgttttcggatttttcgattgagtttttaattttttttcggatatttttatcgcgcgtttcggcgttcgttattttagtttacggtcggtcggtttagttttaggttcgttttttcgcggagtcggaggatatttagggattggagatttcgcgggattttttatttttttacgttttttagatttttaggcgttgggggttttgtgcgaatttgattggttttagaaaagtcgaaggtcgagtttgtattggcgcgtttaagttgcgttttggattttggagatgttaattttagttcggatatttgggttgtgttattcggattattcgggtcgtatagagtatgcg

SEQ ID NO: 7894 - DNA, 2400 bp, Artificial Sequence
  Description of Artificial Sequence: Synthetic polynucleotide
cgaaggtgtcgttagttttagtgtcggtgggcgtttgtattaggaatagttaaagtcgacgatatttagttatttcgagcgttagggaagacgtttcgcgtaaaatcgcggttttaggcggattttcgttttagtttcgcgttgttggtggtattttcggggatttaaagtgggtggtttgggggtaaaggaatagaggtcgaagaatttggggtatgttttattagagtatttaagggacggagtgggaggttatattagatatgcgatttcgatatattttaaaagtggtagtttcgtgggttatttttaatagtgggatggatttttttaatttttttcgtttttcgaagtttttttgttatttcgggttatgtttttttttcgggatttttttgtgtaaaattatttttttttttgtttaaaggattttttttttttttttgattttacgaatttatttttttaataggtttttaaagtatgggcggatgtgttttttttcgtttatcgttaggagtcgagtttcggtaggtgagcggtgtaaaatacgtatttagttgtttttagtttttttcgttttcgttgagttggttgtttttatttcgtattacggtattcgagtttgtgagttttcgatttcggttttagtcgtagtcgttaataattttataataaataagaggataggattgagcgttcgcgtttcggagcgtattggttgggggtaattttttattttcggcgcgtcgttcgttgtttcgattcgagagtatcgggagagtcgagggaagggaaggcggcgaggggaaggtaggcggggatggagggaggtacggcgcggcgcggagcgaggaggtgggttgtaggggacgtcgagaagcggtggggttggcgtagagggcgggcgttcggggcgcgcgttattttcgttttgttttcgtagtggtagtatacggtttataggtatttgagcgttcgttagagtaagatgatgaagaggttttcgaagaaagttattatggaggaggttaggaaagtttattatatgcgttggtttcggttgtcgtacggtatttttatggttatcgggatgatgagcgtatttattttgggttcgtggattgaggacgaggaggaagaggaggaggaagaagaagaagaggaagaggaggaggaggaggaggaggacgcgtttaggttgagatggttcgcgtggatattgttatttattttaagattgttgttttcgtcgtcgtcgtcgtcgtcgttgttgtcgtcgtcgtcgtcgttattatttgttatagttagtaacgggtagtcggcgtaggggttcgggggagtttttttcgtcgttagcgttattttaaatatttattaatagttatattgttgttattgttgtcgtcgtcgtcgtcgtcgtggagcgcgggaggggggcggggaggcgtttgggttcggggcgttgtgcgcgatttggcggggtgcgtcgagatatatatagcgagtcgtcgtcgttcgttcgggggggagggggatggagtgcgcgggtagtttttttttttcggttcgcgtttcgttcgtttcgggttgcgttggtttcgagcgtcgagagttagggggcgtcgcgggtcgttcgcgttcggggtttgcgtcgttttcgggttcgtttcggtttcgcgcgcggtttcgggtgttttcggcgtcgcgtcgttcgtcgtgcgttacgggtgtgcgttgcgttcggtcggtgattttttttttcgagcgtttttcgcgcggttaacgagtcgtttttcgtttattaggtggtaattcgttaataatggataatcggtttttttcgttcgggcgtttttgcgttagtttttttttttcggttgcgttcggtttcggttcgtcgcgttagtgcgcgttcggtcgcggtaggtttatcgcgttcggtcgtcggttcgtggtcgtttgttagtttatgttttcgggattttttagttttgtcgttacgtcgttgagtttttcggttttcgttcgttttttttttttgtcgttttcgattttttttcgttttcgttttcgtcgtttaagttttttcggcgcgcgtttcgcgtttttcgtagtcgttagtagtagtagttgtagtaattggagcgggcgcggatttaggacgatttaggcgggaggggaggaggttcgtcgcgttggttcgtttgggtttcgggttgggtaggggtgggtagggtttttcggtagcggttcggtaagcgtttttgatttttagggcgtaaggtagagcgtttttagtttaggcgcggggttaggcgtttttttttaaggtgttgcgtttttagtcgagagcggtggggtatattgggaggacggcggggcgtttcggttaggtcg

SEQ ID NO: 7895 - DNA, 1859 bp, Artificial Sequence
  Description of Artificial Sequence: Synthetic polynucleotide
cgcgatgttagttacggttcgcggcggttacggagttattttagtatttcgcgatggatagtgattttcggcgtggcgcgagttttttgcggtttttacgcgggtttgggcggcgggtttttttacggtttcgtttagatattcggaggtatttgttaaagttgcggaggtggacgatcgggcgtttaagtacgaattttttcgtcgaggtacggttgtcgggtttcgttttgagggtttggggcggcgaggatcgtcggggaggagggcgcgcgagtcggaggttagagtcgggtcgggtagggcgcgtttaggagtaggggagacggcgattcgggtcgaggcgggacggggatacgttatttgttcgtggagcgcggggaaggggtgcgcggcggcggcggcggcggagtttggcgtagagggtagcggtagtagcgggagtatcggttcgttcggggtcggttagtcggggagatcggggagtagcggggtcgcgggcggcggggtcgaggcgagtagtatcgggggaattacgattttcgcgttgagtcggagtagttcggtcgagttcggtattatttagatttagggcggcggcggcggcggttttgcgtttatcggttagaggagaggttgtcgtcgtcggggttgttgttgttgtagttgtcgtcgtcgtcgttggaatttggcgttcgtttgtattttatattttcgcgttgacggcggcggcgggggcggcgggcgttcgagatgttgggtcggcggcggcgcggtttcggagcgaatttatttggtttcgcggcgcggtcgttcgtttcgtttttgtttcgcgcgggaagtttttttttttttcgttcgcgtcgtcgtcgttttcggattcggttttcgtttcggttttcgttcgttcgcgttttttttcgtcggatttcgtttcgttttcgcgtttttcggttttggtcggggtttttttttcgttgcgtttttggattcgggcggtcgcggaggacgtgggtgggagagggtcgagggcgcgttcggttgggttttcgtcgatgtcggttttttggtggtttttggttttttgggatttagcgtatcgcgagggaggtttcgggtttcgtatttaagggtaagcggaagtcgaggtggcggcgtcggagttaggtatgtttcgttgtttagcgcggggttgagggcgtagacggggatcgcgcgagtcgttttttatttggttttttcggagtttagggcgcggagggtattgggttgcggattcggcgtaggcggtttcggacgttgttaggcgcgggcggatttttgttgtataaatgggttaaataggttcgtaaggttttcgcgggttttttggttcggaagttgagtcgcgggtgtttggtttgaagtttcgcgttttatagtggttcgcgggtttcggcggtttttgttttacgttttttaaggtattaggtaggtggttttagggtttttgtttacgatattttttgggtggggtaggattatttttttgtgaattcgttttggatgtttttaggtatagtttgtattttttttttttttagtatacgcggtttttgacgttgtacgtcgagttttttgggatttaggacgaatcgggttttaaggattttcgtttcgttcggattatacgtaggtagcgtcggtcgagtcgagtttgggttcgtattggttacgcgtagttatcgttagacggcgttagttttttttcgttgtagattttgtttcggaggtcgttagttttttttttatttcgggtttatagttttagtgtagtttttggcgacgcgcgttgatagttgggtagagattttcgtgcg

SEQ ID NO: 7896 - DNA, 902 bp, Artificial Sequence
  Description of Artificial Sequence: Synthetic polynucleotide
cgattttagaattcgttttttatttcgagttcgtttttcgtcgttttttcgtttttgggagggcggttttattaattttcgcgattcgggtcgtttttggcggttttgatttcgttatttcgtttcgcggcgggggtttgggggtgaggggcgcgttttggggtagaggattgcgcggtagggtttgttatagggtagaggttagggtttttcgggaaaaaggtaggcgtatatatgtttttttttttgggaaaagacggggaggggggttttttttgggagattttaggtttcgaaatttttcgttttttatttttcggttttcgtattttttttttttttcgttacgtatttttttttttttttagttatttgttttatttcgtagcgtcgcgataaatacggttttagttcgttttcgtttttgtttagttttttttttaagtttcggggagtgggggagtgagtagacgttttttttttaggaggtcggaatttttgtttttattttttatcggggttcggttggttagaggtaagtttcgagattttttattaattattattatcgttgcgagggtcggtgaggttgtagataacgtttgtaaggacgggagtcggggagggtgtagggcgagtttaaaggacgggtagagtaagtttcgggaagaggtaggggttttttttttcgggtcgtcgtttttcgtattttcggagttagtcgtagttacgtagcgtcgtttgtcgggtatattaaggatttggcgcgtacgtggcgtttatttttattttcgggttcgtttttggttcgcgtttagtttttttagattattcgtaaattgaggatttcggatatagagtgtagagatttcggtaagtttattgaaagttagtcgaattcg

SEQ ID NO: 7897 - DNA, 2044 bp, Artificial Sequence
  Description of Artificial Sequence: Synthetic polynucleotide
cgaaacggtagaggtcggtagttcgcggtttacgtgtatttgtttagggaatcgttttagcgaaatttgattcggatcggaattttttcgtagtatagcggtcgtgtttatcggaatggaacgttataagttgttatttgtattttttttttagttttgatagggaatacgcgttgtttttacgtttatatcgatattcggatttttatttagttcggttagagttttaggggttagggattagtgtagggagaaggttttttattttagtttttaggatttttaattatagtttattcgtttttattttgttcggttttaggtttagtcgaatttatatgttttcgtagtgtcgagcgttattatttatagtcgttttttaaattgtgatttttatttgggagattcggaattatttaggattttggtgtggggggtagtattttttatatttgtttttcgaaaattgttatggagtagtcgcgtttcggcgggtaggtgagggggtcgagtttattagcgtcgtagtttcgttgtttattttttttagcgtcggttgtcgttttcgggtagatatcgtcggttttgattttggggttgatatcgttaaagggtagttagtgttcgtttaggttatttcgggaggtttaggggtacggcgaggggtcggggaaaggcgatcgtttattatagttcgcgcgtttagattgagggaggagtcgggttgtagaatcggcggcggatggagacgggagggaggttgcgaggtcgttcgaggagagattaaggttttagaaacggagaagcgggcgttttgcgggaggcggcggcgttgtcgttggtcgttaagggcgggaagtgttttgggatttttattaggggtcgcgagtttcgagcgttaaattttcgcggcgttcgtttagcgcgttgttgtggcgggcgcggagggcgcgcgtcggtagtgggggttgcggcggcggagggtacgggttttcgtttagcgtttttatttttttggtgtagttgtttttcgcgagtcgagatatttttgttagggaagaggagcgtttcggttgtttttttagagttttttgttggggggatatcgtttttatgaagaaaatttttaaataaattttagtttaggaggaggttatacgattatgttcgcgggttgtcggtcggaggggcgaggacgcgcgggcggaggcgcggttgtcgtgtttaggtagggagtcgagtttcgggtgttcgtcgcgcgtttttcgtcggggttatgtattttcgtttgcgttcgatatcgcgggttggaggcgagtgtagcggcgatagttcgttagcgtcgcggttcgtttcgtttcgggttcgtttttttcgtttcgggcgttttgcgtcggggttcgttttcgtagttttttttagtttttttttagtttgggtttttttagtttcgttttagtttgtggcgcgtttggcgggcgtttttttatatatgttagtatatcggttatcggttgattttttcggtttgtgatttcgcgtgggtgtagttcgtaggagtttatcggtttgtgttacgtacgggggtttttagtgtacggatacgcgtttttttcgttatttgtttatttttattagattttattttttttcgcgtcgtgttcgcggcggaaggcgtttttgtagcgcgtgtattcgcggagcggtggcgattttagtttgagtagaggagttgtagtgatttttgtttcgtttttagcggattgcggagggaattttttattttattttattggggatagggtggtacgtcgtagagtgtcgtagttgtataaatttggaagtttatagtatcgtttgattttttgtgtaatttcgaacgttagtttgttcgggtaattttgagtgggtttttgtagtcggttatgttagcggtttttgtatatttgtattcgcggttttcgttgtttgtaggttgtagagacgggggtattttaaacgtgaaagagtaatgaaggaaaatgtagatagagcgaggacgtcg

SEQ ID NO: 7898 - DNA, 1152 bp, Artificial Sequence
  Description of Artificial Sequence: Synthetic polynucleotide
cgtttttttcgtagagatcgttagttgaggttgtaatatttgtttcggtaaagcgttttcgtagttttttcggtttgttcgattcggtttttttcgtttttgtttcggttgcggtattattttttggagttacgtttcggcgagcgggggtcgcggagcgagggggtcgttgtgtcgttatttattcgagtcgttcgggttggtcgcgagtcgggattcgcgagggttggcgggttttggttttcgaggacgtagatatgtggtttgaattttcgtttttttagtcgttgtttttgtgtatttttttgggcgtttttagcgaatgcgagcggcgaggcgagggcgagcgcgtcgaggaagggcgggagaggcgcggagtttggtcgcgtcgcgttgcgtcgagcgtcgggtttttttcgcgagtttttcgggttcgcgcgcgcgttttttattgttttcgtttttcgcgcggcgcgtgttttttatttttcgtcgcgcgttttcgtattcgttcggttttacgcggcgcgcgtttgttttggcggtagcggcggcggcggcggcgcgttttttttcgaacgtcgtttttagggttgttggttgcgttttttattgtttcgcggttgttgttcggggtgggcggcgaggcgggggggaggtgtcggtttggtcgtcggggagggtttatcgttcgggcggatttttattgcgagagcgatgcgggtttaggcgcggcgcgcgggggttgtagggcgtttagtattgggggttgtcggcgcgcgggggtttttttttggtttttaggtattcgttgttgttgggcgtttttcgtattttcggttattatggatatttcgttttttcgtcgtttttttcgcgtatttcgggaggtcgtcggggcggtagtagcggcgcggtttcgcgggtgtttaggtgatcggttcggtagcggtagagtagtggtagtagtcgttattgtcgttgttattgcggtcgtcgtcgttggagagaggaggacgaggagggtaaggggtagaagtaggttttgttttgtttgttttagaggttatttcgggtttttttttattaattaagcgatttcgtgtttatttcgtaggagacgtttcggtagtttttaatttgtgtgcgtcg

SEQ ID NO: 7899 - DNA, 872 bp, Artificial Sequence
  Description of Artificial Sequence: Synthetic polynucleotide
cggagagttgttatcgatttttttaacgttttaagttttagttttgtcgttcgcgtttttttttttttttgggttataattttggttttttcgggtcggttttacgtagttgcgtaggagttcgcgggggaagatttttcgtggggatttcgagtacgacgtgcgattttaaatttttatattttttttgtcgtttcgtaggttatatgtatcgggagtcgggcggggtaggcgcggttcgtaaggattttcgcgatggagacgtaatattgtcgcgattgtatttggggtagtttcgtcgcgttttagtcgtttttcggtaggaagcgtaggtgtgtgagtcgattcggagcgagtcgcgttttcgggttagcgtgggtagggcgtcgtagtttgcgtagtttcgaggatttcgcgtcgttttttcgagttagggtttttaggagcgggtcgcgtaggagacgttagagggggttgttagcggttgttgggagaacgggttacggaaatagttttttttaaagtcggggttatcgtggggtgggcgagttcgtttttttaggtcgggggcgcggattagaggggacgtgtgtagacggtcgcggttagttttatttcgttcgggcggagacgtatagttggagttggagggtcgtcgttcgttgggtttttaggggtttgaacgtttaggggtcgcggcgagtttattcggagcgagttaggtgagtaggtcgttatggcgatgcggtttcggagagcgtacgtttgtcgcggtcggtatggaaacgttttcgttaggttcgggggcgtcgttgattggtcgatttaatagacgcgggtgggtagtttagtcgtatcgttaagttcggtcg

SEQ ID NO: 7900 - DNA, 1070 bp, Artificial Sequence
  Description of Artificial Sequence: Synthetic polynucleotide
cgagcggtggttcgatttcgggtgtggtaggaaggggtgtttcgcgttttagagttagtgttagtttttattttttcgggaagtcgagatttagggggaataggttttttagagtttagtttgtagggacgcggagggtaggagtcgtcggcgaggagtagttaatttgttatttttggcggttgtatttttcggcggttataggttgttcgatagcggattttagggttttcgcgacggtatttagagtgtttagaagggaggtcggggtcggggtgggtcgggaaaatcgagggagggaaggagtttggagaagtttcgtttaggcggggagggggcgattcggggcgtatttttcgattatgatttttatagattttggcgtcgtaatttgcgttttttgaggtcgaagatgcgtattttggagaagatatttattaggttgtcgttgtagagttcgcggtttttgttggggttgtttcgttttttgttggtagacggtcggttttagtgttgttttcgcgtttgtcgtttttggcggattaagtcgttagcgatggtcgcggttatggtggtttcgggaacgggttcggggagggagggcgcgggaggacggcgagtcgggggtatcggaggggaaggcggcggcgtagatcgtggttcgttttcggggtagaggagggggtgttaggcgggattggggagaggggaaggggggtttagttttgatcgggatttatcgtttttttcgcggggcgcggggttaggcgcgtagatgcgtttagggcgtagtcggacgatttcgggaagtcggacgtcgtggtcgtcgtcgtttggttacgttcgagtggagagcgggatcgcggttgcgggcgttgttggttatcgttcgtcgtaggaatttcggcgggggtcgttatcgttattcgcgttgttttttcgttttgttcggttttcgggcgggaggtagagtcggtcggcggtttttcgggcgtcggttggagggcgggtttcggtagggtttttgcgcgttcgtcggttcgggtcgcgttgggtaggatttagcgtcg

SEQ ID NO: 7901 - DNA, 395 bp, Artificial Sequence
  Description of Artificial Sequence: Synthetic polynucleotide
cgttgggaagggaaaaacggtttatatcgaattggatgtcggatggaaatttttttgcgttattagattgcgtttagtatagtagatggtacgagtacgtgcggcgtttagtttaggttttcggaggtagttgagttggaaatttcgacggaaagtatttataagtttttattttgcgttggtttattcgcgtgtacgtttattttttacgcgcgtttttggtttagaagcgtatagatgtttattgtttagagtcggtatcgttggggagatcgagcgatttgcgcggcgtatagtgcggcgttggtagggttttgggttttcggtcgggggttcgagcggttaagggatgggggtgggggcggggagagtggggggagggcgaaagatcgtcg

SEQ ID NO: 7902 - DNA, 265 bp, Artificial Sequence
  Description of Artificial Sequence: Synthetic polynucleotide
cggggatatttaggcgcggggtaggtgtaggggagggggcgcggggtaggggcgtaggggtcgtcgggttcgggttggaggtgttcgggtcgtgggagggagggagggaaggagggagggaggacggcgagggagggaggtaggggcgggcggcgggggatggggttagcggggaggtggaagcgatatttatcgttcgtattggtttttttggtgttgtcggttttagggggggtttttagcggtttttttcgcgagttcggcg

SEQ ID NO: 7903 - DNA, 1169 bp, Artificial Sequence
  Description of Artificial Sequence: Synthetic polynucleotide
cgggttggcgggtattgagttggggttattacgtttttttagagcgtttgcggaggtggcgaaggtttggagagtatacgaggcggaattcggatcgagtgagttttttgagtcgtttgcgtgggacgtagggagagggcgaataacgtttttaggcgttgaatgtaggggtaaggagttagcgagggtggttggagtaggttttgttagttgttattaagtttttttataggtttgggggtttggggttttttggaaagattttttcgtcgcgttgattagtacggggttcgttttcgtattttgaaggttgtcgcggtttttcgttatttataattaagtttaagattaaggttgtaagttgaggtcggggtattgataacgggaatgaagttataggggaagaggataattgggacgggttggatttatatttgatattcgggaaatttttagagcgtgtggtgtttttgttagcggtagttattggtggagttgaggttatcgttattgtcgtcgttggcgttttgtttttggaattttttagtaagatggtatttattgtttgttttttttcgattagtatttttagtcgcgttttttttttttcgggatacgtattagttatatattgtggggagaagatgggttatgtaaatgtaagttaacgcgtttttttagttatttttgtataatgtaataggaatagcgattcgcgcgtacgaatcgggtagtgtgcgcgtgtgtgtgttcgcgtgtgtgagcgcgtgtgttagcgtgcgttttcgcgcgggcgtgcgtttgggtggatttttgcgtggtttgggaggtaaatcgggcgtttttttaagtcgttttaatatgatttaggtttttaaatacgtgaaagcggtagatataatagggatgcgaaggaaataaaaaataattggggaagtggtgttaagttatttaggttttgaattgaggacgagtagtgcggtcgcgtttggggcgcgttcggaaattatttttagtttgtggcggttattgttttatttaaatttttttgcggggagagttgagcggatttttggggggttggttttgggttagttttaaatttttcggttgtatttcgcgtggttttatcgacggcgcgtttcggcgtagtttttggcgcgggttcg

SEQ ID NO: 7904 - DNA, 1743 bp, Artificial Sequence
  Description of Artificial Sequence: Synthetic polynucleotide
cggtgggtcgggggcgtggcgagattttgttttagtggagggagggtttatgtattgtcgagacgtcgattattagattttgattttgtcgtttttagaaaaattattggtagaagattcggattatggttaatttgtcggttataagtttttttaagaagcgttacgtttgggtgtagttggtagggtatattggtgagtagtggggcgggtgggcgggtgttcgcgacgggaaggggttgggcggcgttgacggatgtcggtttttagggagttttaaggcggcgggtattagcgggttgattttgaagcgttgttcggagtcggagcgttattgtttggcgcggttgatggttgacgcgttgcgcggttgcgtgtttgttttttacggcgtggtggagcgcgacggcgaaagttatttgtagttgtaggatttgttcgatggtttcgacggattttgtgtgttcgattgtaaaatgggcgttaggtatgcgtgttttgttaggtcggttggggggattaagtaggggttcggggtcgggatagttgtttgagggggattcggggcgagtgttcgaaggggttttcgtgtgcgtttttttatgttttggtcgttgtttgcgtttttataggatttatttagaggaggagttgattaaggttcgtgagcggtttaagttgcggaaggatatgtataagaaaatgttggcggtggattttgaagtttttacggaggaggagtacgcgtagcgcgtcgttattaagtcgcgttatatgtagtggcgggaaggtattagttttagtattattttcggttttcgtatcgagggtattaaggtgaggtaggcgcgtttcgttggtatcgtcgtagttttattgcgcgttgtttttttcgatttttcgttttcgtttcgtttgttttttcgtttttttttatcgtttcgtcgttttttgtaattgggaggtatcgttgttttacgttgtttttttttttattggcgggttcggggtttttgatatttttgttttatatttagaaagcggacggtttttgtagtatcgattttaagattacgcgaagtcgagagtaggtgtttcgcgtttttgaagagtttgtgtaaggagatgaggaagtgttggtgagagcgggattttaaattttgaggtgttggggagtttgaagtcgaggattgtttttgttatttggtttagtgttttcggttgtgtttttattatggtttttatcgcgttggttcgtaattgttttacgtttttttttttttgggttacgttgggcggggttttgggttttttttttggcggtatttgttaagtatagcgtgggtttcggttttttatcgttagtaggggtttatttggcgtttagttaatttgttttttttttttattttattttttgtagaggcggtatttgaatcgtttgtagtagattcgggatattttggaggtattcgagttttttaggaggtacgaggtaagcggcggttgttcgggtgttcgggtcgcgagggttagggcgggaattcggtaagggcgtttttgggtagggtcgcggtttgacggtgcggggttcgtaggtgatcggtagttcgtttttttttgtgtacgattattgttatcgcgtcggcgtgtggtttatcgatttcggtaagattacgttttttttcgatggttagattttggattatcggcggttttgggaggagggtaatcgcgaggacg

SEQ ID NO: 7905 - DNA, 2405 bp, Artificial Sequence
  Description of Artificial Sequence: Synthetic polynucleotide
cgtagcgttatagtcgcgattgcggcggcggcggcggcgtagggggcgggggaggagagaagcgtttatttcgtttcgttgttttcgtagtagttttggttttagtttcggcgtattagagcggtttttgggaatttttgggtttgttgtttcggcggtcgttagttgggagtttattatcgttcgatggtatcgaatcgattcgtgtagttttataattttagtttaatttcgaggagttagcgtagatcgtttttcgtttttagttgcggcgaggtaagggttggtagcgttcggacgttttcgttttgttttttttatgtttaagcgcggggaattatacgttttcggtgtagaatagacgatcggggttattagggttgggcggtgggagtgggggttgggagtattatttttggttggacgtgtgtttagatttatcgtttttggtttttaggattttatttttttttgtatttttaggtgtcggtttttttgtattcgttttttacggggttcgttcggcgaagggtagtcgtagtttatatttatttttcgtttttaatttttgttttttttgttcgtcgtagttattcgtttggttgggagtaagttttttttttcgttgagggtgtagagagcgtttagggcgttaagagtagaggggttaaagtttaagcgttattagttagtcgaaggttttgagtttttagggtcgcggtcgggacgtagggaggttaggacgcgacgttcgttttatttgtttttttagcggttttttggtcgatagcgtcggtttgggggagggcgcgcggtcgtagacgtagttttttagtaggtaaagtttcgagggtcgcgagttcgagtcgttttcgaagtagaagagtaggttttgtagtagcgcgaattatttggtttgttattttgtgttgttcgaatttcgtttgtttaggtagtttttgcgcgtgtcgtttttgcgcgttagtagttttagggacgcgacgtggttattatttagtcggatttttttttgtatggtgtttagaggttagcgagattttacgcgtttatatttttttcgcgtagtagtttttcgttcgtgcgcgttgcgcgttgtttttttttggcgttcgttcgttcgttttttttagtttttttttttttttaaatatttatattttaggatttggcgtcgagtcgcggttttttgaatttagatatattatttttcgttggaatttttttttcgtttcgtagagttttagtattcggaagatgtcgttcgattttttttcggtgtcgggtaaattgagggattggcgatttgcgcgttggcgaggggtaggcggagttatgtgacgtcgatttttcgaagagttcgttttagtagcgcggatagggatatacgtacgtagtttcgtcgaggcgtagagtcgcgcgtaggttgtaatttggtgttttttttttttttttagatatatatatacgtatacgtatacgtatatatttaaattttgttttttttttttttatttttttttttttttttcggatgttaaaaagtaaattagattaattttcgtttaatttaatgaaatttcgaaggttcgttatttcgggagtttgcgtttttgcgttttatcgcggcgtattgtagatttggggttaagtgttagttgttatttttttttttaaaggttcgttttttttttttattttatttttaatacgaggtggaaggaggaaggtgggtggcgaaatagagttgtaaaagcgtttagttttagtttttgtatagttagtcgggttatattgaattttagtattcggttgtattttcggcggtttttttagttatttgaggatagtatagggggtgagatggggtggtggttggtgaacgttggttattttattttatattattttattttgagagttgttataattatcggcgttatttttcgtgtattttgaggtttggttggcgagtcgttgttgggagttttttgtaaatattttttaaagtttgaaggcgggttttaaacgtaggcgtcggggattatgggagtttttaaatagttgcgttggcgtaatgatattttaatgatagatttttcgtttttatttttagtttttattcgtttatatagttatacggtatttattcgagaacgttatagcgttcgtatgttgtatcgggagggcgcgcgggtcgtcgggcgagtcgggagttggggcggggagcgcgtatcgttgtttgtcgtagagggtagcgagttcgtttcgattcggagtaagtcgcgtttggttcgggcgttttgtagcggggatgggtgttcgcgtagttttgtgaaggaaagatattattttttcgtacggaaattgcgtatatttttttttcg

SEQ ID NO: 7906 - DNA, 1920 bp, Artificial Sequence
  Description of Artificial Sequence: Synthetic polynucleotide
cgcggatttgggtttggcgtttattttatcgttaggattggatagaaaggttttggtcgaggttattaacggagaggttagagcggagtttttggtttagaatggaggtagtagcgagttttcggcggtttttaggagtattaaggtggaggcggtggaggagtcggaggcggtttttattttgggtttcggagagtttgggttttaggtttcgtcgcggacgtcgtcgtcgcgtagtttcgtttcggttagggttaaggtcgagttgtttagttttacgtcgggttttagttcggtgttcggcgagttgggtttggtcggggttttgtttttttcgtagtacgtgttcgggttcgacgcggcgtttttcgtttcggagattttggttaagatgttcgagttggtgtatagtcggttgtagtagggcgcgggcgcgggcgtcggcggcgcgtagatcgggttttttttcggggtttttaagggcgttacgtgtttcgagtgcgagattatttttagtaacgttaataattattacgtgtataagcgtttttattgtttaggtcgtcgtgcgttcgaggacgcgtttgtcgcgcgtaggtttaaggcgtttttcggttcggttcgcgcgtttttcggttagttcgtcgaattcgacgcgtcgcgttcgttttcgggtttcggagcgcgcgaggagggggttgggggcgcggttacgttcgaggacggcgcgggcggtcggggtagcgagggtagttagagttcgggtagtttcgtggacgacgcggaggacgattttagtcgtacgttgtgcgaggtttgtaatattcgttttagtcgttacgagatttatatcgtgtataagcggtattattgcgtttcgcgttacgattcgtcgtcgcgtcgatcggtcgcgttttcgggattttttgggtcggtcgcgttttcggttttttttttcgtcgcgtttgtgcgtacgcgtagacgtcgtaagttttacgagttgtacgcggtcggcgtttcgtttttttcgtcgttcggttacgttttcgcgttcgagtcgtcgcggttcggaagcggaagcggaagcggtttcggtttcgtttttgcgcgttcgttcggtttcgcggtcgacggttttatcgatttgagtaagaagtcgcggcgttcgtttttcggagtttcggtatcggcgttggtcgattattacgagtgtacggtttgtcgcgtgagtttttatagtttcgaggtttatttggcgtataagaagtattcgtgtttcgttgcgttatcgttcggcgcgttcggtttgttcgtcgtcgtttgtttttattgtttttcgaacggttcggtgcgcggggatttgttggagtattttcgtttggcgtacggtttgttgttcggcgcgtttttggtcggttcgggggtcgaggttcggacgtcggtcgatcgcggtttttcgttcgttttcgttttcgtcgttttttcgtagttcgggtttcgtggttttcgggacggtttcggttcggagttttaggagtcgtcgttcggttcgttttcgttttcggtcgtcgcgttcgaggtcgtgtcgttttcgtcggcgttttttttttattcggataagggcgtttagatttttagtaagggtacgtcggcgtcgttgtttaacggtaattatcggtattgtcgtttttgtaatattaagtttagtagtttgtttatttttatcgtttataagaagtattattgtttttcgtacgtcgtcgagtacgtgaagtgagcgtttatattatagtcgtagacgttttgtacgtttcgttgcgatgcggggagggggtcgtttttaggtcgtacggattgtcgtttttgggaatttcgttacgtataggtttcggcggagggggtcgtagggggtagcgttcg

SEQ ID NO: 7907 - DNA, 1403 bp, Artificial Sequence
  Description of Artificial Sequence: Synthetic polynucleotide
cgcggggttttcgggaatcgtcgtttttttttttcgttttcgcgttcgcgttttttttttcggggtttcggtttatttatttttggtgcggtttcgtcggatttaggagtttcggtcgttcgggttgcggggagggggcgtttcgggtcggttttagaagttattttgtaaagaggtagggggcgcggggtcgcgcggggcgagttcgggattcgcggggaagaagtttttcgggatcgcgtttcggtcgttcgagtttttcgcgttcgtcgttttttatttcggtcgggggtttatttgggagttcgttgttttcggttagtcgttcgcgtgtgtttagggttagtagtacgtataagtgttagcgtacggtcgtcgcgtttatgtttaatgcgggtttcgttgggcgtgcgggcgtgcggggcgcggggattcgatcgatcggtcgttttcgtaggcgttgttcgttgttcgtcgtttcgttatcgttcgggttttcgagtcgtttagttagttcggttgatgagttgatagcgcgcgtttattggttcgtggcgtcggaggggcggggcgtcgtttagggtcggttaatgggcgtcggttttcggtttttcgaggaagaggggggttcgggcgtcgtcggggggattttttttttggggcgggcggtaggtggggggtgtgggtttggtcggtcggttcgttaggcgcggggtttaggttaggttggggttgtttggaggttgcgtttttttttgttcgcggcgtttcggttttcgtcgtcgagagtggacgtttttttggggtaatttttttcggtttagaggtagtttcgggggcggggattttgcgaatcggggatttcgtgaggtcgttcgttattcgtgggtagtgaaacgcgttagcgcgtagagtagattcgtttgcgttgtcgtttgttggacgttttttgagtatttattggggatcgagtgcgggcgaggtagtagcgaaggaatcgggaggggaaatttcgtgaagattatttgaaaattgacgtttaaaataaacgaattttttagtattcgttaaaggatagtggttcgttagtgtgtttgttacggggcggtcgtaggatttgcgtttggaatcgggcgggcgttcgggacggataatgtcgtttggcggtcggtttcgcgggaggttttcgtacggggttaatttcggtcggcgaagttcgttgttcggaatgcgaggtcgaggtttttttttgtgatagatcgggcggggttaggaggaggggtagggcgggtatttcggttcgaagatttaggaattgttttggtttggtttggggtttatatttgacgtttggcgagggttggtttcgggtttggttttatcgggtttgggagggacgggcg

SEQ ID NO: 7908 - DNA, 1088 bp, Artificial Sequence
  Description of Artificial Sequence: Synthetic polynucleotide
cgggaaacgtcgttttttttggcgtttgagatttggggttttttttttatttggttttttcgttttcgttttagtttcgtgcgttttaggagggtatcgtcgagcgtcgggttttcgtagggttcgggagatttcgcggatcggaggagggataggattttcgagttttgggggcgggaagggagggtggaaggaggaggggagcggggttggggaaagttggagtttcggtatttttttttcgggttaggtcgttttcggggttttgcgttgcgtttttaagtgttgggaagatttcgcggggaaaggtttgaggacgcggtcggttggtataggtgtggcggttttagagggtcggggagaatttatggtttcgaggttgtggattagaaatgtttttgattagaagttgagaatttttggttagggaggtggggcggcggggaggggtcgttaagtcggtttagagcgcgtttatttgcgttataagggagaagaggtgtttttcgttttttttcgtttatcgtcgttacgatgcgtcgcggatttcggcgatttagttcgggtagaagcgcgcgttttttttttttagtttcgtgcgtcggtttttgtttcgttagtttcgttatggttttttatttattttcgcgggagcgtttttgtttttttattttgtattttttttagagtcgcgcgttagtttttcgtttcgtggaagcgtttttttttcgatttcggttgattttcgttcgtcgtttttttcgcgggtgcgcgttcggtttttttttcgttcggggcgggtttgcgtgggcggtgtttcgggtcggcgggcggagtttcggttttttagttttgcgtttcggtggagttcgagtcggagtcggtagaggggcgcgggcgcggacgcggcgtttggcggggttttgggaggttcggacggggttttggcgttgagttcggtcggttcggagcgcggatttagtcgtaggggcggcgatgggtatcgagggattttcgttttcggtcgtttttcgcggacgttagggttgtttgttggtatttgcgcgggtgagtgcggttttttagcg

SEQ ID NO: 7909 - DNA, 1812 bp, Artificial Sequence
  Description of Artificial Sequence: Synthetic polynucleotide
cgggcggcggaggagggttggcggttagatatagtatcgttggagtttagagagtcgggtagaggttggcggagagtcgaggttggtttagtttttaggagatcggcgagttggggtgtgtgggagcgggatgtttttaaggcgaaaagaagcgttagtttcgtaagcggtttttatttgggttgtttaggtcggatgtttaggagtttatagtaggggggatggagcgaaggatcgaggggttgggaggcgaggtcgtagcgtattgacgtaggttagcgaggtcgttggtttcgacgtagggcgttcggtaaggtgtttggtattacgagagttaatttttgcgcgttattttcggaggttagtgcgtttagggcgcgtcggttcggtaggagggtgggtgttagtttttttttttatttttcgagtttttttttcggcgtttacgtgggcggagtagcgcgagggtgtgcgtggtaggggtcgcggcggcgtgtgtcgtgcgtggggtggggtgcgggttgggcggtttcgttttcgggtttcgcgtcgtcggggcgcggtttttagttttattttttttgttatttgggcggagatttgggggattgtgatttattttgcggaagatacggaggggacgggtcggttatatttttcgcgttatttcggtaggtatcgggtgggtttttttttcgttttttggtttgagggcggaattcggagaagagtggaaataggggtggcgtgaaggagagttgggggttgggggcgggatcgggagggggtgttgggggaagcgacgtagcggttgggagattttgtaagggggtttgaagaggagtgggggatgggtatggaagggtgggggattattgaggtgggatgcgagagtggaagggggatttagagggggcgcgatggtcggaggagggggagatggacgatggggcggggcggtatcggtcgtcgcgttttttgtcgttaggttcgtttttcggtcgtcgggtttacgggttttttttggttagcgttcgtttttcgtttttcggcgtatttgtatttatttgttcggcgtttaggttcgagtcgggtagtagtagcggacgtagcgagcgtagtttcgcgtcgtatttttcggtcgtttttttttcgttgcgagtttacgtcgttgtcgtcgtcgttatcgttttaaaaaggataaaacggaatagaaaatgaatgtatgtataaaaaaaatcgtaaaaagtaattgaggaggatggtagtcgcgcgcgcggttcggcggggcgggagtcgagaggtcgcggtattggtggtcgcgattcgggtaggcggtcggcgcgtgtcgtacgcgggtggttgtagttttttcggtcgttcgcgttcggtttaggtacggtatcgttttttttttcggggagttttttcgattggtttgtttttttgttagttaggtaggagggcgcggcgttcgtttcgtttcgttttcgttttcgttttgggtagatgtcgggagtttttttgtcgtcgtgggagggggagttgagttgtcggagcgtgcgtattgggttagcgggcggtcggggtagggttggggtttcggcgttgagcgtttttagtcgcgtcgggtagtttggcgtttcgttgagtcggagtaattttcggtaggagtttttaggttttggttaagtttcgggattcgggaagttatttttgttttcgggggttcgagtttggagtggggtttgtaggtaaagcggggttggggtcgttttggtcgttagtggttaggaagacgtagcgatttcg

SEQ ID NO: 7910 - DNA, 5819 bp, Artificial Sequence
  Description of Artificial Sequence: Synthetic polynucleotide
cgagtagaaggcggacgttttcgagtcgtaggttacgtagttgttatagttttgcgattcgttatagggatttttatagacgtttagcgtcgcggtcgagttgagttcgtggcgcgcggtggttagtagtcggttttcgtagatcgggtagtagatcggcgtttgggtcgaggcggcgggttcggagttcgttagcgtgcggttttcggattcgtagtacgtgtttagggagttggtggttattaagaattgtagagagaggtcgcgaggattggcgggaagtcgggttggaggttggggttttgggttttgttaatttcgcgcgtcgtttacgagggcgtgtttcgagtattttcgggtttttcgtcgtttatattaggatgttcgtttttttttattagtttgtgcgcgtttggtttttttcgttacgtggggtttagtcgagtatttatattttttttcggagggtttttaaggtttttgacgttatttgcgcgttaagtttttttttttaggggttttttggggttttaggatttttttggggtatagtttgagttttgtggtttaaatattagggaattcgggttcggttcgtcggatttttttagcgtttcggttttttttcgggggtttggggagtaggggttgggcgtgaggggcgcgcgatttaggttttgttagttcggaagtcgtaggtagtcgtaggtcggatattttttatttttcgttttcgttttattcgttttatcggtatttgcggtggtttgggcggggcggggtttcgtttatttggggagtcgaggagtaggggtatttaaattgcgggtaggatatggcgggcgcggttcggggcggacgggcggggtttgtagggttttgcgcgttggggtcggcgtggcgcggttattgtttcggagttgtaggtttttaggcgttgggagggcgaagtaggagagtcggttagtttattttcgcgtttcgtaaatttttttaatcgggtaataaagtgagtagcggtggtcgtcgcgatttttttaatttcgtatttcggaggttcgagggggttttgggatcgagcggtttcgtagcggcgatagaaatatatattttacgaaaaagaaaaaaaaaaaaacgagtcgcgcgaattcgttaagttagatgtgcgcggtttgaagcggaggaggttttgacgttagttttatttcgcgtagttcggtttggtcgtagattcgtcggttattcgtcggcggtttaggtcgggaggggttaggatagtttcggtcgcgcggtggacggaggggttattttttcgggcgttagtaaataaattttattcgagttaatatcgtttagcgaacggtgtttttttttagttattcgagaacgagaggtatttttaattagaaattaattaatgagtagttgttttttttcgttttattgtaattattcgttttaattataaatgagatttatgaaaggatacgttgaagatgtaattaatagttaaaattagttcggcgttgcgtaggcggtcggttcggtttcgcgttggcgcgttttgtttcgagtggtaggaaggggttcgtaggcgtttcgtacgcgtttcgttattattgtttaatcgagaattagtaacgtttttcgtcggtttttattttacgtcggaatggatttttagaatttattgcggtcgtaagatagttcgtaagagttggttaaaatgtttttaggtgcgtgggggtttcggggttttagttggagttcgatattttgagattggcggttcgagggttgtagggtcgtttcgggcgtgcgtttatcggttttgtatttttgggtagtcgagtgtcgcggagaacgttttattttttttatcgcggttttttaagttttcgtttagtttatcgtttttatttcgttttttcgattttttttttcgatttttttttcgtcggtcgtgtttcgtcggtttttttttgtttttcgcggttaagtcggggattgtcgggcggttttgcgcgttcggaagagtaggttttttaatttaggtttcggtttttttcgttaagttcgtttttttcggcgtttcgtagggttggttgcgagggagggggcgttgggtgtttggcggaggcgtttttttttgtttattttgtttagttttttgtttggggcgtacggagtaatcggaagaggggatcgagcgtttattttaggattttttcggttagtattttttttgggattttgtttaagtttaaagcggaggttagtgagtaggcggtaagggggcggtaagggggcgttcgggttatttcgaattcgtttttcgttttttgcgttatcgtttttcgggatcgggattcgtttcggttgttttcgttttttgggtcggtttttcgtggtaagttgggaaggaagtcgtgtaaggtagcgttgtgtagatttgtttagaaagatttttgggtttagatttgtgaatcgttttagggttattttttaattaatgatgacgttttcgttttttttttagttgtaagtttgttttttagaaacgaaatttgtttgtttttttgatagttcggttgaaggtgattgatgattatttggagattatagtatatattatataatatttgttgcgtaattgttttaatttatagatgaaaatacgagtttttcgatcgcgttggatcggagcgggttacgttcgagttgtttgtagagggaaattatcggaaataatgaatagtcgttttatgtaaattatttagatagtttagcgtcggtagtcgcgagaaatatataaagaatacgagttaaatgatattaataattgtttttgaattttgtattgatttcgcggtaggtcgcgttttttttttttttatttgaatcgttaatattatttttttgtaaataataagaaattagttatcggggtttttcgttagaaatgaattttttaatttttttttttttttttttgtttttttttttttttatttttttttttttttttttttatttttttttttttttattttttgtagttttttggtttttttcgagtatttttttattttttattatttattgtttataaattattcgttttttttaggtaatgaggttcggttgaaggaggggtgtgagtttagtcgggttaagggttgggatggggagtagagatttttagaggggaggtatttagttgtggtttgttttttttttatttatattcggggatttggtttcggcgattgtgagtatttcgtcggttgagggggagagttagggtttaggggtttagttatttatgttttgtatttttgggttttagtgtaatagtttagtttatttagatttgaggttggtgtatttttttttttttagattcggcggggtttaattggagtcgaagttttagaataggcggttatttattttttgagtagagtttgggagaagtagtttttattttttagggtagttagtacgtgggggttttttcgggggttttttttgattattatcgttatttttttttgtttttttttgtttttttagtttgtgtgtataaatcgacgttttagtttttattagcgggcgatttttttttcgtgatttagaaatttggtttttgaatcggtttttttaggtcgtcgtatatatacgttttattttttgttcgttagtaggttttagcgtttggggttcgggtttagttatagttattttgtttcgggaagttcgtaattgtttaggaggttttttgattcgttcggttttatttaggttttattatttattttaggatatagggttaatttagtttgtggattggcgattatcgggatattttattgaaattttgtagtttggtttaggttcgtttgtttaaatcggggatttttattgggttattttttttttatagataatattggaatattttttaagtgtttttattaaaaggttaagtttggagcggaggtatttagtgttttttttattaacgataggacgtttagtattttaggtattagttgaacgcgtttgtatagattcggagtgttgagtttttttttttttagggattttcggtattaaatatattcgtgagtaggtgggttagaagttagtcggttttcggagtatatagtatcggtttagtttcggggagatgaggtgttttcgttggtttggagcgtttcgaagagcggaggattagggtcggagtaggtcgtaggggaggtaggggatggttagtttttaacgcgaagcgtaggcgggtcgtttattttgacggggttatcgttggtcgtcggaattatggaaggttttcggggagataggtcgggttttgattttttttcggttagtttagttttggtgttttaggagttattttgggggttattagtttttcgtattaagagttcgttcggagggagttttttttagtttagagaagttaattttagttaaaggcgaagtcgggagttcggggtattaggtaagggtttttttttttgagatttggggttagagattttgggggcgtttgtgttcgtttatcgttcgggatattcggttggggtgtgggtttgagaggttttacggtcgttgacgtcgtattggcgaatttcgaggttggtaggttatttttttatagtttcgaggttttttcggagttagtggtaggagaaggagttatagggataagcggtgaatttttggatttttaatcgttttttatgggggttcgcggtttttttttttttttttttcgttgcgttttcgtcgtttgttttttgggtacggtttgaggttggacggagcgtcgttcgggcgtttaggatttaggtttggttatttcgagttttttatttttcgtttcgcgtcggttcgcgtattttgtttttcgtaatttgtagtaaacgtagcggtttttggagagtttagcgacgggtagtaaattttgtttttttaagcgtaagagtaattttcgtaaagtttgtgcggcggagtttattttttatttgagttggggaagttttcgttcgcgtcgtgtggttgtcggggtcgcggggagtagttcgtagttcgggacgtatcggggagtcgtcgtagtcgtcgtcgttcgtttttttcggcggtcgcgcggagttttcgttttttcggaaggggggaggggtttcggaatttcggggcgggggcgggagcgggggattttatttatttgcggtggcgttgggtcgttttcggtagttcgcgagggtttcgcgcggaagttcggcgcgcgcgttttagcggggagtcggcgataattaatggagatatttttaggcggagtatttggcgagcggagcgcgtcggcgtttttaggcgtcgcggtcgttagtcgagttcgtatcggcgtgacgtgggcgagcgagcgcgttgtttttattcggtcgtttattaacgttttttttcgcgggcgtcgcgtttttgttaattttttttttcgttcggtttgcgcgcggcgcgtcgggtgtaggagttggggtgagggcgtttcgggtgttagtaggggcgttgggagttgtttgggcggggacgtagggtttcgggaggttatatagttttaataggatagtgggaaggcgcgcgagttagatttggttaaacgttaagttcgttgcggtttcgggttttcggtttacggggttttttttttcgtttgggttgttttatttagggacgtttgggtcgggcgcgaagagttcggaaatagttatttttgtcgtcggttcggttttttttcg

SEQ ID NO: 7911 - DNA, 2001 bp, Artificial Sequence
  Description of Artificial Sequence: Synthetic polynucleotide
cggaggttgtgtcggggttcgttaaaggttataaataaatcggacgggtgggaagtacgttttagcggcgattggatttttaaaaatttgttggtagagtgaaaataaaaattgttttttaagttggtaaaatcggcgttttagacggtgcgtaggagggttttgcgaggtttgttttcggagtttcgcgttagttttgtaggttcggttgggttcgtagttcggtgttttattcgtgggtcgggttcggttgcggggttttttcgtagtcgggatatttaggatagtagcggttggggagtcggggttaggggtttttttgtaattttaatgatttttattattattattcgtaaaggataaacgcggttaaggtcgggttttatagtggttgtgttggttatcgcgtggaggagtgtgcgttaatttaggggcgaggggggcgcgttcggtgtttcggggagagtttagaaggaagacgttttatcgtggtttttatagttagggatagtttgggtgttagaaatttttagagagaattcgaggggttgatgttttgggttattagtttttggtgtttgtggggttttttgcgcgtttatttttatttttttttttttttttaggttcgacggattttttcggaggtttaggatagtgatttatagtaagtggtgatagtggaataacgtgatagttcgttgtatttgttagttggtttttgggtaggtttattcgtcgggttcgattttagagtcgagttttcggagtcgtcgggtaaagttttttttttcgtttcggtgtagtttcgcgtttttcgcgttcggcgttgtcggggaaaagtggtataataggaaagtttcgttagagggttttttttagtcggttttttcgttataaaaagttagattttagtcgaggttttgattttttttaaatatacgtttttttgttcgcggttcgttattttcgttcgggtttcgggttgtgtagtttttttttaggtttgttcgggtttatgtttttttcgaagcggcgggagtcggtgtagttttaatttttattgcgtgttttaggtcgttaattagttttgttcgcgtgtcgttggttcggaggttgtcgcgttagtttttgcgtgcgtttgagcgcgttggagtatttgcgaggttagggttgtcgacggcgagaggatattttgaggaatacggtgttttagtttcgttttcgtttttcgttcgagttggaggttggggcgcgttgagtcgtagcgtttggataagtgcgcgggtcggagtcgtttaggtttgtattcgggggttcgcggtcgacgtatgcgtacgcgcggtggcgggtttgtaggttcgaaggttcggttttttttttaaattcggagcggggaagtttaggggttgagagtttcggttcgggtcgtaggagttggggagcggggacgcgggtaggttaggtttttttatttgtcgtcggggttttttttcgtagtagtaaaggggttttagtgttcgtggtagtgtatgttttagcggatacgttggtttttaaatttagagattagaggggcggttgagaacggggcgttcgttgtgtgtgatttttgatcgtggaggaagggcgggagtcgggagtaggcggtggggttcggggttaggtcgcggtcgtcggttttcggtaaaggcgttttggtcggggaagggggcgagggtgggcggtcggtttttgtcgtcgtagttatatttgggacgttgaaatgggttttggggatagagtttatttttagcgcgttttataggagaagttcgtagtttaggtttgggtcgtgtagatcgttgggcgggttcggggttcgaggagagtaatacggcgcgaggtttagtcgcgagtaataatttcgatagtacggtttttcgaagacgtgtttcgggtatcggggttgtgagcgggggagtttcgggttttgggttcgtttggtacggggcgggggcg

SEQ ID NO: 7912 - DNA, 1265 bp, Artificial Sequence
  Description of Artificial Sequence: Synthetic polynucleotide
cggcgaggagggttgtaggtgaagcgcggggagagggaggtcgttcgtttcggttttttttttaggggttttgcggttggttagcgtttcggttgtattttttggtgcgcgtcgcggcggcgttataggtttttcgattttttgattatcgttttcgggtcgcgcgttcggtagtcgggatcggtgatggcgcgggattgacggtcgtttttttttagatttttttgtttcgtttggggttcgttggggttgcggcgtcgtttcgagttgtatgtggggcgggcgcgttcgagtttagagcgagcggttttcggcgttttcgaggcggtgtttcgtcgcgttagagtacgaggaggagcggcgggtcgggttaggttttttacgcgtcgtagtttcggagtacgggtttttcggaggggatttggggcgttttagtttaggaggaaggattcggaagtagaagcggagtcgcgagtcgagtcgagttattgttttcgttgttcgcgggcgtcgggtgggggtttcggcggttggatgggtagcggcggcgcgggtcgcgggcggcgatgggcgaggagtagagtacggtgagcggcggcggcgggttttaggagtcgtagattttggttagtggtattgcgggttattttgagttttcgaggttttagggggatagcgttcgggcgttttcgttgcgcgtcgttttcgcggagtcgagcggcggtggttgcggaagcgattggggttgcgcggatattagcgttttagagttcgcgaggagtttggggttttcgggttggagtaagagtcgagtatcggcgtagtttgcgggattggtatttatcgggttttttaatttttagattttgttattgtagttggagttggaggaggaagaggaggaagttggggatcgaaaagagggaggggatgaatagtaggaggcgtttttcggcgaagagttggagtttaggattcgcgtgggggtcgtcgacggattggttttggacgtgttgggttagcggcgttcgtttttcgttaagagataagttttttgtttcgtgtattgcgtggagagcgatttgttcgaggttttcgtttcggagtagttttcgtcgttcgcgtcgttatttggggtttcgttagtgttgaatttttttagtattcgtttttttttttttagttttcgattgttttttttaacggattttttttttttcgacggcggtagtatcgagttggagttttatttggcgttcgagtcg

SEQ ID NO: 7913 - DNA, 1360 bp, Artificial Sequence
  Description of Artificial Sequence: Synthetic polynucleotide
cgttttcgattttcgtcgttgggatttttcgtcgtagtttttgttttagtttgtgttgcgggtggggtcgggttgagtagttcggcgttttttatcgcgttttttatcgtatcgttttcgatttaatttcgttttcgggcgtttattggtttgtagtattttttttttagtttgtgaagtgagtagggggaggcggtggtcggtcgtttttttttagcgtttagtttggtttcgcggcggaggcggcgtttttttcgtaggacggagttaagttggattgtcgcgtcgcgcggggcgggtaaagggggcgttgcgttcggtttcgggtagggagtgacggcggcggcggcggtttcgggcgagcgtggttttcgcgtgcgtatacgtatacgtcgtcgcgtagggatatacggatttcggtcgttagtcggttatataggcgcggagattcggttcggcgcgcgtttttcggcgtatacgttttttattttcgcgtcgcgcgggtcgcggatttgtaggttgcgcgttttttgcggagtttgtttcggttttacggataggtttcgtagtgagtaggtaagggtcgtttcgtcgcggttgtttttttacgtttcggtcgttttttttttttttagaattttcgtttagtcgggatttcggatttttttttttggtttggcggttttcgttagtcgcgatttttatcgacggagagcgggcgagggtcggcgttaggtaagttttttagatttgaaatgaagttttttttcgtcgttgcgttttttttgcgcgttaggttgatattttttaatttaagtgtttggcgttgcgttcggggcggtcgatcgtcgtagattgtcggggtgggggtcgatttagttattttacgttttttttgatgcggagaagggagattaggggggtaggtaagttatgcggtcggagggattcggagggatatgtttttttatttttaggtggacggacgtatttacgcggatcgggaaggtagggttggagggtttttcggggttaggtatcgtaattcgtacggggtttgaggggtgggtaagtaatgtgttaggtgggggttggggtaggggttagtgtagaatgtttttttgtggtgatatattcgggattgtttaaaagagtgtcgttttcgtttttcgtggcgcggaggggttggggttggggatgttagggttttagtggtttttagaagaaacgttttgcggggtttgtggggaaacgtatcggtttttttaggttgaagtgggttcgttgagatttttgtttgtcgttttagaggtagaagtttttgcggcggttgcggggggcggaggttatattttcggcg

SEQ ID NO: 7914 - DNA, 362 bp, Artificial Sequence
  Description of Artificial Sequence: Synthetic polynucleotide
cgtttagtacggcgggtagcgtcgcgttgcgtatcgtcgtcgattatgagcgaggatagtcgcggagatagtcgcgtcgagagcgttaaggatttggagaagtagtttcgtttgcgcgtgtgcgtgtttagcgagttttagaagatcgagcgggattatgtgggtacgttggagtttttggtgtcggtgagtgttttcggtagacgtagggggacgttcgggcggcgcggggcgcgggtttcggagtggttgcgggaaggacgcgcggtattgtttgtgcggggattcgggacgggtcggggtattataggcgcgggaatttacgtgtggattttgcgttcgcgggcgcggtgattttcgcg

SEQ ID NO: 7915 - DNA, 2566 bp, Artificial Sequence
  Description of Artificial Sequence: Synthetic polynucleotide
ygtttttaaygygggagygtagtgtattttagtggataaattygagaatygtaygttgtttttygtttttatttttgtttttttygttygyggttttaattygggatttaaatgtaygagttyggtgaatgtttyggtaggagggygagggtttagaggtagtttgtttagtaaaaaygatagttgtgttttggtgggttttgggttattttaggtagaagttagagaagttygagaatttyggygggttggtaaagtttgtygagaagggtttttttggatatttttattaygggttttaggttygaatttttttttttatttggttttggagttttagatatagataagtttygggygygtyggygggygtatgtgygtgtgtgtttatagyggggtggtygtyggagttttttaagaattttagttttttygttttagttgttygttagttgtgagygttygtygggttyggaggttattygtaaatagttgggtyggtagttgggagtttgggaggtttttgtttagtttyggggtttygagaaaggagaagggggagyggagtggttgtttggttgtggttttttttaatttygtttgygaagttttygttgggagttyggagttttagtttttttyggtagtttyggttttygygttygtygygtttagyggtyggygtttygtttygggtttyggggaggaggygygtyggggtagtyggttaggatattgygttgttggtttttagagttgygggygygtttggtyggttttatttttygggttgttggggygggygtygttgtttygatttyggaygygyggaattttggagattyggtygtttttygttagggtygyggtgttgttttaggtttygggygggygttttttttyggttatyggtgtatttygttgttygtttgygggaagygaagaggggttttttgatttgtaatatagaggaaagygtygttttygtttagtttggtatttaygygtttataygtattyggygtyggtygggtygtttatttgagttttaaaagttgttgaatttatatggttaygtttyggggagyggggttttagatttggttygtttaggttatttgygyggygttygygttygttygttttygtttygyggygtyggttttyggttttyggttygtygtttttygtygttygtyggtygyggggygtatagygagttagagygyggtygygyggggttttatgtyggtyggygygtygtygtygttggggygtatggtttaggttgggyggttygygggggygtatatttttyggtyggggygyggggttygyggtttttttygtyggyggtatagygaaggyggtagygaggyggggygtgtttyggygttgtygyggygtagtaaagggttggggagtygyggtttygtttttyggggyggygaggagggaggtyggyggygttgtygtttayggtgygtgtttttyggygygyggtttttgtttttagtyggagtttygygtygatggggyggygttgtttagggtttggggtgaygygaygyggayggaygygagtttttttygygttgtygggtyggggggttttgttagaggtttygtygtygatyggygttatttaagttgttygggggtttygtttgagygttygttttgtagayggtygyggttyggagattggtaggaggygggtaygagaggygygyggggygagggygtygtggagygyggggygtggggaygygyggyggyggygtygygyggaggaggygygyggggatttyggggtttygtygttygygtttatygygttygtygtagagtygttygygttgtttagtygttttttttttygygtttgttttttygygygttygttttygtttttyggagtyggttttaatttygttygttyggttyggtttaygttattygtttttttygtttttygaaygggagttygagtttttggtttggtttyggtttttgttygtygttttattttgygggggtyggggtygtygygggtggtggggggygttgtgtttagtaggggygatagygtaggyggggttttttgtagtttttttttttattttyggtygygtttyggtttttattttgygaaaggttygagagaggtygtaggttaggattggatygtygggygtygtyggatggtgttgttagggtaatyggatggtaygygaagtygttygaggtttygattyggttaygggggygtttagtggattyggagagttattttggggagggggyggtttygaagaaggattgggtgggggygtatggagygggggttgygygaaaagttttttggggyggagttgagttaygygggtygygtaggagygtttgttygagggtygtttaygagggatttttttgttyggttgygygggtttttgygttgatgaagttatygygtttygggtyggagtttyggygtttttgtttygaatttagygaagttyggttttatgtttttaattatttaayggttttttatygtttagyg

SEQ ID NO: 7916 - DNA, 572 bp, Artificial Sequence
  Description of Artificial Sequence: Synthetic polynucleotide
ygttgttygtygggtyggtggygtttatttygtatygygttgtttygttyggggtattatggtttggggttggattatgttttttttattttagtyggygttttttatttaygygygttgagggtgyggtgagttgagtgyggggttaagtatgttttggygtygatttygtttaggggtttaggatttggygtttaaggggttttttggygayggagattttygaygtagtagygattygyggttgtttaagttgatttygttygygtttygagyggttttgggygygyggggtttyggggattggaggatttyggggggyggygtygygtggtggtyggaaggggaygttaagttyggggtgggygtyggaygtttttygtygygtttgttygttttgtttatygygattyggygggtygtgyggaagygggggttgttgyggtttttgttgtygttttttttgttgtyggtyggygygtttygggaatyggygtttaggtagttagggtttggagagygygagygttttyggaggygygtggttagggaggatttygattttttgggyg

SEQ ID NO: 7917 - DNA, 989 bp, Artificial Sequence
  Description of Artificial Sequence: Synthetic polynucleotide
ygtatattttgtgyggttygagtggttyggatggtatagtttaggtgttygggttaaagttggtatttttaaagtttagaaygtaatttgggygygttagtataaattyggttttyggtttttttgaagttagttaagttygtatagggtttttagygtttggaaatttgagaggygtggaagggtggggagtttygygaagtttttagtttttgggtgtttttyggtttygygggggagygggtttggagttaaatyggtyggtygtaggttggagtagygggygtyggagygygyggtggggatgttygaaaaggagttagaggtttagtyggagagttygagaataygagggatgtttattttgtaatatggttttaagtttttttttgtttaygyggaagygtttttygttttatttygggttgtgtagggtygtttyggygattaagtygttttyggagtygggtattggggagtyggtgttgygttygttgttggagtyggggttygattgygtygttaggtagtygggttttttttgggyggttatggtgggygygtagygttygggttttygttgtygtygtygttttgtttgygttgtygttttygttygtyggtygggtttaattggtttttagygtygyggygttagttygtttttttgtagtygtygaygttatygttaaygtygtygtygttattgagttttyggygtattttagtttygggygtygtttaygttattygttatttygggtygyggtttyggttygggtttagtggttgygtygtttttygttagtaaygttygygyggaatgagygygtygygttgttygygtttttattygtagggttyggygtttttttttygttygtygtttttatagtygygygtttattggttyggttagtttayggggagtygyggygggygggyggtttttggygtttatatattygygygygtatatatatattayg

SEQ ID NO: 7918 - DNA, 2400 bp, Artificial Sequence
  Description of Artificial Sequence: Synthetic polynucleotide
yggtttgatyggggygtttygtygtttttttagtgtattttatygttttyggttgggggygtagtattttggagagaggygtttggtttygygtttgggttgggggygttttattttgygttttgggggttaggggygtttgtygggtygttgtygaggggttttgtttatttttgtttagttyggagtttaggygagttagygyggygagtttttttttttttygtttgggtygttttgagttygygttygttttagttgttgtagttgttgttgttggyggttgyggggagygyggggygygygtygaagaggtttgggyggygaggayggggaygaggaggagtyggaggyggtaaggaggaagagygagyggaggtygaggggtttagyggygtggygataggattagggggtttygagaatatgggttagtaggyggttaygggtyggyggtyggaygyggtgaatttgtygyggtygggygygtattggygyggygagtyggagtygagygtagtygggggaggagggttggygtaggggygttygggyggagggggtygattatttattattaaygagttattatttaataagyggagagyggttygttagtygygygggaggygttyggggaagggggttatyggtygagygtagygtatattygtggygtayggygggyggygyggygtygaggatattygggatygygygyggagtyggggygggttygggggyggygtagatttygggygygggyggttygyggygttttttggttttyggygttyggggttagygtagttyggggygagyggggygygggtyggggagggggagttgttygygtattttatttttttttttttygggygggyggyggyggttygttgtatatatttyggygtatttygttaggtygygtatagygtttygagtttaggygttttttygtttttttttygygttttgyggyggyggyggyggyggtagtagtagtagtaatatggttgttgatgggtgtttggggtggygttggyggygggaggagttttttygagtttttgygtyggttgttygttgttagttatggtaaatggtggyggyggyggyggyggtagtagyggyggyggyggyggyggyggaggtagtagttttagaatgagtagtaatatttaygygaattattttagtttagaygygttttttttttttttttttttttttttttttttttttttttttttttttttttttttttygtttttggtttaygagtttaagatggatgygtttattatttyggtgattatggaggtgtygtgygatagtyggggttaaygtatgtggtgggtttttttggttttttttatggtgatttttttygggggtttttttattattttgttttggyggaygtttaagtatttgtggatygtgtgttgttattgygggggtaagaygaaggtaaygygygtttygggygttygttttttgygttagttttatygtttttyggygttttttgtagtttattttttygtttygygtygygtygtgtttttttttattttygtttgtttttttttygtygtttttttttttttyggttttttyggtgttttyggatyggggtagygggyggygygtygggggtgaggagttgtttttagttagtgygtttygggaygyggaygtttaattttgtttttttgtttattgtagggttgttggyggttgyggttggggtyggggtyggggatttataggttygggtgtygtggtgyggggtggggatagttaatttagyggggayggaggaagttgggggtagttgggtgygtgttttgtatygtttatttgtyggggttyggtttttggyggtgggygagagggagtatattygtttatattttaggaatttgttggggagatgagttygtggggttagaaagaagggaaaaattttttgggtaagggagagaataattttgtataagggaatttygggggaggagtatggttygagataatagggggatttygaggggygagagaagttggggagatttattttattattgggggtagtttayggggttgttatttttggaatgtgtygaggtygtatatttgatgtaattttttatttygttttttaggtgttttagtggaatatattttaagtttttyggtttttgtttttttgtttttaggttatttattttgggttttyggaaatgttattagtagygyggagttggagygggagttygtttgaggtygyggttttaygyggagygttttttttggygttygaggtggttagatgtygtyggttttagttatttttggtgtagaygtttatyggtattgaggttggygatattttyg

SEQ ID NO: 7919 - DNA, 1859 bp, Artificial Sequence
  Description of Artificial Sequence: Synthetic polynucleotide
ygtayggaagtttttgtttagttgttagygygygtygttaggggttgtattgaagttgtggattygggatggggaggaggttggyggttttygaagtagggtttatagygggggagggttagygtygtttggyggtggttgygygtggttagtgyggatttaggttyggttyggtyggygttgtttgygtgtggttygggyggagygagggtttttggagttyggttygttttgggttttaggaagttyggygtgtagygttagaggtygygtgtgttgggggagggaggagtatagattgtgtttgggggtatttaggaygaatttatagaggggtggttttgttttatttagggggtgtygtgggtaaaggttttggggttatttgtttggtgttttggagggygtagggtaggagtygtygaggttygygggttattgtggggygyggaattttagattaggtattygyggtttaattttygggttaggggattygygggggttttaygaatttgtttggtttatttgtgtaatagaaattygttygygtttagtagygttyggggtygtttgygtyggattygtagtttagtatttttygygttttggatttygaggaggttaggtagagagyggttygygyggttttygtttgygtttttagtttygygttgggtagygggatatgtttggtttyggygtygttatttyggttttygtttgtttttgagtgyggagttyggagtttttttygyggtgygttgggttttagagggttagaggttattagggggtyggtatyggygggagtttagtygggygygttttyggtttttttttatttaygtttttygyggtygttygggtttaggggygtagyggggaggagatttyggttagggtyggggagygygagggyggggyggggttyggyggggaggggygygggygggyggggatyggggygggggtygggttygggggyggyggyggygygggygggaggaggaggagtttttygygyggggtaggggyggagygagyggtygygtygyggagttaagtgagttygtttyggagtygygtygtygtyggtttagtatttygggygttygtygttttygtygtygtygttagygyggggatgtaggatgtaggygggygttaggttttagyggyggyggyggtagttgtagtagtagtagtttyggyggyggtagttttttttttggtygatggaygtagagtygtygtygtygtygttttgggtttggatggtgtygggttyggtygggttgtttyggtttagygygggggtygtggttttttyggtgttgttygtttyggtttygtygttygyggtttygttgtttttyggttttttyggttggtyggtttygagygagtyggtgttttygttgttgtygttgttttttgygttagatttygtygtygtygtygtygygtatttttttttygygttttaygggtaggtaaygtgttttygtttygtttyggttygggtygtygttttttttgtttttgggygygttttgttyggttyggttttggttttyggttygygygttttttttttyggyggttttygtygttttaaatttttaggayggagttyggtagtygtgtttyggygagaaagttygtgtttggaygttyggtygtttattttygtagttttggtaggtgttttygggtgtttggayggagtygtggagggattygtygtttaggttygygtggggatygtagggaattygygttaygtygggggttattgtttatygygaggtgttgaagtggtttygtgatygtygygggtygtggttgatatygyg

SEQ ID NO: 7920 - DNA, 902 bp, Artificial Sequence
  Description of Artificial Sequence: Synthetic polynucleotide
ygggttyggttggtttttagtaggtttgtyggggtttttgtattttgtgttygggatttttaatttgygaatagtttggggaggttgagygygagttaggagyggattygggggtgggggtaagygttaygtgygygttaggtttttggtgtgttyggtaggyggygttgygtggttgyggttggtttygagggtgyggggggyggygattygggagggaaaatttttgttttttttyggggtttgttttgttygttttttaaattygttttatatttttttygattttygtttttgtaagygttatttgtagttttatyggttttygtaayggtggtggtggttggtggggggtttygaagtttgtttttggttagtyggatttyggtgggagatggaggtagaaatttyggttttttaggagaagggygtttgtttatttttttatttttyggggtttggggagggggttgggtaggggyggaagygagttggagtygtgtttgtygyggygttgyggagtggaatagatggttggggaggggagagggtgygtggyggggaggaggaggggtgygggggtyggaggatagggaaygaggaatttygaagtttggagttttttaggagaagttttttttttygtttttttttagaaaggggggtatatatgygtttgtttttttttyggagagttttggtttttgttttgtggtagattttgtygygtaattttttgttttagggygygttttttatttttaaattttygtygygggayggggtggyggggttaggatygttaggagyggttygggtygygagggttaatggggtygtttttttaggggygaggaggyggygggaaaygggttyggggtggggaaygagttttgggatyg

SEQ ID NO: 7921 - DNA, 2044 bp, Artificial Sequence
  Description of Artificial Sequence: Synthetic polynucleotide
yggygttttygttttgtttgtatttttttttattgtttttttaygtttggaatgttttygtttttgtagtttgtagatagyggaaatygygggtgtaaatgtgtaggggtygttgatatgatyggttgtagaagtttatttagggttattygaataggttagygttygggattgtataagaggttaggygatgttgtgggtttttaaatttgtatagttgygatattttgygaygtgttattttatttttagtggggtggggtgggggatttttttygtagttygttgaaagygaggtaggaattattgtaatttttttgtttaggttgaggtygttatygtttygyggatgtaygygttgtaggggygtttttygtygygggtayggygygggaagggatggggtttggtgggagtgggtaggtggygggagaggygygtgttygtgtattagaggttttygtgygtgatataggtygatgagtttttgygggttgtatttaygyggagttatagatygaaaaggttagtyggtggtyggtgtgttaatatatatagagagaygttygttaggygygttgtaggttgggaygaggttaggagggtttaggttggaggagggttgaggagggttgygggggygggtttyggygtagggygttyggagyggagggggygggttygaggyggggygggtygyggygttgaygggttgtygtygttgtattygtttttagttygyggtgtygagygtaggyggaggtatatggtttygaygggaggygygyggygagtattyggagttyggttttttgtttgagtayggtagtygygttttygttygygygttttygttttttyggtyggtagttygyggatatgatygtgtagtttttttttgggttgggatttgtttgaagattttttttatggaagygatgtttttttagtaggagattttagggggatagtyggggygttttttttttttgataggagtgtttyggttygygggaggtagttgtattaagaaggtgaggaygttgagygggggttygtgtttttygtygtygtagtttttattgtyggygygygtttttygygttygttatagtagygygttaggyggaygtygygggaatttgaygttygaggttygyggtttttaatgagagttttagaatatttttygtttttgayggttagyggtagygtygtygtttttygtagagygttygttttttygtttttagagttttagttttttttygagygatttygtagtttttttttygtttttattygtygtyggttttgtagttyggttttttttttagtttaggygygygggttgtagtgggygatygttttttttygatttttygtygtgtttttgggtttttygaagtggtttgggygagtattgattgttttttggyggtgttagttttaaagttagggtyggygatgtttgttygggagyggtagtyggygttgaagaaggtaggtagyggggttgyggygttggtgggttyggtttttttatttgttygtygaggygyggttgttttatagtagttttyggggggtagatatggggagtattgttttttatattagggttttggatgatttygggttttttaggtgggggttatagtttgaggggygattgtggatgataaygttygatattayggggatatgtaggttyggttgggtttagaatygagtagggtgggggygggtgggttgtggttgggggttttgagggttgaggtgggggattttttttttgtattggtttttggtttttgggattttggtygggttggatagggattygggtgtyggtgtgggygtgggggtagygygtgttttttgttaaagttgggagagggatgtaggtgataatttgtagygttttatttygataaatayggtygttgtgttgygggaggatttygattygggttaggtttygttggaayggttttttgagtaagtgtaygtgggtygygggttgtyggtttttgtygtttyg

SEQ ID NO: 7922 - DNA, 1152 bp, Artificial Sequence
  Description of Artificial Sequence: Synthetic polynucleotide
yggygtatataagttgaggattgtygaggygttttttgygaggtaaataygaagtygtttggttagtgagaagaaattygaggtggtttttggggtagatagagtaggatttgtttttgttttttgtttttttygtttttttttttttagyggyggygatygtagtaatagyggtagtggyggttgttgttattgttttgtygttgtygagtyggttatttgggtattygyggagtygygtygttgttatygtttyggyggtttttyggagtgygyggagggggyggyggaggagygagatatttatagtaatygaggatgygaggggygtttagtagtagygagtgtttgggagttaggaggaggttttygygygtyggtaatttttagtgttaggygttttgtagttttygygygtygygtttgggttygtatygttttygtagtgagggttygttygagyggtaagtttttttyggyggttaagtygatatttttttttygtttygtygtttatttygggtagtagtygyggaataatggagagygtagttagtagttttggagayggygttygggggaggaygygtygtygtygtygtygttgtygttagggtaggygygygtygygtggagtygggygggtgygagggygygyggyggggggtggggggtaygygtygygyggggggygggggtagtggggggygygygygygggttyggggagttygyggggagagttyggygttyggygtagygyggygyggttaagtttygygtttttttygttttttttyggygygttygttttygtttygtygttygtattygttgggggygtttagaaagatgtatagaggtaayggttaggggagyggaggtttaagttatatgtttgygttttygggggttagagttygttagttttygyggatttyggttygyggttagttygagyggttygggtgagtagyggtatagyggttttttygtttygyggttttygttygtygagaygtggttttaagaagtggtgtygtagtyggggtagaggyggaggaagtygagtygggtaagtygggaaggttgyggagaygttttgtyggggtaggtgttgtagttttagttagyggtttttayggagggggyg

SEQ ID NO: 7923 - DNA, 872 bp, Artificial Sequence
  Description of Artificial Sequence: Synthetic polynucleotide
yggtygggtttagygatgyggttgagttgtttattygygtttgttgaatyggttaattagyggygttttyggatttagygggagygtttttatgtygatygyggtaggygtgygtttttyggggtygtatygttatggygatttgtttatttgattygtttygggtggattygtygygatttttgggygtttaggtttttgagggtttaaygggygayggttttttagttttagttgtgygttttygttygggygaggtggggttgatygyggtygtttgtataygttttttttggttygygttttyggtttgggagggyggattygtttattttaygatggtttyggttttggaagggattgttttygtgattygtttttttaatagtygttaataattttttttaaygttttttgygyggttygtttttgagaattttggttygggagagygaygyggggttttyggggttgygtaggttgyggygttttgtttaygttggttygagggygyggttygtttygggtyggtttatatatttaygttttttgtygggaggyggttgggaygyggyggggttgttttaagtgtagtygyggtagtgttgygtttttatygygggggtttttgygggtygygtttgtttygttyggttttyggtgtatgtggtttgygaggyggtagaggagatgtggggatttagggtygtaygtygtgttygaggtttttaygagaggttttttttygygggtttttgygtaattgygtgaagtyggttygggaaagttaagattgtggtttaggaagaggaaggaaygygggygatagagttggggtttgggaygttgagggggtyggtggtagtttttyg

SEQ ID NO: 7924 - DNA, 1070 bp, Artificial Sequence
  Description of Artificial Sequence: Synthetic polynucleotide
yggygttgagttttgtttagygygattyggatygayggaygygtagagattttgtygggattygttttttagtyggygttyggggagtygtyggtyggttttatttttygttygggagtygggtagggygagaaggtagygygagtggyggtggygattttygtyggggtttttgygaygagyggtgattagtagygttygtagtygyggtttygttttttattyggaygtggttaagyggyggyggttaygaygttyggtttttygggatygttyggttgygttttgggygtatttgygygtttggtttygygtttygyggagagggygatgggtttyggttaggattgagtttttttttttttttttttagtttygtttggtatttttttttttgtttygagggygagttayggtttgygtygtygttttttttttyggtgttttyggttygtygttttttygygtttttttttttyggattygttttyggggttattatggtygyggttatygttagyggtttgattygttagaagyggtaggygygggagtagtattgggatyggtygtttgttagtaggaggyggagtagttttagtaagaatygygggttttgtaayggtaatttggtggatattttttttaaagtgygtattttyggttttaagaagygtaggttgyggygttaaggtttgtgggggttatggtygggagatgygtttygggtygtttttttttygtttaaayggagtttttttaggttttttttttttttyggttttttyggtttatttyggtttyggttttttttttgagtattttgggtgtygtygyggggattttggagttygttgtygggtaatttgtagtygtygagaagtgtagtygttagagatggtaagttggttgtttttygtyggyggtttttgtttttygygtttttgtaggttgggttttgggaaatttgttttttttgagtttyggtttttygggaggatagggattggtattggttttggaaygyggggtatttttttttgttatattyggggtygagttatygttyg

SEQ ID NO: 7925 - DNA, 395 bp, Artificial Sequence
  Description of Artificial Sequence: Synthetic polynucleotide
yggyggtttttygttttttttttatttttttygtttttatttttattttttggtygttygaattttygatygggagtttagagttttgttagygtygtattgtgygtygygtaagtygttygatttttttagyggtatyggttttaagtagtaaatatttgtgygtttttgagttagggaygygygtggggggtgggygtgtaygygggtgggttagygtagagtgggagtttgtgggtgtttttygtygggatttttaatttagttgttttygagagtttaagttgagygtygtaygtgttygtgttatttgttgtattggaygtagtttaatagygtagagaggtttttattyggtatttagttygatgtgggtygtttttttttttttagyg

SEQ ID NO: 7926 - DNA, 265 bp, Artificial Sequence
  Description of Artificial Sequence: Synthetic polynucleotide
ygtyggattygyggaaaaggtygttggaagttttttttgaagtyggtagtattaagaggattaataygggyggtgggtatygtttttattttttygttggttttatttttygtygttygtttttgtttttttttttygtygtttttttttttttttttttttttttttttttgyggttyggatatttttagttygaattyggyggtttttgygtttttgtttygygtttttttttttgtatttgtttygygtttaggtgttttyg

SEQ ID NO: 7927 - DNA, 1169 bp, Artificial Sequence
  Description of Artificial Sequence: Synthetic polynucleotide
ygagttygygttaagagttaygtygagaygygtygtyggtggggttaygygagatgtaatyggagagtttaaaattagtttaggattaattttttagggattygtttaatttttttygtagaagagtttaagtggggtagtggtygttataggttgaggatgattttyggaygygttttaggygygatygtattattygtttttagtttaaagtttgagtgatttggtattatttttttaattgttttttatttttttygtatttttgttgtgtttatygtttttaygtatttgagagtttaaattatgttaagaygatttggagaaaygttygatttgttttttaagttaygtaaggatttatttagaygtaygttygygyggagaygtaygttggtataygygtttatataygygagtatatataygygtatattattyggttygtgygygygggtygttgtttttgttgtattatgtaaaggtggttgggaaagygygttgatttatatttatatagtttattttttttttatagtatgtgattaataygtatttyggggaggagggagygyggttgggggtgttaatyggaagggaatagatagtgagtgttattttgttgggaggttttagaagtaaagygttaaygaygatagtagyggtggttttagttttattagtaattgtygttggtaggagtattataygttttaggagtttttygggtattaagtatgggtttagttygttttagttattttttttttttatggttttattttygttgttagtatttygattttagtttgtaattttgattttgggtttgattataaatgaygaaagatygyggtagtttttaaagtgygggagygagtttygtattggttagygyggyggagggatttttttaggaggttttaagtttttaagtttgtggagagatttggtaatagttggtaaggtttgttttagttattttygttggttttttgtttttgtatttagygtttgagggygttattygttttttttttgygttttaygtaagyggtttaaggaatttattygattyggatttygtttygtatgttttttaagttttygttattttygtaggygttttagaaaggygtgatggttttagtttagtgttygttagttyg

SEQ ID NO: 7928 - DNA, 1743 bp, Artificial Sequence
  Description of Artificial Sequence: Synthetic polynucleotide
ygttttygyggttgttttttttttagggtygtyggtggtttaggatttggttatyggggaggggygtggttttgtygaagtygatgagttataygtyggygygatggtagtgatygtgtataaagaggagygagttgtygattatttgygagtttygtatygttaggtygyggttttgtttagagaygtttttgtygggttttygttttagttttygyggttygggtattygggtagtygtygtttatttygtgttttttgaagaattyggatatttttagggtgtttyggatttgttgtaggyggtttagatatygtttttgtagagggtggggtgggagaggagggtaaattaattaaaygttaaatgagtttttgttaaygatgaggagtygggatttaygttgtgtttggtaaatgtygttaggaggaggatttagggtttygtttagygtggtttagaagggaaggagygtagagtagttgygagttagygyggtgagggttatggtggggatatagtygagggtattgggttagatgataggggtagttttyggttttaggttttttaatattttagggtttgggatttygtttttattagtatttttttatttttttgtataaattttttaaagaygygaagtatttgttttyggtttygygtagttttgaagtyggtgttgtaggagtygttygttttttggatgtgggataggagtgttaggggtttygggttygttagtggggaagaggatagygtagagtagyggtattttttagttgtaggggayggygaggyggtgggagagggyggaggggtaggyggggygggagygggggatygggaaagatagygygtagtggggttgyggyggtgttagygaagygygtttgttttattttgatgttttygatgyggaagtygagggtggtgttggagttgatgttttttygttattgtatgtagygyggtttggtgayggygygttgygygtgtttttttttygtgggagttttaggatttatygttagtatttttttgtatatgttttttygtagtttgggtygtttaygggttttggttagttttttttttaggtaagttttgtgggggygtaggtagyggttagggtatgagggggygtatayggagattttttygagtattygtttygggttttttttaagtagttgtttyggtttyggatttttatttgatttttttaatygatttggtagggtaygtatatttgaygtttattttgtagtygagtatataaggttygtygaagttatygagtaggttttgtagttgtaggtagttttygtygtygygttttattaygtygtggaaggtaggtaygtagtygygtagygygttagttattagtygygttaggtagtagygtttyggtttygagtagygttttaggattagttygttggtgttygtygttttaaaattttttgaggatyggtattygttagygtygtttagttttttttygtygygggtattygtttattygttttattgtttattagtgtgttttgttagttgtatttaggygtagygttttttgaaagggtttatgatyggtagattgattatggttyggattttttgttagtggtttttttgaaagygatagggttaaggtttgataatyggygtttyggtaatgtataagttttttttttattgaaatagggtttygttaygttttygatttatyg

SEQ ID NO: 7929 - DNA, 2405 bp, Artificial Sequence
  Description of Artificial Sequence: Synthetic polynucleotide
ygggggaggggtataygtagttttygtgyggaaagatggtgttttttttttatagggttgygygggtatttattttygttgtaaagygttygggttaggygyggtttgtttygggtyggggygagttygttgttttttgyggtagatagygatgygygtttttygttttagttttyggttygttyggyggttygygygttttttyggtgtagtatgygggygttgtgaygttttyggataaatgtygtgtaattgtgtaggygaatgagagttaaaaataagaayggaaaatttattattaaggtattattgygttagygtagttatttgaaggtttttatggttttyggygtttgygtttgaagttygtttttaggttttggggggtatttgtagaaaatttttagtagyggttygttaattagattttagggtgtayggggggtggygtyggtaattatggtaatttttaaaataaaataatataaaataaagtaattaaygtttattaattattattttattttattttttgtattgtttttaggtagttggggaagtygtygggagtgtagtyggatgttggaatttaatgtgattyggttgattatgtaaagattaggattggaygtttttgtagttttatttygttatttatttttttttttttatttygtattagaaataaagtggggggggggggygagtttttggaggagaaaatgataattggtatttaattttaggtttatagtgygtygyggtggggygtaaagaygtaaattttygggatggygagttttyggggttttattgggttaaaygaaaattgatttgatttgttttttaatattygagggagagaaggggagatgaggggagggagggtagggtttgagtgtgtgygtgtgygtgtgygtgtgtgtgtgtttggggagggggaggaggtattaagttgtagtttgygygyggttttgygtttyggyggggttgygtgygtgtgtttttgttygygttgttgaaaygggtttttygagggatyggygttatatgatttygtttgtttttygttagygygtagatygttagttttttagtttgttyggtatyggaggagggtygggyggtatttttygggtattggggttttgyggagyggagaagaggttttagyggggaatggtatatttggatttaagaagtygyggttyggygttagattttggagtgtagatatttggggggaggggagagttagagggagygagygagygagygttagagagaggtagygygtagygygtayggayggggggttgttgygyggagaagatgtaagygygtggggtttygttggtttttgagtattatgtagaaggggattyggttgaatgatggttaygtygygtttttgggattgttggygygtaaggayggtaygygtaaaggttatttgagtaagyggagttyggataatataaaatggtaaattaagtggttygygttgttgtagaatttgtttttttatttygagagygattygagttygyggttttyggggttttatttgttggagggttgygtttgygatygygygtttttttttaagtyggygttgtyggttaaggagtygttggagaaataggtgaggygagygtygygttttgatttttttgygtttyggtygyggttttgggggtttagggttttyggttggttgatggygtttgaattttggtttttttatttttggygttttaggygttttttgtatttttagygagaggggaggtttgtttttagttaggygagtgattgyggygggtagagggggtagggattgagggyggggagtagatgtgggttgyggttgtttttygtyggaygagtttygtgggaggygggtatagaggggtygatatttggagatgtagaggaagatggggttttaaggattagagaygatgagtttggatataygtttagttaaaaatggtgtttttaatttttatttttatygtttagttttaatagtttygatygtttgttttatatygggaaygtgtaatttttygygtttaggtatgggaagggtaagayggaggygttygagygttgttagtttttgtttygtygtagttgagggyggagagyggtttgygttagtttttyggagttgggttggggttatggggttataygggtyggttyggtattatygagyggtggtgggtttttagttggyggtygtyggagtaataagtttaaagatttttaaggatygttttgatgygtyggggttagggttagggttgttgyggaggtagygggaygaagtgggygttttttttttttttygttttttgygtygtygtygtygtygtagtygyggttatagygttgyg

SEQ ID NO: 7930 - DNA, 1920 bp, Artificial Sequence
  Description of Artificial Sequence: Synthetic polynucleotide
ygggygttgttttttgyggtttttttygtygaggtttgtgygtggyggggtttttaggagyggtagttygtgyggtttgggggyggtttttttttygtatygtagyggggygtgtaaagygtttgyggttgtagtgtgggygtttattttaygtgttyggyggygtgygaggagtagtaatattttttgtgggygatgaaggtggataggttgttgaatttgatgttgtaaagayggtagtatyggtggttgtygttgggtagyggygtyggygtgtttttgttgggagtttggaygtttttgttygagtaggaggggggygtyggygggggyggtayggtttygggygyggyggtyggggaygggggygggtygggyggyggtttttggggtttygggtygaggtygtttygggggttaygggattygggttgyggggaggyggygggggygggagygggygaggggtygyggtyggtyggygttygggtttygattttygggtyggttaggggygygtygagtagtaggtygtgygttaggyggaaatgttttagtaggttttygygtatygggtygttyggggggtagtaggggtaggyggyggygggtaggtygagygygtygggyggtggygtagyggggtaygagtattttttgtgygttaggtaggtttygaggttgtggaagtttaygyggtaggtygtgtattygtggtagtyggttagygtyggtgtyggggtttyggggagygggygtygyggttttttgtttaggtygatggggtygtyggtygyggggtygggygagygygtaggggygaggtyggggtygttttygttttygttttygggtygyggygattygggygygggggygtggtygggyggyggggggggyggggygtyggtygygtgtagttygtagagtttgyggygtttgygygtgygtataggygyggygggagagggggtygggggygyggtyggtttagggggtttygggggygyggtyggtyggygyggyggygggtygtggygygaggygtagtagtatygtttgtgtayggtgtaggtttygtggyggttgaagyggatgttgtaggtttygtatagygtgyggttggggtygtttttygygtygtttayggagttattygggttttggttgttttygttgtttyggtygttygygtygttttygggygtggtygygtttttagtttttttttygygygtttyggggttyggggaygagygyggygygtygggttyggygggttggtyggggggygygygggtygggtyggggggygttttgggtttgygygyggtaggygygttttygggygtayggyggtttgaatagtagaggygtttgtgtaygtagtagttgttgaygttgttgaaggtgatttygtattygaagtaygtagygtttttgggggtttyggggaagagttyggtttgygygtygtyggygttygygttygygttttgttgtagtyggttgtgtattagttyggatattttggttaggattttygaggyggggggygtygygtygggttygaataygtattgyggaaggaatagggtttyggttaggtttagttygtygggtatygggttggagttyggygtggggttggatagttyggttttgattttggtyggggyggggttgygyggygayggygttygygayggggtttggggtttaggtttttyggggtttaggatgggggtygttttyggtttttttatygtttttattttgatgtttttgggggtygtygggggttygttgttgtttttattttgggttagaggtttygttttggttttttygttggtggtttyggttagggtttttttgtttagttttggygatggggtgggygttaggtttaggttygyg

SEQ ID NO: 7931 - DNA, 1403 bp, Artificial Sequence
  Description of Artificial Sequence: Synthetic polynucleotide
ygttygttttttttaggttyggtgggattagattygaagttaattttygttaggygttaggtgtagattttaggttaggttagagtagtttttgggttttyggatygggatgttygttttgtttttttttttggtttygttyggtttgttatagggggaggtttyggtttygtatttygggtagygaatttygtyggtygaggttagtttygtgygggggtttttygygggatygatygttaagyggtattgttygtttygggygttygttyggttttagaygtaggttttgyggtygtttygtgataagtatattgaygggttattgttttttgaygagtgttaaaaagttygtttgttttgaaygttaatttttaagtgatttttaygaggttttttttttyggttttttygttgttgtttygttygtattyggtttttagtaggtgtttaagaaaygtttagtaaayggtagygtaggygagtttgttttgygygttggygygttttattgtttayggatggygggygattttaygggattttyggttygtaggattttygttttygaggttgtttttgggtygggaggggttattttagaggggygtttattttygayggygggggtyggggygtygygggtaggggagggygtagtttttaagtagttttagtttggtttagatttygygtttagygagtyggtyggttaggtttatattttttatttgtygttygttttaggggaagggttttttygaygaygttygagtttttttttttttyggagggtyggaggtyggygtttattggtyggttttgggygaygtttygttttttygaygttaygggttaatgagygygygttgttagtttattagtygggttggttgggyggttygggagttygagyggtggyggagyggygagtagygagtagygtttgygggagyggtyggtyggtygggttttygygtttygtaygttygtaygtttagyggggttygtattgagtatgggygyggyggtygtgygttggtatttgtgygtgttgttggttttgggtataygygggyggttggtygggggtagygggtttttaggtaagttttygatygaggtggggggyggygggygyggggggttygggyggtygaggygyggtttyggagggtttttttttygyggatttygagttygtttygygyggtttygygttttttgtttttttgtaaagtaatttttagggtyggttyggggygtttttttttygtagttygggyggtyggggtttttgagttyggyggggtygtattaggggtgggtgggtyggggtttygggaggggaagygygagygygggagygaggaagaaaggyggyggttttyggggatttygyg

SEQ ID NO: 7932 - DNA, 1088 bp, Artificial Sequence
  Description of Artificial Sequence: Synthetic polynucleotide
ygttgaggggtygtatttattygygtaggtattagtaggtagttttggygttygygggaggyggtygggggygggggtttttyggtgtttatygtygtttttgyggttgggttygygtttygggtyggtygagtttaaygttaggatttygttygagttttttagggtttygttaggygtygygttygygttygygtttttttgtyggtttyggttygggttttatyggggygtagggttggggaatyggagtttygttygtygattyggagtatygtttaygtagattygtttygggygagggaggggtygggygygtattygyggggagggyggygagyggggattagtygaagtygggagaggggygtttttayggggygggaaattggygygygattttgggggaagtgtaggatggggggataggggygttttygygggggtggatgggggattatagyggggttggyggggtaggggtyggygtaygaggttggaggaggggagygygygtttttattygggttgggtygtygaggttygyggygtatygtggyggyggtgggyggaggggggyggggggtatttttttttttttgtggygtaggtgggygygttttggatyggtttgaygattttttttygtygttttatttttttggttaaaggtttttagtttttaattagggatatttttagtttatagtttygaagttatgggtttttttyggttttttgaagtygttatatttgtgttagtyggtygygtttttagattttttttygyggagtttttttagtatttggagaygtagygtagggtttygaggayggtttggttyggagaaaagatatygaagttttaattttttttaatttygttttttttttttttttatttttttttttygtttttaaagttygggggttttatttttttttyggttygyggagtttttygaattttgyggggattyggygttyggyggtgtttttttggggygtayggggttggggygggagygaggagattaggtggggaggggattttagattttagaygttaggggagayggygtttttyg

SEQ ID NO: 7933 - DNA, 1812 bp, Artificial Sequence
  Description of Artificial Sequence: Synthetic polynucleotide
yggggtygttgygtttttttgattattgayggttaggayggttttagtttygttttatttgtaagttttattttaggttygagttttygagggtagggatagtttttygggtttygaggtttgattagagtttgaaagtttttgtygggggttgtttygatttagygaggygttaggttgttyggygyggttgggggygtttagygtygggattttagttttgtttyggtygttygttggtttagtgygtaygtttyggtagtttagtttttttttttayggyggtaggagagttttyggtatttgtttggggygggggygggggyggggyggggygggygtygygtttttttgtttgattggtaggaagatagattaatyggaggggtttttyggggggaggggyggtgtygtgtttgagtygggygygggygatygagggagttgtagttattygygtgyggtaygygtyggtygtttgttyggatygyggttattagtgtygyggtttttygattttygtttygtygagtygygygygygattgttattttttttaattgttttttaygattttttttgtgtatgtatttattttttgtttygttttgttttttttaaggyggtggyggyggygatagyggygtaagttygtagyggggagggggyggtyggaggatgyggygyggggttgygttygttaygttygttgttgttgttyggttygggtttgagygtygagtaggtgggtataggtgygtyggggggygggaggygagygttggttagagggaattygtggattyggygatygaggggyggatttggyggtaagggaygyggygatyggtgtygtttygttttatygtttatttttttttttttyggttatygygttttttttgggttttttttttattttygtattttattttagtggttttttatttttttatatttattttttatttttttttagatttttttgtaaaattttttagtygttgygtygttttttttaatattttttttyggtttygtttttagtttttagtttttttttaygttatttttatttttattttttttyggatttygtttttaagttaaggagygggagggggatttattyggtgtttgtyggagtggygyggggggtgtggtyggttygtttttttygtgtttttygtagggtaggttatagttttttagattttygtttaggtggtaaagaagatggagttgggggtygygtttyggyggygyggggttygaaggygaggtygtttagttygtattttattttaygtayggtataygtygtygyggtttttgttaygtatattttygygttgtttygtttaygtgggygtyggggaggaggttygagagatgggaagaaaggttggtatttatttttttgtygggtyggygygttttgggygtattggttttyggagatggygygtaaggattgattttygtggtgttagatattttgtygggygttttgygtyggggttagyggtttygttggtttgygttagtgygttgyggtttygttttttagtttttyggtttttygttttattttttttgttgtgggtttttgagtattyggtttgggtagtttagatagaggtygtttaygaggttggygttttttttygttttagaagtatttygtttttatatattttagttygtyggttttttgaaggttgggttagtttyggtttttygttagtttttgttyggttttttgagttttagygatattgtatttaatygttagttttttttygtygttyg

SEQ ID NO: 7934 - DNA, 5819 bp, Artificial Sequence
  Description of Artificial Sequence: Synthetic polynucleotide
yggagggaaatygggtygaygataagggtggttattttygggtttttygygttyggtttaagygtttttgggtggggtagtttaaayggggagaggggtttygtgggtygagggttygaggtygtagygagtttagygtttggttaaatttggttygygygtttttttattgttttgttagggttgtgtgatttttyggagttttaygttttygtttaaatagtttttagygtttttgttggtattyggggygtttttattttagtttttgtattyggygygtygygygtagatyggayggaggggaaagttggtaagagygyggygttygygggagaaagygttaatgggyggtygggtgggagtagygygttygttygtttaygttaygtyggtgygggttyggttgaygatygyggygtttggggaygtyggygygtttygttygttaggtgtttygtttggaaatgtttttattagttgtygtyggtttttygttggagygygygygtygagttttygygyggagttttygygggttgtygggagyggtttagygttatygtaggtaggtgaggtttttygttttygttttygtttyggggtttygagattttttttttttttygaggaggyggaggtttygygyggtygtygaggggagygggyggyggyggttgyggygatttttyggtgygtttygggttgygagttgtttttygyggtttyggtagttatayggygygggygggagtttttttagtttaggtagggagtgggtttygtygtataaattttgygaggattgtttttgygtttaaggggataaagtttgttattygtygttaggttttttagaggtygttgygtttgttgtaagttgygggaagtagggtgygygggtyggygyggggyggggggtggggggttyggagtggttaggtttgagttttggaygttyggayggygtttygtttagttttaggtygtatttagggagtaagyggygggggygtagygggagagaggagggagagggtygygggtttttatggagggyggttgggaatttagagatttatygtttgtttttgtggtttttttttttattattggtttygagggggtttyggggttgtgaggaaatgatttgttaatttygaggttygttagtgyggygttagygatygtgaggttttttaaatttatattttagtygggtgtttygagyggtgggygggtataggygtttttaaggtttttggttttaggttttagaaagaaaggtttttgtttggtgtttygggttttyggtttygtttttggttggagttaatttttttgggttggaaggagtttttttyggaygagtttttggtgyggggaattggtggtttttagggtaatttttgaagtattagggttaggttggtygaagaagggttagggttyggtttgttttttyggaggttttttatggtttygayggttaayggtaatttygttaaaataggygattygtttgygtttygygttaggggttgattattttttgttttttttgyggtttgtttyggttttggtttttygtttttyggagygttttaggttagygggagtattttattttttygaagttgagtyggtgttgtgtatttygggagtyggttgatttttggtttatttgtttaygggtgtatttagtatygggggtttttagagggaggaaggtttagtatttygagtttatgtagaygygtttagttgatatttgagatgttgagygttttatygttggtgaaagggatattgggtgttttygttttaggtttggttttttggtgaaggtatttggaaaatattttagtattatttatgggagaagggtggtttagtgagaattttyggtttgggtaggygggtttaggttaggttatagggttttagtgagatgtttyggtggtygttaatttataggttggattgattttgtgttttggaatgagtagtggggtttgggtgaggtygggygggttaggaggttttttgggtagttgygagtttttygaggtagggtgattgtgattgggttyggattttaggygttggggtttgttggygggtaggaagtggagygtgtgtgtgyggyggtttgggaaagtygatttagaggttaggtttttgggttayggagaaagggtygttygttggtggggattggagygtygatttatgtatataggttggaaaggtaaaagagaataggagaaggtggyggtggtggttaaaggaagttttygaaagggtttttaygtattggttgttttgggaagtggaggttgttttttttagattttgtttagaagatgaatggtygtttgttttggggtttyggttttagttaagtttygtygggtttggaaggaaggaaatgtattagttttaggtttgggtgggttgagttgttgtattagagtttagaggtgtagggtataggtggttgggtttttgggttttggtttttttttttagtyggyggagtgtttatagtygtygaggttaggttttygagtataggtgaggaaaggataagttatagttgaatgttttttttttgggggtttttattttttattttagtttttggttyggttgggtttatattttttttttagtygggttttattatttggagagagygagtagtttgtaaataataaataatgggaagtagaaggatgttygggaaaaattagaaaattgtaaggagtggggaggagggagggtgggagaggggaggaaggagggtgggggaggggaggagtaggaggagagggaaaggggttgagagatttatttttagygagaaatttyggtggttagttttttattatttataggaaggtgatattagygatttaggtgagaaagaaagaaaygyggtttgtygygaaattaatatagaatttagaaataattattaatgttatttgattygtgttttttatatatttttygyggttatygaygttaaattgtttgaataatttgtatggagyggttatttattattttygatggtttttttttgtaagtagttyggaygtggttygtttyggtttaaygygatyggagaattygtatttttatttgtaaattaaagtaattaygtagtagatattatatgatgtgtattgtggtttttagatagttattaattatttttaatygagttgttaaaagagtaggtagatttygtttttgggaggtaggtttgtagttggggagagggygaggaygttattattaattagagggtgattttggggygatttataggtttgaatttaggaatttttttgagtaagtttgtataaygttgttttgtayggttttttttttaatttattaygggaggtyggtttagggggygagggtaatyggggygagtttyggtttyggagggygatggygtagaaggyggggaaygggttygggatggttygggygtttttttgtygtttttttgtygtttgtttattggttttygttttgaatttgggtaaggttttagggagggtattggtygagggagttttggggtgggygttyggttttttttttygattgtttygtgygttttagatagaaagttgggtaaaatggataggggagggygttttygttaggtatttaaygttttttttttygtagttagttttgyggggygtygggagggaygagtttagygggaggggtyggggtttgggttgaggaatttgttttttygagygygtagggtygttyggtagttttyggtttagtygygaggggtagggggaagtyggyggagtayggtyggyggaaaggggatyggggaggaaagtyggggaggygaggtgggggyggtgggttgagygggaatttaaaagatygyggtggagaagatggggygtttttygygatattyggttgtttagaggtgtaaagtyggtgggygtaygttyggggyggttttatagttttygggtygttagttttagggtgtygggttttaattaaggtttygaagtttttaygtatttgagggtattttgattagtttttgygggttgttttgyggtygtagtgggttttgaaagtttatttyggygtagggtggaaatyggygggaggygttgttgattttygattaaataatagtgaygagaygygtgyggggygtttgygagtttttttttgttattyggagtagagygygttagygygaggtygggtyggtygtttgygtagygtygggttaattttaattgttgattatatttttagygtgtttttttataggttttatttgtaattgagaygaatgattatagtggggygggaaggagtagttgtttattaattaatttttaattaaaagtgtttttygttttygggtgattaaagagaaatatygttygttgggygatattgattyggatggaatttatttgttaaygttyggaggaatggttttttygtttatygygyggtygggattgttttggtttttttyggtttgagtygtyggygagtgatyggygagtttgyggttaggtygggttgygygaggtggggttgaygttagagtttttttygttttaagtygygtatatttgatttgaygggttygygygattygtttttttttttttttttttygtaaaatatgtatttttgtygtygttgygaggtygttyggttttagagttttttygagttttyggaatgygaagttaaaggaatygyggyggttatygttgtttattttgttattyggttagaaaagtttgyggagygyggggatggattaatyggtttttttgtttygtttttttagygtttagaagtttgtagtttyggagtagtggtygygttaygtyggttttagygygtagaattttgtaggtttygttygttygtttygggtygygttygttatgttttattygtagtttggatatttttatttttyggttttttaggtaagyggagtttygtttygtttaggttatygtaggtgtyggtagggyggatggggyggggayggggggtggggagtgttygatttaygattgtttgyggttttygagttagtaaggtttgggtygygygttttttaygtttaatttttgttttttaaattttyggggaaaggtygaggygttaagaaaattygaygggtygggttygggttttttgatgtttgaattataaggtttaggttgtgttttaggggagttttaggattttaaggaatttttggggaaggaggtttggygygtaaatggygttagaggttttggaaatttttyggggaagggtgtaggtgttyggttgggttttaygtggyggaggaggttagaygygtataagttagtggaaaggggygagtattttggtgtggayggygggaggttygggggtattyggggtaygttttygtgggyggygygygggattggtaaggtttagggttttagtttttagttyggtttttygttagttttygyggtttttttttgtagtttttgatggttattaattttttgagtaygtgttgygagttyggaggtygtaygttggyggatttygggttygtygtttyggtttaggygtyggtttattgttyggtttaygagagtyggttgttggttatygygygttaygagtttaattyggtygyggygttgggygtttatgggggtttttatggyggatygtagggttatggtaattaygtgatttayggttyggaggygttygttttttattyg

SEQ ID NO: 7935 - DNA, 2001 bp, Artificial Sequence
  Description of Artificial Sequence: Synthetic polynucleotide
ygttttygtttygtgttaagygggtttaaggttygaggttttttygtttataatttyggtgttyggaataygttttygaggggtygtgttgtyggggttattattygygattggatttygygtygtgttgtttttttygggtttygagttygtttagyggtttgtayggtttaggtttgagttgygggttttttttgtggggygygttgggagtgagttttatttttaaagtttattttaaygttttaggtatgattaygayggtagaggtyggtygtttattttygttttttttttyggttagagygtttttgtygggagtygaygatygyggtttgatttygggttttatygtttattttyggttttygttttttttttayggttaggggttatatatagyggaygtttygtttttagtygtttttttgatttttgaatttgggagttagygtgttygttggggtatgtattgttaygggtattgggatttttttgttgttgyggggaggagtttygayggtaggtgggaagatttagtttgttygygttttygttttttagtttttgygattygggtygaggtttttagtttttgggttttttygtttygggtttgagggaggggtygggttttygggtttgtagattygttatygygygtgygtatgygtyggtygygagttttygggtgtaggtttgggyggtttyggttygygtatttgtttaggygttgyggtttagygygttttaatttttagttygggyggagagygggggygggattgaagtatygtgttttttaaagtattttttygtygtyggtagttttggtttygtaaatgttttagygygtttaggygtaygtagagattggygyggtagttttygggttaayggtaygygagtaaagttggttggygatttgggataygtagtagaagttgaggttgtatygattttygtygtttygggggaggtatgggttygggtaggtttaggaggaagttgtatagttygaggttygggygggagtggygggtygygggtaagggaaygtatatttggaaggggttaggatttyggttggagtttggttttttatggygaggaagtygattgggaagggttttttggygaggtttttttgttgtgttattttttttyggtagygtygggygyggggaaygyggggttgtatyggggygggggagggggttttattyggyggtttygaggattygattttggggtygggttyggygggtaggtttgtttaggagttagttggtaaatgtagyggattgttaygttattttattgttattatttattgtaaattattgttttaagttttygggagaattygtygaatttgagaggggggagggggatgggggtgggygygtaggaagttttataggtattagggattggtgatttaggatattagtttttygagttttttttgggaatttttagtatttagattgtttttgattgtagggattayggtggggygttttttttttaagtttttttygggatatygggygygtttttttygtttttgggttagygtatatttttttaygygatgattagtatagttattgtgaggttyggttttggtygygtttgttttttgygagtgataataataaaaattattggaattgtaaggaagtttttggtttyggttttttagtygttgttgttttgggtgtttyggttgyggaaagatttygtagtygggttygatttaygagtggaatatygggttgyggatttagtygggtttataggattggygyggggtttyggggataggtttygtagggtttttttgygtatygtttgggaygtygattttgttaatttggaggataatttttgtttttattttattagtagatttttaaaaatttagtygtygttgaaaygtgttttttattygttyggtttgtttgtagtttttgaygagtttyggtatagttttyg

SEQ ID NO: 7936 - DNA, 1265 bp, Artificial Sequence
  Description of Artificial Sequence: Synthetic polynucleotide
yggttygggygttaggtagaattttagttygatgttgtygtygtygggggagagggaattygttgggagggatagtygggggttggggaaggaagagygggtgttgggagggtttaatattggyggagttttaggtggygaygygggyggygagagttgtttygaggygggggtttygggtaggtygttttttaygtagtatayggagtagaagatttgttttttggygagggaygggygtygttgatttagtaygtttaggattagttygtyggyggtttttaygygggttttgggttttagtttttygtyggggggygttttttgttgtttatttttttttttttttygatttttagttttttttttttttttttttagttttaattgtagtggtaaggtttggggattgagaggttyggtgagtgttagtttygtaggttgygtyggtgttyggtttttattttagttygggggttttaggtttttygygggttttggggygttggtgttygygtagttttagtygttttygtagttatygtygttyggtttygyggaggyggygygtagygggggygttygggygttgtttttttgaggtttygggggtttagggtggttygtagtgttattggttagggtttgygatttttggggttygtygtygtygtttatygtgttttgtttttygtttatygtygttygyggttygygtygtygttgtttatttagtygtygggatttttattyggygttygygggtagygggggtagtggttyggttygattygyggtttygtttttgttttygggtttttttttttgggttgggaygttttaagtttttttyggggagttygtgtttygaggttgyggygygtggggagtttggttyggttygtygttttttttygtattttggygyggyggggtatygtttygggggygtygagggtygttygttttgggttygggygygttygttttatatgtagttyggggyggygtygtagttttagygagttttaggygggatagaggggtttgggaggagayggtygttagtttygygttattatyggtttyggttgtyggaygygyggttygagggyggtggttaaagggtygaggggtttgtggygtygtygyggygygtattaggaggtgtagtyggagygttggttagtygtagggtttttgggggagaggtyggagygggygattttttttttttygygttttatttatagtttttttygtyg

SEQ ID NO: 7937 - DNA, 1360 bp, Artificial Sequence
  Description of Artificial Sequence: Synthetic polynucleotide
ygtygaggatgtggttttygtttttygtagtygtygtaggagtttttgtttttaaagyggtaggtaggggttttagygggtttattttaatttgggaaggtyggtgygtttttttatagatttygtagggygttttttttggggattattgaagttttggtatttttaattttagttttttygygttaygggaaaygaagaygatatttttttgaataatttyggatgtgttattatagaggggtattttatattggtttttattttaatttttatttagtatattgtttgtttattttttaaatttygtgyggattgyggtatttagtttygggggattttttagttttgttttttygattygygtaggtgygttygtttatttaagggtagggaggtatgttttttygggttttttyggtygtatggtttgtttgtttttttggtttttttttttygtattaggaggggygtgagatagttaggtygatttttatttyggtagtttgyggygatyggtygtttygagygtagygttagatatttgggttggggggtgttagtttgaygygtaggaagggygtagyggygggagggggttttattttagatttgggaggtttgtttggygtyggttttygttygtttttygtyggtggaggtygyggttggyggagatygttaagttagaggaggggattygaggtttyggttgggygaaggttttggagggggagaagayggtygaggygtggaggggtagtygyggyggggygatttttatttgtttattgyggggtttgttygtggggtyggggtagatttygtaaaggaygygtagtttgtaagttygyggttygygyggygyggggatggggagygtgtgygtygaggagygygygtygagtygggttttygygtttgtgtggtyggttggyggtyggggttygtgtgtttttgygyggyggygtgtgygtgtgygtaygyggggattaygttygttyggagtygtygtygtygtygttattttttgttyggggtygagygtagygttttttttgttygtttygygyggygyggtagtttagtttggtttygttttgygggagaggygtygttttygtygygaagttaggttgggygttggagggaggygatygattatygtttttttttgtttattttataggttggggagggggtgttgtaggttaatgagygttygggggyggggttagatygagggyggtgyggtggggggygyggtggggggygtygggttgtttaattygattttattygtagtatagattggagtaggagttgyggygggaaattttagyggygggggtygggggyg

SEQ ID NO: 7938 - DNA, 362 bp, Artificial Sequence
  Description of Artificial Sequence: Synthetic polynucleotide
ygygggggttatygygttygygaaygtagagtttataygtggattttygygtttgtgatgtttygattygtttygggttttygtatagataatgtygygygtttttttygtagttatttygggattygygtttygygtygttyggaygtttttttgygtttgtyggggatatttatygatattaggaattttagygtgtttatatagtttygttyggttttttggagttygttgagtaygtataygygtaggygaagttgtttttttaggtttttggygttttyggygyggttgttttygyggttgttttygtttatggtyggyggyggtgygtagygyggygttgttygtygtgttgagyg

SEQ ID NO: 7939 - DNA, 2566 bp, Artificial Sequence
  Description of Artificial Sequence: Synthetic polynucleotide
cgtttttaacgcgggagcgtagtgtattttagtggataaattcgagaatcgtacgttgtttttcgtttttatttttgtttttttcgttcgcggttttaattcgggatttaaatgtacgagttcggtgaatgtttcggtaggagggcgagggtttagaggtagtttgtttagtaaaaacgatagttgtgttttggtgggttttgggttattttaggtagaagttagagaagttcgagaatttcggcgggttggtaaagtttgtcgagaagggtttttttggatatttttattacgggttttaggttcgaatttttttttttatttggttttggagttttagatatagataagtttcgggcgcgtcggcgggcgtatgtgcgtgtgtgtttatagcggggtggtcgtcggagttttttaagaattttagttttttcgttttagttgttcgttagttgtgagcgttcgtcgggttcggaggttattcgtaaatagttgggtcggtagttgggagtttgggaggtttttgtttagtttcggggtttcgagaaaggagaagggggagcggagtggttgtttggttgtggttttttttaatttcgtttgcgaagttttcgttgggagttcggagttttagtttttttcggtagtttcggttttcgcgttcgtcgcgtttagcggtcggcgtttcgtttcgggtttcggggaggaggcgcgtcggggtagtcggttaggatattgcgttgttggtttttagagttgcgggcgcgtttggtcggttttatttttcgggttgttggggcgggcgtcgttgtttcgatttcggacgcgcggaattttggagattcggtcgtttttcgttagggtcgcggtgttgttttaggtttcgggcgggcgttttttttcggttatcggtgtatttcgttgttcgtttgcgggaagcgaagaggggttttttgatttgtaatatagaggaaagcgtcgttttcgtttagtttggtatttacgcgtttatacgtattcggcgtcggtcgggtcgtttatttgagttttaaaagttgttgaatttatatggttacgtttcggggagcggggttttagatttggttcgtttaggttatttgcgcggcgttcgcgttcgttcgttttcgtttcgcggcgtcggttttcggttttcggttcgtcgtttttcgtcgttcgtcggtcgcggggcgtatagcgagttagagcgcggtcgcgcggggttttatgtcggtcggcgcgtcgtcgtcgttggggcgtatggtttaggttgggcggttcgcgggggcgtatatttttcggtcggggcgcggggttcgcggtttttttcgtcggcggtatagcgaaggcggtagcgaggcggggcgtgtttcggcgttgtcgcggcgtagtaaagggttggggagtcgcggtttcgtttttcggggcggcgaggagggaggtcggcggcgttgtcgtttacggtgcgtgtttttcggcgcgcggtttttgtttttagtcggagtttcgcgtcgatggggcggcgttgtttagggtttggggtgacgcgacgcggacggacgcgagtttttttcgcgttgtcgggtcggggggttttgttagaggtttcgtcgtcgatcggcgttatttaagttgttcgggggtttcgtttgagcgttcgttttgtagacggtcgcggttcggagattggtaggaggcgggtacgagaggcgcgcggggcgagggcgtcgtggagcgcggggcgtggggacgcgcggcggcggcgtcgcgcggaggaggcgcgcggggatttcggggtttcgtcgttcgcgtttatcgcgttcgtcgtagagtcgttcgcgttgtttagtcgttttttttttcgcgtttgttttttcgcgcgttcgttttcgtttttcggagtcggttttaatttcgttcgttcggttcggtttacgttattcgtttttttcgtttttcgaacgggagttcgagtttttggtttggtttcggtttttgttcgtcgttttattttgcgggggtcggggtcgtcgcgggtggtggggggcgttgtgtttagtaggggcgatagcgtaggcggggttttttgtagtttttttttttattttcggtcgcgtttcggtttttattttgcgaaaggttcgagagaggtcgtaggttaggattggatcgtcgggcgtcgtcggatggtgttgttagggtaatcggatggtacgcgaagtcgttcgaggtttcgattcggttacgggggcgtttagtggattcggagagttattttggggagggggcggtttcgaagaaggattgggtgggggcgtatggagcgggggttgcgcgaaaagttttttggggcggagttgagttacgcgggtcgcgtaggagcgtttgttcgagggtcgtttacgagggatttttttgttcggttgcgcgggtttttgcgttgatgaagttatcgcgtttcgggtcggagtttcggcgtttttgtttcgaatttagcgaagttcggttttatgtttttaattatttaacggttttttatcgtttagcg

SEQ ID NO: 7940 - DNA, 572 bp, Artificial Sequence
  Description of Artificial Sequence: Synthetic polynucleotide
cgttgttcgtcgggtcggtggcgtttatttcgtatcgcgttgtttcgttcggggtattatggtttggggttggattatgttttttttattttagtcggcgttttttatttacgcgcgttgagggtgcggtgagttgagtgcggggttaagtatgttttggcgtcgatttcgtttaggggtttaggatttggcgtttaaggggttttttggcgacggagattttcgacgtagtagcgattcgcggttgtttaagttgatttcgttcgcgtttcgagcggttttgggcgcgcggggtttcggggattggaggatttcggggggcggcgtcgcgtggtggtcggaaggggacgttaagttcggggtgggcgtcggacgtttttcgtcgcgtttgttcgttttgtttatcgcgattcggcgggtcgtgcggaagcgggggttgttgcggtttttgttgtcgttttttttgttgtcggtcggcgcgtttcgggaatcggcgtttaggtagttagggtttggagagcgcgagcgttttcggaggcgcgtggttagggaggatttcgattttttgggcg

SEQ ID NO: 7941 - DNA, 989 bp, Artificial Sequence
  Description of Artificial Sequence: Synthetic polynucleotide
cgtatattttgtgcggttcgagtggttcggatggtatagtttaggtgttcgggttaaagttggtatttttaaagtttagaacgtaatttgggcgcgttagtataaattcggttttcggtttttttgaagttagttaagttcgtatagggtttttagcgtttggaaatttgagaggcgtggaagggtggggagtttcgcgaagtttttagtttttgggtgtttttcggtttcgcgggggagcgggtttggagttaaatcggtcggtcgtaggttggagtagcgggcgtcggagcgcgcggtggggatgttcgaaaaggagttagaggtttagtcggagagttcgagaatacgagggatgtttattttgtaatatggttttaagtttttttttgtttacgcggaagcgtttttcgttttatttcgggttgtgtagggtcgtttcggcgattaagtcgttttcggagtcgggtattggggagtcggtgttgcgttcgttgttggagtcggggttcgattgcgtcgttaggtagtcgggttttttttgggcggttatggtgggcgcgtagcgttcgggttttcgttgtcgtcgtcgttttgtttgcgttgtcgttttcgttcgtcggtcgggtttaattggtttttagcgtcgcggcgttagttcgtttttttgtagtcgtcgacgttatcgttaacgtcgtcgtcgttattgagttttcggcgtattttagtttcgggcgtcgtttacgttattcgttatttcgggtcgcggtttcggttcgggtttagtggttgcgtcgtttttcgttagtaacgttcgcgcggaatgagcgcgtcgcgttgttcgcgtttttattcgtagggttcggcgtttttttttcgttcgtcgtttttatagtcgcgcgtttattggttcggttagtttacggggagtcgcggcgggcgggcggtttttggcgtttatatattcgcgcgcgtatatatatattacg

SEQ ID NO: 7942 - DNA, 2400 bp, Artificial Sequence
  Description of Artificial Sequence: Synthetic polynucleotide
cggtttgatcggggcgtttcgtcgtttttttagtgtattttatcgttttcggttgggggcgtagtattttggagagaggcgtttggtttcgcgtttgggttgggggcgttttattttgcgttttgggggttaggggcgtttgtcgggtcgttgtcgaggggttttgtttatttttgtttagttcggagtttaggcgagttagcgcggcgagtttttttttttttcgtttgggtcgttttgagttcgcgttcgttttagttgttgtagttgttgttgttggcggttgcggggagcgcggggcgcgcgtcgaagaggtttgggcggcgaggacggggacgaggaggagtcggaggcggtaaggaggaagagcgagcggaggtcgaggggtttagcggcgtggcgataggattagggggtttcgagaatatgggttagtaggcggttacgggtcggcggtcggacgcggtgaatttgtcgcggtcgggcgcgtattggcgcggcgagtcggagtcgagcgtagtcgggggaggagggttggcgtaggggcgttcgggcggagggggtcgattatttattattaacgagttattatttaataagcggagagcggttcgttagtcgcgcgggaggcgttcggggaagggggttatcggtcgagcgtagcgtatattcgtggcgtacggcgggcggcgcggcgtcgaggatattcgggatcgcgcgcggagtcggggcgggttcgggggcggcgtagatttcgggcgcgggcggttcgcggcgttttttggttttcggcgttcggggttagcgtagttcggggcgagcggggcgcgggtcggggagggggagttgttcgcgtattttatttttttttttttcgggcgggcggcggcggttcgttgtatatatttcggcgtatttcgttaggtcgcgtatagcgtttcgagtttaggcgttttttcgtttttttttcgcgttttgcggcggcggcggcggcggtagtagtagtagtaatatggttgttgatgggtgtttggggtggcgttggcggcgggaggagttttttcgagtttttgcgtcggttgttcgttgttagttatggtaaatggtggcggcggcggcggcggtagtagcggcggcggcggcggcggcggaggtagtagttttagaatgagtagtaatatttacgcgaattattttagtttagacgcgttttttttttttttttttttttttttttttttttttttttttttttttttttttttttcgtttttggtttacgagtttaagatggatgcgtttattatttcggtgattatggaggtgtcgtgcgatagtcggggttaacgtatgtggtgggtttttttggttttttttatggtgatttttttcgggggtttttttattattttgttttggcggacgtttaagtatttgtggatcgtgtgttgttattgcgggggtaagacgaaggtaacgcgcgtttcgggcgttcgttttttgcgttagttttatcgtttttcggcgttttttgtagtttattttttcgtttcgcgtcgcgtcgtgtttttttttattttcgtttgtttttttttcgtcgtttttttttttttcggttttttcggtgttttcggatcggggtagcgggcggcgcgtcgggggtgaggagttgtttttagttagtgcgtttcgggacgcggacgtttaattttgtttttttgtttattgtagggttgttggcggttgcggttggggtcggggtcggggatttataggttcgggtgtcgtggtgcggggtggggatagttaatttagcggggacggaggaagttgggggtagttgggtgcgtgttttgtatcgtttatttgtcggggttcggtttttggcggtgggcgagagggagtatattcgtttatattttaggaatttgttggggagatgagttcgtggggttagaaagaagggaaaaattttttgggtaagggagagaataattttgtataagggaatttcgggggaggagtatggttcgagataatagggggatttcgaggggcgagagaagttggggagatttattttattattgggggtagtttacggggttgttatttttggaatgtgtcgaggtcgtatatttgatgtaattttttatttcgttttttaggtgttttagtggaatatattttaagtttttcggtttttgtttttttgtttttaggttatttattttgggttttcggaaatgttattagtagcgcggagttggagcgggagttcgtttgaggtcgcggttttacgcggagcgttttttttggcgttcgaggtggttagatgtcgtcggttttagttatttttggtgtagacgtttatcggtattgaggttggcgatattttcg

SEQ ID NO: 7943 - DNA, 1859 bp, Artificial Sequence
  Description of Artificial Sequence: Synthetic polynucleotide
cgtacggaagtttttgtttagttgttagcgcgcgtcgttaggggttgtattgaagttgtggattcgggatggggaggaggttggcggttttcgaagtagggtttatagcgggggagggttagcgtcgtttggcggtggttgcgcgtggttagtgcggatttaggttcggttcggtcggcgttgtttgcgtgtggttcgggcggagcgagggtttttggagttcggttcgttttgggttttaggaagttcggcgtgtagcgttagaggtcgcgtgtgttgggggagggaggagtatagattgtgtttgggggtatttaggacgaatttatagaggggtggttttgttttatttagggggtgtcgtgggtaaaggttttggggttatttgtttggtgttttggagggcgtagggtaggagtcgtcgaggttcgcgggttattgtggggcgcggaattttagattaggtattcgcggtttaattttcgggttaggggattcgcgggggttttacgaatttgtttggtttatttgtgtaatagaaattcgttcgcgtttagtagcgttcggggtcgtttgcgtcggattcgtagtttagtatttttcgcgttttggatttcgaggaggttaggtagagagcggttcgcgcggttttcgtttgcgtttttagtttcgcgttgggtagcgggatatgtttggtttcggcgtcgttatttcggttttcgtttgtttttgagtgcggagttcggagtttttttcgcggtgcgttgggttttagagggttagaggttattagggggtcggtatcggcgggagtttagtcgggcgcgttttcggtttttttttatttacgtttttcgcggtcgttcgggtttaggggcgtagcggggaggagatttcggttagggtcggggagcgcgagggcggggcggggttcggcggggaggggcgcgggcgggcggggatcggggcgggggtcgggttcgggggcggcggcggcgcgggcgggaggaggaggagtttttcgcgcggggtaggggcggagcgagcggtcgcgtcgcggagttaagtgagttcgtttcggagtcgcgtcgtcgtcggtttagtatttcgggcgttcgtcgttttcgtcgtcgtcgttagcgcggggatgtaggatgtaggcgggcgttaggttttagcggcggcggcggtagttgtagtagtagtagtttcggcggcggtagttttttttttggtcgatggacgtagagtcgtcgtcgtcgtcgttttgggtttggatggtgtcgggttcggtcgggttgtttcggtttagcgcgggggtcgtggttttttcggtgttgttcgtttcggtttcgtcgttcgcggtttcgttgtttttcggttttttcggttggtcggtttcgagcgagtcggtgttttcgttgttgtcgttgttttttgcgttagatttcgtcgtcgtcgtcgtcgcgtatttttttttcgcgttttacgggtaggtaacgtgttttcgtttcgtttcggttcgggtcgtcgttttttttgtttttgggcgcgttttgttcggttcggttttggttttcggttcgcgcgttttttttttcggcggttttcgtcgttttaaatttttaggacggagttcggtagtcgtgtttcggcgagaaagttcgtgtttggacgttcggtcgtttattttcgtagttttggtaggtgttttcgggtgtttggacggagtcgtggagggattcgtcgtttaggttcgcgtggggatcgtagggaattcgcgttacgtcgggggttattgtttatcgcgaggtgttgaagtggtttcgtgatcgtcgcgggtcgtggttgatatcgcg

SEQ ID NO: 7944 - DNA, 902 bp, Artificial Sequence
  Description of Artificial Sequence: Synthetic polynucleotide
cgggttcggttggtttttagtaggtttgtcggggtttttgtattttgtgttcgggatttttaatttgcgaatagtttggggaggttgagcgcgagttaggagcggattcgggggtgggggtaagcgttacgtgcgcgttaggtttttggtgtgttcggtaggcggcgttgcgtggttgcggttggtttcgagggtgcggggggcggcgattcgggagggaaaatttttgttttttttcggggtttgttttgttcgttttttaaattcgttttatatttttttcgattttcgtttttgtaagcgttatttgtagttttatcggttttcgtaacggtggtggtggttggtggggggtttcgaagtttgtttttggttagtcggatttcggtgggagatggaggtagaaatttcggttttttaggagaagggcgtttgtttatttttttatttttcggggtttggggagggggttgggtaggggcggaagcgagttggagtcgtgtttgtcgcggcgttgcggagtggaatagatggttggggaggggagagggtgcgtggcggggaggaggaggggtgcgggggtcggaggatagggaacgaggaatttcgaagtttggagttttttaggagaagttttttttttcgtttttttttagaaaggggggtatatatgcgtttgtttttttttcggagagttttggtttttgttttgtggtagattttgtcgcgtaattttttgttttagggcgcgttttttatttttaaattttcgtcgcgggacggggtggcggggttaggatcgttaggagcggttcgggtcgcgagggttaatggggtcgtttttttaggggcgaggaggcggcgggaaacgggttcggggtggggaacgagttttgggatcg

SEQ ID NO: 7945 - DNA, 2044 bp, Artificial Sequence
  Description of Artificial Sequence: Synthetic polynucleotide
cggcgttttcgttttgtttgtatttttttttattgtttttttacgtttggaatgttttcgtttttgtagtttgtagatagcggaaatcgcgggtgtaaatgtgtaggggtcgttgatatgatcggttgtagaagtttatttagggttattcgaataggttagcgttcgggattgtataagaggttaggcgatgttgtgggtttttaaatttgtatagttgcgatattttgcgacgtgttattttatttttagtggggtggggtgggggatttttttcgtagttcgttgaaagcgaggtaggaattattgtaatttttttgtttaggttgaggtcgttatcgtttcgcggatgtacgcgttgtaggggcgtttttcgtcgcgggtacggcgcgggaagggatggggtttggtgggagtgggtaggtggcgggagaggcgcgtgttcgtgtattagaggttttcgtgcgtgatataggtcgatgagtttttgcgggttgtatttacgcggagttatagatcgaaaaggttagtcggtggtcggtgtgttaatatatatagagagacgttcgttaggcgcgttgtaggttgggacgaggttaggagggtttaggttggaggagggttgaggagggttgcgggggcgggtttcggcgtagggcgttcggagcggagggggcgggttcgaggcggggcgggtcgcggcgttgacgggttgtcgtcgttgtattcgtttttagttcgcggtgtcgagcgtaggcggaggtatatggtttcgacgggaggcgcgcggcgagtattcggagttcggttttttgtttgagtacggtagtcgcgttttcgttcgcgcgttttcgttttttcggtcggtagttcgcggatatgatcgtgtagtttttttttgggttgggatttgtttgaagattttttttatggaagcgatgtttttttagtaggagattttagggggatagtcggggcgttttttttttttgataggagtgtttcggttcgcgggaggtagttgtattaagaaggtgaggacgttgagcgggggttcgtgtttttcgtcgtcgtagtttttattgtcggcgcgcgtttttcgcgttcgttatagtagcgcgttaggcggacgtcgcgggaatttgacgttcgaggttcgcggtttttaatgagagttttagaatatttttcgtttttgacggttagcggtagcgtcgtcgtttttcgtagagcgttcgttttttcgtttttagagttttagttttttttcgagcgatttcgtagtttttttttcgtttttattcgtcgtcggttttgtagttcggttttttttttagtttaggcgcgcgggttgtagtgggcgatcgttttttttcgatttttcgtcgtgtttttgggtttttcgaagtggtttgggcgagtattgattgttttttggcggtgttagttttaaagttagggtcggcgatgtttgttcgggagcggtagtcggcgttgaagaaggtaggtagcggggttgcggcgttggtgggttcggtttttttatttgttcgtcgaggcgcggttgttttatagtagttttcggggggtagatatggggagtattgttttttatattagggttttggatgatttcgggttttttaggtgggggttatagtttgaggggcgattgtggatgataacgttcgatattacggggatatgtaggttcggttgggtttagaatcgagtagggtgggggcgggtgggttgtggttgggggttttgagggttgaggtgggggattttttttttgtattggtttttggtttttgggattttggtcgggttggatagggattcgggtgtcggtgtgggcgtgggggtagcgcgtgttttttgttaaagttgggagagggatgtaggtgataatttgtagcgttttatttcgataaatacggtcgttgtgttgcgggaggatttcgattcgggttaggtttcgttggaacggttttttgagtaagtgtacgtgggtcgcgggttgtcggtttttgtcgtttcg

SEQ ID NO: 7946 - DNA, 1152 bp, Artificial Sequence
  Description of Artificial Sequence: Synthetic polynucleotide
cggcgtatataagttgaggattgtcgaggcgttttttgcgaggtaaatacgaagtcgtttggttagtgagaagaaattcgaggtggtttttggggtagatagagtaggatttgtttttgttttttgtttttttcgtttttttttttttagcggcggcgatcgtagtaatagcggtagtggcggttgttgttattgttttgtcgttgtcgagtcggttatttgggtattcgcggagtcgcgtcgttgttatcgtttcggcggtttttcggagtgcgcggagggggcggcggaggagcgagatatttatagtaatcgaggatgcgaggggcgtttagtagtagcgagtgtttgggagttaggaggaggttttcgcgcgtcggtaatttttagtgttaggcgttttgtagttttcgcgcgtcgcgtttgggttcgtatcgttttcgtagtgagggttcgttcgagcggtaagtttttttcggcggttaagtcgatatttttttttcgtttcgtcgtttatttcgggtagtagtcgcggaataatggagagcgtagttagtagttttggagacggcgttcgggggaggacgcgtcgtcgtcgtcgtcgttgtcgttagggtaggcgcgcgtcgcgtggagtcgggcgggtgcgagggcgcgcggcggggggtggggggtacgcgtcgcgcggggggcgggggtagtggggggcgcgcgcgcgggttcggggagttcgcggggagagttcggcgttcggcgtagcgcggcgcggttaagtttcgcgtttttttcgttttttttcggcgcgttcgttttcgtttcgtcgttcgtattcgttgggggcgtttagaaagatgtatagaggtaacggttaggggagcggaggtttaagttatatgtttgcgttttcgggggttagagttcgttagttttcgcggatttcggttcgcggttagttcgagcggttcgggtgagtagcggtatagcggttttttcgtttcgcggttttcgttcgtcgagacgtggttttaagaagtggtgtcgtagtcggggtagaggcggaggaagtcgagtcgggtaagtcgggaaggttgcggagacgttttgtcggggtaggtgttgtagttttagttagcggtttttacggagggggcg

SEQ ID NO: 7947 - DNA, 872 bp, Artificial Sequence
  Description of Artificial Sequence: Synthetic polynucleotide
cggtcgggtttagcgatgcggttgagttgtttattcgcgtttgttgaatcggttaattagcggcgttttcggatttagcgggagcgtttttatgtcgatcgcggtaggcgtgcgtttttcggggtcgtatcgttatggcgatttgtttatttgattcgtttcgggtggattcgtcgcgatttttgggcgtttaggtttttgagggtttaacgggcgacggttttttagttttagttgtgcgttttcgttcgggcgaggtggggttgatcgcggtcgtttgtatacgttttttttggttcgcgttttcggtttgggagggcggattcgtttattttacgatggtttcggttttggaagggattgttttcgtgattcgtttttttaatagtcgttaataattttttttaacgttttttgcgcggttcgtttttgagaattttggttcgggagagcgacgcggggttttcggggttgcgtaggttgcggcgttttgtttacgttggttcgagggcgcggttcgtttcgggtcggtttatatatttacgttttttgtcgggaggcggttgggacgcggcggggttgttttaagtgtagtcgcggtagtgttgcgtttttatcgcgggggtttttgcgggtcgcgtttgtttcgttcggttttcggtgtatgtggtttgcgaggcggtagaggagatgtggggatttagggtcgtacgtcgtgttcgaggtttttacgagaggttttttttcgcgggtttttgcgtaattgcgtgaagtcggttcgggaaagttaagattgtggtttaggaagaggaaggaacgcgggcgatagagttggggtttgggacgttgagggggtcggtggtagtttttcg

SEQ ID NO: 7948 - DNA, 1070 bp, Artificial Sequence
  Description of Artificial Sequence: Synthetic polynucleotide
cggcgttgagttttgtttagcgcgattcggatcgacggacgcgtagagattttgtcgggattcgttttttagtcggcgttcggggagtcgtcggtcggttttatttttcgttcgggagtcgggtagggcgagaaggtagcgcgagtggcggtggcgattttcgtcggggtttttgcgacgagcggtgattagtagcgttcgtagtcgcggtttcgttttttattcggacgtggttaagcggcggcggttacgacgttcggtttttcgggatcgttcggttgcgttttgggcgtatttgcgcgtttggtttcgcgtttcgcggagagggcgatgggtttcggttaggattgagtttttttttttttttttttagtttcgtttggtatttttttttttgtttcgagggcgagttacggtttgcgtcgtcgttttttttttcggtgttttcggttcgtcgttttttcgcgtttttttttttcggattcgttttcggggttattatggtcgcggttatcgttagcggtttgattcgttagaagcggtaggcgcgggagtagtattgggatcggtcgtttgttagtaggaggcggagtagttttagtaagaatcgcgggttttgtaacggtaatttggtggatattttttttaaagtgcgtattttcggttttaagaagcgtaggttgcggcgttaaggtttgtgggggttatggtcgggagatgcgtttcgggtcgtttttttttcgtttaaacggagtttttttaggttttttttttttttcggttttttcggtttatttcggtttcggttttttttttgagtattttgggtgtcgtcgcggggattttggagttcgttgtcgggtaatttgtagtcgtcgagaagtgtagtcgttagagatggtaagttggttgtttttcgtcggcggtttttgtttttcgcgtttttgtaggttgggttttgggaaatttgttttttttgagtttcggtttttcgggaggatagggattggtattggttttggaacgcggggtatttttttttgttatattcggggtcgagttatcgttcg

SEQ ID NO: 7949 - DNA, 395 bp, Artificial Sequence
  Description of Artificial Sequence: Synthetic polynucleotide
cggcggtttttcgttttttttttatttttttcgtttttatttttattttttggtcgttcgaattttcgatcgggagtttagagttttgttagcgtcgtattgtgcgtcgcgtaagtcgttcgatttttttagcggtatcggttttaagtagtaaatatttgtgcgtttttgagttagggacgcgcgtggggggtgggcgtgtacgcgggtgggttagcgtagagtgggagtttgtgggtgtttttcgtcgggatttttaatttagttgttttcgagagtttaagttgagcgtcgtacgtgttcgtgttatttgttgtattggacgtagtttaatagcgtagagaggtttttattcggtatttagttcgatgtgggtcgtttttttttttttagcg

SEQ ID NO: 7950 - DNA, 265 bp, Artificial Sequence
  Description of Artificial Sequence: Synthetic polynucleotide
cgtcggattcgcggaaaaggtcgttggaagttttttttgaagtcggtagtattaagaggattaatacgggcggtgggtatcgtttttattttttcgttggttttatttttcgtcgttcgtttttgtttttttttttcgtcgtttttttttttttttttttttttttttttttgcggttcggatatttttagttcgaattcggcggtttttgcgtttttgtttcgcgtttttttttttgtatttgtttcgcgtttaggtgttttcg

SEQ ID NO: 7951 - DNA, 1169 bp, Artificial Sequence
  Description of Artificial Sequence: Synthetic polynucleotide
cgagttcgcgttaagagttacgtcgagacgcgtcgtcggtggggttacgcgagatgtaatcggagagtttaaaattagtttaggattaattttttagggattcgtttaatttttttcgtagaagagtttaagtggggtagtggtcgttataggttgaggatgattttcggacgcgttttaggcgcgatcgtattattcgtttttagtttaaagtttgagtgatttggtattatttttttaattgttttttatttttttcgtatttttgttgtgtttatcgtttttacgtatttgagagtttaaattatgttaagacgatttggagaaacgttcgatttgttttttaagttacgtaaggatttatttagacgtacgttcgcgcggagacgtacgttggtatacgcgtttatatacgcgagtatatatacgcgtatattattcggttcgtgcgcgcgggtcgttgtttttgttgtattatgtaaaggtggttgggaaagcgcgttgatttatatttatatagtttattttttttttatagtatgtgattaatacgtatttcggggaggagggagcgcggttgggggtgttaatcggaagggaatagatagtgagtgttattttgttgggaggttttagaagtaaagcgttaacgacgatagtagcggtggttttagttttattagtaattgtcgttggtaggagtattatacgttttaggagtttttcgggtattaagtatgggtttagttcgttttagttattttttttttttatggttttattttcgttgttagtatttcgattttagtttgtaattttgattttgggtttgattataaatgacgaaagatcgcggtagtttttaaagtgcgggagcgagtttcgtattggttagcgcggcggagggatttttttaggaggttttaagtttttaagtttgtggagagatttggtaatagttggtaaggtttgttttagttattttcgttggttttttgtttttgtatttagcgtttgagggcgttattcgttttttttttgcgttttacgtaagcggtttaaggaatttattcgattcggatttcgtttcgtatgttttttaagttttcgttattttcgtaggcgttttagaaaggcgtgatggttttagtttagtgttcgttagttcg

SEQ ID NO: 7952 - DNA, 1743 bp, Artificial Sequence
  Description of Artificial Sequence: Synthetic polynucleotide
cgttttcgcggttgttttttttttagggtcgtcggtggtttaggatttggttatcggggaggggcgtggttttgtcgaagtcgatgagttatacgtcggcgcgatggtagtgatcgtgtataaagaggagcgagttgtcgattatttgcgagtttcgtatcgttaggtcgcggttttgtttagagacgtttttgtcgggttttcgttttagttttcgcggttcgggtattcgggtagtcgtcgtttatttcgtgttttttgaagaattcggatatttttagggtgtttcggatttgttgtaggcggtttagatatcgtttttgtagagggtggggtgggagaggagggtaaattaattaaacgttaaatgagtttttgttaacgatgaggagtcgggatttacgttgtgtttggtaaatgtcgttaggaggaggatttagggtttcgtttagcgtggtttagaagggaaggagcgtagagtagttgcgagttagcgcggtgagggttatggtggggatatagtcgagggtattgggttagatgataggggtagttttcggttttaggttttttaatattttagggtttgggatttcgtttttattagtatttttttatttttttgtataaattttttaaagacgcgaagtatttgttttcggtttcgcgtagttttgaagtcggtgttgtaggagtcgttcgttttttggatgtgggataggagtgttaggggtttcgggttcgttagtggggaagaggatagcgtagagtagcggtattttttagttgtaggggacggcgaggcggtgggagagggcggaggggtaggcggggcgggagcgggggatcgggaaagatagcgcgtagtggggttgcggcggtgttagcgaagcgcgtttgttttattttgatgttttcgatgcggaagtcgagggtggtgttggagttgatgttttttcgttattgtatgtagcgcggtttggtgacggcgcgttgcgcgtgtttttttttcgtgggagttttaggatttatcgttagtatttttttgtatatgttttttcgtagtttgggtcgtttacgggttttggttagttttttttttaggtaagttttgtgggggcgtaggtagcggttagggtatgagggggcgtatacggagattttttcgagtattcgtttcgggttttttttaagtagttgtttcggtttcggatttttatttgatttttttaatcgatttggtagggtacgtatatttgacgtttattttgtagtcgagtatataaggttcgtcgaagttatcgagtaggttttgtagttgtaggtagttttcgtcgtcgcgttttattacgtcgtggaaggtaggtacgtagtcgcgtagcgcgttagttattagtcgcgttaggtagtagcgtttcggtttcgagtagcgttttaggattagttcgttggtgttcgtcgttttaaaattttttgaggatcggtattcgttagcgtcgtttagttttttttcgtcgcgggtattcgtttattcgttttattgtttattagtgtgttttgttagttgtatttaggcgtagcgttttttgaaagggtttatgatcggtagattgattatggttcggattttttgttagtggtttttttgaaagcgatagggttaaggtttgataatcggcgtttcggtaatgtataagttttttttttattgaaatagggtttcgttacgttttcgatttatcg

SEQ ID NO: 7953 - DNA, 2405 bp, Artificial Sequence
  Description of Artificial Sequence: Synthetic polynucleotide
cgggggaggggtatacgtagttttcgtgcggaaagatggtgttttttttttatagggttgcgcgggtatttattttcgttgtaaagcgttcgggttaggcgcggtttgtttcgggtcggggcgagttcgttgttttttgcggtagatagcgatgcgcgtttttcgttttagttttcggttcgttcggcggttcgcgcgttttttcggtgtagtatgcgggcgttgtgacgttttcggataaatgtcgtgtaattgtgtaggcgaatgagagttaaaaataagaacggaaaatttattattaaggtattattgcgttagcgtagttatttgaaggtttttatggttttcggcgtttgcgtttgaagttcgtttttaggttttggggggtatttgtagaaaatttttagtagcggttcgttaattagattttagggtgtacggggggtggcgtcggtaattatggtaatttttaaaataaaataatataaaataaagtaattaacgtttattaattattattttattttattttttgtattgtttttaggtagttggggaagtcgtcgggagtgtagtcggatgttggaatttaatgtgattcggttgattatgtaaagattaggattggacgtttttgtagttttatttcgttatttatttttttttttttatttcgtattagaaataaagtggggggggggggcgagtttttggaggagaaaatgataattggtatttaattttaggtttatagtgcgtcgcggtggggcgtaaagacgtaaattttcgggatggcgagttttcggggttttattgggttaaacgaaaattgatttgatttgttttttaatattcgagggagagaaggggagatgaggggagggagggtagggtttgagtgtgtgcgtgtgcgtgtgcgtgtgtgtgtgtttggggagggggaggaggtattaagttgtagtttgcgcgcggttttgcgtttcggcggggttgcgtgcgtgtgtttttgttcgcgttgttgaaacgggtttttcgagggatcggcgttatatgatttcgtttgtttttcgttagcgcgtagatcgttagttttttagtttgttcggtatcggaggagggtcgggcggtatttttcgggtattggggttttgcggagcggagaagaggttttagcggggaatggtatatttggatttaagaagtcgcggttcggcgttagattttggagtgtagatatttggggggaggggagagttagagggagcgagcgagcgagcgttagagagaggtagcgcgtagcgcgtacggacggggggttgttgcgcggagaagatgtaagcgcgtggggtttcgttggtttttgagtattatgtagaaggggattcggttgaatgatggttacgtcgcgtttttgggattgttggcgcgtaaggacggtacgcgtaaaggttatttgagtaagcggagttcggataatataaaatggtaaattaagtggttcgcgttgttgtagaatttgtttttttatttcgagagcgattcgagttcgcggttttcggggttttatttgttggagggttgcgtttgcgatcgcgcgtttttttttaagtcggcgttgtcggttaaggagtcgttggagaaataggtgaggcgagcgtcgcgttttgatttttttgcgtttcggtcgcggttttgggggtttagggttttcggttggttgatggcgtttgaattttggtttttttatttttggcgttttaggcgttttttgtatttttagcgagaggggaggtttgtttttagttaggcgagtgattgcggcgggtagagggggtagggattgagggcggggagtagatgtgggttgcggttgtttttcgtcggacgagtttcgtgggaggcgggtatagaggggtcgatatttggagatgtagaggaagatggggttttaaggattagagacgatgagtttggatatacgtttagttaaaaatggtgtttttaatttttatttttatcgtttagttttaatagtttcgatcgtttgttttatatcgggaacgtgtaatttttcgcgtttaggtatgggaagggtaagacggaggcgttcgagcgttgttagtttttgtttcgtcgtagttgagggcggagagcggtttgcgttagtttttcggagttgggttggggttatggggttatacgggtcggttcggtattatcgagcggtggtgggtttttagttggcggtcgtcggagtaataagtttaaagatttttaaggatcgttttgatgcgtcggggttagggttagggttgttgcggaggtagcgggacgaagtgggcgttttttttttttttcgttttttgcgtcgtcgtcgtcgtcgtagtcgcggttatagcgttgcg

SEQ ID NO: 7954 - DNA, 1920 bp, Artificial Sequence
  Description of Artificial Sequence: Synthetic polynucleotide
cgggcgttgttttttgcggtttttttcgtcgaggtttgtgcgtggcggggtttttaggagcggtagttcgtgcggtttgggggcggtttttttttcgtatcgtagcggggcgtgtaaagcgtttgcggttgtagtgtgggcgtttattttacgtgttcggcggcgtgcgaggagtagtaatattttttgtgggcgatgaaggtggataggttgttgaatttgatgttgtaaagacggtagtatcggtggttgtcgttgggtagcggcgtcggcgtgtttttgttgggagtttggacgtttttgttcgagtaggaggggggcgtcggcgggggcggtacggtttcgggcgcggcggtcggggacgggggcgggtcgggcggcggtttttggggtttcgggtcgaggtcgtttcgggggttacgggattcgggttgcggggaggcggcgggggcgggagcgggcgaggggtcgcggtcggtcggcgttcgggtttcgattttcgggtcggttaggggcgcgtcgagtagtaggtcgtgcgttaggcggaaatgttttagtaggttttcgcgtatcgggtcgttcggggggtagtaggggtaggcggcggcgggtaggtcgagcgcgtcgggcggtggcgtagcggggtacgagtattttttgtgcgttaggtaggtttcgaggttgtggaagtttacgcggtaggtcgtgtattcgtggtagtcggttagcgtcggtgtcggggtttcggggagcgggcgtcgcggttttttgtttaggtcgatggggtcgtcggtcgcggggtcgggcgagcgcgtaggggcgaggtcggggtcgttttcgttttcgttttcgggtcgcggcgattcgggcgcgggggcgtggtcgggcggcggggggggcggggcgtcggtcgcgtgtagttcgtagagtttgcggcgtttgcgcgtgcgtataggcgcggcgggagagggggtcgggggcgcggtcggtttagggggtttcgggggcgcggtcggtcggcgcggcggcgggtcgtggcgcgaggcgtagtagtatcgtttgtgtacggtgtaggtttcgtggcggttgaagcggatgttgtaggtttcgtatagcgtgcggttggggtcgtttttcgcgtcgtttacggagttattcgggttttggttgttttcgttgtttcggtcgttcgcgtcgttttcgggcgtggtcgcgtttttagtttttttttcgcgcgtttcggggttcggggacgagcgcggcgcgtcgggttcggcgggttggtcggggggcgcgcgggtcgggtcggggggcgttttgggtttgcgcgcggtaggcgcgttttcgggcgtacggcggtttgaatagtagaggcgtttgtgtacgtagtagttgttgacgttgttgaaggtgatttcgtattcgaagtacgtagcgtttttgggggtttcggggaagagttcggtttgcgcgtcgtcggcgttcgcgttcgcgttttgttgtagtcggttgtgtattagttcggatattttggttaggattttcgaggcggggggcgtcgcgtcgggttcgaatacgtattgcggaaggaatagggtttcggttaggtttagttcgtcgggtatcgggttggagttcggcgtggggttggatagttcggttttgattttggtcggggcggggttgcgcggcgacggcgttcgcgacggggtttggggtttaggtttttcggggtttaggatgggggtcgttttcggtttttttatcgtttttattttgatgtttttgggggtcgtcgggggttcgttgttgtttttattttgggttagaggtttcgttttggttttttcgttggtggtttcggttagggtttttttgtttagttttggcgatggggtgggcgttaggtttaggttcgcg

SEQ ID NO: 7955 - DNA, 1403 bp, Artificial Sequence
  Description of Artificial Sequence: Synthetic polynucleotide
cgttcgttttttttaggttcggtgggattagattcgaagttaattttcgttaggcgttaggtgtagattttaggttaggttagagtagtttttgggttttcggatcgggatgttcgttttgtttttttttttggtttcgttcggtttgttatagggggaggtttcggtttcgtatttcgggtagcgaatttcgtcggtcgaggttagtttcgtgcgggggtttttcgcgggatcgatcgttaagcggtattgttcgtttcgggcgttcgttcggttttagacgtaggttttgcggtcgtttcgtgataagtatattgacgggttattgttttttgacgagtgttaaaaagttcgtttgttttgaacgttaatttttaagtgatttttacgaggttttttttttcggttttttcgttgttgtttcgttcgtattcggtttttagtaggtgtttaagaaacgtttagtaaacggtagcgtaggcgagtttgttttgcgcgttggcgcgttttattgtttacggatggcgggcgattttacgggattttcggttcgtaggattttcgttttcgaggttgtttttgggtcgggaggggttattttagaggggcgtttattttcgacggcgggggtcggggcgtcgcgggtaggggagggcgtagtttttaagtagttttagtttggtttagatttcgcgtttagcgagtcggtcggttaggtttatattttttatttgtcgttcgttttaggggaagggttttttcgacgacgttcgagtttttttttttttcggagggtcggaggtcggcgtttattggtcggttttgggcgacgtttcgttttttcgacgttacgggttaatgagcgcgcgttgttagtttattagtcgggttggttgggcggttcgggagttcgagcggtggcggagcggcgagtagcgagtagcgtttgcgggagcggtcggtcggtcgggttttcgcgtttcgtacgttcgtacgtttagcggggttcgtattgagtatgggcgcggcggtcgtgcgttggtatttgtgcgtgttgttggttttgggtatacgcgggcggttggtcgggggtagcgggtttttaggtaagttttcgatcgaggtggggggcggcgggcgcggggggttcgggcggtcgaggcgcggtttcggagggtttttttttcgcggatttcgagttcgtttcgcgcggtttcgcgttttttgtttttttgtaaagtaatttttagggtcggttcggggcgtttttttttcgtagttcgggcggtcggggtttttgagttcggcggggtcgtattaggggtgggtgggtcggggtttcgggaggggaagcgcgagcgcgggagcgaggaagaaaggcggcggttttcggggatttcgcg

SEQ ID NO: 7956 - DNA, 1088 bp, Artificial Sequence
  Description of Artificial Sequence: Synthetic polynucleotide
cgttgaggggtcgtatttattcgcgtaggtattagtaggtagttttggcgttcgcgggaggcggtcgggggcgggggtttttcggtgtttatcgtcgtttttgcggttgggttcgcgtttcgggtcggtcgagtttaacgttaggatttcgttcgagttttttagggtttcgttaggcgtcgcgttcgcgttcgcgtttttttgtcggtttcggttcgggttttatcggggcgtagggttggggaatcggagtttcgttcgtcgattcggagtatcgtttacgtagattcgtttcgggcgagggaggggtcgggcgcgtattcgcggggagggcggcgagcggggattagtcgaagtcgggagaggggcgtttttacggggcgggaaattggcgcgcgattttgggggaagtgtaggatggggggataggggcgttttcgcgggggtggatgggggattatagcggggttggcggggtaggggtcggcgtacgaggttggaggaggggagcgcgcgtttttattcgggttgggtcgtcgaggttcgcggcgtatcgtggcggcggtgggcggaggggggcggggggtatttttttttttttgtggcgtaggtgggcgcgttttggatcggtttgacgattttttttcgtcgttttatttttttggttaaaggtttttagtttttaattagggatatttttagtttatagtttcgaagttatgggtttttttcggttttttgaagtcgttatatttgtgttagtcggtcgcgtttttagattttttttcgcggagtttttttagtatttggagacgtagcgtagggtttcgaggacggtttggttcggagaaaagatatcgaagttttaattttttttaatttcgttttttttttttttttatttttttttttcgtttttaaagttcgggggttttatttttttttcggttcgcggagtttttcgaattttgcggggattcggcgttcggcggtgtttttttggggcgtacggggttggggcgggagcgaggagattaggtggggaggggattttagattttagacgttaggggagacggcgtttttcg

SEQ ID NO: 7957 - DNA, 1812 bp, Artificial Sequence
  Description of Artificial Sequence: Synthetic polynucleotide
cggggtcgttgcgtttttttgattattgacggttaggacggttttagtttcgttttatttgtaagttttattttaggttcgagttttcgagggtagggatagtttttcgggtttcgaggtttgattagagtttgaaagtttttgtcgggggttgtttcgatttagcgaggcgttaggttgttcggcgcggttgggggcgtttagcgtcgggattttagttttgtttcggtcgttcgttggtttagtgcgtacgtttcggtagtttagtttttttttttacggcggtaggagagttttcggtatttgtttggggcgggggcgggggcggggcggggcgggcgtcgcgtttttttgtttgattggtaggaagatagattaatcggaggggtttttcggggggaggggcggtgtcgtgtttgagtcgggcgcgggcgatcgagggagttgtagttattcgcgtgcggtacgcgtcggtcgtttgttcggatcgcggttattagtgtcgcggtttttcgattttcgtttcgtcgagtcgcgcgcgcgattgttattttttttaattgttttttacgattttttttgtgtatgtatttattttttgtttcgttttgttttttttaaggcggtggcggcggcgatagcggcgtaagttcgtagcggggagggggcggtcggaggatgcggcgcggggttgcgttcgttacgttcgttgttgttgttcggttcgggtttgagcgtcgagtaggtgggtataggtgcgtcggggggcgggaggcgagcgttggttagagggaattcgtggattcggcgatcgaggggcggatttggcggtaagggacgcggcgatcggtgtcgtttcgttttatcgtttatttttttttttttcggttatcgcgttttttttgggttttttttttattttcgtattttattttagtggttttttatttttttatatttattttttatttttttttagatttttttgtaaaattttttagtcgttgcgtcgttttttttaatattttttttcggtttcgtttttagtttttagtttttttttacgttatttttatttttattttttttcggatttcgtttttaagttaaggagcgggagggggatttattcggtgtttgtcggagtggcgcggggggtgtggtcggttcgtttttttcgtgtttttcgtagggtaggttatagttttttagattttcgtttaggtggtaaagaagatggagttgggggtcgcgtttcggcggcgcggggttcgaaggcgaggtcgtttagttcgtattttattttacgtacggtatacgtcgtcgcggtttttgttacgtatattttcgcgttgtttcgtttacgtgggcgtcggggaggaggttcgagagatgggaagaaaggttggtatttatttttttgtcgggtcggcgcgttttgggcgtattggttttcggagatggcgcgtaaggattgattttcgtggtgttagatattttgtcgggcgttttgcgtcggggttagcggtttcgttggtttgcgttagtgcgttgcggtttcgttttttagtttttcggtttttcgttttattttttttgttgtgggtttttgagtattcggtttgggtagtttagatagaggtcgtttacgaggttggcgttttttttcgttttagaagtatttcgtttttatatattttagttcgtcggttttttgaaggttgggttagtttcggtttttcgttagtttttgttcggttttttgagttttagcgatattgtatttaatcgttagttttttttcgtcgttcg

SEQ ID NO: 7958 - DNA, 5819 bp, Artificial Sequence
  Description of Artificial Sequence: Synthetic polynucleotide
cggagggaaatcgggtcgacgataagggtggttattttcgggtttttcgcgttcggtttaagcgtttttgggtggggtagtttaaacggggagaggggtttcgtgggtcgagggttcgaggtcgtagcgagtttagcgtttggttaaatttggttcgcgcgtttttttattgttttgttagggttgtgtgatttttcggagttttacgttttcgtttaaatagtttttagcgtttttgttggtattcggggcgtttttattttagtttttgtattcggcgcgtcgcgcgtagatcggacggaggggaaagttggtaagagcgcggcgttcgcgggagaaagcgttaatgggcggtcgggtgggagtagcgcgttcgttcgtttacgttacgtcggtgcgggttcggttgacgatcgcggcgtttggggacgtcggcgcgtttcgttcgttaggtgtttcgtttggaaatgtttttattagttgtcgtcggtttttcgttggagcgcgcgcgtcgagttttcgcgcggagttttcgcgggttgtcgggagcggtttagcgttatcgtaggtaggtgaggtttttcgttttcgttttcgtttcggggtttcgagattttttttttttttcgaggaggcggaggtttcgcgcggtcgtcgaggggagcgggcggcggcggttgcggcgatttttcggtgcgtttcgggttgcgagttgtttttcgcggtttcggtagttatacggcgcgggcgggagtttttttagtttaggtagggagtgggtttcgtcgtataaattttgcgaggattgtttttgcgtttaaggggataaagtttgttattcgtcgttaggttttttagaggtcgttgcgtttgttgtaagttgcgggaagtagggtgcgcgggtcggcgcggggcggggggtggggggttcggagtggttaggtttgagttttggacgttcggacggcgtttcgtttagttttaggtcgtatttagggagtaagcggcgggggcgtagcgggagagaggagggagagggtcgcgggtttttatggagggcggttgggaatttagagatttatcgtttgtttttgtggtttttttttttattattggtttcgagggggtttcggggttgtgaggaaatgatttgttaatttcgaggttcgttagtgcggcgttagcgatcgtgaggttttttaaatttatattttagtcgggtgtttcgagcggtgggcgggtataggcgtttttaaggtttttggttttaggttttagaaagaaaggtttttgtttggtgtttcgggttttcggtttcgtttttggttggagttaatttttttgggttggaaggagtttttttcggacgagtttttggtgcggggaattggtggtttttagggtaatttttgaagtattagggttaggttggtcgaagaagggttagggttcggtttgttttttcggaggttttttatggtttcgacggttaacggtaatttcgttaaaataggcgattcgtttgcgtttcgcgttaggggttgattattttttgttttttttgcggtttgtttcggttttggtttttcgtttttcggagcgttttaggttagcgggagtattttattttttcgaagttgagtcggtgttgtgtatttcgggagtcggttgatttttggtttatttgtttacgggtgtatttagtatcgggggtttttagagggaggaaggtttagtatttcgagtttatgtagacgcgtttagttgatatttgagatgttgagcgttttatcgttggtgaaagggatattgggtgttttcgttttaggtttggttttttggtgaaggtatttggaaaatattttagtattatttatgggagaagggtggtttagtgagaattttcggtttgggtaggcgggtttaggttaggttatagggttttagtgagatgtttcggtggtcgttaatttataggttggattgattttgtgttttggaatgagtagtggggtttgggtgaggtcgggcgggttaggaggttttttgggtagttgcgagtttttcgaggtagggtgattgtgattgggttcggattttaggcgttggggtttgttggcgggtaggaagtggagcgtgtgtgtgcggcggtttgggaaagtcgatttagaggttaggtttttgggttacggagaaagggtcgttcgttggtggggattggagcgtcgatttatgtatataggttggaaaggtaaaagagaataggagaaggtggcggtggtggttaaaggaagttttcgaaagggtttttacgtattggttgttttgggaagtggaggttgttttttttagattttgtttagaagatgaatggtcgtttgttttggggtttcggttttagttaagtttcgtcgggtttggaaggaaggaaatgtattagttttaggtttgggtgggttgagttgttgtattagagtttagaggtgtagggtataggtggttgggtttttgggttttggtttttttttttagtcggcggagtgtttatagtcgtcgaggttaggttttcgagtataggtgaggaaaggataagttatagttgaatgttttttttttgggggtttttattttttattttagtttttggttcggttgggtttatattttttttttagtcgggttttattatttggagagagcgagtagtttgtaaataataaataatgggaagtagaaggatgttcgggaaaaattagaaaattgtaaggagtggggaggagggagggtgggagaggggaggaaggagggtgggggaggggaggagtaggaggagagggaaaggggttgagagatttatttttagcgagaaatttcggtggttagttttttattatttataggaaggtgatattagcgatttaggtgagaaagaaagaaacgcggtttgtcgcgaaattaatatagaatttagaaataattattaatgttatttgattcgtgttttttatatatttttcgcggttatcgacgttaaattgtttgaataatttgtatggagcggttatttattattttcgatggtttttttttgtaagtagttcggacgtggttcgtttcggtttaacgcgatcggagaattcgtatttttatttgtaaattaaagtaattacgtagtagatattatatgatgtgtattgtggtttttagatagttattaattatttttaatcgagttgttaaaagagtaggtagatttcgtttttgggaggtaggtttgtagttggggagagggcgaggacgttattattaattagagggtgattttggggcgatttataggtttgaatttaggaatttttttgagtaagtttgtataacgttgttttgtacggttttttttttaatttattacgggaggtcggtttagggggcgagggtaatcggggcgagtttcggtttcggagggcgatggcgtagaaggcggggaacgggttcgggatggttcgggcgtttttttgtcgtttttttgtcgtttgtttattggttttcgttttgaatttgggtaaggttttagggagggtattggtcgagggagttttggggtgggcgttcggttttttttttcgattgtttcgtgcgttttagatagaaagttgggtaaaatggataggggagggcgttttcgttaggtatttaacgttttttttttcgtagttagttttgcggggcgtcgggagggacgagtttagcgggaggggtcggggtttgggttgaggaatttgttttttcgagcgcgtagggtcgttcggtagttttcggtttagtcgcgaggggtagggggaagtcggcggagtacggtcggcggaaaggggatcggggaggaaagtcggggaggcgaggtgggggcggtgggttgagcgggaatttaaaagatcgcggtggagaagatggggcgtttttcgcgatattcggttgtttagaggtgtaaagtcggtgggcgtacgttcggggcggttttatagttttcgggtcgttagttttagggtgtcgggttttaattaaggtttcgaagtttttacgtatttgagggtattttgattagtttttgcgggttgttttgcggtcgtagtgggttttgaaagtttatttcggcgtagggtggaaatcggcgggaggcgttgttgattttcgattaaataatagtgacgagacgcgtgcggggcgtttgcgagtttttttttgttattcggagtagagcgcgttagcgcgaggtcgggtcggtcgtttgcgtagcgtcgggttaattttaattgttgattatatttttagcgtgtttttttataggttttatttgtaattgagacgaatgattatagtggggcgggaaggagtagttgtttattaattaatttttaattaaaagtgtttttcgttttcgggtgattaaagagaaatatcgttcgttgggcgatattgattcggatggaatttatttgttaacgttcggaggaatggttttttcgtttatcgcgcggtcgggattgttttggtttttttcggtttgagtcgtcggcgagtgatcggcgagtttgcggttaggtcgggttgcgcgaggtggggttgacgttagagtttttttcgttttaagtcgcgtatatttgatttgacgggttcgcgcgattcgtttttttttttttttttttcgtaaaatatgtatttttgtcgtcgttgcgaggtcgttcggttttagagttttttcgagttttcggaatgcgaagttaaaggaatcgcggcggttatcgttgtttattttgttattcggttagaaaagtttgcggagcgcggggatggattaatcggtttttttgtttcgtttttttagcgtttagaagtttgtagtttcggagtagtggtcgcgttacgtcggttttagcgcgtagaattttgtaggtttcgttcgttcgtttcgggtcgcgttcgttatgttttattcgtagtttggatatttttatttttcggttttttaggtaagcggagtttcgtttcgtttaggttatcgtaggtgtcggtagggcggatggggcggggacggggggtggggagtgttcgatttacgattgtttgcggttttcgagttagtaaggtttgggtcgcgcgttttttacgtttaatttttgttttttaaattttcggggaaaggtcgaggcgttaagaaaattcgacgggtcgggttcgggttttttgatgtttgaattataaggtttaggttgtgttttaggggagttttaggattttaaggaatttttggggaaggaggtttggcgcgtaaatggcgttagaggttttggaaatttttcggggaagggtgtaggtgttcggttgggttttacgtggcggaggaggttagacgcgtataagttagtggaaaggggcgagtattttggtgtggacggcgggaggttcgggggtattcggggtacgttttcgtgggcggcgcgcgggattggtaaggtttagggttttagtttttagttcggtttttcgttagttttcgcggtttttttttgtagtttttgatggttattaattttttgagtacgtgttgcgagttcggaggtcgtacgttggcggatttcgggttcgtcgtttcggtttaggcgtcggtttattgttcggtttacgagagtcggttgttggttatcgcgcgttacgagtttaattcggtcgcggcgttgggcgtttatgggggtttttatggcggatcgtagggttatggtaattacgtgatttacggttcggaggcgttcgttttttattcg

SEQ ID NO: 7959 - DNA, 2001 bp, Artificial Sequence
  Description of Artificial Sequence: Synthetic polynucleotide
cgttttcgtttcgtgttaagcgggtttaaggttcgaggttttttcgtttataatttcggtgttcggaatacgttttcgaggggtcgtgttgtcggggttattattcgcgattggatttcgcgtcgtgttgtttttttcgggtttcgagttcgtttagcggtttgtacggtttaggtttgagttgcgggttttttttgtggggcgcgttgggagtgagttttatttttaaagtttattttaacgttttaggtatgattacgacggtagaggtcggtcgtttattttcgttttttttttcggttagagcgtttttgtcgggagtcgacgatcgcggtttgatttcgggttttatcgtttattttcggttttcgttttttttttacggttaggggttatatatagcggacgtttcgtttttagtcgtttttttgatttttgaatttgggagttagcgtgttcgttggggtatgtattgttacgggtattgggatttttttgttgttgcggggaggagtttcgacggtaggtgggaagatttagtttgttcgcgttttcgttttttagtttttgcgattcgggtcgaggtttttagtttttgggttttttcgtttcgggtttgagggaggggtcgggttttcgggtttgtagattcgttatcgcgcgtgcgtatgcgtcggtcgcgagttttcgggtgtaggtttgggcggtttcggttcgcgtatttgtttaggcgttgcggtttagcgcgttttaatttttagttcgggcggagagcgggggcgggattgaagtatcgtgttttttaaagtattttttcgtcgtcggtagttttggtttcgtaaatgttttagcgcgtttaggcgtacgtagagattggcgcggtagttttcgggttaacggtacgcgagtaaagttggttggcgatttgggatacgtagtagaagttgaggttgtatcgattttcgtcgtttcgggggaggtatgggttcgggtaggtttaggaggaagttgtatagttcgaggttcgggcgggagtggcgggtcgcgggtaagggaacgtatatttggaaggggttaggatttcggttggagtttggttttttatggcgaggaagtcgattgggaagggttttttggcgaggtttttttgttgtgttattttttttcggtagcgtcgggcgcggggaacgcggggttgtatcggggcgggggagggggttttattcggcggtttcgaggattcgattttggggtcgggttcggcgggtaggtttgtttaggagttagttggtaaatgtagcggattgttacgttattttattgttattatttattgtaaattattgttttaagttttcgggagaattcgtcgaatttgagaggggggagggggatgggggtgggcgcgtaggaagttttataggtattagggattggtgatttaggatattagtttttcgagttttttttgggaatttttagtatttagattgtttttgattgtagggattacggtggggcgttttttttttaagtttttttcgggatatcgggcgcgtttttttcgtttttgggttagcgtatatttttttacgcgatgattagtatagttattgtgaggttcggttttggtcgcgtttgttttttgcgagtgataataataaaaattattggaattgtaaggaagtttttggtttcggttttttagtcgttgttgttttgggtgtttcggttgcggaaagatttcgtagtcgggttcgatttacgagtggaatatcgggttgcggatttagtcgggtttataggattggcgcggggtttcggggataggtttcgtagggtttttttgcgtatcgtttgggacgtcgattttgttaatttggaggataatttttgtttttattttattagtagatttttaaaaatttagtcgtcgttgaaacgtgttttttattcgttcggtttgtttgtagtttttgacgagtttcggtatagttttcg

SEQ ID NO: 7960 - DNA, 1265 bp, Artificial Sequence
  Description of Artificial Sequence: Synthetic polynucleotide
cggttcgggcgttaggtagaattttagttcgatgttgtcgtcgtcgggggagagggaattcgttgggagggatagtcgggggttggggaaggaagagcgggtgttgggagggtttaatattggcggagttttaggtggcgacgcgggcggcgagagttgtttcgaggcgggggtttcgggtaggtcgttttttacgtagtatacggagtagaagatttgttttttggcgagggacgggcgtcgttgatttagtacgtttaggattagttcgtcggcggtttttacgcgggttttgggttttagtttttcgtcggggggcgttttttgttgtttatttttttttttttttcgatttttagttttttttttttttttttttagttttaattgtagtggtaaggtttggggattgagaggttcggtgagtgttagtttcgtaggttgcgtcggtgttcggtttttattttagttcgggggttttaggtttttcgcgggttttggggcgttggtgttcgcgtagttttagtcgttttcgtagttatcgtcgttcggtttcgcggaggcggcgcgtagcgggggcgttcgggcgttgtttttttgaggtttcgggggtttagggtggttcgtagtgttattggttagggtttgcgatttttggggttcgtcgtcgtcgtttatcgtgttttgtttttcgtttatcgtcgttcgcggttcgcgtcgtcgttgtttatttagtcgtcgggatttttattcggcgttcgcgggtagcgggggtagtggttcggttcgattcgcggtttcgtttttgttttcgggtttttttttttgggttgggacgttttaagtttttttcggggagttcgtgtttcgaggttgcggcgcgtggggagtttggttcggttcgtcgttttttttcgtattttggcgcggcggggtatcgtttcgggggcgtcgagggtcgttcgttttgggttcgggcgcgttcgttttatatgtagttcggggcggcgtcgtagttttagcgagttttaggcgggatagaggggtttgggaggagacggtcgttagtttcgcgttattatcggtttcggttgtcggacgcgcggttcgagggcggtggttaaagggtcgaggggtttgtggcgtcgtcgcggcgcgtattaggaggtgtagtcggagcgttggttagtcgtagggtttttgggggagaggtcggagcgggcgattttttttttttcgcgttttatttatagtttttttcgtcg

SEQ ID NO: 7961 - DNA, 1360 bp, Artificial Sequence
  Description of Artificial Sequence: Synthetic polynucleotide
cgtcgaggatgtggttttcgtttttcgtagtcgtcgtaggagtttttgtttttaaagcggtaggtaggggttttagcgggtttattttaatttgggaaggtcggtgcgtttttttatagatttcgtagggcgttttttttggggattattgaagttttggtatttttaattttagttttttcgcgttacgggaaacgaagacgatatttttttgaataatttcggatgtgttattatagaggggtattttatattggtttttattttaatttttatttagtatattgtttgtttattttttaaatttcgtgcggattgcggtatttagtttcgggggattttttagttttgttttttcgattcgcgtaggtgcgttcgtttatttaagggtagggaggtatgttttttcgggttttttcggtcgtatggtttgtttgtttttttggtttttttttttcgtattaggaggggcgtgagatagttaggtcgatttttatttcggtagtttgcggcgatcggtcgtttcgagcgtagcgttagatatttgggttggggggtgttagtttgacgcgtaggaagggcgtagcggcgggagggggttttattttagatttgggaggtttgtttggcgtcggttttcgttcgtttttcgtcggtggaggtcgcggttggcggagatcgttaagttagaggaggggattcgaggtttcggttgggcgaaggttttggagggggagaagacggtcgaggcgtggaggggtagtcgcggcggggcgatttttatttgtttattgcggggtttgttcgtggggtcggggtagatttcgtaaaggacgcgtagtttgtaagttcgcggttcgcgcggcgcggggatggggagcgtgtgcgtcgaggagcgcgcgtcgagtcgggttttcgcgtttgtgtggtcggttggcggtcggggttcgtgtgtttttgcgcggcggcgtgtgcgtgtgcgtacgcggggattacgttcgttcggagtcgtcgtcgtcgtcgttattttttgttcggggtcgagcgtagcgttttttttgttcgtttcgcgcggcgcggtagtttagtttggtttcgttttgcgggagaggcgtcgttttcgtcgcgaagttaggttgggcgttggagggaggcgatcgattatcgtttttttttgtttattttataggttggggagggggtgttgtaggttaatgagcgttcgggggcggggttagatcgagggcggtgcggtggggggcgcggtggggggcgtcgggttgtttaattcgattttattcgtagtatagattggagtaggagttgcggcgggaaattttagcggcgggggtcgggggcg

SEQ ID NO: 7962 - DNA, 362 bp, Artificial Sequence
  Description of Artificial Sequence: Synthetic polynucleotide
cgcgggggttatcgcgttcgcgaacgtagagtttatacgtggattttcgcgtttgtgatgtttcgattcgtttcgggttttcgtatagataatgtcgcgcgtttttttcgtagttatttcgggattcgcgtttcgcgtcgttcggacgtttttttgcgtttgtcggggatatttatcgatattaggaattttagcgtgtttatatagtttcgttcggttttttggagttcgttgagtacgtatacgcgtaggcgaagttgtttttttaggtttttggcgttttcggcgcggttgttttcgcggttgttttcgtttatggtcggcggcggtgcgtagcgcggcgttgttcgtcgtgttgagcg

SEQ ID NO: 7963 - DNA, 56 bp, Homo sapiens; identical to SEQ ID NO: 112

SEQ ID NO: 7964 - DNA, 431 bp, Homo sapiens; identical to SEQ ID NO: 374

SEQ ID NO: 7965 - DNA, 84 bp, Homo sapiens; identical to SEQ ID NO: 396

SEQ ID NO: 7966 - DNA, 50 bp, Homo sapiens; identical to SEQ ID NO: 418

SEQ ID NO: 7967 - DNA, 166 bp, Homo sapiens; identical to SEQ ID NO: 2

SEQ ID NO: 7968 - DNA, 125 bp, Homo sapiens; identical to SEQ ID NO: 13

SEQ ID NO: 7969 - DNA, 396 bp, Homo sapiens; identical to SEQ ID NO: 35

SEQ ID NO: 7970 - DNA, 173 bp, Homo sapiens; identical to SEQ ID NO: 46

SEQ ID NO: 7971 - DNA, 97 bp, Homo sapiens; identical to SEQ ID NO: 57

SEQ ID NO: 7972 - DNA, 208 bp, Homo sapiens; identical to SEQ ID NO: 68

SEQ ID NO: 7973 - DNA, 647 bp, Homo sapiens; identical to SEQ ID NO: 79

SEQ ID NO: 7974 - DNA, 282 bp, Homo sapiens; identical to SEQ ID NO: 90

SEQ ID NO: 7975 - DNA, 141 bp, Homo sapiens; identical to SEQ ID NO: 135

SEQ ID NO: 7976 - DNA, 25 bp, Homo sapiens
cgtgcaccctgaggtctggttggcg

SEQ ID NO: 7977 - DNA, 56 bp, Homo sapiens; identical to SEQ ID NO: 540

SEQ ID NO: 7978 - DNA, 431 bp, Homo sapiens; identical to SEQ ID NO: 802

SEQ ID NO: 7979 - DNA, 84 bp, Homo sapiens; identical to SEQ ID NO: 824

SEQ ID NO: 7980 - DNA, 50 bp, Homo sapiens; identical to SEQ ID NO: 846

SEQ ID NO: 7981 - DNA, 166 bp, Homo sapiens; identical to SEQ ID NO: 430

SEQ ID NO: 7982 - DNA, 125 bp, Homo sapiens; identical to SEQ ID NO: 441

SEQ ID NO: 7983 - DNA, 396 bp, Homo sapiens; identical to SEQ ID NO: 463

SEQ ID NO: 7984 - DNA, 173 bp, Homo sapiens; identical to SEQ ID NO: 474

SEQ ID NO: 7985 - DNA, 97 bp, Homo sapiens; identical to SEQ ID NO: 485

SEQ ID NO: 7986 - DNA, 208 bp, Homo sapiens; identical to SEQ ID NO: 496

SEQ ID NO: 7987 - DNA, 647 bp, Homo sapiens; identical to SEQ ID NO: 507

SEQ ID NO: 7988 - DNA, 282 bp, Homo sapiens; identical to SEQ ID NO: 518

SEQ ID NO: 7989 - DNA, 141 bp, Homo sapiens; identical to SEQ ID NO: 563

SEQ ID NO: 7990 - DNA, 25 bp, Homo sapiens
cgccaaccagacctcagggtgcacg

SEQ ID NO: 7991 - DNA, 56 bp, Artificial Sequence; identical to SEQ ID NO: 968
  Description of Artificial Sequence: Synthetic oligonucleotide

SEQ ID NO: 7992 - DNA, 431 bp, Artificial Sequence; identical to SEQ ID NO: 1230
  Description of Artificial Sequence: Synthetic polynucleotide

SEQ ID NO: 7993 - DNA, 84 bp, Artificial Sequence; identical to SEQ ID NO: 1252
  Description of Artificial Sequence: Synthetic oligonucleotide

SEQ ID NO: 7994 - DNA, 50 bp, Artificial Sequence; identical to SEQ ID NO: 1274
  Description of Artificial Sequence: Synthetic oligonucleotide

SEQ ID NO: 7995 - DNA, 166 bp, Artificial Sequence; identical to SEQ ID NO: 858
  Description of Artificial Sequence: Synthetic polynucleotide

SEQ ID NO: 7996 - DNA, 125 bp, Artificial Sequence; identical to SEQ ID NO: 869
  Description of Artificial Sequence: Synthetic polynucleotide

SEQ ID NO: 7997 - DNA, 396 bp, Artificial Sequence; identical to SEQ ID NO: 891
  Description of Artificial Sequence: Synthetic polynucleotide

SEQ ID NO: 7998 - DNA, 173 bp, Artificial Sequence; identical to SEQ ID NO: 902
  Description of Artificial Sequence: Synthetic polynucleotide

SEQ ID NO: 7999 - DNA, 97 bp, Artificial Sequence; identical to SEQ ID NO: 913
  Description of Artificial Sequence: Synthetic oligonucleotide

SEQ ID NO: 8000 - DNA, 208 bp, Artificial Sequence; identical to SEQ ID NO: 924
  Description of Artificial Sequence: Synthetic polynucleotide

SEQ ID NO: 8001 - DNA, 647 bp, Artificial Sequence; identical to SEQ ID NO: 935
  Description of Artificial Sequence: Synthetic polynucleotide

SEQ ID NO: 8002 - DNA, 282 bp, Artificial Sequence; identical to SEQ ID NO: 946
  Description of Artificial Sequence: Synthetic polynucleotide

SEQ ID NO: 8003 - DNA, 141 bp, Artificial Sequence; identical to SEQ ID NO: 991
  Description of Artificial Sequence: Synthetic polynucleotide

SEQ ID NO: 8004 - DNA, 25 bp, Artificial Sequence
  Description of Artificial Sequence: Synthetic oligonucleotide
ygtgtattttgaggtttggttggyg

SEQ ID NO: 8005 - DNA, 56 bp, Artificial Sequence; identical to SEQ ID NO: 1396
  Description of Artificial Sequence: Synthetic oligonucleotide

SEQ ID NO: 8006 - DNA, 431 bp, Artificial Sequence; identical to SEQ ID NO: 1658
  Description of Artificial Sequence: Synthetic polynucleotide

SEQ ID NO: 8007 - DNA, 84 bp, Artificial Sequence; identical to SEQ ID NO: 1680
  Description of Artificial Sequence: Synthetic oligonucleotide

SEQ ID NO: 8008 - DNA, 50 bp, Artificial Sequence; identical to SEQ ID NO: 1702
  Description of Artificial Sequence: Synthetic oligonucleotide

SEQ ID NO: 8009 - DNA, 166 bp, Artificial Sequence; identical to SEQ ID NO: 1286
  Description of Artificial Sequence: Synthetic polynucleotide

SEQ ID NO: 8010 - DNA, 125 bp, Artificial Sequence; identical to SEQ ID NO: 1297
  Description of Artificial Sequence: Synthetic polynucleotide

SEQ ID NO: 8011 - DNA, 396 bp, Artificial Sequence; identical to SEQ ID NO: 1319
  Description of Artificial Sequence: Synthetic polynucleotide

SEQ ID NO: 8012 - DNA, 173 bp, Artificial Sequence; identical to SEQ ID NO: 1330
  Description of Artificial Sequence: Synthetic polynucleotide

SEQ ID NO: 8013 - DNA, 97 bp, Artificial Sequence; identical to SEQ ID NO: 1341
  Description of Artificial Sequence: Synthetic oligonucleotide

SEQ ID NO: 8014 - DNA, 208 bp, Artificial Sequence; identical to SEQ ID NO: 1352
  Description of Artificial Sequence: Synthetic polynucleotide

SEQ ID NO: 8015 - DNA, 647 bp, Artificial Sequence; identical to SEQ ID NO: 1363
  Description of Artificial Sequence: Synthetic polynucleotide

SEQ ID NO: 8016 - DNA, 282 bp, Artificial Sequence; identical to SEQ ID NO: 1374
  Description of Artificial Sequence: Synthetic polynucleotide

SEQ ID NO: 8017 - DNA, 141 bp, Artificial Sequence; identical to SEQ ID NO: 1419
  Description of Artificial Sequence: Synthetic polynucleotide

SEQ ID NO: 8018 - DNA, 25 bp, Artificial Sequence
  Description of Artificial Sequence: Synthetic oligonucleotide
cgtgtattttgaggtttggttggcg

SEQ ID NO: 8019 - DNA, 56 bp, Artificial Sequence; identical to SEQ ID NO: 1824
  Description of Artificial Sequence: Synthetic oligonucleotide

SEQ ID NO: 8020 - DNA, 431 bp, Artificial Sequence; identical to SEQ ID NO: 2086
  Description of Artificial Sequence: Synthetic polynucleotide

SEQ ID NO: 8021 - DNA, 84 bp, Artificial Sequence; identical to SEQ ID NO: 2108
  Description of Artificial Sequence: Synthetic oligonucleotide

SEQ ID NO: 8022 - DNA, 50 bp, Artificial Sequence; identical to SEQ ID NO: 2130
  Description of Artificial Sequence: Synthetic oligonucleotide

SEQ ID NO: 8023 - DNA, 166 bp, Artificial Sequence; identical to SEQ ID NO: 1714
  Description of Artificial Sequence: Synthetic polynucleotide

SEQ ID NO: 8024 - DNA, 125 bp, Artificial Sequence; identical to SEQ ID NO: 1725
  Description of Artificial Sequence: Synthetic polynucleotide

SEQ ID NO: 8025 - DNA, 396 bp, Artificial Sequence; identical to SEQ ID NO: 1747
  Description of Artificial Sequence: Synthetic polynucleotide

SEQ ID NO: 8026 - DNA, 173 bp, Artificial Sequence; identical to SEQ ID NO: 1758
  Description of Artificial Sequence: Synthetic polynucleotide

SEQ ID NO: 8027 - DNA, 97 bp, Artificial Sequence; identical to SEQ ID NO: 1769
  Description of Artificial Sequence: Synthetic oligonucleotide

SEQ ID NO: 8028 - DNA, 208 bp, Artificial Sequence; identical to SEQ ID NO: 1780
  Description of Artificial Sequence: Synthetic polynucleotide

SEQ ID NO: 8029 - DNA, 647 bp, Artificial Sequence; identical to SEQ ID NO: 1791
  Description of Artificial Sequence: Synthetic polynucleotide

SEQ ID NO: 8030 - DNA, 282 bp, Artificial Sequence; identical to SEQ ID NO: 1802
  Description of Artificial Sequence: Synthetic polynucleotide

SEQ ID NO: 8031 - DNA, 141 bp, Artificial Sequence; identical to SEQ ID NO: 1847
  Description of Artificial Sequence: Synthetic polynucleotide

SEQ ID NO: 8032 - DNA, 25 bp, Artificial Sequence
  Description of Artificial Sequence: Synthetic oligonucleotide
ygttaattagattttagggtgtayg

SEQ ID NO: 8033 - DNA, 56 bp, Artificial Sequence; identical to SEQ ID NO: 2252
  Description of Artificial Sequence: Synthetic oligonucleotide

SEQ ID NO: 8034 - DNA, 431 bp, Artificial Sequence; identical to SEQ ID NO: 2514
  Description of Artificial Sequence: Synthetic polynucleotide

SEQ ID NO: 8035 - DNA, 84 bp, Artificial Sequence; identical to SEQ ID NO: 2536
  Description of Artificial Sequence: Synthetic oligonucleotide

SEQ ID NO: 8036 - DNA, 50 bp, Artificial Sequence; identical to SEQ ID NO: 2558
  Description of Artificial Sequence: Synthetic oligonucleotide

SEQ ID NO: 8037 - DNA, 166 bp, Artificial Sequence; identical to SEQ ID NO: 2142
  Description of Artificial Sequence: Synthetic polynucleotide

SEQ ID NO: 8038 - DNA, 125 bp, Artificial Sequence; identical to SEQ ID NO: 2153
  Description of Artificial Sequence: Synthetic polynucleotide

SEQ ID NO: 8039 - DNA, 396 bp, Artificial Sequence; identical to SEQ ID NO: 2175
  Description of Artificial Sequence: Synthetic polynucleotide

SEQ ID NO: 8040 - DNA, 173 bp, Artificial Sequence; identical to SEQ ID NO: 2186
  Description of Artificial Sequence: Synthetic polynucleotide

SEQ ID NO: 8041 - DNA, 97 bp, Artificial Sequence; identical to SEQ ID NO: 2197
  Description of Artificial Sequence: Synthetic oligonucleotide

SEQ ID NO: 8042 - DNA, 208 bp, Artificial Sequence; identical to SEQ ID NO: 2208
  Description of Artificial Sequence: Synthetic polynucleotide

SEQ ID NO: 8043 - DNA, 647 bp, Artificial Sequence; identical to SEQ ID NO: 2219
  Description of Artificial Sequence: Synthetic polynucleotide

SEQ ID NO: 8044 - DNA, 282 bp, Artificial Sequence; identical to SEQ ID NO: 2230
  Description of Artificial Sequence: Synthetic polynucleotide

SEQ ID NO: 8045 - DNA, 141 bp, Artificial Sequence; identical to SEQ ID NO: 2275
  Description of Artificial Sequence: Synthetic polynucleotide

SEQ ID NO: 8046 - DNA, 25 bp, Artificial Sequence
  Description of Artificial Sequence: Synthetic oligonucleotide
cgttaattagattttagggtgtacg

SEQ ID NO: 8047 - DNA, 255 bp, Homo sapiens; identical to SEQ ID NO: 2680

SEQ ID NO: 8048 - DNA, 630 bp, Homo sapiens; identical to SEQ ID NO: 2942

SEQ ID NO: 8049 - DNA, 283 bp, Homo sapiens; identical to SEQ ID NO: 2964

SEQ ID NO: 8050 - DNA, 249 bp, Homo sapiens; identical to SEQ ID NO: 2986

SEQ ID NO: 8051 - DNA, 365 bp, Homo sapiens; identical to SEQ ID NO: 2570

SEQ ID NO: 8052 - DNA, 324 bp, Homo sapiens; identical to SEQ ID NO: 2581

SEQ ID NO: 8053 - DNA, 595 bp, Homo sapiens; identical to SEQ ID NO: 2603

SEQ ID NO: 8054 - DNA, 372 bp, Homo sapiens; identical to SEQ ID NO: 2614

SEQ ID NO: 8055 - DNA, 296 bp, Homo sapiens; identical to SEQ ID NO: 2625

SEQ ID NO: 8056 - DNA, 407 bp, Homo sapiens; identical to SEQ ID NO: 2636

SEQ ID NO: 8057 - DNA, 846 bp, Homo sapiens; identical to SEQ ID NO: 2647

SEQ ID NO: 8058 - DNA, 481 bp, Homo sapiens; identical to SEQ ID NO: 2658

SEQ ID NO: 8059 - DNA, 340 bp, Homo sapiens; identical to SEQ ID NO: 2703

SEQ ID NO: 8060 - DNA, 224 bp, Homo sapiens; identical to SEQ ID NO: 2714

SEQ ID NO: 8061 - DNA, 255 bp, Homo sapiens; identical to SEQ ID NO: 3108

SEQ ID NO: 8062 - DNA, 630 bp, Homo sapiens; identical to SEQ ID NO: 3370

SEQ ID NO: 8063 - DNA, 283 bp, Homo sapiens; identical to SEQ ID NO: 3392

SEQ ID NO: 8064 - DNA, 249 bp, Homo sapiens; identical to SEQ ID NO: 3414

SEQ ID NO: 8065 - DNA, 365 bp, Homo sapiens; identical to SEQ ID NO: 2998

SEQ ID NO: 8066 - DNA, 324 bp, Homo sapiens; identical to SEQ ID NO: 3009

SEQ ID NO: 8067 - DNA, 595 bp, Homo sapiens; identical to SEQ ID NO: 3031

SEQ ID NO: 8068 - DNA, 372 bp, Homo sapiens; identical to SEQ ID NO: 3042

SEQ ID NO: 8069 - DNA, 296 bp, Homo sapiens; identical to SEQ ID NO: 3053

SEQ ID NO: 8070 - DNA, 407 bp, Homo sapiens; identical to SEQ ID NO: 3064

SEQ ID NO: 8071 - DNA, 846 bp, Homo sapiens; identical to SEQ ID NO: 3075

SEQ ID NO: 8072 - DNA, 481 bp, Homo sapiens; identical to SEQ ID NO: 3086

SEQ ID NO: 8073 - DNA, 340 bp, Homo sapiens; identical to SEQ ID NO: 3131

SEQ ID NO: 8074 - DNA, 224 bp, Homo sapiens; identical to SEQ ID NO: 3142

SEQ ID NO: 8075 - DNA, 255 bp, Artificial Sequence; identical to SEQ ID NO: 3536
  Description of Artificial Sequence: Synthetic polynucleotide

SEQ ID NO: 8076 - DNA, 630 bp, Artificial Sequence; identical to SEQ ID NO: 3798
  Description of Artificial Sequence: Synthetic polynucleotide

SEQ ID NO: 8077 - DNA, 283 bp, Artificial Sequence; identical to SEQ ID NO: 3820
  Description of Artificial Sequence: Synthetic polynucleotide

SEQ ID NO: 8078 - DNA, 249 bp, Artificial Sequence; identical to SEQ ID NO: 3842
  Description of Artificial Sequence: Synthetic polynucleotide

SEQ ID NO: 8079 - DNA, 365 bp, Artificial Sequence; identical to SEQ ID NO: 3426
  Description of Artificial Sequence: Synthetic polynucleotide

SEQ ID NO: 8080 - DNA, 324 bp, Artificial Sequence; identical to SEQ ID NO: 3437
  Description of Artificial Sequence: Synthetic polynucleotide

SEQ ID NO: 8081 - DNA, 595 bp, Artificial Sequence; identical to SEQ ID NO: 3459
  Description of Artificial Sequence: Synthetic polynucleotide

SEQ ID NO: 8082 - DNA, 372 bp, Artificial Sequence; identical to SEQ ID NO: 3470
  Description of Artificial Sequence: Synthetic polynucleotide

SEQ ID NO: 8083 - DNA, 296 bp, Artificial Sequence; identical to SEQ ID NO: 3481
  Description of Artificial Sequence: Synthetic polynucleotide

SEQ ID NO: 8084 - DNA, 407 bp, Artificial Sequence; identical to SEQ ID NO: 3492
  Description of Artificial Sequence: Synthetic polynucleotide

SEQ ID NO: 8085 - DNA, 846 bp, Artificial Sequence; identical to SEQ ID NO: 3503
  Description of Artificial Sequence: Synthetic polynucleotide

SEQ ID NO: 8086 - DNA, 481 bp, Artificial Sequence; identical to SEQ ID NO: 3514
  Description of Artificial Sequence: Synthetic polynucleotide

SEQ ID NO: 8087 - DNA, 340 bp, Artificial Sequence; identical to SEQ ID NO: 3559
  Description of Artificial Sequence: Synthetic polynucleotide

SEQ ID NO: 8088 - DNA, 224 bp, Artificial Sequence; identical to SEQ ID NO: 3570
  Description of Artificial Sequence: Synthetic polynucleotide

SEQ ID NO: 8089 - DNA, 255 bp, Artificial Sequence; identical to SEQ ID NO: 3964
  Description of Artificial Sequence: Synthetic polynucleotide

SEQ ID NO: 8090 - DNA, 630 bp, Artificial Sequence; identical to SEQ ID NO: 4226
  Description of Artificial Sequence: Synthetic polynucleotide

SEQ ID NO: 8091 - DNA, 283 bp, Artificial Sequence; identical to SEQ ID NO: 4248
  Description of Artificial Sequence: Synthetic polynucleotide

SEQ ID NO: 8092 - DNA, 249 bp, Artificial Sequence; identical to SEQ ID NO: 4270
  Description of Artificial Sequence: Synthetic polynucleotide

SEQ ID NO: 8093 - DNA, 365 bp, Artificial Sequence; identical to SEQ ID NO: 3854
  Description of Artificial Sequence: Synthetic polynucleotide

SEQ ID NO: 8094 - DNA, 324 bp, Artificial Sequence; identical to SEQ ID NO: 3865
  Description of Artificial Sequence: Synthetic polynucleotide

SEQ ID NO: 8095 - DNA, 595 bp, Artificial Sequence; identical to SEQ ID NO: 3887
  Description of Artificial Sequence: Synthetic polynucleotide

SEQ ID NO: 8096 - DNA, 372 bp, Artificial Sequence; identical to SEQ ID NO: 3898
  Description of Artificial Sequence: Synthetic polynucleotide

SEQ ID NO: 8097 - DNA, 296 bp, Artificial Sequence; identical to SEQ ID NO: 3909
  Description of Artificial Sequence: Synthetic polynucleotide

SEQ ID NO: 8098 - DNA, 407 bp, Artificial Sequence; identical to SEQ ID NO: 3920
  Description of Artificial Sequence: Synthetic polynucleotide

SEQ ID NO: 8099 - DNA, 846 bp, Artificial Sequence; identical to SEQ ID NO: 3931
  Description of Artificial Sequence: Synthetic polynucleotide

SEQ ID NO: 8100 - DNA, 481 bp, Artificial Sequence; identical to SEQ ID NO: 3942
  Description of Artificial Sequence: Synthetic polynucleotide

SEQ ID NO: 8101 - DNA, 340 bp, Artificial Sequence; identical to SEQ ID NO: 3987
  Description of Artificial Sequence: Synthetic polynucleotide

SEQ ID NO: 8102 - DNA, 224 bp, Artificial Sequence; identical to SEQ ID NO: 3998
  Description of Artificial Sequence: Synthetic polynucleotide

SEQ ID NO: 8103 - DNA, 255 bp, Artificial Sequence; identical to SEQ ID NO: 4392
  Description of Artificial Sequence: Synthetic polynucleotide

SEQ ID NO: 8104 - DNA, 630 bp, Artificial Sequence; identical to SEQ ID NO: 4654
  Description of Artificial Sequence: Synthetic polynucleotide

SEQ ID NO: 8105 - DNA, 283 bp, Artificial Sequence; identical to SEQ ID NO: 4676
  Description of Artificial Sequence: Synthetic polynucleotide

SEQ ID NO: 8106 - DNA, 249 bp, Artificial Sequence; identical to SEQ ID NO: 4698
  Description of Artificial Sequence: Synthetic polynucleotide

SEQ ID NO: 8107 - DNA, 365 bp, Artificial Sequence; identical to SEQ ID NO: 4282
  Description of Artificial Sequence: Synthetic polynucleotide

SEQ ID NO: 8108 - DNA, 324 bp, Artificial Sequence; identical to SEQ ID NO: 4293
  Description of Artificial Sequence: Synthetic polynucleotide

SEQ ID NO: 8109 - DNA, 595 bp, Artificial Sequence; identical to SEQ ID NO: 4315
  Description of Artificial Sequence: Synthetic polynucleotide

SEQ ID NO: 8110 - DNA, 372 bp, Artificial Sequence; identical to SEQ ID NO: 4326
  Description of Artificial Sequence: Synthetic polynucleotide

SEQ ID NO: 8111 - DNA, 296 bp, Artificial Sequence; identical to SEQ ID NO: 4337
  Description of Artificial Sequence: Synthetic polynucleotide

SEQ ID NO: 8112 - DNA, 407 bp, Artificial Sequence; identical to SEQ ID NO: 4348
  Description of Artificial Sequence: Synthetic polynucleotide

SEQ ID NO: 8113 - DNA, 846 bp, Artificial Sequence; identical to SEQ ID NO: 4359
  Description of Artificial Sequence: Synthetic polynucleotide

SEQ ID NO: 8114 - DNA, 481 bp, Artificial Sequence; identical to SEQ ID NO: 4370
  Description of Artificial Sequence: Synthetic polynucleotide

SEQ ID NO: 8115 - DNA, 340 bp, Artificial Sequence; identical to SEQ ID NO: 4415
  Description of Artificial Sequence: Synthetic polynucleotide

SEQ ID NO: 8116 - DNA, 224 bp, Artificial Sequence; identical to SEQ ID NO: 4426
  Description of Artificial Sequence: Synthetic polynucleotide

SEQ ID NO: 8117 - DNA, 255 bp, Artificial Sequence; identical to SEQ ID NO: 4820
  Description of Artificial Sequence: Synthetic polynucleotide

SEQ ID NO: 8118 - DNA, 630 bp, Artificial Sequence; identical to SEQ ID NO: 5082
  Description of Artificial Sequence: Synthetic polynucleotide

SEQ ID NO: 8119 - DNA, 283 bp, Artificial Sequence; identical to SEQ ID NO: 5104
  Description of Artificial Sequence: Synthetic polynucleotide

SEQ ID NO: 8120 - DNA, 249 bp, Artificial Sequence; identical to SEQ ID NO: 5126
  Description of Artificial Sequence: Synthetic polynucleotide

SEQ ID NO: 8121 - DNA, 365 bp, Artificial Sequence; identical to SEQ ID NO: 4710
  Description of Artificial Sequence: Synthetic polynucleotide

SEQ ID NO: 8122 - DNA, 324 bp, Artificial Sequence; identical to SEQ ID NO: 4721
  Description of Artificial Sequence: Synthetic polynucleotide

SEQ ID NO: 8123 - DNA, 595 bp, Artificial Sequence; identical to SEQ ID NO: 4743
  Description of Artificial Sequence: Synthetic polynucleotide

SEQ ID NO: 8124 - DNA, 372 bp, Artificial Sequence; identical to SEQ ID NO: 4754
  Description of Artificial Sequence: Synthetic polynucleotide

SEQ ID NO: 8125 - DNA, 296 bp, Artificial Sequence; identical to SEQ ID NO: 4765
  Description of Artificial Sequence: Synthetic polynucleotide

SEQ ID NO: 8126 - DNA, 407 bp, Artificial Sequence; identical to SEQ ID NO: 4776
  Description of Artificial Sequence: Synthetic polynucleotide

SEQ ID NO: 8127 - DNA, 846 bp, Artificial Sequence; identical to SEQ ID NO: 4787
  Description of Artificial Sequence: Synthetic polynucleotide

SEQ ID NO: 8128 - DNA, 481 bp, Artificial Sequence; identical to SEQ ID NO: 4798
  Description of Artificial Sequence: Synthetic polynucleotide

SEQ ID NO: 8129 - DNA, 340 bp, Artificial Sequence; identical to SEQ ID NO: 4843
  Description of Artificial Sequence: Synthetic polynucleotide

SEQ ID NO: 8130 - DNA, 224 bp, Artificial Sequence; identical to SEQ ID NO: 4854
  Description of Artificial Sequence: Synthetic polynucleotide

SEQ ID NO: 8131 - DNA, 395 bp, Homo sapiens; identical to SEQ ID NO: 7829

SEQ ID NO: 8132 - DNA, 5819 bp, Homo sapiens; identical to SEQ ID NO: 7838

SEQ ID NO: 8133 - DNA, 1265 bp, Homo sapiens; identical to SEQ ID NO: 7840

SEQ ID NO: 8134 - DNA, 362 bp, Homo sapiens; identical to SEQ ID NO: 7842

SEQ ID NO: 8135 - DNA, 572 bp, Homo sapiens; identical to SEQ ID NO: 7820

SEQ ID NO: 8136 - DNA, 2400 bp, Homo sapiens; identical to SEQ ID NO: 7822

SEQ ID NO: 8137 - DNA, 1859 bp, Homo sapiens; identical to SEQ ID NO: 7823

SEQ ID NO: 8138 - DNA, 902 bp, Homo sapiens; identical to SEQ ID NO: 7824

SEQ ID NO: 8139 - DNA, 2044 bp, Homo sapiens; identical to SEQ ID NO: 7825

SEQ ID NO: 8140 - DNA, 1152 bp, Homo sapiens; identical to SEQ ID NO: 7826

SEQ ID NO: 8141 - DNA, 872 bp, Homo sapiens; identical to SEQ ID NO: 7827

SEQ ID NO: 8142 - DNA, 1743 bp, Homo sapiens; identical to SEQ ID NO: 7832

SEQ ID NO: 8143 - DNA, 2405 bp, Homo sapiens; identical to SEQ ID NO: 7833

SEQ ID NO: 8144 - DNA, 395 bp, Homo sapiens; identical to SEQ ID NO: 7853

SEQ ID NO: 8145 - DNA, 5819 bp, Homo sapiens; identical to SEQ ID NO: 7862

SEQ ID NO: 8146 - DNA, 1265 bp, Homo sapiens; identical to SEQ ID NO: 7864

SEQ ID NO: 8147 - DNA, 362 bp, Homo sapiens; identical to SEQ ID NO: 7866

SEQ ID NO: 8148 - DNA, 572 bp, Homo sapiens; identical to SEQ ID NO: 7844

SEQ ID NO: 8149 - DNA, 2400 bp, Homo sapiens; identical to SEQ ID NO: 7846

SEQ ID NO: 8150 - DNA, 1859 bp, Homo sapiens; identical to SEQ ID NO: 7847

SEQ ID NO: 8151 - DNA, 902 bp, Homo sapiens; identical to SEQ ID NO: 7848

SEQ ID NO: 8152 - DNA, 2044 bp, Homo sapiens; identical to SEQ ID NO: 7849

SEQ ID NO: 8153 - DNA, 1152 bp, Homo sapiens; identical to SEQ ID NO: 7850

SEQ ID NO: 8154 - DNA, 872 bp, Homo sapiens; identical to SEQ ID NO: 7851

SEQ ID NO: 8155 - DNA, 1743 bp, Homo sapiens; identical to SEQ ID NO: 7856

SEQ ID NO: 8156 - DNA, 2405 bp, Homo sapiens; identical to SEQ ID NO: 7857

SEQ ID NO: 8157 - DNA, 395 bp, Artificial Sequence; identical to SEQ ID NO: 7877
  Description of Artificial Sequence: Synthetic polynucleotide

SEQ ID NO: 8158 - DNA, 5819 bp, Artificial Sequence; identical to SEQ ID NO: 7886
  Description of Artificial Sequence: Synthetic polynucleotide

SEQ ID NO: 8159 - DNA, 1265 bp, Artificial Sequence; identical to SEQ ID NO: 7888
  Description of Artificial Sequence: Synthetic polynucleotide

SEQ ID NO: 8160 - DNA, 362 bp, Artificial Sequence; identical to SEQ ID NO: 7890
  Description of Artificial Sequence: Synthetic polynucleotide

SEQ ID NO: 8161 - DNA, 572 bp, Artificial Sequence; identical to SEQ ID NO: 7868
  Description of Artificial Sequence: Synthetic polynucleotide

SEQ ID NO: 8162 - DNA, 2400 bp, Artificial Sequence; identical to SEQ ID NO: 7870
  Description of Artificial Sequence: Synthetic polynucleotide

SEQ ID NO: 8163 - DNA, 1859 bp, Artificial Sequence; identical to SEQ ID NO: 7871
  Description of Artificial Sequence: Synthetic polynucleotide

SEQ ID NO: 8164 - DNA, 902 bp, Artificial Sequence; identical to SEQ ID NO: 7872
  Description of Artificial Sequence: Synthetic polynucleotide

SEQ ID NO: 8165 - DNA, 2044 bp, Artificial Sequence; identical to SEQ ID NO: 7873
  Description of Artificial Sequence: Synthetic polynucleotide

SEQ ID NO: 8166 - DNA, 1152 bp, Artificial Sequence; identical to SEQ ID NO: 7874
  Description of Artificial Sequence: Synthetic polynucleotide

SEQ ID NO: 8167 - DNA, 872 bp, Artificial Sequence; identical to SEQ ID NO: 7875
  Description of Artificial Sequence: Synthetic polynucleotide

SEQ ID NO: 8168 - DNA, 1743 bp, Artificial Sequence; identical to SEQ ID NO: 7880
  Description of Artificial Sequence: Synthetic polynucleotide

SEQ ID NO: 8169 - DNA, 2405 bp, Artificial Sequence; identical to SEQ ID NO: 7881
  Description of Artificial Sequence: Synthetic polynucleotide

SEQ ID NO: 8170 - DNA, 395 bp, Artificial Sequence; identical to SEQ ID NO: 7901
  Description of Artificial Sequence: Synthetic polynucleotide

SEQ ID NO: 8171 - DNA, 5819 bp, Artificial Sequence; identical to SEQ ID NO: 7910
  Description of Artificial Sequence: Synthetic polynucleotide

SEQ ID NO: 8172 - DNA, 1265 bp, Artificial Sequence; identical to SEQ ID NO: 7912
  Description of Artificial Sequence: Synthetic polynucleotide

SEQ ID NO: 8173 - DNA, 362 bp, Artificial Sequence; identical to SEQ ID NO: 7914
  Description of Artificial Sequence: Synthetic polynucleotide

SEQ ID NO: 8174 - DNA, 572 bp, Artificial Sequence; identical to SEQ ID NO: 7892
  Description of Artificial Sequence: Synthetic polynucleotide

SEQ ID NO: 8175 - DNA, 2400 bp, Artificial Sequence; identical to SEQ ID NO: 7894
  Description of Artificial Sequence: Synthetic polynucleotide

SEQ ID NO: 8176 - DNA, 1859 bp, Artificial Sequence; identical to SEQ ID NO: 7895
  Description of Artificial Sequence: Synthetic polynucleotide

SEQ ID NO: 8177 - DNA, 902 bp, Artificial Sequence; identical to SEQ ID NO: 7896
  Description of Artificial Sequence: Synthetic polynucleotide

SEQ ID NO: 8178 - DNA, 2044 bp, Artificial Sequence; identical to SEQ ID NO: 7897
  Description of Artificial Sequence: Synthetic polynucleotide

SEQ ID NO: 8179 - DNA, 1152 bp, Artificial Sequence; identical to SEQ ID NO: 7898
  Description of Artificial Sequence: Synthetic polynucleotide

SEQ ID NO: 8180 - DNA, 872 bp, Artificial Sequence; identical to SEQ ID NO: 7899
  Description of Artificial Sequence: Synthetic polynucleotide

SEQ ID NO: 8181 - DNA, 1743 bp, Artificial Sequence; identical to SEQ ID NO: 7904
  Description of Artificial Sequence: Synthetic polynucleotide

SEQ ID NO: 8182 - DNA, 2405 bp, Artificial Sequence; identical to SEQ ID NO: 7905
  Description of Artificial Sequence: Synthetic polynucleotide

SEQ ID NO: 8183 - DNA, 395 bp, Artificial Sequence; identical to SEQ ID NO: 7925
  Description of Artificial Sequence: Synthetic polynucleotide

SEQ ID NO: 8184 - DNA, 5819 bp, Artificial Sequence; identical to SEQ ID NO: 7934
  Description of Artificial Sequence: Synthetic polynucleotide

SEQ ID NO: 8185 - DNA, 1265 bp, Artificial Sequence; identical to SEQ ID NO: 7936
  Description of Artificial Sequence: Synthetic polynucleotide

SEQ ID NO: 8186 - DNA, 362 bp, Artificial Sequence; identical to SEQ ID NO: 7938
  Description of Artificial Sequence: Synthetic polynucleotide

SEQ ID NO: 8187 - DNA, 572 bp, Artificial Sequence; identical to SEQ ID NO: 7916
  Description of Artificial Sequence: Synthetic polynucleotide

SEQ ID NO: 8188 - DNA, 2400 bp, Artificial Sequence; identical to SEQ ID NO: 7918
  Description of Artificial Sequence: Synthetic polynucleotide

SEQ ID NO: 8189 - DNA, 1859 bp, Artificial Sequence; identical to SEQ ID NO: 7919
  Description of Artificial Sequence: Synthetic polynucleotide

SEQ ID NO: 8190 - DNA, 902 bp, Artificial Sequence; identical to SEQ ID NO: 7920
  Description of Artificial Sequence: Synthetic polynucleotide

SEQ ID NO: 8191 - DNA, 2044 bp, Artificial Sequence; identical to SEQ ID NO: 7921
  Description of Artificial Sequence: Synthetic polynucleotide

SEQ ID NO: 8192 - DNA, 1152 bp, Artificial Sequence; identical to SEQ ID NO: 7922
  Description of Artificial Sequence: Synthetic polynucleotide

SEQ ID NO: 8193 - DNA, 872 bp, Artificial Sequence; identical to SEQ ID NO: 7923
  Description of Artificial Sequence: Synthetic polynucleotide

SEQ ID NO: 8194 - DNA, 1743 bp, Artificial Sequence; identical to SEQ ID NO: 7928
  Description of Artificial Sequence: Synthetic polynucleotide

SEQ ID NO: 8195 - DNA, 2405 bp, Artificial Sequence; identical to SEQ ID NO: 7929
  Description of Artificial Sequence: Synthetic polynucleotide

SEQ ID NO: 8196 - DNA, 395 bp, Artificial Sequence; identical to SEQ ID NO: 7949
  Description of Artificial Sequence: Synthetic polynucleotide

SEQ ID NO: 8197 - DNA, 5819 bp, Artificial Sequence; identical to SEQ ID NO: 7958
  Description of Artificial Sequence: Synthetic polynucleotide

SEQ ID NO: 8198 - DNA, 1265 bp, Artificial Sequence; identical to SEQ ID NO: 7960
  Description of Artificial Sequence: Synthetic polynucleotide

SEQ ID NO: 8199 - DNA, 362 bp, Artificial Sequence; identical to SEQ ID NO: 7962
  Description of Artificial Sequence: Synthetic polynucleotide

SEQ ID NO: 8200 - DNA, 572 bp, Artificial Sequence; identical to SEQ ID NO: 7940
  Description of Artificial Sequence: Synthetic polynucleotide

SEQ ID NO: 8201 - DNA, 2400 bp, Artificial Sequence; identical to SEQ ID NO: 7942
  Description of Artificial Sequence: Synthetic polynucleotide

SEQ ID NO: 8202 - DNA, 1859 bp, Artificial Sequence; identical to SEQ ID NO: 7943
  Description of Artificial Sequence: Synthetic polynucleotide

SEQ ID NO: 8203 - DNA, 902 bp, Artificial Sequence; identical to SEQ ID NO: 7944
  Description of Artificial Sequence: Synthetic polynucleotide

SEQ ID NO: 8204 - DNA, 2044 bp, Artificial Sequence; identical to SEQ ID NO: 7945
  Description of Artificial Sequence: Synthetic polynucleotide

SEQ ID NO: 8205 - DNA, 1152 bp, Artificial Sequence; identical to SEQ ID NO: 7946
  Description of Artificial Sequence: Synthetic polynucleotide

SEQ ID NO: 8206 - DNA, 872 bp, Artificial Sequence; identical to SEQ ID NO: 7947
  Description of Artificial Sequence: Synthetic polynucleotide

SEQ ID NO: 8207 - DNA, 1743 bp, Artificial Sequence; identical to SEQ ID NO: 7952
  Description of Artificial Sequence: Synthetic polynucleotide

SEQ ID NO: 8208 - DNA, 2405 bp, Artificial Sequence; identical to SEQ ID NO: 7953
  Description of Artificial Sequence: Synthetic polynucleotide

SEQ ID NO: 8209 - DNA, 355 bp, Homo sapiens
tcgaactggatgccggatggaaacctctctgcgctattagactgcgtccagtacagcagatggcacgagcacgtgcggcgctcagcttaggctctcggaggcagctgagttggaaatcccgacggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggtcgggggttcgagcggccaagggatgggggtgggggcggggagagtggggggagg

SEQ ID NO: 8210 - DNA, 730 bp, Homo sapiens
ctgctccggagctgcaggcttctaggcgctgggagggcgaagcaggagagccggttagtccatccccgcgctccgcaaacttttctaaccgggtaacaaagtgagcagcggtggccgccgcgattcctttaacttcgcattccggaggctcgagggggctctgggaccgagcggcctcgcagcggcgacagaaatacatattttacgaaaaagaaaaaaaaaaaaacgagtcgcgcgaacccgtcaagtcagatgtgcgcggcttgaagcggaggaggctctgacgtcagccccacctcgcgcagcccggcctggccgcagactcgccggtcactcgccggcggctcaggccgggaggggccaggacagtcccggccgcgcggtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacacgctgaagatgtaatcaacagttaaaattagcccggcgctgcgcaggcggccggcccggcctcgcgctggcgcgctctgctccgagtggcaggaaggggctcgcaggcgccccgcacgcgtctcgtcactattgtttaatcgagaatcagc

SEQ ID NO: 8211 - DNA, 383 bp, Homo sapiens
agcggcggcgcgggccgcgggcggcgatgggcgaggagcagagcacggtgagcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttggagctggaggaggaagaggaggaagctggggatcgaaaagag

SEQ ID NO: 8212 - DNA, 349 bp, Homo sapiens
agaccgagcgggactatgtgggcacgctggagttcctggtgtcggtgagtgtccccggcagacgcagggggacgtccgggcggcgcggggcgcgggtcccggagtggctgcgggaaggacgcgcggcattgtctgtgcggggacccgggacgggtcggggcatcacaggcgcgggaatccacgtgtggactctgcgttcgcgggcgcggtgacccccgcggggatttgttggtgccccgagactcactgagttgcgggggccttggagacctccaggtctgaaaagttagctctagagaagagagctccagtccagggaatcccggctgccctatcttccctcactttt

SEQ ID NO: 8213 - DNA, 465 bp, Homo sapiens
ccgcacggcccgccgggtcgcggtgagcaaggcgggcaggcgcggcgggaggcgtccgacgcccaccccgggcttggcgtccccttccggccaccacgcggcgccgccccccgggatcctccagtccccggagccccgcgcgcccagagccgctcggagcgcgggcggggtcagcttgggcagccgcgggtcgctgctgcgtcggaagtctccgtcgccagggagccccttgggcgccaggtcctgggcccctgggcgaagtcgacgccagaacatgcttggccccgcactcagctcaccgcaccctcagcgcgcgtgggtggggggcgccggctgaggtggggagggcatagtccagccccaggccatagtgccccgggcggggcagcgcggtgcggggtgaacgccaccggcccggcggacagcgagtggcttcaggcgagagctcccagagcctctgtttcc

SEQ ID NO: 8214 - DNA, 424 bp, Homo sapiens
acacagaggtgacgcacgagtgacccacagagagggacccctgggcctctggtgggggcctgggagacggtcgaagggggcccgggcagaagctccgcggccgggccggcggagggaagggggcggccgcgcccgggacccggctcccctcggctccacttacctgctccgaagagtggccccagctctgcgcctcttcctgcgaccccacacacagggacagccccaggcacagccccagcagcaggagcatggcggggcgagggcgcgggacgctcggggacccggcgggacacgctttgcagcgcccagggctccagccactgcgggacgctctcggggccgcccaccccgcggtcccagcccggaccccgcccaccccacggacccagcccggaccccgcccaccccgcggtcccagccc

SEQ ID NO: 8215 - DNA, 540 bp, Homo sapiens
acgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccgcccgggggggagggggatggagtgcgcgggcagctccccctccccggcccgcgccccgctcgccccgggctgcgctggccccgagcgccgagagccagggggcgccgcgggccgcccgcgcccggggtctgcgccgcccccgggcccgc

SEQ ID NO: 8216 - DNA, 472 bp, Homo sapiens
tctttttaatcccatgtcttaaaagccaaactctagttctaaagtgcagtgtggcattagcgaatgtggtggactccggcaggcctggggcaggggaatctccggtaacatccctcagtaccgaaggcaggatttcccggccacttccgtcggttggaattctcttaagcattgccctgagtctattttcaaatgaaagggggaaaaacccaaaccagattagaatctgaaacagctgaaacagctatcgatttccagcttgctttcaagtctggcagagactgtgaaagtcctaacttctccgcgatgtcagccacggcccgcggcggtcacggagccacttcagcacctcgcgatggacagtgacccccggcgtggcgcgagttccctgcggtccccacgcgggcctgggcggcgggtccctccacggctccgtccagacacccggaggcacctgccaaagctgcggagg

SEQ ID NO: 8217 - DNA, 396 bp, Homo sapiens
ggggagtgggggagtgagcagacgcccttctcctaggaggccggaatttctgcctccatctcccaccggggtccggctggccagaggcaagcttcgagaccccccaccaaccaccaccaccgttgcgagggccggtgaggctgcagataacgcttgcaaggacgggagtcggggagggtgtagggcgagtttaaaggacgggcagagcaagccccgggaagaggcaggggttttccctcccgggtcgccgccccccgcaccctcggagccagccgcagccacgcagcgccgcctgccgggcacaccaaggacctggcgcgcacgtggcgcttacccccacccccgggtccgctcctggctcgcgctcagcctccccagactattcgcaaattgagg

SEQ ID NO: 8218 - DNA, 507 bp, Homo sapiens
tgactttggggctgacaccgccaaagggcagtcagtgctcgcccaggccacttcgggaggcccaggggcacggcgaggggtcggggaaaggcgatcgcccactacagcccgcgcgcctagactgagggaggagccgggctgcagaaccggcggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggccgcgagcctcgagcgtcaaattcccgcggcgtccgcctagcgcgctgctgtggcgggcgcggagggcgcgcgccggcagtgggggctgcggcggcggagggcacgggcccccgctcagcgtcctcaccttcttggtgcagctgcctcccgcgagccgagacactcctgtcagggaagaggagcgccccggctgtccccctagagtctcct

SEQ ID NO: 8219 - DNA, 946 bp, Homo sapiens
cgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggaga

SEQ ID NO: 8220 - DNA, 390 bp, Homo sapiens
cggggcaggcgcggcccgcaaggacccccgcgatggagacgcaacactgccgcgactgcacttggggcagccccgccgcgtcccagccgcctcccggcaggaagcgtaggtgtgtgagccgacccggagcgagccgcgccctcgggccagcgtgggcagggcgccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagcccc

SEQ ID NO: 8221 - DNA, 440 bp, Homo sapiens
ctggtgagcagtggggcgggtgggcgggtgcccgcgacgggaaggggctgggcggcgctgacggatgccggtcctcagggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggtatgcgtgccctgccaggtcggttggggggatcaagtaggggtccggggccgggacagctgcttgagggggacccggggcgagtgctcgaaggggtctccgtgtgcgccccctcatgccctggccgctgcctgcgcccccacag

SEQ ID NO: 8222 - DNA, 324 bp, Homo sapiens
aattccagcatccggctgcactcccggcggcttccccagctacctgaggacagtacagggggtgagatggggtggtggttggtgaacgttggttactttattttatattattttattttgagagttgccataattaccggcgccaccccccgtgcaccctgaggtctggttggcgagccgctgctgggagttttctgcaaataccccccaaagcctgaaggcgggcttcaaacgcaggcgccggggaccatgggagccttcaaatagctgcgctggcgcaatgataccttaatgatagattttccgttcttatttttagctctc

SEQ ID NO: 8223 - DNA, 355 bp, Artificial Sequence
  Description of Artificial Sequence: Synthetic polynucleotide
tygaattggatgtyggatggaaatttttttgygttattagattgygtttagtatagtagatggtaygagtaygtgyggygtttagtttaggttttyggaggtagttgagttggaaatttygayggaaagtatttataagtttttattttgygttggtttattygygtgtaygtttattttttaygygygtttttggtttagaagygtatagatgtttattgtttagagtyggtatygttggggagatygagygatttgygyggygtatagtgyggygttggtagggttttgggttttyggtygggggttygagyggttaagggatgggggtgggggyggggagagtggggggagg

SEQ ID NO: 8224 - DNA, 730 bp, Artificial Sequence
  Description of Artificial Sequence: Synthetic polynucleotide
ttgtttyggagttgtaggtttttaggygttgggagggygaagtaggagagtyggttagtttattttygygtttygtaaatttttttaatygggtaataaagtgagtagyggtggtygtygygatttttttaatttygtatttyggaggttygagggggttttgggatygagyggtttygtagyggygatagaaatatatattttaygaaaaagaaaaaaaaaaaaaygagtygygygaattygttaagttagatgtgygyggtttgaagyggaggaggttttgaygttagttttatttygygtagttyggtttggtygtagattygtyggttattygtyggyggtttaggtygggaggggttaggatagtttyggtygygyggtggayggaggggttattttttygggygttagtaaataaattttattygagttaatatygtttagygaayggtgtttttttttagttattygagaaygagaggtatttttaattagaaattaattaatgagtagttgttttttttygttttattgtaattattygttttaattataaatgagatttatgaaaggataygttgaagatgtaattaatagttaaaattagttyggygttgygtaggyggtyggttyggtttygygttggygygttttgtttygagtggtaggaaggggttygtaggygtttygtaygygtttygttattattgtttaatygagaattagt

SEQ ID NO: 8225 - DNA, 383 bp, Artificial Sequence
  Description of Artificial Sequence: Synthetic polynucleotide
agyggyggygygggcygygggyggygatgggygaggagtagagtayggtgagyggyggyggygggttttaggagtygtagattttggttagtggtattgygggttattttgagttttygaggttttagggggatagygccygggygccccygctgygygcygccttygyggagtygagyggyggtggttgyggaagygattggggttgygyggatattagygttttagagttygygaggagtttggggttttygggttggagtaagagtygagtatyggygtagtttgygggattggtatttatygggttttttaatttttagattttgttattgtagttggagttggaggaggaagaggaggaagttggggatygaaaagag

SEQ ID NO: 8226 - DNA, 349 bp, Artificial Sequence
  Description of Artificial Sequence: Synthetic polynucleotide
agatygagygggattatgtgggtaygttggagtttttggtgtyggtgagtgttttyggtagaygtagggggaygtcygggyggygyggggygygggtttyggagtggttgygggaaggaygygyggtattgtttgtgyggggattygggaygggtyggggtattataggygygggaatttaygtgtggattttgygttygygggygyggtgattttygyggggatttgttggtgtttygagatttattgagttgygggggttttggagatttttaggtttgaaaagttagttttagagaagagagttttagtttagggaatttyggttgttttatttttttttattttt

SEQ ID NO: 8227 - DNA, 465 bp, Artificial Sequence
  Description of Artificial Sequence: Synthetic polynucleotide
tygtayggttygtygggtygyggtgagtaaggygggtaggygyggygggaggygttygaygtttatttygggtttggygttttttttyggttattaygyggygtygtttttygggattttttagttttyggagtttygygygtttagagtygttyggagygygggyggggttagtttgggtagtygygggtygttgttgygtyggaagttttygtygttagggagttttttgggygttaggttttgggtttttgggygaagtygaygttagaatatgtttggtttygtatttagtttatygtatttttagygygygtgggtggggggygtyggttgaggtggggagggtatagtttagttttaggttatagtgtttygggyggggtagygyggtgyggggtgaaygttatyggttyggyggatagygagtggcttcaggygagagctcccagagcctctgtttcc

SEQ ID NO: 8228 - DNA, 424 bp, Artificial Sequence
  Description of Artificial Sequence: Synthetic polynucleotide
atatagaggtgaygtaygagtgatttatagagagggatttttgggtttttggtgggggtttgggagayggtygaagggggttygggtagaagttcygyggcygggcyggyggagggaagggggyggcygygccygggattyggtttttttyggttttatttatttgtttygaagagtggttttagttttgygtttttttttgygattttatatatagggatagttttaggtatagttttagtagtaggagtatggyggggygagggygygggaygttyggggattyggygggataygttttgtagygtttagggttttagttattgygggaygttttyggggtygcccacccygyggtcccagccyggacccygcccaccccayggacccagccyggacccygcccacccygyggtcccagccc

SEQ ID NO: 8229 - DNA, 540 bp, Artificial Sequence
  Description of Artificial Sequence: Synthetic polynucleotide
aygaggaggaagaggaggaggaagaagaagaagaggaagaggaggaggaggaggaggaggaygygtttaggttgagatggttygygtggatattgttatttattttaagattgctgcctcygcygcygcygcygcygcygctgctgcygcygcygcygcygccaccatttgttatagttagtaaygggtagtyggygtaggggttygggggagtttttttygtygttagygttattttaaatatttattaatagttatattgttgttattgctgcygcygcygcygcygcygyggagygygggaggggggyggggaggygtttgggttyggggygttgtgygygatttggyggggtgygtygagatatatatagygagcygcygcygccygccygggggggagggggatggagtgygygggtagttttttttcccyggccygygcccygctygcccygggctgygctggcccygagygcygagagccagggggygcygygggcygccygygccyggggtctgygcygccccygggccygc

SEQ ID NO: 8230 - DNA, 472 bp, Artificial Sequence
  Description of Artificial Sequence: Synthetic polynucleotide
tttttttaattttatgttttaaaagttaaattttagttttaaagtgtagtgtggtattagygaatgtggtggatttyggtaggtttggggtaggggaattttyggtaatattttttagtatygaaggtaggatttttyggttattttygtyggttggaatttttttaagtattgttttgagtttatttttaaatgaaagggggaaaaatttaaattagattagaatttgaaatagttgaaatagttatygatttttagtttgtttttaagtttggtagagattgtgaaagttttaattttttygygatgttagttayggttygyggyggttayggagttattttagtatttygygatggatagtgattttyggygtggygygagttttttgyggtttttaygygggtttgggyggygggtttttttayggtttygtttagatattyggaggtatttgttaaagttgyggagg

SEQ ID NO: 8231 - DNA, 396 bp, Artificial Sequence
  Description of Artificial Sequence: Synthetic polynucleotide
ggggagtgggggagtgagtagaygttttttttttaggaggtyggaatttttgtttttattttttatyggggttyggttggttagaggtaagtttygagattttttattaattattattatygttgygagggtyggtgaggttgtagataaygtttgtaaggaygggagtyggggagggtgtagggygagtttaaaggaygggtagagtaagtttygggaagaggtaggggttttttttttygggtygtygtttttygtattttyggagttagtygtagttaygtagygtygtttgtygggtatattaaggatttggygygtaygtggygtttatttttattttygggttygtttttggttygygtttagtttttttagattattygtaaattgagg

SEQ ID NO: 8232 - DNA, 507 bp, Artificial Sequence
  Description of Artificial Sequence: Synthetic polynucleotide
tgattttggggttgatatygttaaagggtagttagtgttygtttaggttatttygggaggtttaggggtayggygaggggtyggggaaaggygatygtttattatagttygygygtttagattgagggaggagtygggttgtagaatyggyggyggatggagaygggagggaggttgygaggtygttygaggagagattaaggttttagaaayggagaagygggygttttgygggaggyggyggygttgtygttggtygttaagggygggaagtgttttgggatttttattaggggtygygagtttygagygttaaattttygyggygttygtttagygygttgttgtggygggygyggagggygygygcyggcagtgggggctgyggyggyggagggcaygggccccygcttagygtttttatttttttggtgtagttgtttttygygagtygagatatttttgttagggaagaggagygtttyggttgtttttttagagtttttt

SEQ ID NO: 8233 - DNA, 946 bp, Artificial Sequence
  Description of Artificial Sequence: Synthetic polynucleotide
ygttatttattygagtygttygggttggtygygagtygggattygygagggttggygggttttggttttygaggaygtagatatgtggtttgaattttygtttttttagtygttgtttttgtgtatttttttgggygtttttagygaatgygagyggygaggygagggygagygygtygaggaagggygggagaggygyggagtttggcygygcygygctgygcygagygcygggctctcccygygagctcccygggccygygygygygccccccactgccccygcccccygygyggygygtgccccccacccccygcygygygccctygcaccygccyggctccaygyggygygygcctgttttggyggcagyggyggyggyggyggygygttttttttygaaygtygtttttagggttgttggttgygttttttattgtttygyggttgttgttyggggtgggyggygaggygggggggaggtgtyggtttggtygtyggggagggtttatygttygggyggatttttattgygagagygatgygggtttaggygyggygygygggggttgtagggygtttagtattgggggttgtyggygygygggggtttttttttggtttttaggtattygttgttgttgggygtttttygtattttyggttattatggatatttygttttttygtygtttttttygygtatttygggaggtygtyggggyggtagtagyggygyggtttygygggtgtttaggtgatyggttyggtagyggtagagtagtggtagtagtygttattgtygttgttattgyggtygtygtygttggagagaggaggaygaggagggtaaggggtagaagtaggttttgttttgtttgttttagaggttatttygggtttttttttattaattaagygatttygtgtttatttygtaggaga

SEQ ID NO: 8234 - DNA, 390 bp, Artificial Sequence
  Description of Artificial Sequence: Synthetic polynucleotide
yggggtaggygyggttygtaaggattttygygatggagaygtaatattgtygygattgtatttggggtagtttygtygygttttagtygtttttyggtaggaagygtaggtgtgtgagtygattyggagygagtygygttttygggttagygtgggtagggygtygtagtttgygtagtttygaggatttygygtygttttttygagttagggtttttaggagygggtygygtaggagaygttagagggggttgttagyggttgttgggagaaygggttayggaaatagttttttttaaagtyggggttatygtggggtgggygagttygtttttttaggtygggggygyggattagaggggaygtgtgtagayggtygyggttagtttt

SEQ ID NO: 8235 - DNA, 440 bp, Artificial Sequence
  Description of Artificial Sequence: Synthetic polynucleotide
ttggtgagtagtggggygggtgggygggtgttygygaygggaaggggttgggyggygttgayggatgtyggtttttagggagttttaaggyggygggtattagygggttgattttgaagygttgttyggagtyggagygttattgtttggygyggttgatggttgaygygttgygyggttgygtgtttgttttttayggygtggtggagygygayggygaaagttatttgtagttgtaggatttgttygatggtttygayggattttgtgtgttygattgtaaaatgggygttaggtatgygtgttttgttaggtyggttggggggattaagtaggggttyggggtygggatagttgtttgagggggattyggggygagtgttygaaggggttttygtgtgygtttttttatgttttggtygttgtttgygtttttatag

SEQ ID NO: 8236 - DNA, 324 bp, Artificial Sequence
  Description of Artificial Sequence: Synthetic polynucleotide
aattttagtattyggttgtattttyggyggtttttttagttatttgaggatagtatagggggtgagatggggtggtggttggtgaaygttggttactttattttatattattttattttgagagttgttataattatyggygttatttttygtgtattttgaggtttggttggygagtygttgttgggagttttttgtaaatattttttaaagtttgaaggygggttttaaaygtaggygtyggggattatgggagtttttaaatagttgygttggygtaatgatattttaatgatagatttttygtttttatttttagttttt

SEQ ID NO: 8237 - DNA, 355 bp, Artificial Sequence
  Description of Artificial Sequence: Synthetic polynucleotide
tcgaattggatgtcggatggaaatttttttgcgttattagattgcgtttagtatagtagatggtacgagtacgtgcggcgtttagtttaggttttcggaggtagttgagttggaaatttcgacggaaagtatttataagtttttattttgcgttggtttattcgcgtgtacgtttattttttacgcgcgtttttggtttagaagcgtatagatgtttattgtttagagtcggtatcgttggggagatcgagcgatttgcgcggcgtatagtgcggcgttggtagggttttgggttttcggtcgggggttcgagcggttaagggatgggggtgggggcggggagagtggggggagg

SEQ ID NO: 8238 - DNA, 730 bp, Artificial Sequence
  Description of Artificial Sequence: Synthetic polynucleotide
ttgtttcggagttgtaggtttttaggcgttgggagggcgaagtaggagagtcggttagtttattttcgcgtttcgtaaatttttttaatcgggtaataaagtgagtagcggtggtcgtcgcgatttttttaatttcgtatttcggaggttcgagggggttttgggatcgagcggtttcgtagcggcgatagaaatatatattttacgaaaaagaaaaaaaaaaaaacgagtcgcgcgaattcgttaagttagatgtgcgcggtttgaagcggaggaggttttgacgttagttttatttcgcgtagttcggtttggtcgtagattcgtcggttattcgtcggcggtttaggtcgggaggggttaggatagtttcggtcgcgcggtggacggaggggttattttttcgggcgttagtaaataaattttattcgagttaatatcgtttagcgaacggtgtttttttttagttattcgagaacgagaggtatttttaattagaaattaattaatgagtagttgttttttttcgttttattgtaattattcgttttaattataaatgagatttatgaaaggatacgttgaagatgtaattaatagttaaaattagttcggcgttgcgtaggcggtcggttcggtttcgcgttggcgcgttttgtttcgagtggtaggaaggggttcgtaggcgtttcgtacgcgtttcgttattattgtttaatcgagaattagt

SEQ ID NO: 8239 - DNA, 383 bp, Artificial Sequence
  Description of Artificial Sequence: Synthetic polynucleotide
agcggcggcgcgggccgcgggcggcgatgggcgaggagtagagtacggtgagcggcggcggcgggttttaggagtcgtagattttggttagtggtattgcgggttattttgagttttcgaggttttagggggatagcgcccgggcgcccccgctgcgcgccgccttcgcggagtcgagcggcggtggttgcggaagcgattggggttgcgcggatattagcgttttagagttcgcgaggagtttggggttttcgggttggagtaagagtcgagtatcggcgtagtttgcgggattggtatttatcgggttttttaatttttagattttgttattgtagttggagttggaggaggaagaggaggaagttggggatcgaaaagag

SEQ ID NO: 8240 - DNA, 349 bp, Artificial Sequence
  Description of Artificial Sequence: Synthetic polynucleotide
agatcgagcgggattatgtgggtacgttggagtttttggtgtcggtgagtgttttcggtagacgtagggggacgtccgggcggcgcggggcgcgggtttcggagtggttgcgggaaggacgcgcggtattgtttgtgcggggattcgggacgggtcggggtattataggcgcgggaatttacgtgtggattttgcgttcgcgggcgcggtgattttcgcggggatttgttggtgtttcgagatttattgagttgcgggggttttggagatttttaggtttgaaaagttagttttagagaagagagttttagtttagggaatttcggttgttttatttttttttattttt

SEQ ID NO: 8241 - DNA, 465 bp, Artificial Sequence
  Description of Artificial Sequence: Synthetic polynucleotide
tcgtacggttcgtcgggtcgcggtgagtaaggcgggtaggcgcggcgggaggcgttcgacgtttatttcgggtttggcgttttttttcggttattacgcggcgtcgtttttcgggattttttagttttcggagtttcgcgcgtttagagtcgttcggagcgcgggcggggttagtttgggtagtcgcgggtcgttgttgcgtcggaagttttcgtcgttagggagttttttgggcgttaggttttgggtttttgggcgaagtcgacgttagaatatgtttggtttcgtatttagtttatcgtatttttagcgcgcgtgggtggggggcgtcggttgaggtggggagggtatagtttagttttaggttatagtgtttcgggcggggtagcgcggtgcggggtgaacgttatcggttcggcggatagcgagtggcttcaggcgagagctcccagagcctctgtttcc

SEQ ID NO: 8242 - DNA, 424 bp, Artificial Sequence
  Description of Artificial Sequence: Synthetic polynucleotide
atatagaggtgacgtacgagtgatttatagagagggatttttgggtttttggtgggggtttgggagacggtcgaagggggttcgggtagaagttccgcggccgggccggcggagggaagggggcggccgcgcccgggattcggtttttttcggttttatttatttgtttcgaagagtggttttagttttgcgtttttttttgcgattttatatatagggatagttttaggtatagttttagtagtaggagtatggcggggcgagggcgcgggacgttcggggattcggcgggatacgttttgtagcgtttagggttttagttattgcgggacgttttcggggtcgcccaccccgcggtcccagcccggaccccgcccaccccacggacccagcccggaccccgcccaccccgcggtcccagccc

SEQ ID NO: 8243 - DNA, 540 bp, Artificial Sequence
  Description of Artificial Sequence: Synthetic polynucleotide
acgaggaggaagaggaggaggaagaagaagaagaggaagaggaggaggaggaggaggaggacgcgtttaggttgagatggttcgcgtggatattgttatttattttaagattgctgcctccgccgccgccgccgccgccgctgctgccgccgccgccgccgccaccatttgttatagttagtaacgggtagtcggcgtaggggttcgggggagtttttttcgtcgttagcgttattttaaatatttattaatagttatattgttgttattgctgccgccgccgccgccgccgcggagcgcgggaggggggcggggaggcgtttgggttcggggcgttgtgcgcgatttggcggggtgcgtcgagatatatatagcgagccgccgccgcccgcccgggggggagggggatggagtgcgcgggtagttttttttccccggcccgcgccccgctcgccccgggctgcgctggccccgagcgccgagagccagggggcgccgcgggccgcccgcgcccggggtctgcgccgcccccgggcccgc

SEQ ID NO: 8244 - DNA, 472 bp, Artificial Sequence
  Description of Artificial Sequence: Synthetic polynucleotide
tttttttaattttatgttttaaaagttaaattttagttttaaagtgtagtgtggtattagcgaatgtggtggatttcggtaggtttggggtaggggaattttcggtaatattttttagtatcgaaggtaggatttttcggttattttcgtcggttggaatttttttaagtattgttttgagtttatttttaaatgaaagggggaaaaatttaaattagattagaatttgaaatagttgaaatagttatcgatttttagtttgtttttaagtttggtagagattgtgaaagttttaattttttcgcgatgttagttacggttcgcggcggttacggagttattttagtatttcgcgatggatagtgattttcggcgtggcgcgagttttttgcggtttttacgcgggtttgggcggcgggtttttttacggtttcgtttagatattcggaggtatttgttaaagttgcggagg

SEQ ID NO: 8245 - DNA, 396 bp, Artificial Sequence
  Description of Artificial Sequence: Synthetic polynucleotide
ggggagtgggggagtgagtagacgttttttttttaggaggtcggaatttttgtttttattttttatcggggttcggttggttagaggtaagtttcgagattttttattaattattattatcgttgcgagggtcggtgaggttgtagataacgtttgtaaggacgggagtcggggagggtgtagggcgagtttaaaggacgggtagagtaagtttcgggaagaggtaggggttttttttttcgggtcgtcgtttttcgtattttcggagttagtcgtagttacgtagcgtcgtttgtcgggtatattaaggatttggcgcgtacgtggcgtttatttttattttcgggttcgtttttggttcgcgtttagtttttttagattattcgtaaattgagg

SEQ ID NO: 8246 - DNA, 507 bp, Artificial Sequence
  Description of Artificial Sequence: Synthetic polynucleotide
tgattttggggttgatatcgttaaagggtagttagtgttcgtttaggttatttcgggaggtttaggggtacggcgaggggtcggggaaaggcgatcgtttattatagttcgcgcgtttagattgagggaggagtcgggttgtagaatcggcggcggatggagacgggagggaggttgcgaggtcgttcgaggagagattaaggttttagaaacggagaagcgggcgttttgcgggaggcggcggcgttgtcgttggtcgttaagggcgggaagtgttttgggatttttattaggggtcgcgagtttcgagcgttaaattttcgcggcgttcgtttagcgcgttgttgtggcgggcgcggagggcgcgcgccggcagtgggggctgcggcggcggagggcacgggcccccgcttagcgtttttatttttttggtgtagttgtttttcgcgagtcgagatatttttgttagggaagaggagcgtttcggttgtttttttagagtttttt

SEQ ID NO: 8247 - DNA, 946 bp, Artificial Sequence
  Description of Artificial Sequence: Synthetic polynucleotide
cgttatttattcgagtcgttcgggttggtcgcgagtcgggattcgcgagggttggcgggttttggttttcgaggacgtagatatgtggtttgaattttcgtttttttagtcgttgtttttgtgtatttttttgggcgtttttagcgaatgcgagcggcgaggcgagggcgagcgcgtcgaggaagggcgggagaggcgcggagtttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgttttggcggcagcggcggcggcggcggcgcgttttttttcgaacgtcgtttttagggttgttggttgcgttttttattgtttcgcggttgttgttcggggtgggcggcgaggcgggggggaggtgtcggtttggtcgtcggggagggtttatcgttcgggcggatttttattgcgagagcgatgcgggtttaggcgcggcgcgcgggggttgtagggcgtttagtattgggggttgtcggcgcgcgggggtttttttttggtttttaggtattcgttgttgttgggcgtttttcgtattttcggttattatggatatttcgttttttcgtcgtttttttcgcgtatttcgggaggtcgtcggggcggtagtagcggcgcggtttcgcgggtgtttaggtgatcggttcggtagcggtagagtagtggtagtagtcgttattgtcgttgttattgcggtcgtcgtcgttggagagaggaggacgaggagggtaaggggtagaagtaggttttgttttgtttgttttagaggttatttcgggtttttttttattaattaagcgatttcgtgtttatttcgtaggaga

SEQ ID NO: 8248 - DNA, 390 bp, Artificial Sequence
  Description of Artificial Sequence: Synthetic polynucleotide
cggggtaggcgcggttcgtaaggattttcgcgatggagacgtaatattgtcgcgattgtatttggggtagtttcgtcgcgttttagtcgtttttcggtaggaagcgtaggtgtgtgagtcgattcggagcgagtcgcgttttcgggttagcgtgggtagggcgtcgtagtttgcgtagtttcgaggatttcgcgtcgttttttcgagttagggtttttaggagcgggtcgcgtaggagacgttagagggggttgttagcggttgttgggagaacgggttacggaaatagttttttttaaagtcggggttatcgtggggtgggcgagttcgtttttttaggtcgggggcgcggattagaggggacgtgtgtagacggtcgcggttagtttt

SEQ ID NO: 8249 - DNA, 440 bp, Artificial Sequence
  Description of Artificial Sequence: Synthetic polynucleotide
ttggtgagtagtggggcgggtgggcgggtgttcgcgacgggaaggggttgggcggcgttgacggatgtcggtttttagggagttttaaggcggcgggtattagcgggttgattttgaagcgttgttcggagtcggagcgttattgtttggcgcggttgatggttgacgcgttgcgcggttgcgtgtttgttttttacggcgtggtggagcgcgacggcgaaagttatttgtagttgtaggatttgttcgatggtttcgacggattttgtgtgttcgattgtaaaatgggcgttaggtatgcgtgttttgttaggtcggttggggggattaagtaggggttcggggtcgggatagttgtttgagggggattcggggcgagtgttcgaaggggttttcgtgtgcgtttttttatgttttggtcgttgtttgcgtttttatag

SEQ ID NO: 8250 - DNA, 324 bp, Artificial Sequence
  Description of Artificial Sequence: Synthetic polynucleotide
aattttagtattcggttgtattttcggcggtttttttagttatttgaggatagtatagggggtgagatggggtggtggttggtgaacgttggttactttattttatattattttattttgagagttgttataattatcggcgttatttttcgtgtattttgaggtttggttggcgagtcgttgttgggagttttttgtaaatattttttaaagtttgaaggcgggttttaaacgtaggcgtcggggattatgggagtttttaaatagttgcgttggcgtaatgatattttaatgatagatttttcgtttttatttttagttttt

SEQ ID NO: 8251 - DNA, 355 bp, Homo sapiens
cctccccccactctccccgcccccacccccatcccttggccgctcgaacccccgaccgggagcccagagccctgccagcgccgcactgtgcgccgcgcaagtcgctcgatctccccagcggtaccggctctaagcagtaaacatctgtgcgcttctgagccagggacgcgcgtggggggtgggcgtgcacgcgggtgggccagcgcagagtgggagcttgtgggtgctttccgtcgggatttccaactcagctgcctccgagagcctaagctgagcgccgcacgtgctcgtgccatctgctgtactggacgcagtctaatagcgcagagaggtttccatccggcatccagttcga

SEQ ID NO: 8252 - DNA, 730 bp, Homo sapiens
gctgattctcgattaaacaatagtgacgagacgcgtgcggggcgcctgcgagccccttcctgccactcggagcagagcgcgccagcgcgaggccgggccggccgcctgcgcagcgccgggctaattttaactgttgattacatcttcagcgtgtcctttcataggtctcatttgtaattgagacgaatgattacagtggggcgggaaggagcagctgctcattaattaatttctaattaaaagtgcctctcgttctcgggtgactaaagagaaacaccgttcgctgggcgatattgactcggatggaatttatttgctaacgcccggaggaatggcccctccgtccaccgcgcggccgggactgtcctggcccctcccggcctgagccgccggcgagtgaccggcgagtctgcggccaggccgggctgcgcgaggtggggctgacgtcagagcctcctccgcttcaagccgcgcacatctgacttgacgggttcgcgcgactcgtttttttttttttctttttcgtaaaatatgtatttctgtcgccgctgcgaggccgctcggtcccagagccccctcgagcctccggaatgcgaagttaaaggaatcgcggcggccaccgctgctcactttgttacccggttagaaaagtttgcggagcgcggggatggactaaccggctctcctgcttcgccctcccagcgcctagaagcctgcagctccggagcag

SEQ ID NO: 8253 - DNA, 383 bp, Homo sapiens
ctcttttcgatccccagcttcctcctcttcctcctccagctccaactgcagtggcaaggtctggggattgagaggcccggtgagtgccagtcccgcaggctgcgccggtgctcggctcttactccagcccgggggccccaggctcctcgcgggctctggggcgctggtgtccgcgcagccccagtcgcttccgcagccaccgccgctcggctccgcggaggcggcgcgcagcgggggcgcccgggcgctgtccccctgaggcctcgggggctcagggtggcccgcagtgccactggccagggtctgcgactcctggggcccgccgccgccgctcaccgtgctctgctcctcgcccatcgccgcccgcggcccgcgccgccgct

SEQ ID NO: 8254 - DNA, 349 bp, Homo sapiens
aaaagtgagggaagatagggcagccgggattccctggactggagctctcttctctagagctaacttttcagacctggaggtctccaaggcccccgcaactcagtgagtctcggggcaccaacaaatccccgcgggggtcaccgcgcccgcgaacgcagagtccacacgtggattcccgcgcctgtgatgccccgacccgtcccgggtccccgcacagacaatgccgcgcgtccttcccgcagccactccgggacccgcgccccgcgccgcccggacgtccccctgcgtctgccggggacactcaccgacaccaggaactccagcgtgcccacatagtcccgctcggtct

SEQ ID NO: 8255 - DNA, 465 bp, Homo sapiens
ggaaacagaggctctgggagctctcgcctgaagccactcgctgtccgccgggccggtggcgttcaccccgcaccgcgctgccccgcccggggcactatggcctggggctggactatgccctccccacctcagccggcgccccccacccacgcgcgctgagggtgcggtgagctgagtgcggggccaagcatgttctggcgtcgacttcgcccaggggcccaggacctggcgcccaaggggctccctggcgacggagacttccgacgcagcagcgacccgcggctgcccaagctgaccccgcccgcgctccgagcggctctgggcgcgcggggctccggggactggaggatcccggggggcggcgccgcgtggtggccggaaggggacgccaagcccggggtgggcgtcggacgcctcccgccgcgcctgcccgccttgctcaccgcgacccggcgggccgtgcgg

SEQ ID NO: 8256 - DNA, 424 bp, Homo sapiens
gggctgggaccgcggggtgggcggggtccgggctgggtccgtggggtgggcggggtccgggctgggaccgcggggtgggcggccccgagagcgtcccgcagtggctggagccctgggcgctgcaaagcgtgtcccgccgggtccccgagcgtcccgcgccctcgccccgccatgctcctgctgctggggctgtgcctggggctgtccctgtgtgtggggtcgcaggaagaggcgcagagctggggccactcttcggagcaggtaagtggagccgaggggagccgggtcccgggcgcggccgcccccttccctccgccggcccggccgcggagcttctgcccgggcccccttcgaccgtctcccaggcccccaccagaggcccaggggtccctctctgtgggtcactcgtgcgtcacctctgtgt

SEQ ID NO: 8257 - DNA, 540 bp, Homo sapiens
gcgggcccgggggcggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgt

SEQ ID NO: 8258 - DNA, 472 bp, Homo sapiens
cctccgcagctttggcaggtgcctccgggtgtctggacggagccgtggagggacccgccgcccaggcccgcgtggggaccgcagggaactcgcgccacgccgggggtcactgtccatcgcgaggtgctgaagtggctccgtgaccgccgcgggccgtggctgacatcgcggagaagttaggactttcacagtctctgccagacttgaaagcaagctggaaatcgatagctgtttcagctgtttcagattctaatctggtttgggtttttccccctttcatttgaaaatagactcagggcaatgcttaagagaattccaaccgacggaagtggccgggaaatcctgccttcggtactgagggatgttaccggagattcccctgccccaggcctgccggagtccaccacattcgctaatgccacactgcactttagaactagagtttggcttttaagacatgggattaaaaaga

SEQ ID NO: 8259 - DNA, 396 bp, Homo sapiens
cctcaatttgcgaatagtctggggaggctgagcgcgagccaggagcggacccgggggtgggggtaagcgccacgtgcgcgccaggtccttggtgtgcccggcaggcggcgctgcgtggctgcggctggctccgagggtgcggggggcggcgacccgggagggaaaacccctgcctcttcccggggcttgctctgcccgtcctttaaactcgccctacaccctccccgactcccgtccttgcaagcgttatctgcagcctcaccggccctcgcaacggtggtggtggttggtggggggtctcgaagcttgcctctggccagccggaccccggtgggagatggaggcagaaattccggcctcctaggagaagggcgtctgctcactcccccactcccc

SEQ ID NO: 8260 - DNA, 507 bp, Homo sapiens
aggagactctagggggacagccggggcgctcctcttccctgacaggagtgtctcggctcgcgggaggcagctgcaccaagaaggtgaggacgctgagcgggggcccgtgccctccgccgccgcagcccccactgccggcgcgcgccctccgcgcccgccacagcagcgcgctaggcggacgccgcgggaatttgacgctcgaggctcgcggcccctaatgagagtcccagaacacttcccgcccttgacggccagcggcagcgccgccgcctcccgcagagcgcccgcttctccgtttctagagccttagtctctcctcgagcgacctcgcagcctccctcccgtctccatccgccgccggttctgcagcccggctcctccctcagtctaggcgcgcgggctgtagtgggcgatcgcctttccccgacccctcgccgtgcccctgggcctcccgaagtggcctgggcgagcactgactgccctttggcggtgtcagccccaaagtca

SEQ ID NO: 8261 - DNA, 946 bp, Homo sapiens
tctcctgcgaggtaaacacgaagtcgcttggttagtgagaagaaacccgaggtggcctctggggcagacagagcaggacctgcttctgccccttgccctcctcgtcctcctctctccagcggcggcgaccgcagtaacagcggcagtggcggctgctgccactgctctgccgctgccgagccggtcacctgggcacccgcggagccgcgccgctgctaccgccccggcggcctcccggagtgcgcggagggggcggcggaggagcgagatatccatagtaaccgaggatgcgaggggcgcccagcagcagcgagtgcctgggagccaggaggaggcccccgcgcgccggcaacccccagtgctaggcgccctgcagcccccgcgcgccgcgcctgggcccgcatcgctctcgcagtgagggtccgcccgagcggtaagccctccccggcggccaagccgacacctcccccccgcctcgccgcccaccccgggcagcagccgcggaacaatggagagcgcagccagcagccctggagacggcgttcgggggaggacgcgccgccgccgccgccgctgccgccagggcaggcgcgcgccgcgtggagccgggcgggtgcgagggcgcgcggcggggggtggggggcacgcgccgcgcggggggcgggggcagtggggggcgcgcgcgcgggcccggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggtgagtagcg

SEQ ID NO: 8262 - DNA, 390 bp, Homo sapiens
ggggctgaccgcggccgtctgcacacgtcccctctggtccgcgcccccggcctgggagggcggactcgcccaccccacgatggccccggctttggaagggactgtttccgtgacccgttctcccaacagccgctaacaaccccctctaacgtctcctgcgcggcccgctcctgagaaccctggctcgggagagcgacgcggggtcctcggggctgcgcaggctgcggcgccctgcccacgctggcccgagggcgcggctcgctccgggtcggctcacacacctacgcttcctgccgggaggcggctgggacgcggcggggctgccccaagtgcagtcgcggcagtgttgcgtctccatcgcgggggtccttgcgggccgcgcctgccccg

SEQ ID NO: 8263 - DNA, 440 bp, Homo sapiens
ctgtgggggcgcaggcagcggccagggcatgagggggcgcacacggagaccccttcgagcactcgccccgggtccccctcaagcagctgtcccggccccggacccctacttgatccccccaaccgacctggcagggcacgcatacctgacgcccattttgcagtcgagcacacaaggtccgtcgaagccatcgagcaggtcctgcagctgcaggtagctttcgccgtcgcgctccaccacgccgtggaaggcaggcacgcagccgcgcagcgcgtcagccatcagccgcgccaggcagtagcgctccggctccgagcagcgcttcaggatcagcccgctggtgcccgccgccttaaaactccctgaggaccggcatccgtcagcgccgcccagccccttcccgtcgcgggcacccgcccacccgccccactgctcaccag

SEQ ID NO: 8264 - DNA, 324 bp, Homo sapiens
gagagctaaaaataagaacggaaaatctatcattaaggtatcattgcgccagcgcagctatttgaaggctcccatggtccccggcgcctgcgtttgaagcccgccttcaggctttggggggtatttgcagaaaactcccagcagcggctcgccaaccagacctcagggtgcacggggggtggcgccggtaattatggcaactctcaaaataaaataatataaaataaagtaaccaacgttcaccaaccaccaccccatctcaccccctgtactgtcctcaggtagctggggaagccgccgggagtgcagccggatgctggaatt

SEQ ID NO: 8265 - DNA, 355 bp, Artificial Sequence
  Description of Artificial Sequence: Synthetic polynucleotide
tttttttttatttttttygtttttatttttattttttggtygttygaattttygatygggagtttagagttttgttagygtygtattgtgygtygygtaagtygttygatttttttagyggtatyggttttaagtagtaaatatttgtgygtttttgagttagggaygygygtggggggtgggygtgtaygygggtgggttagygtagagtgggagtttgtgggtgtttttygtygggatttttaatttagttgttttygagagtttaagttgagygtygtaygtgttygtgttatttgttgtattggaygtagtttaatagygtagagaggtttttattyggtatttagttyga

SEQ ID NO: 8266 - DNA, 730 bp, Artificial Sequence
  Description of Artificial Sequence: Synthetic polynucleotide
gttgattttygattaaataatagtgaygagaygygtgyggggygtttgygagtttttttttgttattyggagtagagygygttagygygaggtygggtyggtygtttgygtagygtygggttaattttaattgttgattatatttttagygtgtttttttataggttttatttgtaattgagaygaatgattatagtggggygggaaggagtagttgtttattaattaatttttaattaaaagtgtttttygttttygggtgattaaagagaaatatygttygttgggygatattgattyggatggaatttatttgttaaygttyggaggaatggttttttygtttatygygyggtygggattgttttggtttttttyggtttgagtygtyggygagtgatyggygagtttgyggttaggtygggttgygygaggtggggttgaygttagagtttttttygttttaagtygygtatatttgatttgaygggttygygygattygtttttttttttttttttttygtaaaatatgtatttttgtygtygttgygaggtygttyggttttagagttttttygagttttyggaatgygaagttaaaggaatygyggyggttatygttgtttattttgttattyggttagaaaagtttgyggagygyggggatggattaatyggtttttttgtttygtttttttagygtttagaagtttgtagtttyggagtag

SEQ ID NO: 8267 - DNA, 383 bp, Artificial Sequence
  Description of Artificial Sequence: Synthetic polynucleotide
tttttttygatttttagttttttttttttttttttttagttttaattgtagtggtaaggtttggggattgagaggttyggtgagtgttagtttygtaggttgygtyggtgttyggtttttattttagttygggggttttaggtttttygygggttttggggygttggtgttygygtagttttagtygttttygtagttatygtygttyggtttygyggaggyggygygtagygggggygttygggygttgtttttttgaggtttygggggtttagggtggttygtagtgttattggttagggtttgygatttttggggttygtygtygtygtttatygtgttttgtttttygtttatygtygttygyggttygygtygtygtt

SEQ ID NO: 8268 - DNA, 349 bp, Artificial Sequence
  Description of Artificial Sequence: Synthetic polynucleotide
aaaagtgagggaagatagggtagtygggattttttggattggagtttttttttttagagttaattttttagatttggaggtttttaaggttttygtaatttagtgagtttyggggtattaataaattttygygggggttatygygttygygaaygtagagtttataygtggattttygygtttgtgatgtttygattygtttygggttttygtatagataatgtygygygtttttttygtagttatttygggattygygtttygygtygttyggaygtttttttgygtttgtyggggatatttatygatattaggaattttagygtgtttatatagtttygttyggttt

SEQ ID NO: 8269 - DNA, 465 bp, Artificial Sequence
  Description of Artificial Sequence: Synthetic polynucleotide
ggaaatagaggttttgggagttttygtttgaagttattygttgttygtygggtyggtggygtttatttygtatygygttgtttygttyggggtattatggtttggggttggattatgttttttttattttagtyggygttttttatttaygygygttgagggtgyggtgagttgagtgyggggttaagtatgttttggygtygatttygtttaggggtttaggatttggygtttaaggggttttttggygayggagattttygaygtagtagygattygyggttgtttaagttgatttygttygygtttygagyggttttgggygygyggggtttyggggattggaggatttyggggggyggygtygygtggtggtyggaaggggaygttaagttyggggtgggygtyggaygtttttygtygygtttgttygttttgtttatygygattyggygggtygtgygg

SEQ ID NO: 8270 - DNA, 424 bp, Artificial Sequence
  Description of Artificial Sequence: Synthetic polynucleotide
gggttgggatygyggggtgggyggggttygggttgggttygtggggtgggyggggttygggttgggatygyggggtgggyggtttygagagygtttygtagtggttggagttttgggygttgtaaagygtgtttygtygggttttygagygtttygygttttygtttygttatgtttttgttgttggggttgtgtttggggttgtttttgtgtgtggggtygtaggaagaggygtagagttggggttatttttyggagtaggtaagtggagtygaggggagtygggtttygggygyggtygttttttttttttygtyggttyggtygyggagtttttgttygggtttttttygatygttttttaggtttttattagaggtttaggggtttttttttgtgggttattygtgygttatttttgtgt

SEQ ID NO: 8271 - DNA, 540 bp, Artificial Sequence
  Description of Artificial Sequence: Synthetic polynucleotide
gygggttygggggyggygtagatttygggygygggyggttygyggygttttttggttttyggygttyggggttagygtagttyggggygagyggggygygggtyggggagggggagttgttygygtattttatttttttttttttygggygggyggyggyggttygttgtatatatttyggygtatttygttaggtygygtatagygtttygagtttaggygttttttygtttttttttygygtttygyggyggyggyggyggyggtagtagtagtagtaatatggttgttgatgggtgtttggggtggygttggyggygggaggagttttttygagtttttgygtyggttgttygttgttagttatggtaaatggtggyggyggyggyggyggtagtagyggyggyggyggyggyggyggaggtagtagttttagaatgagtagtaatatttaygygaattattttagtttagaygygttttttttttttttttttttttttttttttttttttttttttttttttttttttttttygt

SEQ ID NO: 8272 - DNA, 472 bp, Artificial Sequence
  Description of Artificial Sequence: Synthetic polynucleotide
ttttygtagttttggtaggtgttttygggtgtttggayggagtygtggagggattygtygtttaggttygygtggggatygtagggaattygygttaygtygggggttattgtttatygygaggtgttgaagtggtttygtgatygtygygggtygtggttgatatygyggagaagttaggatttttatagtttttgttagatttgaaagtaagttggaaatygatagttgttttagttgttttagattttaatttggtttgggttttttttttttttatttgaaaatagatttagggtaatgtttaagagaattttaatygayggaagtggtygggaaattttgttttyggtattgagggatgttatyggagatttttttgttttaggtttgtyggagtttattatattygttaatgttatattgtattttagaattagagtttggtttttaagatatgggattaaaaaga

SEQ ID NO: 8273 - DNA, 396 bp, Artificial Sequence
  Description of Artificial Sequence: Synthetic polynucleotide
ttttaatttgygaatagtttggggaggttgagygygagttaggagyggattygggggtgggggtaagygttaygtgygygttaggtttttggtgtgttyggtaggyggygttgygtggttgyggttggtttygagggtgyggggggyggygattygggagggaaaatttttgttttttttyggggtttgttttgttygttttttaaattygttttatatttttttygattttygtttttgtaagygttatttgtagttttatyggttttygtaayggtggtggtggttggtggggggtttygaagtttgtttttggttagtyggatttyggtgggagatggaggtagaaatttyggttttttaggagaagggygtttgtttatttttttatttttt

SEQ ID NO: 8274 - DNA, 507 bp, Artificial Sequence
  Description of Artificial Sequence: Synthetic polynucleotide
aggagattttagggggatagtyggggygttttttttttttgataggagtgtttyggttygygggaggtagttgtattaagaaggtgaggaygttgagygggggttygtgtttttygtygtygtagtttttattgtyggygygygtttttygygttygttatagtagygygttaggyggaygtygygggaatttgaygttygaggttygyggtttttaatgagagttttagaatatttttygtttttgayggttagyggtagygtygtygtttttygtagagygttygttttttygtttttagagttttagttttttttygagygatttygtagtttttttttygtttttattygtygtyggttttgtagttyggttttttttttagtttaggygygygggttgtagtgggygatygttttttttygatttttygtygtgtttttgggtttttygaagtggtttgggygagtattgattgttttttggyggtgttagttttaaagtta

SEQ ID NO: 8275 - DNA, 946 bp, Artificial Sequence
  Description of Artificial Sequence: Synthetic polynucleotide
ttttttgygaggtaaataygaagtygtttggttagtgagaagaaattygaggtggtttttggggtagatagagtaggatttgtttttgttttttgtttttttygtttttttttttttagyggyggygatygtagtaatagyggtagtggyggttgttgttattgttttgtygttgtygagtyggttatttgggtattygyggagtygygtygttgttatygtttyggyggtttttyggagtgygyggagggggyggyggaggagygagatatttatagtaatygaggatgygaggggygtttagtagtagygagtgtttgggagttaggaggaggttttygygygtyggtaatttttagtgttaggygttttgtagttttygygygtygygtttgggttygtatygttttygtagtgagggttygttygagyggtaagtttttttyggyggttaagtygatatttttttttygtttygtygtttatttygggtagtagtygyggaataatggagagygtagttagtagttttggagayggygttygggggaggaygygtygtygtygtygtygttgtygttagggtaggygygygtygygtggagtygggygggtgygagggygygyggyggggggtggggggtaygygtygygyggggggygggggtagtggggggygygygygygggttyggggagttygyggggagagttyggygttyggygtagygyggygyggttaagtttygygtttttttygttttttttyggygygttygttttygtttygtygttygtattygttgggggygtttagaaagatgtatagaggtaayggttaggggagyggaggtttaagttatatgtttgygttttygggggttagagttygttagttttygyggatttyggttygyggttagttygagyggttygggtgagtagyg

SEQ ID NO: 8276 - DNA, 390 bp, Artificial Sequence
  Description of Artificial Sequence: Synthetic polynucleotide
ggggttgatygyggtygtttgtataygttttttttggttygygttttyggtttgggagggyggattygtttattttaygatggtttyggttttggaagggattgttttygtgattygtttttttaatagtygttaataattttttttaaygttttttgygyggttygtttttgagaattttggttygggagagygaygyggggttttyggggttgygtaggttgyggygttttgtttaygttggttygagggygyggttygtttygggtyggtttatatatttaygttttttgtygggaggyggttgggaygyggyggggttgttttaagtgtagtygyggtagtgttgygtttttatygygggggtttttgygggtygygtttgtttyg

SEQ ID NO: 8277 - DNA, 440 bp, Artificial Sequence
  Description of Artificial Sequence: Synthetic polynucleotide
ttgtgggggygtaggtagyggttagggtatgagggggygtatayggagattttttygagtattygtttygggttttttttaagtagttgtttyggtttyggatttttatttgatttttttaatygatttggtagggtaygtatatttgaygtttattttgtagtygagtatataaggttygtygaagttatygagtaggttttgtagttgtaggtagttttygtygtygygttttattaygtygtggaaggtaggtaygtagtygygtagygygttagttattagtygygttaggtagtagygtttyggtttygagtagygttttaggattagttygttggtgttygtygttttaaaattttttgaggatyggtattygttagygtygtttagttttttttygtygygggtattygtttattygttttattgtttattag

SEQ ID NO: 8278 - DNA, 324 bp, Artificial Sequence
  Description of Artificial Sequence: Synthetic polynucleotide
gagagttaaaaataagaayggaaaatttattattaaggtattattgygttagygtagttatttgaaggtttttatggttttyggygtttgygtttgaagttygtttttaggttttggggggtatttgtagaaaatttttagtagyggttygttaattagattttagggtgtayggggggtggygtyggtaattatggtaatttttaaaataaaataatataaaataaagtaattaaygtttattaattattattttattttattttttgtattgtttttaggtagttggggaagtygtygggagtgtagtyggatgttggaatt

SEQ ID NO: 8279 - DNA, 355 bp, Artificial Sequence
  Description of Artificial Sequence: Synthetic polynucleotide
tttttttttatttttttcgtttttatttttattttttggtcgttcgaattttcgatcgggagtttagagttttgttagcgtcgtattgtgcgtcgcgtaagtcgttcgatttttttagcggtatcggttttaagtagtaaatatttgtgcgtttttgagttagggacgcgcgtggggggtgggcgtgtacgcgggtgggttagcgtagagtgggagtttgtgggtgtttttcgtcgggatttttaatttagttgttttcgagagtttaagttgagcgtcgtacgtgttcgtgttatttgttgtattggacgtagtttaatagcgtagagaggtttttattcggtatttagttcga

SEQ ID NO: 8280 - DNA, 730 bp, Artificial Sequence
  Description of Artificial Sequence: Synthetic polynucleotide
gttgattttcgattaaataatagtgacgagacgcgtgcggggcgtttgcgagtttttttttgttattcggagtagagcgcgttagcgcgaggtcgggtcggtcgtttgcgtagcgtcgggttaattttaattgttgattatatttttagcgtgtttttttataggttttatttgtaattgagacgaatgattatagtggggcgggaaggagtagttgtttattaattaatttttaattaaaagtgtttttcgttttcgggtgattaaagagaaatatcgttcgttgggcgatattgattcggatggaatttatttgttaacgttcggaggaatggttttttcgtttatcgcgcggtcgggattgttttggtttttttcggtttgagtcgtcggcgagtgatcggcgagtttgcggttaggtcgggttgcgcgaggtggggttgacgttagagtttttttcgttttaagtcgcgtatatttgatttgacgggttcgcgcgattcgtttttttttttttttttttcgtaaaatatgtatttttgtcgtcgttgcgaggtcgttcggttttagagttttttcgagttttcggaatgcgaagttaaaggaatcgcggcggttatcgttgtttattttgttattcggttagaaaagtttgcggagcgcggggatggattaatcggtttttttgtttcgtttttttagcgtttagaagtttgtagtttcggagtag

SEQ ID NO: 8281 - DNA, 383 bp, Artificial Sequence
  Description of Artificial Sequence: Synthetic polynucleotide
tttttttcgatttttagttttttttttttttttttttagttttaattgtagtggtaaggtttggggattgagaggttcggtgagtgttagtttcgtaggttgcgtcggtgttcggtttttattttagttcgggggttttaggtttttcgcgggttttggggcgttggtgttcgcgtagttttagtcgttttcgtagttatcgtcgttcggtttcgcggaggcggcgcgtagcgggggcgttcgggcgttgtttttttgaggtttcgggggtttagggtggttcgtagtgttattggttagggtttgcgatttttggggttcgtcgtcgtcgtttatcgtgttttgtttttcgtttatcgtcgttcgcggttcgcgtcgtcgtt

SEQ ID NO: 8282 - DNA, 349 bp, Artificial Sequence
  Description of Artificial Sequence: Synthetic polynucleotide
aaaagtgagggaagatagggtagtcgggattttttggattggagtttttttttttagagttaattttttagatttggaggtttttaaggttttcgtaatttagtgagtttcggggtattaataaattttcgcgggggttatcgcgttcgcgaacgtagagtttatacgtggattttcgcgtttgtgatgtttcgattcgtttcgggttttcgtatagataatgtcgcgcgtttttttcgtagttatttcgggattcgcgtttcgcgtcgttcggacgtttttttgcgtttgtcggggatatttatcgatattaggaattttagcgtgtttatatagtttcgttcggttt

SEQ ID NO: 8283 - DNA, 465 bp, Artificial Sequence
  Description of Artificial Sequence: Synthetic polynucleotide
ggaaatagaggttttgggagttttcgtttgaagttattcgttgttcgtcgggtcggtggcgtttatttcgtatcgcgttgtttcgttcggggtattatggtttggggttggattatgttttttttattttagtcggcgttttttatttacgcgcgttgagggtgcggtgagttgagtgcggggttaagtatgttttggcgtcgatttcgtttaggggtttaggatttggcgtttaaggggttttttggcgacggagattttcgacgtagtagcgattcgcggttgtttaagttgatttcgttcgcgtttcgagcggttttgggcgcgcggggtttcggggattggaggatttcggggggcggcgtcgcgtggtggtcggaaggggacgttaagttcggggtgggcgtcggacgtttttcgtcgcgtttgttcgttttgtttatcgcgattcggcgggtcgtgcgg

SEQ ID NO: 8284 - DNA, 424 bp, Artificial Sequence
  Description of Artificial Sequence: Synthetic polynucleotide
gggttgggatcgcggggtgggcggggttcgggttgggttcgtggggtgggcggggttcgggttgggatcgcggggtgggcggtttcgagagcgtttcgtagtggttggagttttgggcgttgtaaagcgtgtttcgtcgggttttcgagcgtttcgcgttttcgtttcgttatgtttttgttgttggggttgtgtttggggttgtttttgtgtgtggggtcgtaggaagaggcgtagagttggggttatttttcggagtaggtaagtggagtcgaggggagtcgggtttcgggcgcggtcgttttttttttttcgtcggttcggtcgcggagtttttgttcgggtttttttcgatcgttttttaggtttttattagaggtttaggggtttttttttgtgggttattcgtgcgttatttttgtgt

SEQ ID NO: 8285 - DNA, 540 bp, Artificial Sequence
  Description of Artificial Sequence: Synthetic polynucleotide
gcgggttcgggggcggcgtagatttcgggcgcgggcggttcgcggcgttttttggttttcggcgttcggggttagcgtagttcggggcgagcggggcgcgggtcggggagggggagttgttcgcgtattttatttttttttttttcgggcgggcggcggcggttcgttgtatatatttcggcgtatttcgttaggtcgcgtatagcgtttcgagtttaggcgttttttcgtttttttttcgcgtttcgcggcggcggcggcggcggtagtagtagtagtaatatggttgttgatgggtgtttggggtggcgttggcggcgggaggagttttttcgagtttttgcgtcggttgttcgttgttagttatggtaaatggtggcggcggcggcggcggtagtagcggcggcggcggcggcggcggaggtagtagttttagaatgagtagtaatatttacgcgaattattttagtttagacgcgttttttttttttttttttttttttttttttttttttttttttttttttttttttttttcgt

SEQ ID NO: 8286 - DNA, 472 bp, Artificial Sequence
  Description of Artificial Sequence: Synthetic polynucleotide
ttttcgtagttttggtaggtgttttcgggtgtttggacggagtcgtggagggattcgtcgtttaggttcgcgtggggatcgtagggaattcgcgttacgtcgggggttattgtttatcgcgaggtgttgaagtggtttcgtgatcgtcgcgggtcgtggttgatatcgcggagaagttaggatttttatagtttttgttagatttgaaagtaagttggaaatcgatagttgttttagttgttttagattttaatttggtttgggttttttttttttttatttgaaaatagatttagggtaatgtttaagagaattttaatcgacggaagtggtcgggaaattttgttttcggtattgagggatgttatcggagatttttttgttttaggtttgtcggagtttattatattcgttaatgttatattgtattttagaattagagtttggtttttaagatatgggattaaaaaga

SEQ ID NO: 8287 - DNA, 396 bp, Artificial Sequence
  Description of Artificial Sequence: Synthetic polynucleotide
ttttaatttgcgaatagtttggggaggttgagcgcgagttaggagcggattcgggggtgggggtaagcgttacgtgcgcgttaggtttttggtgtgttcggtaggcggcgttgcgtggttgcggttggtttcgagggtgcggggggcggcgattcgggagggaaaatttttgttttttttcggggtttgttttgttcgttttttaaattcgttttatatttttttcgattttcgtttttgtaagcgttatttgtagttttatcggttttcgtaacggtggtggtggttggtggggggtttcgaagtttgtttttggttagtcggatttcggtgggagatggaggtagaaatttcggttttttaggagaagggcgtttgtttatttttttatttttt

SEQ ID NO: 8288 - DNA, 507 bp, Artificial Sequence
  Description of Artificial Sequence: Synthetic polynucleotide
aggagattttagggggatagtcggggcgttttttttttttgataggagtgtttcggttcgcgggaggtagttgtattaagaaggtgaggacgttgagcgggggttcgtgtttttcgtcgtcgtagtttttattgtcggcgcgcgtttttcgcgttcgttatagtagcgcgttaggcggacgtcgcgggaatttgacgttcgaggttcgcggtttttaatgagagttttagaatatttttcgtttttgacggttagcggtagcgtcgtcgtttttcgtagagcgttcgttttttcgtttttagagttttagttttttttcgagcgatttcgtagtttttttttcgtttttattcgtcgtcggttttgtagttcggttttttttttagtttaggcgcgcgggttgtagtgggcgatcgttttttttcgatttttcgtcgtgtttttgggtttttcgaagtggtttgggcgagtattgattgttttttggcggtgttagttttaaagtta

SEQ ID NO: 8289 - DNA, 946 bp, Artificial Sequence
  Description of Artificial Sequence: Synthetic polynucleotide
ttttttgcgaggtaaatacgaagtcgtttggttagtgagaagaaattcgaggtggtttttggggtagatagagtaggatttgtttttgttttttgtttttttcgtttttttttttttagcggcggcgatcgtagtaatagcggtagtggcggttgttgttattgttttgtcgttgtcgagtcggttatttgggtattcgcggagtcgcgtcgttgttatcgtttcggcggtttttcggagtgcgcggagggggcggcggaggagcgagatatttatagtaatcgaggatgcgaggggcgtttagtagtagcgagtgtttgggagttaggaggaggttttcgcgcgtcggtaatttttagtgttaggcgttttgtagttttcgcgcgtcgcgtttgggttcgtatcgttttcgtagtgagggttcgttcgagcggtaagtttttttcggcggttaagtcgatatttttttttcgtttcgtcgtttatttcgggtagtagtcgcggaataatggagagcgtagttagtagttttggagacggcgttcgggggaggacgcgtcgtcgtcgtcgtcgttgtcgttagggtaggcgcgcgtcgcgtggagtcgggcgggtgcgagggcgcgcggcggggggtggggggtacgcgtcgcgcggggggcgggggtagtggggggcgcgcgcgcgggttcggggagttcgcggggagagttcggcgttcggcgtagcgcggcgcggttaagtttcgcgtttttttcgttttttttcggcgcgttcgttttcgtttcgtcgttcgtattcgttgggggcgtttagaaagatgtatagaggtaacggttaggggagcggaggtttaagttatatgtttgcgttttcgggggttagagttcgttagttttcgcggatttcggttcgcggttagttcgagcggttcgggtgagtagcg

SEQ ID NO: 8290 - DNA, 390 bp, Artificial Sequence
  Description of Artificial Sequence: Synthetic polynucleotide
ggggttgatcgcggtcgtttgtatacgttttttttggttcgcgttttcggtttgggagggcggattcgtttattttacgatggtttcggttttggaagggattgttttcgtgattcgtttttttaatagtcgttaataattttttttaacgttttttgcgcggttcgtttttgagaattttggttcgggagagcgacgcggggttttcggggttgcgtaggttgcggcgttttgtttacgttggttcgagggcgcggttcgtttcgggtcggtttatatatttacgttttttgtcgggaggcggttgggacgcggcggggttgttttaagtgtagtcgcggtagtgttgcgtttttatcgcgggggtttttgcgggtcgcgtttgtttcg

SEQ ID NO: 8291 - DNA, 440 bp, Artificial Sequence
  Description of Artificial Sequence: Synthetic polynucleotide
ttgtgggggcgtaggtagcggttagggtatgagggggcgtatacggagattttttcgagtattcgtttcgggttttttttaagtagttgtttcggtttcggatttttatttgatttttttaatcgatttggtagggtacgtatatttgacgtttattttgtagtcgagtatataaggttcgtcgaagttatcgagtaggttttgtagttgtaggtagttttcgtcgtcgcgttttattacgtcgtggaaggtaggtacgtagtcgcgtagcgcgttagttattagtcgcgttaggtagtagcgtttcggtttcgagtagcgttttaggattagttcgttggtgttcgtcgttttaaaattttttgaggatcggtattcgttagcgtcgtttagttttttttcgtcgcgggtattcgtttattcgttttattgtttattag

SEQ ID NO: 8292 - DNA, 324 bp, Artificial Sequence
  Description of Artificial Sequence: Synthetic polynucleotide
gagagttaaaaataagaacggaaaatttattattaaggtattattgcgttagcgtagttatttgaaggtttttatggttttcggcgtttgcgtttgaagttcgtttttaggttttggggggtatttgtagaaaatttttagtagcggttcgttaattagattttagggtgtacggggggtggcgtcggtaattatggtaatttttaaaataaaataatataaaataaagtaattaacgtttattaattattattttattttattttttgtattgtttttaggtagttggggaagtcgtcgggagtgtagtcggatgttggaatt

SEQ ID NO: 8293 - DNA, 265 bp, Homo sapiens
ttagactgcgtccagtacagcagatggcacgagcacgtgcggcgctcagcttaggctctcggaggcagctgagttggaaatcccgacggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggt

SEQ ID NO: 8294 - DNA, 235 bp, Homo sapiens
tcaggccgggaggggccaggacagtcccggccgcgcggtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacac

SEQ ID NO: 8295 - DNA, 270 bp, Homo sapiens
gtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttgga

SEQ ID NO: 8296 - DNA, 270 bp, Homo sapiens
tgggcacgctggagttcctggtgtcggtgagtgtccccggcagacgcagggggacgtccgggcggcgcggggcgcgggtcccggagtggctgcgggaaggacgcgcggcattgtctgtgcggggacccgggacgggtcggggcatcacaggcgcgggaatccacgtgtggactctgcgttcgcgggcgcggtgacccccgcggggatttgttggtgccccgagactcactgagttgcgggggccttggagacctccaggtctgaaaagtt

SEQ ID NO: 8297 - DNA, 149 bp, Homo sapiens
gggcgccaggtcctgggcccctgggcgaagtcgacgccagaacatgcttggccccgcactcagctcaccgcaccctcagcgcgcgtgggtggggggcgccggctgaggtggggagggcatagtccagccccaggccatagtgccccggg

SEQ ID NO: 8298 - DNA, 232 bp, Homo sapiens
cccacagagagggacccctgggcctctggtgggggcctgggagacggtcgaagggggcccgggcagaagctccgcggccgggccggcggagggaagggggcggccgcgcccgggacccggctcccctcggctccacttacctgctccgaagagtggccccagctctgcgcctcttcctgcgaccccacacacagggacagccccaggcacagccccagcagcaggagcatgg

SEQ ID NO: 8299 - DNA, 189 bp, Homo sapiens
tggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgc

SEQ ID NO: 8300 - DNA, 260 bp, Homo sapiens
gccaaactctagttctaaagtgcagtgtggcattagcgaatgtggtggactccggcaggcctggggcaggggaatctccggtaacatccctcagtaccgaaggcaggatttcccggccacttccgtcggttggaattctcttaagcattgccctgagtctattttcaaatgaaagggggaaaaacccaaaccagattagaatctgaaacagctgaaacagctatcgatttccagcttgctttcaagtctggcagagactg

SEQ ID NO: 8301 - DNA, 187 bp, Homo sapiens
aggaggccggaatttctgcctccatctcccaccggggtccggctggccagaggcaagcttcgagaccccccaccaaccaccaccaccgttgcgagggccggtgaggctgcagataacgcttgcaaggacgggagtcggggagggtgtagggcgagtttaaaggacgggcagagcaagccccgggaag

SEQ ID NO: 8302 - DNA, 249 bp, Homo sapiens
cacttcgggaggcccaggggcacggcgaggggtcggggaaaggcgatcgcccactacagcccgcgcgcctagactgagggaggagccgggctgcagaaccggcggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggc

SEQ ID NO: 8303 - DNA, 196 bp, Homo sapiens
gccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccgg

SEQ ID NO: 8304 - DNA, 176 bp, Homo sapiens
gcgactgcacttggggcagccccgccgcgtcccagccgcctcccggcaggaagcgtaggtgtgtgagccgacccggagcgagccgcgccctcgggccagcgtgggcagggcgccgcagcctgcgcagccccgaggaccccgcgtcgctctcccgagccagggttctcaggagcggg

SEQ ID NO: 8305 - DNA, 152 bp, Homo sapiens
aaagctacctgcagctgcaggacctgctcgatggcttcgacggaccttgtgtgctcgactgcaaaatgggcgtcaggtatgcgtgccctgccaggtcggttggggggatcaagtaggggtccggggccgggacagctgcttgagggggaccc

SEQ ID NO: 8306 - DNA, 232 bp, Homo sapiens
ctacctgaggacagtacagggggtgagatggggtggtggttggtgaacgttggttactttattttatattattttattttgagagttgccataattaccggcgccaccccccgtgcaccctgaggtctggttggcgagccgctgctgggagttttctgcaaataccccccaaagcctgaaggcgggcttcaaacgcaggcgccggggaccatgggagccttcaaatagctgc

SEQ ID NO: 8307 - DNA, 265 bp, Artificial Sequence
  Description of Artificial Sequence: Synthetic polynucleotide
ttagattgygtttagtatagtagatggtaygagtaygtgyggygtttagtttaggttttyggaggtagttgagttggaaatttygayggaaagtatttataagtttttattttgygttggtttattygygtgtaygtttattttttaygygygtttttggtttagaagygtatagatgtttattgtttagagtyggtatygttggggagatygagygatttgygyggygtatagtgyggygttggtagggttttgggttttyggt

SEQ ID NO: 8308 - DNA, 235 bp, Artificial Sequence
  Description of Artificial Sequence: Synthetic polynucleotide
ttaggtygggaggggttaggatagtttyggtygygyggtggayggaggggttattttttygggygttagtaaataaattttattygagttaatatygtttagygaayggtgtttttttttagttattygagaaygagaggtatttttaattagaaattaattaatgagtagttgttttttttygttttattgtaattattygttttaattataaatgagatttatgaaaggatat

SEQ ID NO: 8309 - DNA, 270 bp, Artificial Sequence
  Description of Artificial Sequence: Synthetic polynucleotide
gtygtagattttggttagtggtattgygggttattttgagttttygaggttttagggggatagygttygggygttttygttgygygtygttttygyggagtygagyggyggtggttgyggaagygattggggttgygyggatattagygttttagagttygygaggagtttggggttttygggttggagtaagagtygagtatyggygtagtttgygggattggtatttatygggttttttaatttttagattttgttattgtagttgga

SEQ ID NO: 8310 - DNA, 270 bp, Artificial Sequence
  Description of Artificial Sequence: Synthetic polynucleotide
tgggtaygttggagtttttggtgtyggtgagtgttttyggtagaygtagggggaygttygggyggygyggggygygggtttyggagtggttgygggaaggaygygyggtattgtttgtgyggggattygggaygggtyggggtattataggygygggaatttaygtgtggattttgygttygygggygyggtgattttygyggggatttgttggtgtttygagatttattgagttgygggggttttggagatttttaggtttgaaaagtt

SEQ ID NO: 8311 - DNA, 149 bp, Artificial Sequence
  Description of Artificial Sequence: Synthetic polynucleotide
gggygttaggttttgggtttttgggygaagtygaygttagaatatgtttggtttygtatttagtttatygtatttttagygygygtgggtggggggygtyggttgaggtggggagggtatagtttagttttaggttatagtgtttyggg

SEQ ID NO: 8312 - DNA, 232 bp, Artificial Sequence
  Description of Artificial Sequence: Synthetic polynucleotide
tttatagagagggatttttgggtttttggtgggggtttgggagayggtygaagggggttygggtagaagtttygyggtygggtyggyggagggaagggggyggtygygttygggattyggtttttttyggttttatttatttgtttygaagagtggttttagttttgygtttttttttgygattttatatatagggatagttttaggtatagttttagtagtaggagtatgg

SEQ ID NO: 8313 - DNA, 189 bp, Artificial Sequence
  Description of Artificial Sequence: Synthetic polynucleotide
tggatattgttatttattttaagattgttgttttygtygtygtygtygtygtygttgttgtygtygtygtygtygttattatttgttatagttagtaaygggtagtyggygtaggggttygggggagtttttttygtygttagygttattttaaatatttattaatagttatattgttgttattgttgt

SEQ ID NO: 8314 - DNA, 260 bp, Artificial Sequence
  Description of Artificial Sequence: Synthetic polynucleotide
gttaaattttagttttaaagtgtagtgtggtattagygaatgtggtggatttyggtaggtttggggtaggggaattttyggtaatattttttagtatygaaggtaggatttttyggttattttygtyggttggaatttttttaagtattgttttgagtttatttttaaatgaaagggggaaaaatttaaattagattagaatttgaaatagttgaaatagttatygatttttagtttgtttttaagtttggtagagattg

SEQ ID NO: 8315 - DNA, 187 bp, Artificial Sequence
  Description of Artificial Sequence: Synthetic polynucleotide
aggaggtyggaatttttgtttttattttttatyggggttyggttggttagaggtaagtttygagattttttattaattattattatygttgygagggtyggtgaggttgtagataaygtttgtaaggaygggagtyggggagggtgtagggygagtttaaaggaygggtagagtaagtttygggaag

SEQ ID NO: 8316 - DNA, 249 bp, Artificial Sequence
  Description of Artificial Sequence: Synthetic polynucleotide
tatttygggaggtttaggggtayggygaggggtyggggaaaggygatygtttattatagttygygygtttagattgagggaggagtygggttgtagaatyggyggyggatggagaygggagggaggttgygaggtygttygaggagagattaaggttttagaaayggagaagygggygttttgygggaggyggyggygttgtygttggtygttaagggygggaagtgttttgggatttttattaggggt

SEQ ID NO: 8317 - DNA, 196 bp, Artificial Sequence
  Description of Artificial Sequence: Synthetic polynucleotide
gtygtttttagggttgttggttgygttttttattgtttygyggttgttgttyggggtgggyggygaggygggggggaggtgtyggtttggtygtyggggagggtttatygttygggyggatttttattgygagagygatgygggtttaggygyggygygygggggttgtagggygtttagtattgggggttgtygg

SEQ ID NO: 8318 - DNA, 176 bp, Artificial Sequence
  Description of Artificial Sequence: Synthetic polynucleotide
gygattgtatttggggtagtttygtygygttttagtygtttttyggtaggaagygtaggtgtgtgagtygattyggagygagtygygttttygggttagygtgggtagggygtygtagtttgygtagtttygaggatttygygtygttttttygagttagggtttttaggagyggg

SEQ ID NO: 8319 - DNA, 152 bp, Artificial Sequence
  Description of Artificial Sequence: Synthetic polynucleotide
aaagttatttgtagttgtaggatttgttygatggtttygayggattttgtgtgttygattgtaaaatgggygttaggtatgygtgttttgttaggtyggttggggggattaagtaggggttyggggtygggatagttgtttgagggggattt

SEQ ID NO: 8320 - DNA, 232 bp, Artificial Sequence
  Description of Artificial Sequence: Synthetic polynucleotide
ttatttgaggatagtatagggggtgagatggggtggtggttggtgaaygttggttattttattttatattattttattttgagagttgttataattatyggygttatttttygtgtattttgaggtttggttggygagtygttgttgggagttttttgtaaatattttttaaagtttgaaggygggttttaaaygtaggygtyggggattatgggagtttttaaatagttgt

SEQ ID NO: 8321 - DNA, 265 bp, Artificial Sequence
  Description of Artificial Sequence: Synthetic polynucleotide
ttagattgcgtttagtatagtagatggtacgagtacgtgcggcgtttagtttaggttttcggaggtagttgagttggaaatttcgacggaaagtatttataagtttttattttgcgttggtttattcgcgtgtacgtttattttttacgcgcgtttttggtttagaagcgtatagatgtttattgtttagagtcggtatcgttggggagatcgagcgatttgcgcggcgtatagtgcggcgttggtagggttttgggttttcggt

SEQ ID NO: 8322 - DNA, 235 bp, Artificial Sequence
  Description of Artificial Sequence: Synthetic polynucleotide
ttaggtcgggaggggttaggatagtttcggtcgcgcggtggacggaggggttattttttcgggcgttagtaaataaattttattcgagttaatatcgtttagcgaacggtgtttttttttagttattcgagaacgagaggtatttttaattagaaattaattaatgagtagttgttttttttcgttttattgtaattattcgttttaattataaatgagatttatgaaaggatat

SEQ ID NO: 8323 - DNA, 270 bp, Artificial Sequence
  Description of Artificial Sequence: Synthetic polynucleotide
gtcgtagattttggttagtggtattgcgggttattttgagttttcgaggttttagggggatagcgttcgggcgttttcgttgcgcgtcgttttcgcggagtcgagcggcggtggttgcggaagcgattggggttgcgcggatattagcgttttagagttcgcgaggagtttggggttttcgggttggagtaagagtcgagtatcggcgtagtttgcgggattggtatttatcgggttttttaatttttagattttgttattgtagttgga

SEQ ID NO: 8324 - DNA, 270 bp, Artificial Sequence
  Description of Artificial Sequence: Synthetic polynucleotide
tgggtacgttggagtttttggtgtcggtgagtgttttcggtagacgtagggggacgttcgggcggcgcggggcgcgggtttcggagtggttgcgggaaggacgcgcggtattgtttgtgcggggattcgggacgggtcggggtattataggcgcgggaatttacgtgtggattttgcgttcgcgggcgcggtgattttcgcggggatttgttggtgtttcgagatttattgagttgcgggggttttggagatttttaggtttgaaaagtt

SEQ ID NO: 8325 - DNA, 149 bp, Artificial Sequence
  Description of Artificial Sequence: Synthetic polynucleotide
gggcgttaggttttgggtttttgggcgaagtcgacgttagaatatgtttggtttcgtatttagtttatcgtatttttagcgcgcgtgggtggggggcgtcggttgaggtggggagggtatagtttagttttaggttatagtgtttcggg

SEQ ID NO: 8326 - DNA, 232 bp, Artificial Sequence
  Description of Artificial Sequence: Synthetic polynucleotide
tttatagagagggatttttgggtttttggtgggggtttgggagacggtcgaagggggttcgggtagaagtttcgcggtcgggtcggcggagggaagggggcggtcgcgttcgggattcggtttttttcggttttatttatttgtttcgaagagtggttttagttttgcgtttttttttgcgattttatatatagggatagttttaggtatagttttagtagtaggagtatgg

SEQ ID NO: 8327 - DNA, 189 bp, Artificial Sequence
  Description of Artificial Sequence: Synthetic polynucleotide
tggatattgttatttattttaagattgttgttttcgtcgtcgtcgtcgtcgtcgttgttgtcgtcgtcgtcgtcgttattatttgttatagttagtaacgggtagtcggcgtaggggttcgggggagtttttttcgtcgttagcgttattttaaatatttattaatagttatattgttgttattgttgt

SEQ ID NO: 8328 - DNA, 260 bp, Artificial Sequence
  Description of Artificial Sequence: Synthetic polynucleotide
gttaaattttagttttaaagtgtagtgtggtattagcgaatgtggtggatttcggtaggtttggggtaggggaattttcggtaatattttttagtatcgaaggtaggatttttcggttattttcgtcggttggaatttttttaagtattgttttgagtttatttttaaatgaaagggggaaaaatttaaattagattagaatttgaaatagttgaaatagttatcgatttttagtttgtttttaagtttggtagagattg

SEQ ID NO: 8329 - DNA, 187 bp, Artificial Sequence
  Description of Artificial Sequence: Synthetic polynucleotide
aggaggtcggaatttttgtttttattttttatcggggttcggttggttagaggtaagtttcgagattttttattaattattattatcgttgcgagggtcggtgaggttgtagataacgtttgtaaggacgggagtcggggagggtgtagggcgagtttaaaggacgggtagagtaagtttcgggaag

SEQ ID NO: 8330 - DNA, 249 bp, Artificial Sequence
  Description of Artificial Sequence: Synthetic polynucleotide
tatttcgggaggtttaggggtacggcgaggggtcggggaaaggcgatcgtttattatagttcgcgcgtttagattgagggaggagtcgggttgtagaatcggcggcggatggagacgggagggaggttgcgaggtcgttcgaggagagattaaggttttagaaacggagaagcgggcgttttgcgggaggcggcggcgttgtcgttggtcgttaagggcgggaagtgttttgggatttttattaggggt

SEQ ID NO: 8331 - DNA, 196 bp, Artificial Sequence
  Description of Artificial Sequence: Synthetic polynucleotide
gtcgtttttagggttgttggttgcgttttttattgtttcgcggttgttgttcggggtgggcggcgaggcgggggggaggtgtcggtttggtcgtcggggagggtttatcgttcgggcggatttttattgcgagagcgatgcgggtttaggcgcggcgcgcgggggttgtagggcgtttagtattgggggttgtcgg

SEQ ID NO: 8332 - DNA, 176 bp, Artificial Sequence
  Description of Artificial Sequence: Synthetic polynucleotide
gcgattgtatttggggtagtttcgtcgcgttttagtcgtttttcggtaggaagcgtaggtgtgtgagtcgattcggagcgagtcgcgttttcgggttagcgtgggtagggcgtcgtagtttgcgtagtttcgaggatttcgcgtcgttttttcgagttagggtttttaggagcggg

SEQ ID NO: 8333 - DNA, 152 bp, Artificial Sequence
  Description of Artificial Sequence: Synthetic polynucleotide
aaagttatttgtagttgtaggatttgttcgatggtttcgacggattttgtgtgttcgattgtaaaatgggcgttaggtatgcgtgttttgttaggtcggttggggggattaagtaggggttcggggtcgggatagttgtttgagggggattt

SEQ ID NO: 8334 - DNA, 232 bp, Artificial Sequence
  Description of Artificial Sequence: Synthetic polynucleotide
ttatttgaggatagtatagggggtgagatggggtggtggttggtgaacgttggttattttattttatattattttattttgagagttgttataattatcggcgttatttttcgtgtattttgaggtttggttggcgagtcgttgttgggagttttttgtaaatattttttaaagtttgaaggcgggttttaaacgtaggcgtcggggattatgggagtttttaaatagttgt

SEQ ID NO: 8335 - DNA, 265 bp, Homo sapiens
accgggagcccagagccctgccagcgccgcactgtgcgccgcgcaagtcgctcgatctccccagcggtaccggctctaagcagtaaacatctgtgcgcttctgagccagggacgcgcgtggggggtgggcgtgcacgcgggtgggccagcgcagagtgggagcttgtgggtgctttccgtcgggatttccaactcagctgcctccgagagcctaagctgagcgccgcacgtgctcgtgccatctgctgtactggacgcagtctaa

SEQ ID NO: 8336 - DNA, 235 bp, Homo sapiens
gtgtcctttcataggtctcatttgtaattgagacgaatgattacagtggggcgggaaggagcagctgctcattaattaatttctaattaaaagtgcctctcgttctcgggtgactaaagagaaacaccgttcgctgggcgatattgactcggatggaatttatttgctaacgcccggaggaatggcccctccgtccaccgcgcggccgggactgtcctggcccctcccggcctga

SEQ ID NO: 8337 - DNA, 270 bp, Homo sapiens
tccaactgcagtggcaaggtctggggattgagaggcccggtgagtgccagtcccgcaggctgcgccggtgctcggctcttactccagcccgggggccccaggctcctcgcgggctctggggcgctggtgtccgcgcagccccagtcgcttccgcagccaccgccgctcggctccgcggaggcggcgcgcagcgggggcgcccgggcgctgtccccctgaggcctcgggggctcagggtggcccgcagtgccactggccagggtctgcgac

SEQ ID NO: 8338 - DNA, 270 bp, Homo sapiens
aacttttcagacctggaggtctccaaggcccccgcaactcagtgagtctcggggcaccaacaaatccccgcgggggtcaccgcgcccgcgaacgcagagtccacacgtggattcccgcgcctgtgatgccccgacccgtcccgggtccccgcacagacaatgccgcgcgtccttcccgcagccactccgggacccgcgccccgcgccgcccggacgtccccctgcgtctgccggggacactcaccgacaccaggaactccagcgtgccca

SEQ ID NO: 8339 - DNA, 149 bp, Homo sapiens
cccggggcactatggcctggggctggactatgccctccccacctcagccggcgccccccacccacgcgcgctgagggtgcggtgagctgagtgcggggccaagcatgttctggcgtcgacttcgcccaggggcccaggacctggcgccc

SEQ ID NO: 8340 - DNA, 232 bp, Homo sapiens
ccatgctcctgctgctggggctgtgcctggggctgtccctgtgtgtggggtcgcaggaagaggcgcagagctggggccactcttcggagcaggtaagtggagccgaggggagccgggtcccgggcgcggccgcccccttccctccgccggcccggccgcggagcttctgcccgggcccccttcgaccgtctcccaggcccccaccagaggcccaggggtccctctctgtggg

SEQ ID NO: 8341 - DNA, 189 bp, Homo sapiens
gcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatcca

SEQ ID NO: 8342 - DNA, 260 bp, Homo sapiens
cagtctctgccagacttgaaagcaagctggaaatcgatagctgtttcagctgtttcagattctaatctggtttgggtttttccccctttcatttgaaaatagactcagggcaatgcttaagagaattccaaccgacggaagtggccgggaaatcctgccttcggtactgagggatgttaccggagattcccctgccccaggcctgccggagtccaccacattcgctaatgccacactgcactttagaactagagtttggc

SEQ ID NO: 8343 - DNA, 187 bp, Homo sapiens
cttcccggggcttgctctgcccgtcctttaaactcgccctacaccctccccgactcccgtccttgcaagcgttatctgcagcctcaccggccctcgcaacggtggtggtggttggtggggggtctcgaagcttgcctctggccagccggaccccggtgggagatggaggcagaaattccggcctcct

SEQ ID NO: 8344 - DNA, 249 bp, Homo sapiens
gcccctaatgagagtcccagaacacttcccgcccttgacggccagcggcagcgccgccgcctcccgcagagcgcccgcttctccgtttctagagccttagtctctcctcgagcgacctcgcagcctccctcccgtctccatccgccgccggttctgcagcccggctcctccctcagtctaggcgcgcgggctgtagtgggcgatcgcctttccccgacccctcgccgtgcccctgggcctcccgaagtg

SEQ ID NO: 8345 - DNA, 196 bp, Homo sapiens
ccggcaacccccagtgctaggcgccctgcagcccccgcgcgccgcgcctgggcccgcatcgctctcgcagtgagggtccgcccgagcggtaagccctccccggcggccaagccgacacctcccccccgcctcgccgcccaccccgggcagcagccgcggaacaatggagagcgcagccagcagccctggagacggc

SEQ ID NO: 8346 - DNA, 176 bp, Homo sapiens
cccgctcctgagaaccctggctcgggagagcgacgcggggtcctcggggctgcgcaggctgcggcgccctgcccacgctggcccgagggcgcggctcgctccgggtcggctcacacacctacgcttcctgccgggaggcggctgggacgcggcggggctgccccaagtgcagtcgc

SEQ ID NO: 8347 - DNA, 152 bp, Homo sapiens
gggtccccctcaagcagctgtcccggccccggacccctacttgatccccccaaccgacctggcagggcacgcatacctgacgcccattttgcagtcgagcacacaaggtccgtcgaagccatcgagcaggtcctgcagctgcaggtagcttt

SEQ ID NO: 8348 - DNA, 232 bp, Homo sapiens
gcagctatttgaaggctcccatggtccccggcgcctgcgtttgaagcccgccttcaggctttggggggtatttgcagaaaactcccagcagcggctcgccaaccagacctcagggtgcacggggggtggcgccggtaattatggcaactctcaaaataaaataatataaaataaagtaaccaacgttcaccaaccaccaccccatctcaccccctgtactgtcctcaggtag

SEQ ID NO: 8349 - DNA, 265 bp, Artificial Sequence
  Description of Artificial Sequence: Synthetic polynucleotide
atygggagtttagagttttgttagygtygtattgtgygtygygtaagtygttygatttttttagyggtatyggttttaagtagtaaatatttgtgygtttttgagttagggaygygygtggggggtgggygtgtaygygggtgggttagygtagagtgggagtttgtgggtgtttttygtygggatttttaatttagttgttttygagagtttaagttgagygtygtaygtgttygtgttatttgttgtattggaygtagtttaa

SEQ ID NO: 8350 - DNA, 235 bp, Artificial Sequence
  Description of Artificial Sequence: Synthetic polynucleotide
gtgtttttttataggttttatttgtaattgagaygaatgattatagtggggygggaaggagtagttgtttattaattaatttttaattaaaagtgtttttygttttygggtgattaaagagaaatatygttygttgggygatattgattyggatggaatttatttgttaaygttyggaggaatggttttttygtttatygygyggtygggattgttttggtttttttyggtttga

SEQ ID NO: 8351 - DNA, 270 bp, Artificial Sequence
  Description of Artificial Sequence: Synthetic polynucleotide
tttaattgtagtggtaaggtttggggattgagaggttyggtgagtgttagtttygtaggttgygtyggtgttyggtttttattttagttygggggttttaggtttttygygggttttggggygttggtgttygygtagttttagtygttttygtagttatygtygttyggtttygyggaggyggygygtagygggggygttygggygttgtttttttgaggtttygggggtttagggtggttygtagtgttattggttagggtttgygat

SEQ ID NO: 8352 - DNA, 270 bp, Artificial Sequence
  Description of Artificial Sequence: Synthetic polynucleotide
aattttttagatttggaggtttttaaggttttygtaatttagtgagtttyggggtattaataaattttygygggggttatygygttygygaaygtagagtttataygtggattttygygtttgtgatgtttygattygtttygggttttygtatagataatgtygygygtttttttygtagttatttygggattygygtttygygtygttyggaygtttttttgygtttgtyggggatatttatygatattaggaattttagygtgttta

SEQ ID NO: 8353 - DNA, 149 bp, Artificial Sequence
  Description of Artificial Sequence: Synthetic polynucleotide
ttyggggtattatggtttggggttggattatgttttttttattttagtyggygttttttatttaygygygttgagggtgyggtgagttgagtgyggggttaagtatgttttggygtygatttygtttaggggtttaggatttggygttt

SEQ ID NO: 8354 - DNA, 232 bp, Artificial Sequence
  Description of Artificial Sequence: Synthetic polynucleotide
ttatgtttttgttgttggggttgtgtttggggttgtttttgtgtgtggggtygtaggaagaggygtagagttggggttatttttyggagtaggtaagtggagtygaggggagtygggtttygggygyggtygttttttttttttygtyggttyggtygyggagtttttgttygggtttttttygatygttttttaggtttttattagaggtttaggggtttttttttgtggg

SEQ ID NO: 8355 - DNA, 189 bp, Artificial Sequence
  Description of Artificial Sequence: Synthetic polynucleotide
gtagtagtagtagtaatatggttgttgatgggtgtttggggtggygttggyggygggaggagttttttygagtttttgygtyggttgttygttgttagttatggtaaatggtggyggyggyggyggyggtagtagyggyggyggyggyggyggyggaggtagtagttttagaatgagtagtaatattta

SEQ ID NO: 8356 - DNA, 260 bp, Artificial Sequence
  Description of Artificial Sequence: Synthetic polynucleotide
tagtttttgttagatttgaaagtaagttggaaatygatagttgttttagttgttttagattttaatttggtttgggttttttttttttttatttgaaaatagatttagggtaatgtttaagagaattttaatygayggaagtggtygggaaattttgttttyggtattgagggatgttatyggagatttttttgttttaggtttgtyggagtttattatattygttaatgttatattgtattttagaattagagtttggt

SEQ ID NO: 8357 - DNA, 187 bp, Artificial Sequence
  Description of Artificial Sequence: Synthetic polynucleotide
tttttyggggtttgttttgttygttttttaaattygttttatatttttttygattttygtttttgtaagygttatttgtagttttatyggttttygtaayggtggtggtggttggtggggggtttygaagtttgtttttggttagtyggatttyggtgggagatggaggtagaaatttyggtttttt

SEQ ID NO: 8358 - DNA, 249 bp, Artificial Sequence
  Description of Artificial Sequence: Synthetic polynucleotide
gtttttaatgagagttttagaatatttttygtttttgayggttagyggtagygtygtygtttttygtagagygttygttttttygtttttagagttttagttttttttygagygatttygtagtttttttttygtttttattygtygtyggttttgtagttyggttttttttttagtttaggygygygggttgtagtgggygatygttttttttygatttttygtygtgtttttgggtttttygaagtg

SEQ ID NO: 8359 - DNA, 196 bp, Artificial Sequence
  Description of Artificial Sequence: Synthetic polynucleotide
tyggtaatttttagtgttaggygttttgtagttttygygygtygygtttgggttygtatygttttygtagtgagggttygttygagyggtaagtttttttyggyggttaagtygatatttttttttygtttygtygtttatttygggtagtagtygyggaataatggagagygtagttagtagttttggagayggt

SEQ ID NO: 8360 - DNA, 176 bp, Artificial Sequence
  Description of Artificial Sequence: Synthetic polynucleotide
ttygtttttgagaattttggttygggagagygaygyggggttttyggggttgygtaggttgyggygttttgtttaygttggttygagggygyggttygtttygggtyggtttatatatttaygttttttgtygggaggyggttgggaygyggyggggttgttttaagtgtagtygt

SEQ ID NO: 8361 - DNA, 152 bp, Artificial Sequence
  Description of Artificial Sequence: Synthetic polynucleotide
gggttttttttaagtagttgtttyggtttyggatttttatttgatttttttaatygatttggtagggtaygtatatttgaygtttattttgtagtygagtatataaggttygtygaagttatygagtaggttttgtagttgtaggtagtttt

SEQ ID NO: 8362 - DNA, 232 bp, Artificial Sequence
  Description of Artificial Sequence: Synthetic polynucleotide
gtagttatttgaaggtttttatggttttyggygtttgygtttgaagttygtttttaggttttggggggtatttgtagaaaatttttagtagyggttygttaattagattttagggtgtayggggggtggygtyggtaattatggtaatttttaaaataaaataatataaaataaagtaattaaygtttattaattattattttattttattttttgtattgtttttaggtag

SEQ ID NO: 8363 - DNA, 265 bp, Artificial Sequence
  Description of Artificial Sequence: Synthetic polynucleotide
atcgggagtttagagttttgttagcgtcgtattgtgcgtcgcgtaagtcgttcgatttttttagcggtatcggttttaagtagtaaatatttgtgcgtttttgagttagggacgcgcgtggggggtgggcgtgtacgcgggtgggttagcgtagagtgggagtttgtgggtgtttttcgtcgggatttttaatttagttgttttcgagagtttaagttgagcgtcgtacgtgttcgtgttatttgttgtattggacgtagtttaa

SEQ ID NO: 8364 - DNA, 235 bp, Artificial Sequence
  Description of Artificial Sequence: Synthetic polynucleotide
gtgtttttttataggttttatttgtaattgagacgaatgattatagtggggcgggaaggagtagttgtttattaattaatttttaattaaaagtgtttttcgttttcgggtgattaaagagaaatatcgttcgttgggcgatattgattcggatggaatttatttgttaacgttcggaggaatggttttttcgtttatcgcgcggtcgggattgttttggtttttttcggtttga

SEQ ID NO: 8365 - DNA, 270 bp, Artificial Sequence
  Description of Artificial Sequence: Synthetic polynucleotide
tttaattgtagtggtaaggtttggggattgagaggttcggtgagtgttagtttcgtaggttgcgtcggtgttcggtttttattttagttcgggggttttaggtttttcgcgggttttggggcgttggtgttcgcgtagttttagtcgttttcgtagttatcgtcgttcggtttcgcggaggcggcgcgtagcgggggcgttcgggcgttgtttttttgaggtttcgggggtttagggtggttcgtagtgttattggttagggtttgcgat

SEQ ID NO: 8366 - DNA, 270 bp, Artificial Sequence
  Description of Artificial Sequence: Synthetic polynucleotide
aattttttagatttggaggtttttaaggttttcgtaatttagtgagtttcggggtattaataaattttcgcgggggttatcgcgttcgcgaacgtagagtttatacgtggattttcgcgtttgtgatgtttcgattcgtttcgggttttcgtatagataatgtcgcgcgtttttttcgtagttatttcgggattcgcgtttcgcgtcgttcggacgtttttttgcgtttgtcggggatatttatcgatattaggaattttagcgtgttta

SEQ ID NO: 8367 - DNA, 149 bp, Artificial Sequence
  Description of Artificial Sequence: Synthetic polynucleotide
ttcggggtattatggtttggggttggattatgttttttttattttagtcggcgttttttatttacgcgcgttgagggtgcggtgagttgagtgcggggttaagtatgttttggcgtcgatttcgtttaggggtttaggatttggcgttt

SEQ ID NO: 8368 - DNA, 232 bp, Artificial Sequence
  Description of Artificial Sequence: Synthetic polynucleotide
ttatgtttttgttgttggggttgtgtttggggttgtttttgtgtgtggggtcgtaggaagaggcgtagagttggggttatttttcggagtaggtaagtggagtcgaggggagtcgggtttcgggcgcggtcgttttttttttttcgtcggttcggtcgcggagtttttgttcgggtttttttcgatcgttttttaggtttttattagaggtttaggggtttttttttgtggg

SEQ ID NO: 8369 - DNA, 189 bp, Artificial Sequence
  Description of Artificial Sequence: Synthetic polynucleotide
gtagtagtagtagtaatatggttgttgatgggtgtttggggtggcgttggcggcgggaggagttttttcgagtttttgcgtcggttgttcgttgttagttatggtaaatggtggcggcggcggcggcggtagtagcggcggcggcggcggcggcggaggtagtagttttagaatgagtagtaatattta

SEQ ID NO: 8370 - DNA, 260 bp, Artificial Sequence
  Description of Artificial Sequence: Synthetic polynucleotide
tagtttttgttagatttgaaagtaagttggaaatcgatagttgttttagttgttttagattttaatttggtttgggttttttttttttttatttgaaaatagatttagggtaatgtttaagagaattttaatcgacggaagtggtcgggaaattttgttttcggtattgagggatgttatcggagatttttttgttttaggtttgtcggagtttattatattcgttaatgttatattgtattttagaattagagtttggt

SEQ ID NO: 8371 - DNA, 187 bp, Artificial Sequence
  Description of Artificial Sequence: Synthetic polynucleotide
tttttcggggtttgttttgttcgttttttaaattcgttttatatttttttcgattttcgtttttgtaagcgttatttgtagttttatcggttttcgtaacggtggtggtggttggtggggggtttcgaagtttgtttttggttagtcggatttcggtgggagatggaggtagaaatttcggtttttt

SEQ ID NO: 8372 - DNA, 249 bp, Artificial Sequence
  Description of Artificial Sequence: Synthetic polynucleotide
gtttttaatgagagttttagaatatttttcgtttttgacggttagcggtagcgtcgtcgtttttcgtagagcgttcgttttttcgtttttagagttttagttttttttcgagcgatttcgtagtttttttttcgtttttattcgtcgtcggttttgtagttcggttttttttttagtttaggcgcgcgggttgtagtgggcgatcgttttttttcgatttttcgtcgtgtttttgggtttttcgaagtg

SEQ ID NO: 8373 - DNA, 196 bp, Artificial Sequence
  Description of Artificial Sequence: Synthetic polynucleotide
tcggtaatttttagtgttaggcgttttgtagttttcgcgcgtcgcgtttgggttcgtatcgttttcgtagtgagggttcgttcgagcggtaagtttttttcggcggttaagtcgatatttttttttcgtttcgtcgtttatttcgggtagtagtcgcggaataatggagagcgtagttagtagttttggagacggt

SEQ ID NO: 8374 - DNA, 176 bp, Artificial Sequence
  Description of Artificial Sequence: Synthetic polynucleotide
ttcgtttttgagaattttggttcgggagagcgacgcggggttttcggggttgcgtaggttgcggcgttttgtttacgttggttcgagggcgcggttcgtttcgggtcggtttatatatttacgttttttgtcgggaggcggttgggacgcggcggggttgttttaagtgtagtcgt

SEQ ID NO: 8375 - DNA, 152 bp, Artificial Sequence
  Description of Artificial Sequence: Synthetic polynucleotide
gggttttttttaagtagttgtttcggtttcggatttttatttgatttttttaatcgatttggtagggtacgtatatttgacgtttattttgtagtcgagtatataaggttcgtcgaagttatcgagtaggttttgtagttgtaggtagtttt

SEQ ID NO: 8376 - DNA, 232 bp, Artificial Sequence
  Description of Artificial Sequence: Synthetic polynucleotide
gtagttatttgaaggtttttatggttttcggcgtttgcgtttgaagttcgtttttaggttttggggggtatttgtagaaaatttttagtagcggttcgttaattagattttagggtgtacggggggtggcgtcggtaattatggtaatttttaaaataaaataatataaaataaagtaattaacgtttattaattattattttattttattttttgtattgtttttaggtag

SEQ ID NO: 8377 - DNA, 28 bp, Artificial Sequence
  Description of Artificial Sequence: Synthetic primer
ttagattgygtttagtatagtagatggt

SEQ ID NO: 8378 - DNA, 24 bp, Artificial Sequence
  Description of Artificial Sequence: Synthetic primer
ttaggtygggaggggttaggatag

SEQ ID NO: 8379 - DNA, 25 bp, Artificial Sequence
  Description of Artificial Sequence: Synthetic primer
gtygtagattttggttagtggtatt

SEQ ID NO: 8380 - DNA, 22 bp, Artificial Sequence
  Description of Artificial Sequence: Synthetic primer
tgggtaygttggagtttttggt

SEQ ID NO: 8381 - DNA, 22 bp, Artificial Sequence
  Description of Artificial Sequence: Synthetic primer
gggygttaggttttgggttttt

SEQ ID NO: 8382 - DNA, 29 bp, Artificial Sequence
  Description of Artificial Sequence: Synthetic primer
tttatagagagggatttttgggtttttgg

SEQ ID NO: 8383 - DNA, 32 bp, Artificial Sequence
  Description of Artificial Sequence: Synthetic primer
ggatattgttatttattttaagattgttgttt

SEQ ID NO: 8384 - DNA, 31 bp, Artificial Sequence
  Description of Artificial Sequence: Synthetic primer
gttaaattttagttttaaagtgtagtgtggt

SEQ ID NO: 8385 - DNA, 25 bp, Artificial Sequence
  Description of Artificial Sequence: Synthetic primer
aggaggtyggaatttttgtttttat

SEQ ID NO: 8386 - DNA, 22 bp, Artificial Sequence
  Description of Artificial Sequence: Synthetic primer
tatttygggaggtttaggggta

SEQ ID NO: 8387 - DNA, 22 bp, Artificial Sequence
  Description of Artificial Sequence: Synthetic primer
gtygtttttagggttgttggtt

SEQ ID NO: 8388 - DNA, 22 bp, Artificial Sequence
  Description of Artificial Sequence: Synthetic primer
gygattgtatttggggtagttt

SEQ ID NO: 8389 - DNA, 28 bp, Artificial Sequence
  Description of Artificial Sequence: Synthetic primer
aaagttatttgtagttgtaggatttgtt

SEQ ID NO: 8390 - DNA, 27 bp, Artificial Sequence
  Description of Artificial Sequence: Synthetic primer
ttatttgaggatagtatagggggtgag

SEQ ID NO: 8391 - DNA, 24 bp, Artificial Sequence
  Description of Artificial Sequence: Synthetic primer
accraaaacccaaaaccctaccaa

SEQ ID NO: 8392 - DNA, 33 bp, Artificial Sequence
  Description of Artificial Sequence: Synthetic primer
atatcctttcataaatctcatttataattaaaa

SEQ ID NO: 8393 - DNA, 33 bp, Artificial Sequence
  Description of Artificial Sequence: Synthetic primer
tccaactacaataacaaaatctaaaaattaaaa

SEQ ID NO: 8394 - DNA, 30 bp, Artificial Sequence
  Description of Artificial Sequence: Synthetic primer
aacttttcaaacctaaaaatctccaaaacc

SEQ ID NO: 8395 - DNA, 34 bp, Artificial Sequence
  Description of Artificial Sequence: Synthetic primer
cccraaacactataacctaaaactaaactatacc

SEQ ID NO: 8396 - DNA, 36 bp, Artificial Sequence
  Description of Artificial Sequence: Synthetic primer
ccatactcctactactaaaactatacctaaaactat

SEQ ID NO: 8397 - DNA, 36 bp, Artificial Sequence
  Description of Artificial Sequence: Synthetic primer
acaacaataacaacaatataactattaataaatatt

SEQ ID NO: 8398 - DNA, 31 bp, Artificial Sequence
  Description of Artificial Sequence: Synthetic primer
caatctctaccaaacttaaaaacaaactaaa

SEQ ID NO: 8399 - DNA, 22 bp, Artificial Sequence
  Description of Artificial Sequence: Synthetic primer
cttcccraaacttactctaccc

SEQ ID NO: 8400 - DNA, 25 bp, Artificial Sequence
  Description of Artificial Sequence: Synthetic primer
acccctaataaaaatcccaaaacac

SEQ ID NO: 8401 - DNA, 22 bp, Artificial Sequence
  Description of Artificial Sequence: Synthetic primer
ccracaacccccaatactaaac

SEQ ID NO: 8402 - DNA, 22 bp, Artificial Sequence
  Description of Artificial Sequence: Synthetic primer
cccrctcctaaaaaccctaact

SEQ ID NO: 8403 - DNA, 22 bp, Artificial Sequence
  Description of Artificial Sequence: Synthetic primer
aaatccccctcaaacaactatc

SEQ ID NO: 8404 - DNA, 28 bp, Artificial Sequence
  Description of Artificial Sequence: Synthetic primer
acaactatttaaaaactcccataatccc

SEQ ID NO: 8405 - DNA, 116 bp, Homo sapiens
agggacagccccaggcacagccccagcagcaggagcatggcggggcgagggcgcgggacgctcggggacccggcgggacacgctttgcagcgcccagggctccagccactgcggga

SEQ ID NO: 8406 - DNA, 272 bp, Homo sapiens
gggggaaaaacccaaaccagattagaatctgaaacagctgaaacagctatcgatttccagcttgctttcaagtctggcagagactgtgaaagtcctaacttctccgcgatgtcagccacggcccgcggcggtcacggagccacttcagcacctcgcgatggacagtgacccccggcgtggcgcgagttccctgcggtccccacgcgggcctgggcggcgggtccctccacggctccgtccagacacccggaggcacctgccaaagctgcgga

SEQ ID NO: 8407 - DNA, 209 bp, Homo sapiens
agtgttctgggactctcattaggggccgcgagcctcgagcgtcaaattcccgcggcgtccgcctagcgcgctgctgtggcgggcgcggagggcgcgcgccggcagtgggggctgcggcggcggagggcacgggcccccgctcagcgtcctcaccttcttggtgcagctgcctcccgcgagccgagacactcctgtcagggaagaggagc

SEQ ID NO: 8408 - DNA, 114 bp, Homo sapiens
ggcagcggcagagcagtggcagcagccgccactgccgctgttactgcggtcgccgccgctggagagaggaggacgaggagggcaaggggcagaagcaggtcctgctctgtctgc

SEQ ID NO: 8409 - DNA, 184 bp, Homo sapiens
gatgccggtcctcagggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgct

SEQ ID NO: 8410 - DNA, 116 bp, Artificial Sequence
  Description of Artificial Sequence: Synthetic polynucleotide
agggatagttttaggtatagttttagtagtaggagtatggyggggygagggygygggaygttyggggattyggygggataygttttgtagygtttagggttttagttattgyggga

SEQ ID NO: 8411 - DNA, 272 bp, Artificial Sequence
  Description of Artificial Sequence: Synthetic polynucleotide
gggggaaaaatttaaattagattagaatttgaaatagttgaaatagttatygatttttagtttgtttttaagtttggtagagattgtgaaagttttaattttttygygatgttagttayggttygyggyggttayggagttattttagtatttygygatggatagtgattttyggygtggygygagttttttgyggtttttaygygggtttgggyggygggtttttttayggtttygtttagatattyggaggtatttgttaaagttgygga

SEQ ID NO: 8412 - DNA, 209 bp, Artificial Sequence
  Description of Artificial Sequence: Synthetic polynucleotide
agtgttttgggatttttattaggggtygygagtttygagygttaaattttygyggygttygtttagygygttgttgtggygggygyggagggygygygtyggtagtgggggttgyggyggyggagggtaygggttttygtttagygtttttatttttttggtgtagttgtttttygygagtygagatatttttgttagggaagaggagt

SEQ ID NO: 8413 - DNA, 114 bp, Artificial Sequence
  Description of Artificial Sequence: Synthetic polynucleotide
ggtagyggtagagtagtggtagtagtygttattgtygttgttattgyggtygtygtygttggagagaggaggaygaggagggtaaggggtagaagtaggttttgttttgtttgt

SEQ ID NO: 8414 - DNA, 184 bp, Artificial Sequence
  Description of Artificial Sequence: Synthetic polynucleotide
gatgtyggtttttagggagttttaaggyggygggtattagygggttgattttgaagygttgttyggagtyggagygttattgtttggygyggttgatggttgaygygttgygyggttgygtgtttgttttttayggygtggtggagygygayggygaaagttatttgtagttgtaggatttgtt

SEQ ID NO: 8415 - DNA, 116 bp, Artificial Sequence
  Description of Artificial Sequence: Synthetic polynucleotide
agggatagttttaggtatagttttagtagtaggagtatggcggggcgagggcgcgggacgttcggggattcggcgggatacgttttgtagcgtttagggttttagttattgcggga

SEQ ID NO: 8416 - DNA, 272 bp, Artificial Sequence
  Description of Artificial Sequence: Synthetic polynucleotide
gggggaaaaatttaaattagattagaatttgaaatagttgaaatagttatcgatttttagtttgtttttaagtttggtagagattgtgaaagttttaattttttcgcgatgttagttacggttcgcggcggttacggagttattttagtatttcgcgatggatagtgattttcggcgtggcgcgagttttttgcggtttttacgcgggtttgggcggcgggtttttttacggtttcgtttagatattcggaggtatttgttaaagttgcgga

SEQ ID NO: 8417 - DNA, 209 bp, Artificial Sequence
  Description of Artificial Sequence: Synthetic polynucleotide
agtgttttgggatttttattaggggtcgcgagtttcgagcgttaaattttcgcggcgttcgtttagcgcgttgttgtggcgggcgcggagggcgcgcgtcggtagtgggggttgcggcggcggagggtacgggttttcgtttagcgtttttatttttttggtgtagttgtttttcgcgagtcgagatatttttgttagggaagaggagt

SEQ ID NO: 8418 - DNA, 114 bp, Artificial Sequence
  Description of Artificial Sequence: Synthetic polynucleotide
ggtagcggtagagtagtggtagtagtcgttattgtcgttgttattgcggtcgtcgtcgttggagagaggaggacgaggagggtaaggggtagaagtaggttttgttttgtttgt

SEQ ID NO: 8419 - DNA, 184 bp, Artificial Sequence
  Description of Artificial Sequence: Synthetic polynucleotide
gatgtcggtttttagggagttttaaggcggcgggtattagcgggttgattttgaagcgttgttcggagtcggagcgttattgtttggcgcggttgatggttgacgcgttgcgcggttgcgtgtttgttttttacggcgtggtggagcgcgacggcgaaagttatttgtagttgtaggatttgtt

SEQ ID NO: 8420 - DNA, 116 bp, Homo sapiens
tcccgcagtggctggagccctgggcgctgcaaagcgtgtcccgccgggtccccgagcgtcccgcgccctcgccccgccatgctcctgctgctggggctgtgcctggggctgtccct

SEQ ID NO: 8421 - DNA, 272 bp, Homo sapiens
tccgcagctttggcaggtgcctccgggtgtctggacggagccgtggagggacccgccgcccaggcccgcgtggggaccgcagggaactcgcgccacgccgggggtcactgtccatcgcgaggtgctgaagtggctccgtgaccgccgcgggccgtggctgacatcgcggagaagttaggactttcacagtctctgccagacttgaaagcaagctggaaatcgatagctgtttcagctgtttcagattctaatctggtttgggtttttccccc

SEQ ID NO: 8422 - DNA, 209 bp, Homo sapiens
gctcctcttccctgacaggagtgtctcggctcgcgggaggcagctgcaccaagaaggtgaggacgctgagcgggggcccgtgccctccgccgccgcagcccccactgccggcgcgcgccctccgcgcccgccacagcagcgcgctaggcggacgccgcgggaatttgacgctcgaggctcgcggcccctaatgagagtcccagaacact

SEQ ID NO: 8423 - DNA, 114 bp, Homo sapiens
gcagacagagcaggacctgcttctgccccttgccctcctcgtcctcctctctccagcggcggcgaccgcagtaacagcggcagtggcggctgctgccactgctctgccgctgcc

SEQ ID NO: 8424 - DNA, 184 bp, Homo sapiens
agcaggtcctgcagctgcaggtagctttcgccgtcgcgctccaccacgccgtggaaggcaggcacgcagccgcgcagcgcgtcagccatcagccgcgccaggcagtagcgctccggctccgagcagcgcttcaggatcagcccgctggtgcccgccgccttaaaactccctgaggaccggcatc

SEQ ID NO: 8425 - DNA, 116 bp, Artificial Sequence
  Description of Artificial Sequence: Synthetic polynucleotide
tttygtagtggttggagttttgggygttgtaaagygtgtttygtygggttttygagygtttygygttttygtttygttatgtttttgttgttggggttgtgtttggggttgttttt

SEQ ID NO: 8426 - DNA, 272 bp, Artificial Sequence
  Description of Artificial Sequence: Synthetic polynucleotide
ttygtagttttggtaggtgttttygggtgtttggayggagtygtggagggattygtygtttaggttygygtggggatygtagggaattygygttaygtygggggttattgtttatygygaggtgttgaagtggtttygtgatygtygygggtygtggttgatatygyggagaagttaggatttttatagtttttgttagatttgaaagtaagttggaaatygatagttgttttagttgttttagattttaatttggtttgggtttttttttt

SEQ ID NO: 8427 - DNA, 209 bp, Artificial Sequence
  Description of Artificial Sequence: Synthetic polynucleotide
gttttttttttttgataggagtgtttyggttygygggaggtagttgtattaagaaggtgaggaygttgagygggggttygtgtttttygtygtygtagtttttattgtyggygygygtttttygygttygttatagtagygygttaggyggaygtygygggaatttgaygttygaggttygyggtttttaatgagagttttagaatatt

SEQ ID NO: 8428 - DNA, 114 bp, Artificial Sequence
  Description of Artificial Sequence: Synthetic polynucleotide
gtagatagagtaggatttgtttttgttttttgtttttttygtttttttttttttagyggyggygatygtagtaatagyggtagtggyggttgttgttattgttttgtygttgtt

SEQ ID NO: 8429 - DNA, 184 bp, Artificial Sequence
  Description of Artificial Sequence: Synthetic polynucleotide
agtaggttttgtagttgtaggtagttttygtygtygygttttattaygtygtggaaggtaggtaygtagtygygtagygygttagttattagtygygttaggtagtagygtttyggtttygagtagygttttaggattagttygttggtgttygtygttttaaaattttttgaggatyggtatt

SEQ ID NO: 8430 - DNA, 116 bp, Artificial Sequence
  Description of Artificial Sequence: Synthetic polynucleotide
tttcgtagtggttggagttttgggcgttgtaaagcgtgtttcgtcgggttttcgagcgtttcgcgttttcgtttcgttatgtttttgttgttggggttgtgtttggggttgttttt

SEQ ID NO: 8431 - DNA, 272 bp, Artificial Sequence
  Description of Artificial Sequence: Synthetic polynucleotide
ttcgtagttttggtaggtgttttcgggtgtttggacggagtcgtggagggattcgtcgtttaggttcgcgtggggatcgtagggaattcgcgttacgtcgggggttattgtttatcgcgaggtgttgaagtggtttcgtgatcgtcgcgggtcgtggttgatatcgcggagaagttaggatttttatagtttttgttagatttgaaagtaagttggaaatcgatagttgttttagttgttttagattttaatttggtttgggtttttttttt

SEQ ID NO: 8432 - DNA, 209 bp, Artificial Sequence
  Description of Artificial Sequence: Synthetic polynucleotide
gttttttttttttgataggagtgtttcggttcgcgggaggtagttgtattaagaaggtgaggacgttgagcgggggttcgtgtttttcgtcgtcgtagtttttattgtcggcgcgcgtttttcgcgttcgttatagtagcgcgttaggcggacgtcgcgggaatttgacgttcgaggttcgcggtttttaatgagagttttagaatatt

SEQ ID NO: 8433 - DNA, 114 bp, Artificial Sequence
  Description of Artificial Sequence: Synthetic polynucleotide
gtagatagagtaggatttgtttttgttttttgtttttttcgtttttttttttttagcggcggcgatcgtagtaatagcggtagtggcggttgttgttattgttttgtcgttgtt

SEQ ID NO: 8434 - DNA, 184 bp, Artificial Sequence
  Description of Artificial Sequence: Synthetic polynucleotide
agtaggttttgtagttgtaggtagttttcgtcgtcgcgttttattacgtcgtggaaggtaggtacgtagtcgcgtagcgcgttagttattagtcgcgttaggtagtagcgtttcggtttcgagtagcgttttaggattagttcgttggtgttcgtcgttttaaaattttttgaggatcggtatt

SEQ ID NO: 8435 - DNA, 30 bp, Artificial Sequence
  Description of Artificial Sequence: Synthetic primer
agggatagttttaggtatagttttagtagt

SEQ ID NO: 8436 - DNA, 31 bp, Artificial Sequence
  Description of Artificial Sequence: Synthetic primer
gggggaaaaatttaaattagattagaatttg

SEQ ID NO: 8437 - DNA, 25 bp, Artificial Sequence
  Description of Artificial Sequence: Synthetic primer
agtgttttgggatttttattagggg

SEQ ID NO: 8438 - DNA, 25 bp, Artificial Sequence
  Description of Artificial Sequence: Synthetic primer
ggtagyggtagagtagtggtagtag

SEQ ID NO: 8439 - DNA, 22 bp, Artificial Sequence
  Description of Artificial Sequence: Synthetic primer
gatgtyggtttttagggagttt

SEQ ID NO: 8440 - DNA, 23 bp, Artificial Sequence
  Description of Artificial Sequence: Synthetic primer
tcccrcaataactaaaaccctaa

SEQ ID NO: 8441 - DNA, 23 bp, Artificial Sequence
  Description of Artificial Sequence: Synthetic primer
tccrcaactttaacaaatacctc

SEQ ID NO: 8442 - DNA, 25 bp, Artificial Sequence
  Description of Artificial Sequence: Synthetic primer
actcctcttccctaacaaaaatatc

SEQ ID NO: 8443 - DNA, 27 bp, Artificial Sequence
  Description of Artificial Sequence: Synthetic primer
acaaaacaaaacctacttctacccctt

SEQ ID NO: 8444 - DNA, 28 bp, Artificial Sequence
  Description of Artificial Sequence: Synthetic primer
aacaaatcctacaactacaaataacttt

SEQ ID NO: 8445 - DNA, 22 bp, Artificial Sequence
  Description of Artificial Sequence: Synthetic primer
ctcrtcctcctaccrcaaaata

SEQ ID NO: 8446 - DNA, 19 bp, Artificial Sequence
  Description of Artificial Sequence: Synthetic primer
gttgtttaggttgtaggtg

SEQ ID NO: 8447 - DNA, 20 bp, Homo sapiens
cgtggtgcgcgcggcgggcg

SEQ ID NO: 8448 - DNA, 116 bp, Homo sapiens
cgagcgccgtgggcggggctccagggcggcggcgcctcgcggggagggtcctccgtgctgggggcgaggccacccgaggcagctccccgcccgcccccaaccccgccccgctctcg

SEQ ID NO: 8449 - DNA, 2 bp, Homo sapiens
cg

SEQ ID NO: 8450 - DNA, 2 bp, Homo sapiens
cg

SEQ ID NO: 8451 - DNA, 2 bp, Homo sapiens
cg

SEQ ID NO: 8452 - DNA, 2 bp, Homo sapiens
cg

SEQ ID NO: 8453 - DNA, 2 bp, Homo sapiens
cg

SEQ ID NO: 8454 - DNA, 2 bp, Homo sapiens
cg

SEQ ID NO: 8455 - DNA, 2 bp, Homo sapiens
cg

SEQ ID NO: 8456 - DNA, 2 bp, Homo sapiens
cg

SEQ ID NO: 8457 - DNA, 2 bp, Homo sapiens
cg

SEQ ID NO: 8458 - DNA, 2 bp, Homo sapiens
cg

SEQ ID NO: 8459 - DNA, 44 bp, Homo sapiens
cgcgcgccccccgggccccgctcgcacccctcacgcgccccccg

SEQ ID NO: 8460 - DNA, 2 bp, Homo sapiens
cg

SEQ ID NO: 8461 - DNA, 2 bp, Homo sapiens
cg

SEQ ID NO: 8462 - DNA, 2 bp, Homo sapiens
cg

SEQ ID NO: 8463 - DNA, 2 bp, Homo sapiens
cg

SEQ ID NO: 8464 - DNA, 2 bp, Homo sapiens
cg

SEQ ID NO: 8465 - DNA, 2 bp, Homo sapiens
cg

SEQ ID NO: 8466 - DNA, 2 bp, Homo sapiens
cg

SEQ ID NO: 8467 - DNA, 2 bp, Homo sapiens
cg

SEQ ID NO: 8468 - DNA, 2 bp, Homo sapiens
cg

SEQ ID NO: 8469 - DNA, 2 bp, Homo sapiens
cg

SEQ ID NO: 8470 - DNA, 34 bp, Homo sapiens
cgtctgctcggcggctctagaaggtcgggctgcg

SEQ ID NO: 8471 - DNA, 2 bp, Homo sapiens
cg

SEQ ID NO: 8472 - DNA, 2 bp, Homo sapiens
cg

SEQ ID NO: 8473 - DNA, 2 bp, Homo sapiens
cg

SEQ ID NO: 8474 - DNA, 2 bp, Homo sapiens
cg

SEQ ID NO: 8475 - DNA, 2 bp, Homo sapiens
cg

SEQ ID NO: 8476 - DNA, 2 bp, Homo sapiens
cg

SEQ ID NO: 8477 - DNA, 2 bp, Homo sapiens
cg

SEQ ID NO: 8478 - DNA, 2 bp, Homo sapiens
cg

SEQ ID NO: 8479 - DNA, 2 bp, Homo sapiens
cg

SEQ ID NO: 8480 - DNA, 2 bp, Homo sapiens
cg

SEQ ID NO: 8481 - DNA, 211 bp, Homo sapiens
cgatccccggcgcagacacagaggccgcccccagccccgccgcctcgtggtcccgcccccgctgcacgctcccttacccctcggacctcgcagggccgcggcggacacggcccgatcggggacgtgaacgcgcagaactacatttcccagcgtcccgctcgcgctggaactacacttcccggggggctcggcggtgcacccgccggggtcg

SEQ ID NO: 8482 - DNA, 2 bp, Homo sapiens
cg

SEQ ID NO: 8483 - DNA, 2 bp, Homo sapiens
cg

SEQ ID NO: 8484 - DNA, 2 bp, Homo sapiens
cg

SEQ ID NO: 8485 - DNA, 2 bp, Homo sapiens
cg

SEQ ID NO: 8486 - DNA, 2 bp, Homo sapiens
cg

SEQ ID NO: 8487 - DNA, 2 bp, Homo sapiens
cg

SEQ ID NO: 8488 - DNA, 2 bp, Homo sapiens
cg

SEQ ID NO: 8489 - DNA, 2 bp, Homo sapiens
cg

SEQ ID NO: 8490 - DNA, 2 bp, Homo sapiens
cg

SEQ ID NO: 8491 - DNA, 2 bp, Homo sapiens
cg

SEQ ID NO: 8492 - DNA, 95 bp, Homo sapiens
cgggaaaaggggcgcggaagaggggcggggcgggccacggcgcgcagggcccttccctcccgcctcggactcaattaattgggcttgagcttccg

SEQ ID NO: 8493 - DNA, 2 bp, Homo sapiens
cg

SEQ ID NO: 8494 - DNA, 2 bp, Homo sapiens
cg

SEQ ID NO: 8495 - DNA, 2 bp, Homo sapiens
cg

SEQ ID NO: 8496 - DNA, 2 bp, Homo sapiens
cg

SEQ ID NO: 8497 - DNA, 2 bp, Homo sapiens
cg

SEQ ID NO: 8498 - DNA, 2 bp, Homo sapiens
cg

SEQ ID NO: 8499 - DNA, 2 bp, Homo sapiens
cg

SEQ ID NO: 8500 - DNA, 2 bp, Homo sapiens
cg

SEQ ID NO: 8501 - DNA, 2 bp, Homo sapiens
cg

SEQ ID NO: 8502 - DNA, 2 bp, Homo sapiens
cg

SEQ ID NO: 8503 - DNA, 264 bp, Homo sapiens
cgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccg

SEQ ID NO: 8504 - DNA, 2 bp, Homo sapiens
cg

SEQ ID NO: 8505 - DNA, 2 bp, Homo sapiens
cg

SEQ ID NO: 8506 - DNA, 2 bp, Homo sapiens
cg

SEQ ID NO: 8507 - DNA, 2 bp, Homo sapiens
cg

SEQ ID NO: 8508 - DNA, 2 bp, Homo sapiens
cg

SEQ ID NO: 8509 - DNA, 2 bp, Homo sapiens
cg

SEQ ID NO: 8510 - DNA, 2 bp, Homo sapiens
cg

SEQ ID NO: 8511 - DNA, 2 bp, Homo sapiens
cg

SEQ ID NO: 8512 - DNA, 2 bp, Homo sapiens
cg

SEQ ID NO: 8513 - DNA, 2 bp, Homo sapiens
cg

SEQ ID NO: 8514 - DNA, 59 bp, Homo sapiens
cgttccccgtcccggagctgccggcggcatgatccgacacgccggggcgcccgcgcgcg

SEQ ID NO: 8515 - DNA, 2 bp, Homo sapiens
cg

SEQ ID NO: 8516 - DNA, 2 bp, Homo sapiens
cg

SEQ ID NO: 8517 - DNA, 2 bp, Homo sapiens
cg

SEQ ID NO: 8518 - DNA, 2 bp, Homo sapiens
cg

SEQ ID NO: 8519 - DNA, 2 bp, Homo sapiens
cg

SEQ ID NO: 8520 - DNA, 2 bp, Homo sapiens
cg

SEQ ID NO: 8521 - DNA, 2 bp, Homo sapiens
cg

SEQ ID NO: 8522 - DNA, 2 bp, Homo sapiens
cg

SEQ ID NO: 8523 - DNA, 2 bp, Homo sapiens
cg

SEQ ID NO: 8524 - DNA, 2 bp, Homo sapiens
cg

SEQ ID NO: 8525 - DNA, 4 bp, Homo sapiens
cgcg

SEQ ID NO: 8526 - DNA, 2 bp, Homo sapiens
cg

SEQ ID NO: 8527 - DNA, 2 bp, Homo sapiens
cg

SEQ ID NO: 8528 - DNA, 2 bp, Homo sapiens
cg

SEQ ID NO: 8529 - DNA, 2 bp, Homo sapiens
cg

SEQ ID NO: 8530 - DNA, 2 bp, Homo sapiens
cg

SEQ ID NO: 8531 - DNA, 2 bp, Homo sapiens
cg

SEQ ID NO: 8532 - DNA, 2 bp, Homo sapiens
cg

SEQ ID NO: 8533 - DNA, 2 bp, Homo sapiens
cg

SEQ ID NO: 8534 - DNA, 2 bp, Homo sapiens
cg

SEQ ID NO: 8535 - DNA, 2 bp, Homo sapiens
cg

SEQ ID NO: 8536 - DNA, 324 bp, Homo sapiens
cggcgaaggccccgtgtcccacgagatccctcttgctgtactcgaagtcacccaccacctccatggccgcgcccccggggcacacagcggacgggcgggcggcgcagtgcggcgcaggtatcagcaccgcggctccgcgggcccggagcgcgccagcgtgcggcgggtctggggcagccgcagccccgggcccgggcggactctcatgccgagagaccggagcggaaactggggaagctgccgcgcggagccagggtcagcgaggcccggcccggcccctgccgctcatggcccggcctgccgccggccgctggctgtctggcg

SEQ ID NO: 8537 - DNA, 2 bp, Homo sapiens
cg

SEQ ID NO: 8538 - DNA, 2 bp, Homo sapiens
cg

SEQ ID NO: 8539 - DNA, 2 bp, Homo sapiens
cg

SEQ ID NO: 8540 - DNA, 2 bp, Homo sapiens
cg

SEQ ID NO: 8541 - DNA, 2 bp, Homo sapiens
cg

SEQ ID NO: 8542 - DNA, 2 bp, Homo sapiens
cg

SEQ ID NO: 8543 - DNA, 2 bp, Homo sapiens
cg

SEQ ID NO: 8544 - DNA, 102 bp, Homo sapiens
cgttgagtccgcgctgaacaagattctctcgcagctctgcgtcccgcgccgggtgaaggggcgtgttcctgcaggcgctcggggctcggcctggagctggcg

SEQ ID NO: 8545 - DNA, 24 bp, Homo sapiens
cgcaacgactcgctgccgcccacg

SEQ ID NO: 8546 - DNA, 521 bp, Homo sapiens
cgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcg

SEQ ID NO: 8547 - DNA, 1484 bp, Homo sapiens
cgcaagggcgccggggagcgggaggggcgctgggggcggcaaggggtcccagatcccaggccacgaactgttttccttttccccgggcaagagccccgctcccttcaactgacagaaattcactggggcaggggggcgagtggggagagaggtcgctcagggctcgctactggctgcgcctcccccggctctggtctgggaagcggctctgggccctccgggcgagcagcttgggcgccggcgccccctgcgaggaagatcgcggggtgacggtcggtacccgttcggctgggccgcgctgccgctccgatccacctcccttccgcgcccgcgccctcccccttcctttcactaggagtccgggattcggagagggcgcgggaggcaggcacacgggcccgaccccactccagcgctcaccggggacgcgggcgggcggcgacgggacgcggcgggggcgcggggcgggcgcggccatggagcagcagcggcggcggcggcggcggcggcggcaacactagcgaccgcgggcggacgagcgggcgggcagggccgccgggctcagcggaccgaactgcacagctcagcaaaagcgccctcgccctccgcgcgccgcctcctgcgagcccaaacccaccaacattttttaacgctccaacccatcctttgaagaaaagcaaaaaaaaaaaaaaaaaaaaaaaaaaaagcaaaaaaagaaaaagcattgatcggagagacggggatatatatatatatatatatatatatatatatataaaattttttttggctcctgctaaaattagcagggctcgccgcgcgcctgtgtgccagtgtgtgcgagtgtgtgtgcgtgcgggcgtgtgtgtgtgaatgtgattactccaggactcctcgggctccggagacgccattttcccccttgatatctctctccataaatcggtggcgcggcggaggcggcagagtcgggcgggaagcgcggggccggccggggcgcccgccgctcgccgccgcctccgcgcgcccgggggccccggcgccccccgagctagggcggccagctcgcggctcgccgtttgacagatgctcatcgccatggagttgccgcagcagcacctttgggggctcgggcgagcgacgggagccgggatctgagcgagcgccggggccagcggagccggagccgccgggacatgggtgagcacgcgcggcgaccttggcccgggagcccgggcgcccagcctccctccgcgccgcgggcccccgcactcccggaaccgggggcgacgtgtgtgccctgcatgcaaaagttcacgtcgccttgctgggtctttgactttgcacccggcgggaagggggagaccgggccgagggggcgggatgccggtccgggcgaggttgcaggagatgggcgcgattccggcgggccggcgggtgggcggcgatgctggctcaattggagtggctcgttggtggcggcg

SEQ ID NO: 8548 - DNA, 34 bp, Homo sapiens
cgcgtcgcccgctcccgctccccccgcctccccg

SEQ ID NO: 8549 - DNA, 14 bp, Homo sapiens
cggcgaggggctcg

SEQ ID NO: 8550 - DNA, 37 bp, Homo sapiens
cgtggcgcgcccactccacggtgctgaagagcagccg

SEQ ID NO: 8551 - DNA, 34 bp, Homo sapiens
cgggatttgtccgcttctttgtctttggctgccg

SEQ ID NO: 8552 - DNA, 538 bp, Homo sapiens
cgcggggccacctcaccgcgagctcctcccgcagcccggcccgggtcacctcgactcgccaggcttaactcaataaccacaacaccggaaaaggaagcaaaggtcgaagttcatccgcggccctgaggcctgtgggaaacgtagtccaacaacgaaagagccctgaagctcaagcggagcccgctggccgcaggggccgcaccacgccccagaccctggagtttccgggtgcgcagacccttgccatcagcagaggctgccgctgcgcgtcccctaggcgcggaagaggcggctggtggtccctgacggcaaggtgaagtcgaggcagtaatcgggaacccaggttgggaggacagaatggggaacaggaagctggggcgagggtggtcttgggggaggtggggggccgcggaattctaggtggcccctgcctcacctctggaaagaaccggaagcccgggccggggagggtgaagggagtcgcggacccggctgctcagccgaggaggaaacccggaccccaggctgagggaggccg

SEQ ID NO: 8553 - DNA, 109 bp, Homo sapiens
cggcgtccggagcgctggactacatttcccagaggcaccgctcccggagcgtagcttcatttccgttagtttgcgagatttggaggcctcgcgtggggagagggccgcg

SEQ ID NO: 8554 - DNA, 901 bp, Homo sapiens
cgcgcggggctccggggccggccctccctcgccgggcgcctcgggctcgccgcccgggttctccgcggacagcggccggtcgcgcaggcccacggcgcgcaccaggccgcccgccagctcttccagctcctccggccgcagcgccccgagccgcgcggcgccgcggaacgcgcccagggcttcggggaggcggccggcgcgggccagcgcgtcccccagcctcaggcacaggccgcggtccggctgcgccagcccggctagcatggagcgaaagagctcggctgccatctcgtagtcgcccgcgcggaaggcctcgtcgccctcctctaagcgctgggcgatcggctccgcgcggtcgcagccaggacactggggcggcggcggcggcgggaccggctcggggctcatcaccgcggggctgcgacgacgcgggtccggagcgaaggcgcggagcagggaggatgcgctgctgctgggaactggccggcgggagcgcggtctcagccctcgccagcagccacgcgcgtctgggggcggcgcgctgcgagcggctgagaccgcgggcgggggcgggcgcctggcttgggcagcgtcctcagcgcggtgtgggcggcgagccccgcagggctgcaatcgttccggggtgggggccgggacaggcaccgcgggcgcaatctgagcccctgcccacgcgcagcggcctctcagtcccgccggcttaggtaacccaggtcgctgcggtaacgcagtgaccgcgctccaggtccgcgtctcttgcgatgcttcccccactcgcctgagggctcctgcgcgactgcgcgcgcgtcctctgcctgccgcctccccgcagaggtgccggggccctgggagcaggtggccttggccgcgggctgctggcgcg

SEQ ID NO: 8555 - DNA, 15 bp, Homo sapiens
cgggcggcgcgggcg

SEQ ID NO: 8556 - DNA, 383 bp, Homo sapiens
cgggacatccccgaaggcggcgcgctggaggcggggagcggccggggcgcacggagagggcggggagcccgcgggagggggaggagggggaggagggggaggaggcgcgaggtgggggggagcgcggcgggcggcagggagggagcgggagggaggcaagaaagtagcagaaagtgaggctggcaggcggcggcaaaggagccggcgcgcggcggcggcaggaagtctgtgcccgagaacagcagaaataagagccagggagggaccgcggccgcggcggcggcggcgagagcgaaagaggaaactgcagaggaggaagctgcgccgcagcccgagccgcccggcatccccgccgcctctgcgcccgcgccgcgcccccggcg

SEQ ID NO: 8557 - DNA, 4 bp, Homo sapiens
cgcg

SEQ ID NO: 8558 - DNA, 624 bp, Homo sapiens
cgcggaggtgggcgagcgggcgtgcgcgcactcacttgccggcgcgagggagtgtcgggggggaagggagtggtctccaaaagggggaggggagaaggcagggggcggggagaagccggccctttaggacccggctgcggcggcgagggaggaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcg

SEQ ID NO: 8559 - DNA, 94 bp, Homo sapiens
cgagatagccagcgagttcaggcggtccttgcagcgctgggagaggaatgtgcgcgaaatcaaccagagcgaaatcagccggaggagccggccg

SEQ ID NO: 8560 - DNA, 63 bp, Homo sapiens
cgtgcagggcgcagagctgggccgagccgtcgccggcgccacgcgagtcccgcagccgccgcg

SEQ ID NO: 8561 - DNA, 41 bp, Homo sapiens
cgccgcggcttctggggtccccgccctcttgtccgccatcg

SEQ ID NO: 8562 - DNA, 1041 bp, Homo sapiens
cgcgcagggaccgggccgggtagagtcgggcggggtggagaggcaagcggagcgcgcggtggggctgaggggaggcgtggggcgagtgcccgttgctcgctctctagctctcttgctcttacgctctctcgctcgcagccgctcgcagctcggcggtgcagctgtgctggatccggcggcgccgcagccttttatcgcctcctgatgtcactggggtgcgggggcccgggcggcccggtgcgcgggccaatagctgcacggcctccgcggcccagcggcgcagggcggggcgcgcctgacagctcccccgccccccgcgtcagctgactggcggcccgagcggccccggagcggcggaggcctggcggagcgctggagcggagtgggacggccagcctgggcccacccccgtaccctgcaggtcccggcccacgcacgctcgcctggagtgcgcgccccacctctaggccaaatcaccgctttcccctcctcgcgcactctcctccctcagttccctttgcaccccacccccatcccgtgtcacccccaaggaggctcagaatgagcgccgggacaacgcctcctgggccctttgttcccaagcggcccccgcccagtgggcgacgctctgtgtgtcctcgcggcttctggccgtgtgtgtcgtgcgttcctgtttctggagatctgcgcgtatttgtatgttggggagggcgggctcgaggctccgagagttgtgttcagacccaactcttaacctcaggggacctttctcaggccaagcgagggcccctcctggcgggtgcagtcgcagagccctgaggttcgactccactggccccgccgctccccgcgttcaccccaccgcacaatgttcacagtgaaggcgacgggaaaagcagcagcccaaaggctctgaattcctcttccccgccacacgcacggaatcctgagcccccggagcctcggggccgaggccggcccgggacggtgctccgagtagctctccactgctggggagccggccctgtttttgtttgaacg

SEQ ID NO: 8563 - DNA, 23 bp, Homo sapiens
cgccttcggctcgggccatggcg

SEQ ID NO: 8564 - DNA, 515 bp, Homo sapiens
cgcagcagaataccctgacccaaaataaaaatactatgacaaaaatactccaggaggcagccggctttacttcgtttaaagccggatttcgcttagtcccgtgaaagcgaaggagcaccagcgcttcctgattccgcacagttctctcggcagagacggcccgtcctctccaagaaccggaagccggacagcgtcaggacgttttattcttctcacctgggattcagagaggcagcggccaaggacagggcccccgccgaggccaccgggcagcgtccaggtctcggcctttgggaggggagcagcgggggaggggcacggggaggggcgagggcggggcgcgcctgggcctcggcgctgggctcctcctctgcccgctccgggggacacccacaggattcttgcagacctctgccgaggcaggatggaggcctgcagggatgcaccgcgggcccgcgacccgggcggccggaacatagttctttctggccggagatcggcccggtcgtgagtcg

SEQ ID NO: 8565 - DNA, 1017 bp, Homo sapiens
cgggccaggtctgcggaggacgcccccgggcgcgcacacacagcccgaggacgcgccctgtattttaagacgcagggtcggatttcaccccgaaacttggctcccacagccccaggccgaactgtgtctggttctcagcccccgagcccgagttctacgccgcaaagagatggggccccattgtgcctagctggcctcctagcacggacgtgtattttcttttggtctgtcttttgctaaaaaccggcagtgcgcttcgcctccctgcccagccgcagcctgccgtcccctagacaaaaagcggcgaccgcggcccggccacccgagccccgccgcgctgcgcctttgttgggcggtccacagatggtgcccagcacggggccgcgccgagggcgggggcgggaggccgcgaagagggtcgggcgggaggggaggagacggcggagcagccaatccgcgcgcggcccatcagctgaccgcctttgcttacaccaggtgcacgccggctgcggggagcacaaagcggggcgcaccgcgggcgccggcaacgagccggtgaacgaggcgaggcccgtgcgcccgcggctgcaagcgcccgcctggcggggagaggggccgacggcgtcagcccgggcggcggcatccctaggcgcctggggcgccttcctccggacctggccgctcgctgccccgccctctgcaccccacttctccgaccctccttcccagtcctgcctccccctgccctggcctctgagagccgactgagcccagccccgtgcagcagcggttgcctgtgtcgccgcctagtctccggtcttggtgctctcccgggggtgccccaaggagccagtgcgcgctgcgggctgggaaggaggcgccgctcagctagtcctcctcctcctcctcgtctttctcctcctcctgctgctgctgccgccgccgccgccgtgggtgccgggtccgcgcgcaccccaacacccccaccagctgggcctcggggtaagtccctggccg

SEQ ID NO: 8566 - DNA, 8 bp, Homo sapiens
cgcgctcg

SEQ ID NO: 8567 - DNA, 54 bp, Homo sapiens
cgagcgcaggcgggcggagagcagaccacgcggaagaggccgagagagaaagcg

SEQ ID NO: 8568 - DNA, 10 bp, Homo sapiens
cgcgttgtcg

SEQ ID NO: 8569 - DNA, 26 bp, Homo sapiens
cgggcaggttcgaccaggcggccgcg

SEQ ID NO: 8570 - DNA, 934 bp, Homo sapiens
cgaatcccggcggccgccgcgctttcccgcttcgcggagaccgacgcaggcgcccgcccccgaggccgaagggcactgggcggcgagggctgcggtagctggcgactccgggggcgtctgcgcggcgcgcgctagacgaggctgccccggcggccaccccgcgaccccgcgtcgccgggatttgcgcgcggagaacgccggttctggagggagcacgcctccccaaagtgcagaggagggtccggcggcgcgtctccgcggaaaccctctccactgtagttaccccggatgccgacttagtagtttgttttccgagaaaagagaggggatctgggcagaagggccccgtttgccccaaaagaaggtgcaaggatcagaagataacgaaacgtccacttcctgaagggtgggaaaaaaagaaaaagaaaaaggagccacccacgctggagatgtccgttttagatcttcttattttcttccctttcgcttcggtttttcttctcgaggctcatttaatctgctagagaaggaggaggagcagaagatgggggccgaggaggaggggaagagaaagagaagtttgccaagaataaagtttttgccggcaagcgcggggactccgcagtggagggcactgcggagtctcggggagtcacagcgggggcctcgggcccaaatgcctctgcccggagctcgagccgacacacacactcagtccgacccctctttgttcccggctcgagtttctcagcctggctcgccggctcgccgctctgcacgcctccgccggccagctctgtcaaagcaaagagctgcgccccttgagttcgcccggccgaggggaggggacgccccgagcttggccgcgtgcgaggctccgggcgcgtcctggttcctcggcccgagagcgcgcagcccgggtccctcctccgcg

SEQ ID NO: 8571 - DNA, 279 bp, Homo sapiens
cgcggggtaaggaatccgcgggcagttacctccgccaggggcagggtccggccagtcaggcgcgagaaggctaggcgaggccgactgcgcggggtgaagacgccaggccgacagctgcgggccctaccgccagccctgacgcgagcctgcgtcctggcgacggcggagggcgggcagggggcgcgggcgctgccacggcgcctgctcagaaccggccgggaacgccgcgggcgggtctccccggtcctccgcccctccagccctgctctcaggcctccg

SEQ ID NO: 8572 - DNA, 2 bp, Homo sapiens
cg

SEQ ID NO: 8573 - DNA, 9 bp, Homo sapiens
cgccccgcg

SEQ ID NO: 8574 - DNA, 11 bp, Homo sapiens
cgagcgcatcg

SEQ ID NO: 8575 - DNA, 30 bp, Homo sapiens
cgcttgtaatctcagctactcaggaggccg

SEQ ID NO: 8576 - DNA, 10 bp, Homo sapiens
cgctcccgcg

SEQ ID NO: 8577 - DNA, 56 bp, Homo sapiens
cggcgtctgatgagcggcgggcccggacacgaggggacggggccgatttgtgggcg

SEQ ID NO: 8578 - DNA, 98 bp, Homo sapiens
cggccagcagggcggggcaggaggctgggagagggacgggtgcgggggtgggggagaggaagggagcggtcacgtgtgaggggcggcccgaggtcacg

SEQ ID NO: 8579 - DNA, 33 bp, Homo sapiens
cgggaggacgcgcaggggcggccgccgccgtcg

SEQ ID NO: 8580 - DNA, 48 bp, Homo sapiens
cgtcccaccccctccaccacacacgcaccccccaccccaattccttcg

SEQ ID NO: 8581 - DNA, 93 bp, Homo sapiens
cgacctgccccggccgcacccgcctccgctccagcacgcgacgctgcccggcgcgacccctgctcccccggcccagccccaccgctgccctcg

SEQ ID NO: 8582 - DNA, 2 bp, Homo sapiens
cg

SEQ ID NO: 8583 - DNA, 2 bp, Homo sapiens
cg

SEQ ID NO: 8584 - DNA, 2 bp, Homo sapiens
cg

SEQ ID NO: 8585 - DNA, 2 bp, Homo sapiens
cg

SEQ ID NO: 8586 - DNA, 2 bp, Homo sapiens
cg

SEQ ID NO: 8587 - DNA, 2 bp, Homo sapiens
cg

SEQ ID NO: 8588 - DNA, 2 bp, Homo sapiens
cg

SEQ ID NO: 8589 - DNA, 42 bp, Homo sapiens
cggagcgaggcgcgcgcccggccagagagcgagcgcgcaacg

SEQ ID NO: 8590 - DNA, 2 bp, Homo sapiens
cg

SEQ ID NO: 8591 - DNA, 2 bp, Homo sapiens
cg

SEQ ID NO: 8592 - DNA, 2 bp, Homo sapiens
cg

SEQ ID NO: 8593 - DNA, 2 bp, Homo sapiens
cg

SEQ ID NO: 8594 - DNA, 2 bp, Homo sapiens
cg

SEQ ID NO: 8595 - DNA, 2 bp, Homo sapiens
cg

SEQ ID NO: 8596 - DNA, 2 bp, Homo sapiens
cg

SEQ ID NO: 8597 - DNA, 2 bp, Homo sapiens
cg

SEQ ID NO: 8598 - DNA, 2 bp, Homo sapiens
cg

SEQ ID NO: 8599 - DNA, 2 bp, Homo sapiens
cg

SEQ ID NO: 8600 - DNA, 40 bp, Homo sapiens
cggcgcactggcgctgggagcagggccgcactccggcgcg

SEQ ID NO: 8601 - DNA, 2 bp, Homo sapiens
cg

SEQ ID NO: 8602 - DNA, 2 bp, Homo sapiens
cg

SEQ ID NO: 8603 - DNA, 2 bp, Homo sapiens
cg

SEQ ID NO: 8604 - DNA, 2 bp, Homo sapiens
cg

SEQ ID NO: 8605 - DNA, 2 bp, Homo sapiens
cg

SEQ ID NO: 8606 - DNA, 2 bp, Homo sapiens
cg

SEQ ID NO: 8607 - DNA, 2 bp, Homo sapiens
cg

SEQ ID NO: 8608 - DNA, 2 bp, Homo sapiens
cg

SEQ ID NO: 8609 - DNA, 2 bp, Homo sapiens
cg

SEQ ID NO: 8610 - DNA, 2 bp, Homo sapiens
cg

SEQ ID NO: 8611 - DNA, 2 bp, Homo sapiens
cg

SEQ ID NO: 8612 - DNA, 2 bp, Homo sapiens
cg

SEQ ID NO: 8613 - DNA, 2 bp, Homo sapiens
cg

SEQ ID NO: 8614 - DNA, 2 bp, Homo sapiens
cg

SEQ ID NO: 8615 - DNA, 2 bp, Homo sapiens
cg

SEQ ID NO: 8616 - DNA, 2 bp, Homo sapiens
cg

SEQ ID NO: 8617 - DNA, 2 bp, Homo sapiens
cg

SEQ ID NO: 8618 - DNA, 2 bp, Homo sapiens
cg

SEQ ID NO: 8619 - DNA, 2 bp, Homo sapiens
cg

SEQ ID NO: 8620 - DNA, 2 bp, Homo sapiens
cg

SEQ ID NO: 8621 - DNA, 2 bp, Homo sapiens
cg

SEQ ID NO: 8622 - DNA, 42 bp, Homo sapiens
cgggcgggcggcgttcggtctgagggagcggggcggtctccg

SEQ ID NO: 8623 - DNA, 2 bp, Homo sapiens
cg

SEQ ID NO: 8624 - DNA, 2 bp, Homo sapiens
cg

SEQ ID NO: 8625 - DNA, 2 bp, Homo sapiens
cg

SEQ ID NO: 8626 - DNA, 2 bp, Homo sapiens
cg

SEQ ID NO: 8627 - DNA, 2 bp, Homo sapiens
cg

SEQ ID NO: 8628 - DNA, 2 bp, Homo sapiens
cg

SEQ ID NO: 8629 - DNA, 2 bp, Homo sapiens
cg

SEQ ID NO: 8630 - DNA, 2 bp, Homo sapiens
cg

SEQ ID NO: 8631 - DNA, 2 bp, Homo sapiens
cg

SEQ ID NO: 8632 - DNA, 2 bp, Homo sapiens
cg

SEQ ID NO: 8633 - DNA, 20 bp, Homo sapiens
cgcccgccgcgcgcaccacg

SEQ ID NO: 8634 - DNA, 116 bp, Homo sapiens
cgagagcggggcggggttgggggcgggcggggagctgcctcgggtggcctcgcccccagcacggaggaccctccccgcgaggcgccgccgccctggagccccgcccacggcgctcg

SEQ ID NO: 8635 - DNA, 2 bp, Homo sapiens
cg

SEQ ID NO: 8636 - DNA, 2 bp, Homo sapiens
cg

SEQ ID NO: 8637 - DNA, 2 bp, Homo sapiens
cg

SEQ ID NO: 8638 - DNA, 2 bp, Homo sapiens
cg

SEQ ID NO: 8639 - DNA, 2 bp, Homo sapiens
cg

SEQ ID NO: 8640 - DNA, 2 bp, Homo sapiens
cg

SEQ ID NO: 8641 - DNA, 2 bp, Homo sapiens
cg

SEQ ID NO: 8642 - DNA, 2 bp, Homo sapiens
cg

SEQ ID NO: 8643 - DNA, 2 bp, Homo sapiens
cg

SEQ ID NO: 8644 - DNA, 2 bp, Homo sapiens
cg

SEQ ID NO: 8645 - DNA, 44 bp, Homo sapiens
cggggggcgcgtgaggggtgcgagcggggcccggggggcgcgcg

SEQ ID NO: 8646 - DNA, 2 bp, Homo sapiens
cg

SEQ ID NO: 8647 - DNA, 2 bp, Homo sapiens
cg

SEQ ID NO: 8648 - DNA, 2 bp, Homo sapiens
cg

SEQ ID NO: 8649 - DNA, 2 bp, Homo sapiens
cg

SEQ ID NO: 8650 - DNA, 2 bp, Homo sapiens
cg

SEQ ID NO: 8651 - DNA, 2 bp, Homo sapiens
cg

SEQ ID NO: 8652 - DNA, 2 bp, Homo sapiens
cg

SEQ ID NO: 8653 - DNA, 2 bp, Homo sapiens
cg

SEQ ID NO: 8654 - DNA, 2 bp, Homo sapiens
cg

SEQ ID NO: 8655 - DNA, 2 bp, Homo sapiens
cg

SEQ ID NO: 8656 - DNA, 34 bp, Homo sapiens
cgcagcccgaccttctagagccgccgagcagacg

SEQ ID NO: 8657 - DNA, 2 bp, Homo sapiens
cg

SEQ ID NO: 8658 - DNA, 2 bp, Homo sapiens
cg

SEQ ID NO: 8659 - DNA, 2 bp, Homo sapiens
cg

SEQ ID NO: 8660 - DNA, 2 bp, Homo sapiens
cg

SEQ ID NO: 8661 - DNA, 2 bp, Homo sapiens
cg

SEQ ID NO: 8662 - DNA, 2 bp, Homo sapiens
cg

SEQ ID NO: 8663 - DNA, 2 bp, Homo sapiens
cg

SEQ ID NO: 8664 - DNA, 2 bp, Homo sapiens
cg

SEQ ID NO: 8665 - DNA, 2 bp, Homo sapiens
cg

SEQ ID NO: 8666 - DNA, 2 bp, Homo sapiens
cg

SEQ ID NO: 8667 - DNA, 211 bp, Homo sapiens
cgaccccggcgggtgcaccgccgagccccccgggaagtgtagttccagcgcgagcgggacgctgggaaatgtagttctgcgcgttcacgtccccgatcgggccgtgtccgccgcggccctgcgaggtccgaggggtaagggagcgtgcagcgggggcgggaccacgaggcggcggggctgggggcggcctctgtgtctgcgccggggatcg

SEQ ID NO: 8668 - DNA, 2 bp, Homo sapiens
cg

SEQ ID NO: 8669 - DNA, 2 bp, Homo sapiens
cg

SEQ ID NO: 8670 - DNA, 2 bp, Homo sapiens
cg

SEQ ID NO: 8671 - DNA, 2 bp, Homo sapiens
cg

SEQ ID NO: 8672 - DNA, 2 bp, Homo sapiens
cg

SEQ ID NO: 8673 - DNA, 2 bp, Homo sapiens
cg

SEQ ID NO: 8674 - DNA, 2 bp, Homo sapiens
cg

SEQ ID NO: 8675 - DNA, 2 bp, Homo sapiens
cg

SEQ ID NO: 8676 - DNA, 2 bp, Homo sapiens
cg

SEQ ID NO: 8677 - DNA, 2 bp, Homo sapiens
cg

SEQ ID NO: 8678 - DNA, 95 bp, Homo sapiens
cggaagctcaagcccaattaattgagtccgaggcgggagggaagggccctgcgcgccgtggcccgccccgcccctcttccgcgccccttttcccg

SEQ ID NO: 8679 - DNA, 2 bp, Homo sapiens
cg

SEQ ID NO: 8680 - DNA, 2 bp, Homo sapiens
cg

SEQ ID NO: 8681 - DNA, 2 bp, Homo sapiens
cg

SEQ ID NO: 8682 - DNA, 2 bp, Homo sapiens
cg

SEQ ID NO: 8683 - DNA, 2 bp, Homo sapiens
cg

SEQ ID NO: 8684 - DNA, 2 bp, Homo sapiens
cg

SEQ ID NO: 8685 - DNA, 2 bp, Homo sapiens
cg

SEQ ID NO: 8686 - DNA, 2 bp, Homo sapiens
cg

SEQ ID NO: 8687 - DNA, 2 bp, Homo sapiens
cg

SEQ ID NO: 8688 - DNA, 2 bp, Homo sapiens
cg

SEQ ID NO: 8689 - DNA, 264 bp, Homo sapiens
cggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccg

SEQ ID NO: 8690 - DNA, 2 bp, Homo sapiens
cg

SEQ ID NO: 8691 - DNA, 2 bp, Homo sapiens
cg

SEQ ID NO: 8692 - DNA, 2 bp, Homo sapiens
cg

SEQ ID NO: 8693 - DNA, 2 bp, Homo sapiens
cg

SEQ ID NO: 8694 - DNA, 2 bp, Homo sapiens
cg

SEQ ID NO: 8695 - DNA, 2 bp, Homo sapiens
cg

SEQ ID NO: 8696 - DNA, 2 bp, Homo sapiens
cg

SEQ ID NO: 8697 - DNA, 2 bp, Homo sapiens
cg

SEQ ID NO: 8698 - DNA, 2 bp, Homo sapiens
cg

SEQ ID NO: 8699 - DNA, 2 bp, Homo sapiens
cg

SEQ ID NO: 8700 - DNA, 59 bp, Homo sapiens
cgcgcgcgggcgccccggcgtgtcggatcatgccgccggcagctccgggacggggaacg

SEQ ID NO: 8701 - DNA, 2 bp, Homo sapiens
cg

SEQ ID NO: 8702 - DNA, 2 bp, Homo sapiens
cg

SEQ ID NO: 8703 - DNA, 2 bp, Homo sapiens
cg

SEQ ID NO: 8704 - DNA, 2 bp, Homo sapiens
cg

SEQ ID NO: 8705 - DNA, 2 bp, Homo sapiens
cg

SEQ ID NO: 8706 - DNA, 2 bp, Homo sapiens
cg

SEQ ID NO: 8707 - DNA, 2 bp, Homo sapiens
cg

SEQ ID NO: 8708 - DNA, 2 bp, Homo sapiens
cg

SEQ ID NO: 8709 - DNA, 2 bp, Homo sapiens
cg

SEQ ID NO: 8710 - DNA, 2 bp, Homo sapiens
cg

SEQ ID NO: 8711 - DNA, 4 bp, Homo sapiens
cgcg

SEQ ID NO: 8712 - DNA, 2 bp, Homo sapiens
cg

SEQ ID NO: 8713 - DNA, 2 bp, Homo sapiens
cg

SEQ ID NO: 8714 - DNA, 2 bp, Homo sapiens
cg

SEQ ID NO: 8715 - DNA, 2 bp, Homo sapiens
cg

SEQ ID NO: 8716 - DNA, 2 bp, Homo sapiens
cg

SEQ ID NO: 8717 - DNA, 2 bp, Homo sapiens
cg

SEQ ID NO: 8718 - DNA, 2 bp, Homo sapiens
cg

SEQ ID NO: 8719 - DNA, 2 bp, Homo sapiens
cg

SEQ ID NO: 8720 - DNA, 2 bp, Homo sapiens
cg

SEQ ID NO: 8721 - DNA, 2 bp, Homo sapiens
cg

SEQ ID NO: 8722 - DNA, 324 bp, Homo sapiens
cgccagacagccagcggccggcggcaggccgggccatgagcggcaggggccgggccgggcctcgctgaccctggctccgcgcggcagcttccccagtttccgctccggtctctcggcatgagagtccgcccgggcccggggctgcggctgccccagacccgccgcacgctggcgcgctccgggcccgcggagccgcggtgctgatacctgcgccgcactgcgccgcccgcccgtccgctgtgtgccccgggggcgcggccatggaggtggtgggtgacttcgagtacagcaagagggatctcgtgggacacggggccttcgccg

SEQ ID NO: 8723 - DNA, 2 bp, Homo sapiens
cg

SEQ ID NO: 8724 - DNA, 2 bp, Homo sapiens
cg

SEQ ID NO: 8725 - DNA, 2 bp, Homo sapiens
cg

SEQ ID NO: 8726 - DNA, 2 bp, Homo sapiens
cg

SEQ ID NO: 8727 - DNA, 2 bp, Homo sapiens
cg

SEQ ID NO: 8728 - DNA, 2 bp, Homo sapiens
cg

SEQ ID NO: 8729 - DNA, 2 bp, Homo sapiens
cg

SEQ ID NO: 8730 - DNA, 102 bp, Homo sapiens
cgccagctccaggccgagccccgagcgcctgcaggaacacgccccttcacccggcgcgggacgcagagctgcgagagaatcttgttcagcgcggactcaacg

SEQ ID NO: 8731 - DNA, 24 bp, Homo sapiens
cgtgggcggcagcgagtcgttgcg

SEQ ID NO: 8732 - DNA, 521 bp, Homo sapiens
cgcaccggcctccctgtctcgcactggctgctccgcccgcctgtcaaggccaggcctggggggctggggcccgagtggccgctgggggacagtcctgggcacacgaccggagcgcccccctcctccccgcctggcccgcgcccaggggacggcgagagacgcggcctcagcccctccccccgggcgccccgctgcggccagatgtgggcggatgtggaggccgggccatggcgaggagggcgggcgcccagaggggaagagattcctccccttccccgggcgcagggtccttctgcaggaggctgtatttgggcagccaaacaaagttctctgtcaccgccgccgcgcgctctgcgcctgcaagggttaaacggcagcgcacgcggctggcaggcaggatcccggcctgtgggctcaagagccgaggggcgcagggcgaacatgcgagtcccatggcaccagcgagaggccaccaactcccacccaccgagggcacccctgcagctaacacccccaccacg

SEQ ID NO: 8733 - DNA, 1484 bp, Homo sapiens
cgccgccaccaacgagccactccaattgagccagcatcgccgcccacccgccggcccgccggaatcgcgcccatctcctgcaacctcgcccggaccggcatcccgccccctcggcccggtctcccccttcccgccgggtgcaaagtcaaagacccagcaaggcgacgtgaacttttgcatgcagggcacacacgtcgcccccggttccgggagtgcgggggcccgcggcgcggagggaggctgggcgcccgggctcccgggccaaggtcgccgcgcgtgctcacccatgtcccggcggctccggctccgctggccccggcgctcgctcagatcccggctcccgtcgctcgcccgagcccccaaaggtgctgctgcggcaactccatggcgatgagcatctgtcaaacggcgagccgcgagctggccgccctagctcggggggcgccggggcccccgggcgcgcggaggcggcggcgagcggcgggcgccccggccggccccgcgcttcccgcccgactctgccgcctccgccgcgccaccgatttatggagagagatatcaagggggaaaatggcgtctccggagcccgaggagtcctggagtaatcacattcacacacacacgcccgcacgcacacacactcgcacacactggcacacaggcgcgcggcgagccctgctaattttagcaggagccaaaaaaaattttatatatatatatatatatatatatatatatatatccccgtctctccgatcaatgctttttctttttttgcttttttttttttttttttttttttttttgcttttcttcaaaggatgggttggagcgttaaaaaatgttggtgggtttgggctcgcaggaggcggcgcgcggagggcgagggcgcttttgctgagctgtgcagttcggtccgctgagcccggcggccctgcccgcccgctcgtccgcccgcggtcgctagtgttgccgccgccgccgccgccgccgccgctgctgctccatggccgcgcccgccccgcgcccccgccgcgtcccgtcgccgcccgcccgcgtccccggtgagcgctggagtggggtcgggcccgtgtgcctgcctcccgcgccctctccgaatcccggactcctagtgaaaggaagggggagggcgcgggcgcggaagggaggtggatcggagcggcagcgcggcccagccgaacgggtaccgaccgtcaccccgcgatcttcctcgcagggggcgccggcgcccaagctgctcgcccggagggcccagagccgcttcccagaccagagccgggggaggcgcagccagtagcgagccctgagcgacctctctccccactcgcccccctgccccagtgaatttctgtcagttgaagggagcggggctcttgcccggggaaaaggaaaacagttcgtggcctgggatctgggaccccttgccgcccccagcgcccctcccgctccccggcgcccttgcg

SEQ ID NO: 8734 - DNA, 34 bp, Homo sapiens
cggggaggcggggggagcgggagcgggcgacgcg

SEQ ID NO: 8735 - DNA, 14 bp, Homo sapiens
cgagcccctcgccg

SEQ ID NO: 8736 - DNA, 37 bp, Homo sapiens
cggctgctcttcagcaccgtggagtgggcgcgccacg

SEQ ID NO: 8737 - DNA, 34 bp, Homo sapiens
cggcagccaaagacaaagaagcggacaaatcccg

SEQ ID NO: 8738 - DNA, 538 bp, Homo sapiens
cggcctccctcagcctggggtccgggtttcctcctcggctgagcagccgggtccgcgactcccttcaccctccccggcccgggcttccggttctttccagaggtgaggcaggggccacctagaattccgcggccccccacctcccccaagaccaccctcgccccagcttcctgttccccattctgtcctcccaacctgggttcccgattactgcctcgacttcaccttgccgtcagggaccaccagccgcctcttccgcgcctaggggacgcgcagcggcagcctctgctgatggcaagggtctgcgcacccggaaactccagggtctggggcgtggtgcggcccctgcggccagcgggctccgcttgagcttcagggctctttcgttgttggactacgtttcccacaggcctcagggccgcggatgaacttcgacctttgcttccttttccggtgttgtggttattgagttaagcctggcgagtcgaggtgacccgggccgggctgcgggaggagctcgcggtgaggtggccccgcg

SEQ ID NO: 8739 - DNA, 109 bp, Homo sapiens
cgcggccctctccccacgcgaggcctccaaatctcgcaaactaacggaaatgaagctacgctccgggagcggtgcctctgggaaatgtagtccagcgctccggacgccg

SEQ ID NO: 8740 - DNA, 901 bp, Homo sapiens
cgcgccagcagcccgcggccaaggccacctgctcccagggccccggcacctctgcggggaggcggcaggcagaggacgcgcgcgcagtcgcgcaggagccctcaggcgagtgggggaagcatcgcaagagacgcggacctggagcgcggtcactgcgttaccgcagcgacctgggttacctaagccggcgggactgagaggccgctgcgcgtgggcaggggctcagattgcgcccgcggtgcctgtcccggcccccaccccggaacgattgcagccctgcggggctcgccgcccacaccgcgctgaggacgctgcccaagccaggcgcccgcccccgcccgcggtctcagccgctcgcagcgcgccgcccccagacgcgcgtggctgctggcgagggctgagaccgcgctcccgccggccagttcccagcagcagcgcatcctccctgctccgcgccttcgctccggacccgcgtcgtcgcagccccgcggtgatgagccccgagccggtcccgccgccgccgccgccccagtgtcctggctgcgaccgcgcggagccgatcgcccagcgcttagaggagggcgacgaggccttccgcgcgggcgactacgagatggcagccgagctctttcgctccatgctagccgggctggcgcagccggaccgcggcctgtgcctgaggctgggggacgcgctggcccgcgccggccgcctccccgaagccctgggcgcgttccgcggcgccgcgcggctcggggcgctgcggccggaggagctggaagagctggcgggcggcctggtgcgcgccgtgggcctgcgcgaccggccgctgtccgcggagaacccgggcggcgagcccgaggcgcccggcgagggagggccggccccggagccccgcgcg

SEQ ID NO: 8741 - DNA, 15 bp, Homo sapiens
cgcccgcgccgcccg

SEQ ID NO: 8742 - DNA, 383 bp, Homo sapiens
cgccgggggcgcggcgcgggcgcagaggcggcggggatgccgggcggctcgggctgcggcgcagcttcctcctctgcagtttcctctttcgctctcgccgccgccgccgcggccgcggtccctccctggctcttatttctgctgttctcgggcacagacttcctgccgccgccgcgcgccggctcctttgccgccgcctgccagcctcactttctgctactttcttgcctccctcccgctccctccctgccgcccgccgcgctcccccccacctcgcgcctcctccccctcctccccctcctccccctcccgcgggctccccgccctctccgtgcgccccggccgctccccgcctccagcgcgccgccttcggggatgtcccg

SEQ ID NO: 8743 - DNA, 4 bp, Homo sapiens
cgcg

SEQ ID NO: 8744 - DNA, 624 bp, Homo sapiens
cgcctgcaggggcagctcggagcccgggtggggatagcagcgcagcccctggccgcagcgcggggtgtagacgccgcacgcctcgccctccagccgggcgcacaccgagcagcagccgcagcccggctcccggacgagctccgcgcatggcatgcgggcgcctccggccactgcggccaccgcggcgggcggcgcaaccggcgggggcccgcaggcggccaggcgctcgggtgtgcagggcgggcagcggaacagcacctccgcgcgcgccccgccgccgccgccactcgcgcccagtagcagcagcagcagcggcagcagcggcggcggcggcagcggcagcgcggggcagcccactctcggcagcatgctggcggtcggcagcgcggcgcggcgggcgagcgagcgagcgggcgggcgggcaggtggcacggccctgcgagcgcgggagccgcctcctccgcttcttcctcctccctcgccgccgcagccgggtcctaaagggccggcttctccccgccccctgccttctcccctcccccttttggagaccactcccttcccccccgacactccctcgcgccggcaagtgagtgcgcgcacgcccgctcgcccacctccgcg

SEQ ID NO: 8745 - DNA, 94 bp, Homo sapiens
cggccggctcctccggctgatttcgctctggttgatttcgcgcacattcctctcccagcgctgcaaggaccgcctgaactcgctggctatctcg

SEQ ID NO: 8746 - DNA, 63 bp, Homo sapiens
cgcggcggctgcgggactcgcgtggcgccggcgacggctcggcccagctctgcgccctgcacg

SEQ ID NO: 8747 - DNA, 41 bp, Homo sapiens
cgatggcggacaagagggcggggaccccagaagccgcggcg

SEQ ID NO: 8748 - DNA, 1041 bp, Homo sapiens
cgttcaaacaaaaacagggccggctccccagcagtggagagctactcggagcaccgtcccgggccggcctcggccccgaggctccgggggctcaggattccgtgcgtgtggcggggaagaggaattcagagcctttgggctgctgcttttcccgtcgccttcactgtgaacattgtgcggtggggtgaacgcggggagcggcggggccagtggagtcgaacctcagggctctgcgactgcacccgccaggaggggccctcgcttggcctgagaaaggtcccctgaggttaagagttgggtctgaacacaactctcggagcctcgagcccgccctccccaacatacaaatacgcgcagatctccagaaacaggaacgcacgacacacacggccagaagccgcgaggacacacagagcgtcgcccactgggcgggggccgcttgggaacaaagggcccaggaggcgttgtcccggcgctcattctgagcctccttgggggtgacacgggatgggggtggggtgcaaagggaactgagggaggagagtgcgcgaggaggggaaagcggtgatttggcctagaggtggggcgcgcactccaggcgagcgtgcgtgggccgggacctgcagggtacgggggtgggcccaggctggccgtcccactccgctccagcgctccgccaggcctccgccgctccggggccgctcgggccgccagtcagctgacgcggggggcgggggagctgtcaggcgcgccccgccctgcgccgctgggccgcggaggccgtgcagctattggcccgcgcaccgggccgcccgggcccccgcaccccagtgacatcaggaggcgataaaaggctgcggcgccgccggatccagcacagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcg

SEQ ID NO: 8749 - DNA, 23 bp, Homo sapiens
cgccatggcccgagccgaaggcg

SEQ ID NO: 8750 - DNA, 515 bp, Homo sapiens
cgactcacgaccgggccgatctccggccagaaagaactatgttccggccgcccgggtcgcgggcccgcggtgcatccctgcaggcctccatcctgcctcggcagaggtctgcaagaatcctgtgggtgtcccccggagcgggcagaggaggagcccagcgccgaggcccaggcgcgccccgccctcgcccctccccgtgcccctcccccgctgctcccctcccaaaggccgagacctggacgctgcccggtggcctcggcgggggccctgtccttggccgctgcctctctgaatcccaggtgagaagaataaaacgtcctgacgctgtccggcttccggttcttggagaggacgggccgtctctgccgagagaactgtgcggaatcaggaagcgctggtgctccttcgctttcacgggactaagcgaaatccggctttaaacgaagtaaagccggctgcctcctggagtatttttgtcatagtatttttattttgggtcagggtattctgctgcg

SEQ ID NO: 8751 - DNA, 1017 bp, Homo sapiens
cggccagggacttaccccgaggcccagctggtgggggtgttggggtgcgcgcggacccggcacccacggcggcggcggcggcagcagcagcaggaggaggagaaagacgaggaggaggaggaggactagctgagcggcgcctccttcccagcccgcagcgcgcactggctccttggggcacccccgggagagcaccaagaccggagactaggcggcgacacaggcaaccgctgctgcacggggctgggctcagtcggctctcagaggccagggcagggggaggcaggactgggaaggagggtcggagaagtggggtgcagagggcggggcagcgagcggccaggtccggaggaaggcgccccaggcgcctagggatgccgccgcccgggctgacgccgtcggcccctctccccgccaggcgggcgcttgcagccgcgggcgcacgggcctcgcctcgttcaccggctcgttgccggcgcccgcggtgcgccccgctttgtgctccccgcagccggcgtgcacctggtgtaagcaaaggcggtcagctgatgggccgcgcgcggattggctgctccgccgtctcctcccctcccgcccgaccctcttcgcggcctcccgcccccgccctcggcgcggccccgtgctgggcaccatctgtggaccgcccaacaaaggcgcagcgcggcggggctcgggtggccgggccgcggtcgccgctttttgtctaggggacggcaggctgcggctgggcagggaggcgaagcgcactgccggtttttagcaaaagacagaccaaaagaaaatacacgtccgtgctaggaggccagctaggcacaatggggccccatctctttgcggcgtagaactcgggctcgggggctgagaaccagacacagttcggcctggggctgtgggagccaagtttcggggtgaaatccgaccctgcgtcttaaaatacagggcgcgtcctcgggctgtgtgtgcgcgcccgggggcgtcctccgcagacctggcccg

SEQ ID NO: 8752 - DNA, 8 bp, Homo sapiens
cgagcgcg

SEQ ID NO: 8753 - DNA, 54 bp, Homo sapiens
cgctttctctctcggcctcttccgcgtggtctgctctccgcccgcctgcgctcg

SEQ ID NO: 8754 - DNA, 10 bp, Homo sapiens
cgacaacgcg

SEQ ID NO: 8755 - DNA, 26 bp, Homo sapiens
cgcggccgcctggtcgaacctgcccg

SEQ ID NO: 8756 - DNA, 934 bp, Homo sapiens
cgcggaggagggacccgggctgcgcgctctcgggccgaggaaccaggacgcgcccggagcctcgcacgcggccaagctcggggcgtcccctcccctcggccgggcgaactcaaggggcgcagctctttgctttgacagagctggccggcggaggcgtgcagagcggcgagccggcgagccaggctgagaaactcgagccgggaacaaagaggggtcggactgagtgtgtgtgtcggctcgagctccgggcagaggcatttgggcccgaggcccccgctgtgactccccgagactccgcagtgccctccactgcggagtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcg

SEQ ID NO: 8757 - DNA, 279 bp, Homo sapiens
cggaggcctgagagcagggctggaggggcggaggaccggggagacccgcccgcggcgttcccggccggttctgagcaggcgccgtggcagcgcccgcgccccctgcccgccctccgccgtcgccaggacgcaggctcgcgtcagggctggcggtagggcccgcagctgtcggcctggcgtcttcaccccgcgcagtcggcctcgcctagccttctcgcgcctgactggccggaccctgcccctggcggaggtaactgcccgcggattccttaccccgcg

SEQ ID NO: 8758 - DNA, 2 bp, Homo sapiens
cg

SEQ ID NO: 8759 - DNA, 9 bp, Homo sapiens
cgcggggcg

SEQ ID NO: 8760 - DNA, 11 bp, Homo sapiens
cgatgcgctcg

SEQ ID NO: 8761 - DNA, 30 bp, Homo sapiens
cggcctcctgagtagctgagattacaagcg

SEQ ID NO: 8762 - DNA, 10 bp, Homo sapiens
cgcgggagcg

SEQ ID NO: 8763 - DNA, 56 bp, Homo sapiens
cgcccacaaatcggccccgtcccctcgtgtccgggcccgccgctcatcagacgccg

SEQ ID NO: 8764 - DNA, 98 bp, Homo sapiens
cgtgacctcgggccgcccctcacacgtgaccgctcccttcctctcccccacccccgcacccgtccctctcccagcctcctgccccgccctgctggccg

SEQ ID NO: 8765 - DNA, 33 bp, Homo sapiens
cgacggcggcggccgcccctgcgcgtcctcccg

SEQ ID NO: 8766 - DNA, 48 bp, Homo sapiens
cgaaggaattggggtggggggtgcgtgtgtggtggagggggtgggacg

SEQ ID NO: 8767 - DNA, 93 bp, Homo sapiens
cgagggcagcggtggggctgggccgggggagcaggggtcgcgccgggcagcgtcgcgtgctggagcggaggcgggtgcggccggggcaggtcg

SEQ ID NO: 8768 - DNA, 2 bp, Homo sapiens
cg

SEQ ID NO: 8769 - DNA, 2 bp, Homo sapiens
cg

SEQ ID NO: 8770 - DNA, 2 bp, Homo sapiens
cg

SEQ ID NO: 8771 - DNA, 2 bp, Homo sapiens
cg

SEQ ID NO: 8772 - DNA, 2 bp, Homo sapiens
cg

SEQ ID NO: 8773 - DNA, 2 bp, Homo sapiens
cg

SEQ ID NO: 8774 - DNA, 2 bp, Homo sapiens
cg

SEQ ID NO: 8775 - DNA, 42 bp, Homo sapiens
cgttgcgcgctcgctctctggccgggcgcgcgcctcgctccg

SEQ ID NO: 8776 - DNA, 2 bp, Homo sapiens
cg

SEQ ID NO: 8777 - DNA, 2 bp, Homo sapiens
cg

SEQ ID NO: 8778 - DNA, 2 bp, Homo sapiens
cg

SEQ ID NO: 8779 - DNA, 2 bp, Homo sapiens
cg

SEQ ID NO: 8780 - DNA, 2 bp, Homo sapiens
cg

SEQ ID NO: 8781 - DNA, 2 bp, Homo sapiens
cg

SEQ ID NO: 8782 - DNA, 2 bp, Homo sapiens
cg

SEQ ID NO: 8783 - DNA, 2 bp, Homo sapiens
cg

SEQ ID NO: 8784 - DNA, 2 bp, Homo sapiens
cg

SEQ ID NO: 8785 - DNA, 2 bp, Homo sapiens
cg

SEQ ID NO: 8786 - DNA, 40 bp, Homo sapiens
cgcgccggagtgcggccctgctcccagcgccagtgcgccg

SEQ ID NO: 8787 - DNA, 2 bp, Homo sapiens
cg

SEQ ID NO: 8788 - DNA, 2 bp, Homo sapiens
cg

SEQ ID NO: 8789 - DNA, 2 bp, Homo sapiens
cg

SEQ ID NO: 8790 - DNA, 2 bp, Homo sapiens
cg

SEQ ID NO: 8791 - DNA, 2 bp, Homo sapiens
cg

SEQ ID NO: 8792 - DNA, 2 bp, Homo sapiens
cg

SEQ ID NO: 8793 - DNA, 2 bp, Homo sapiens
cg

SEQ ID NO: 8794 - DNA, 2 bp, Homo sapiens
cg

SEQ ID NO: 8795 - DNA, 2 bp, Homo sapiens
cg

SEQ ID NO: 8796 - DNA, 2 bp, Homo sapiens
cg

SEQ ID NO: 8797 - DNA, 2 bp, Homo sapiens
cg

SEQ ID NO: 8798 - DNA, 2 bp, Homo sapiens
cg

SEQ ID NO: 8799 - DNA, 2 bp, Homo sapiens
cg

SEQ ID NO: 8800 - DNA, 2 bp, Homo sapiens
cg

SEQ ID NO: 8801 - DNA, 2 bp, Homo sapiens
cg

SEQ ID NO: 8802 - DNA, 2 bp, Homo sapiens
cg

SEQ ID NO: 8803 - DNA, 2 bp, Homo sapiens
cg

SEQ ID NO: 8804 - DNA, 2 bp, Homo sapiens
cg

SEQ ID NO: 8805 - DNA, 2 bp, Homo sapiens
cg

SEQ ID NO: 8806 - DNA, 2 bp, Homo sapiens
cg

SEQ ID NO: 8807 - DNA, 2 bp, Homo sapiens
cg

SEQ ID NO: 8808 - DNA, 42 bp, Homo sapiens
cggagaccgccccgctccctcagaccgaacgccgcccgcccg

SEQ ID NO: 8809 - DNA, 2 bp, Homo sapiens
cg

SEQ ID NO: 8810 - DNA, 2 bp, Homo sapiens
cg

SEQ ID NO: 8811 - DNA, 2 bp, Homo sapiens
cg

SEQ ID NO: 8812 - DNA, 2 bp, Homo sapiens
cg

SEQ ID NO: 8813 - DNA, 2 bp, Homo sapiens
cg

SEQ ID NO: 8814 - DNA, 2 bp, Homo sapiens
cg

SEQ ID NO: 8815 - DNA, 2 bp, Homo sapiens
cg

SEQ ID NO: 8816 - DNA, 2 bp, Homo sapiens
cg

SEQ ID NO: 8817 - DNA, 2 bp, Homo sapiens
cg

SEQ ID NO: 8818 - DNA, 2 bp, Homo sapiens
cg

SEQ ID NO: 8819 - DNA, 20 bp, Artificial Sequence
  Description of Artificial Sequence: Synthetic oligonucleotide
ygtggtgygygyggygggyg

SEQ ID NO: 8820 - DNA, 116 bp, Artificial Sequence
  Description of Artificial Sequence: Synthetic polynucleotide
ygagygtygtgggyggggttttagggyggyggygtttygyggggagggtttttygtgttgggggygaggttattygaggtagtttttygttygtttttaatttygtttygttttyg

SEQ ID NO: 8821 - DNA, 2 bp, Artificial Sequence
  Description of Artificial Sequence: Synthetic oligonucleotide
yg

SEQ ID NO: 8822 - DNA, 2 bp, Artificial Sequence
  Description of Artificial Sequence: Synthetic oligonucleotide
yg

SEQ ID NO: 8823 - DNA, 2 bp, Artificial Sequence
  Description of Artificial Sequence: Synthetic oligonucleotide
yg

SEQ ID NO: 8824 - DNA, 2 bp, Artificial Sequence
  Description of Artificial Sequence: Synthetic oligonucleotide
yg

SEQ ID NO: 8825 - DNA, 2 bp, Artificial Sequence
  Description of Artificial Sequence: Synthetic oligonucleotide
yg

SEQ ID NO: 8826 - DNA, 2 bp, Artificial Sequence
  Description of Artificial Sequence: Synthetic oligonucleotide
yg

SEQ ID NO: 8827 - DNA, 2 bp, Artificial Sequence
  Description of Artificial Sequence: Synthetic oligonucleotide
yg

SEQ ID NO: 8828 - DNA, 2 bp, Artificial Sequence
  Description of Artificial Sequence: Synthetic oligonucleotide
yg

SEQ ID NO: 8829 - DNA, 2 bp, Artificial Sequence
  Description of Artificial Sequence: Synthetic oligonucleotide
yg

SEQ ID NO: 8830 - DNA, 2 bp, Artificial Sequence
  Description of Artificial Sequence: Synthetic oligonucleotide
yg

SEQ ID NO: 8831 - DNA, 44 bp, Artificial Sequence
  Description of Artificial Sequence: Synthetic oligonucleotide
ygygygtttttygggtttygttygtattttttaygygtttttyg

SEQ ID NO: 8832 - DNA, 2 bp, Artificial Sequence
  Description of Artificial Sequence: Synthetic oligonucleotide
yg

SEQ ID NO: 8833 - DNA, 2 bp, Artificial Sequence
  Description of Artificial Sequence: Synthetic oligonucleotide
yg

SEQ ID NO: 8834 - DNA, 2 bp, Artificial Sequence
  Description of Artificial Sequence: Synthetic oligonucleotide
yg

SEQ ID NO: 8835 - DNA, 2 bp, Artificial Sequence
  Description of Artificial Sequence: Synthetic oligonucleotide
yg

SEQ ID NO: 8836 - DNA, 2 bp, Artificial Sequence
  Description of Artificial Sequence: Synthetic oligonucleotide
yg

SEQ ID NO: 8837 - DNA, 2 bp, Artificial Sequence
  Description of Artificial Sequence: Synthetic oligonucleotide
yg

SEQ ID NO: 8838 - DNA, 2 bp, Artificial Sequence
  Description of Artificial Sequence: Synthetic oligonucleotide
yg

SEQ ID NO: 8839 - DNA, 2 bp, Artificial Sequence
  Description of Artificial Sequence: Synthetic oligonucleotide
yg

SEQ ID NO: 8840 - DNA, 2 bp, Artificial Sequence
  Description of Artificial Sequence: Synthetic oligonucleotide
tg

SEQ ID NO: 8841 - DNA, 2 bp, Artificial Sequence
  Description of Artificial Sequence: Synthetic oligonucleotide
yg

SEQ ID NO: 8842 - DNA, 34 bp, Artificial Sequence
  Description of Artificial Sequence: Synthetic oligonucleotide
ygtttgttyggyggttttagaaggtygggttgyg

SEQ ID NO: 8843 - DNA, 2 bp, Artificial Sequence
  Description of Artificial Sequence: Synthetic oligonucleotide
yg

SEQ ID NO: 8844 - DNA, 2 bp, Artificial Sequence
  Description of Artificial Sequence: Synthetic oligonucleotide
yg

SEQ ID NO: 8845 - DNA, 2 bp, Artificial Sequence
  Description of Artificial Sequence: Synthetic oligonucleotide
yg

SEQ ID NO: 8846 - DNA, 2 bp, Artificial Sequence
  Description of Artificial Sequence: Synthetic oligonucleotide
yg

SEQ ID NO: 8847 - DNA, 2 bp, Artificial Sequence
  Description of Artificial Sequence: Synthetic oligonucleotide
yg

SEQ ID NO: 8848 - DNA, 2 bp, Artificial Sequence
  Description of Artificial Sequence: Synthetic oligonucleotide
yg

SEQ ID NO: 8849 - DNA, 2 bp, Artificial Sequence
  Description of Artificial Sequence: Synthetic oligonucleotide
yg

SEQ ID NO: 8850 - DNA, 2 bp, Artificial Sequence
  Description of Artificial Sequence: Synthetic oligonucleotide
yg

SEQ ID NO: 8851 - DNA, 2 bp, Artificial Sequence
  Description of Artificial Sequence: Synthetic oligonucleotide
yg

SEQ ID NO: 8852 - DNA, 2 bp, Artificial Sequence
  Description of Artificial Sequence: Synthetic oligonucleotide
yg

SEQ ID NO: 8853 - DNA, 211 bp, Artificial Sequence
  Description of Artificial Sequence: Synthetic polynucleotide
ygattttyggygtagatatagaggtygtttttagtttygtygtttygtggtttygttttygttgtaygtttttttatttttyggatttygtagggtygyggyggatayggttygatyggggaygtgaaygygtagaattatattttttagygtttygttygygttggaattatatttttyggggggttyggyggtgtattygtyggggtyg

SEQ ID NO: 8854 - DNA, 2 bp, Artificial Sequence
  Description of Artificial Sequence: Synthetic oligonucleotide
yg

SEQ ID NO: 8855 - DNA, 2 bp, Artificial Sequence
  Description of Artificial Sequence: Synthetic oligonucleotide
yg

SEQ ID NO: 8856 - DNA, 2 bp, Artificial Sequence
  Description of Artificial Sequence: Synthetic oligonucleotide
yg

SEQ ID NO: 8857 - DNA, 2 bp, Artificial Sequence
  Description of Artificial Sequence: Synthetic oligonucleotide
yg

SEQ ID NO: 8858 - DNA, 2 bp, Artificial Sequence
  Description of Artificial Sequence: Synthetic oligonucleotide
yg

SEQ ID NO: 8859 - DNA, 2 bp, Artificial Sequence
  Description of Artificial Sequence: Synthetic oligonucleotide
yg

SEQ ID NO: 8860 - DNA, 2 bp, Artificial Sequence
  Description of Artificial Sequence: Synthetic oligonucleotide
yg

SEQ ID NO: 8861 - DNA, 2 bp, Artificial Sequence
  Description of Artificial Sequence: Synthetic oligonucleotide
yg

SEQ ID NO: 8862 - DNA, 2 bp, Artificial Sequence
  Description of Artificial Sequence: Synthetic oligonucleotide
yg

SEQ ID NO: 8863 - DNA, 2 bp, Artificial Sequence
  Description of Artificial Sequence: Synthetic oligonucleotide
yg

SEQ ID NO: 8864 - DNA, 95 bp, Artificial Sequence
  Description of Artificial Sequence: Synthetic oligonucleotide
ygggaaaaggggygyggaagaggggyggggygggttayggygygtagggtttttttttttygtttyggatttaattaattgggtttgagtttttg

SEQ ID NO: 8865 - DNA, 2 bp, Artificial Sequence
  Description of Artificial Sequence: Synthetic oligonucleotide
yg

SEQ ID NO: 8866 - DNA, 2 bp, Artificial Sequence
  Description of Artificial Sequence: Synthetic oligonucleotide
yg

SEQ ID NO: 8867 - DNA, 2 bp, Artificial Sequence
  Description of Artificial Sequence: Synthetic oligonucleotide
yg

SEQ ID NO: 8868 - DNA, 2 bp, Artificial Sequence
  Description of Artificial Sequence: Synthetic oligonucleotide
yg

SEQ ID NO: 8869 - DNA, 2 bp, Artificial Sequence
  Description of Artificial Sequence: Synthetic oligonucleotide
yg

SEQ ID NO: 8870 - DNA, 2 bp, Artificial Sequence
  Description of Artificial Sequence: Synthetic oligonucleotide
yg

SEQ ID NO: 8871 - DNA, 2 bp, Artificial Sequence
  Description of Artificial Sequence: Synthetic oligonucleotide
yg

SEQ ID NO: 8872 - DNA, 2 bp, Artificial Sequence
  Description of Artificial Sequence: Synthetic oligonucleotide
yg

SEQ ID NO: 8873 - DNA, 2 bp, Artificial Sequence
  Description of Artificial Sequence: Synthetic oligonucleotide
yg

SEQ ID NO: 8874 - DNA, 2 bp, Artificial Sequence
  Description of Artificial Sequence: Synthetic oligonucleotide
yg

SEQ ID NO: 8875 - DNA, 264 bp, Artificial Sequence
  Description of Artificial Sequence: Synthetic polynucleotide
ygggttgtaaggyggtgtattaygtgtgygygtttagtatgtaygttagygtgttgtttatyggtttgtttagtttgtagygttgtttygtagttattygtttttttttggygtttyggttgygtagttyggttttggttygtygtttgttgttggyggtttggttggtygttttgttgttygtygtttyggtygtygtttatygttatttgtggagggatygygtatgttagttgtgttattygtygtyggtttaygtygtyg

SEQ ID NO: 8876 - DNA, 2 bp, Artificial Sequence
  Description of Artificial Sequence: Synthetic oligonucleotide
yg

SEQ ID NO: 8877 - DNA, 2 bp, Artificial Sequence
  Description of Artificial Sequence: Synthetic oligonucleotide
yg

SEQ ID NO: 8878 - DNA, 2 bp, Artificial Sequence
  Description of Artificial Sequence: Synthetic oligonucleotide
yg

SEQ ID NO: 8879 - DNA, 2 bp, Artificial Sequence
  Description of Artificial Sequence: Synthetic oligonucleotide
yg

SEQ ID NO: 8880 - DNA, 2 bp, Artificial Sequence
  Description of Artificial Sequence: Synthetic oligonucleotide
yg

SEQ ID NO: 8881 - DNA, 2 bp, Artificial Sequence
  Description of Artificial Sequence: Synthetic oligonucleotide
yg

SEQ ID NO: 8882 - DNA, 2 bp, Artificial Sequence
  Description of Artificial Sequence: Synthetic oligonucleotide
yg

SEQ ID NO: 8883 - DNA, 2 bp, Artificial Sequence
  Description of Artificial Sequence: Synthetic oligonucleotide
yg

SEQ ID NO: 8884 - DNA, 2 bp, Artificial Sequence
  Description of Artificial Sequence: Synthetic oligonucleotide
yg

SEQ ID NO: 8885 - DNA, 2 bp, Artificial Sequence
  Description of Artificial Sequence: Synthetic oligonucleotide
yg

SEQ ID NO: 8886 - DNA, 59 bp, Artificial Sequence
  Description of Artificial Sequence: Synthetic oligonucleotide
ygtttttygtttyggagttgtyggyggtatgattygataygtyggggygttygygygyg

SEQ ID NO: 8887 - DNA, 2 bp, Artificial Sequence
  Description of Artificial Sequence: Synthetic oligonucleotide
yg

SEQ ID NO: 8888 - DNA, 2 bp, Artificial Sequence
  Description of Artificial Sequence: Synthetic oligonucleotide
yg

SEQ ID NO: 8889 - DNA, 2 bp, Artificial Sequence
  Description of Artificial Sequence: Synthetic oligonucleotide
yg

SEQ ID NO: 8890 - DNA, 2 bp, Artificial Sequence
  Description of Artificial Sequence: Synthetic oligonucleotide
yg

SEQ ID NO: 8891 - DNA, 2 bp, Artificial Sequence
  Description of Artificial Sequence: Synthetic oligonucleotide
yg

SEQ ID NO: 8892 - DNA, 2 bp, Artificial Sequence
  Description of Artificial Sequence: Synthetic oligonucleotide
yg

SEQ ID NO: 8893 - DNA, 2 bp, Artificial Sequence
  Description of Artificial Sequence: Synthetic oligonucleotide
yg

SEQ ID NO: 8894 - DNA, 2 bp, Artificial Sequence
  Description of Artificial Sequence: Synthetic oligonucleotide
yg

SEQ ID NO: 8895 - DNA, 2 bp, Artificial Sequence
  Description of Artificial Sequence: Synthetic oligonucleotide
yg

SEQ ID NO: 8896 - DNA, 2 bp, Artificial Sequence
  Description of Artificial Sequence: Synthetic oligonucleotide
yg

SEQ ID NO: 8897 - DNA, 4 bp, Artificial Sequence
  Description of Artificial Sequence: Synthetic oligonucleotide
ygyg

SEQ ID NO: 8898 - DNA, 2 bp, Artificial Sequence
  Description of Artificial Sequence: Synthetic oligonucleotide
yg

SEQ ID NO: 8899 - DNA, 2 bp, Artificial Sequence
  Description of Artificial Sequence: Synthetic oligonucleotide
yg

SEQ ID NO: 8900 - DNA, 2 bp, Artificial Sequence
  Description of Artificial Sequence: Synthetic oligonucleotide
yg

SEQ ID NO: 8901 - DNA, 2 bp, Artificial Sequence
  Description of Artificial Sequence: Synthetic oligonucleotide
yg

SEQ ID NO: 8902 - DNA, 2 bp, Artificial Sequence
  Description of Artificial Sequence: Synthetic oligonucleotide
yg

SEQ ID NO: 8903 - DNA, 2 bp, Artificial Sequence
  Description of Artificial Sequence: Synthetic oligonucleotide
yg

SEQ ID NO: 8904 - DNA, 2 bp, Artificial Sequence
  Description of Artificial Sequence: Synthetic oligonucleotide
yg

SEQ ID NO: 8905 - DNA, 2 bp, Artificial Sequence
  Description of Artificial Sequence: Synthetic oligonucleotide
yg

SEQ ID NO: 8906 - DNA, 2 bp, Artificial Sequence
  Description of Artificial Sequence: Synthetic oligonucleotide
yg

SEQ ID NO: 8907 - DNA, 2 bp, Artificial Sequence
  Description of Artificial Sequence: Synthetic oligonucleotide
yg

SEQ ID NO: 8908 - DNA, 324 bp, Artificial Sequence
  Description of Artificial Sequence: Synthetic polynucleotide
yggygaaggtttygtgttttaygagattttttttgttgtattygaagttatttattatttttatggtygygttttyggggtatatagyggaygggygggyggygtagtgyggygtaggtattagtatygyggtttygygggttyggagygygttagygtgyggygggtttggggtagtygtagtttygggttygggyggatttttatgtygagagatyggagyggaaattggggaagttgtygygyggagttagggttagygaggttyggttyggtttttgtygtttatggttyggtttgtygtyggtygttggttgtttggyg

SEQ ID NO: 8909 - DNA, 2 bp, Artificial Sequence
  Description of Artificial Sequence: Synthetic oligonucleotide
yg

SEQ ID NO: 8910 - DNA, 2 bp, Artificial Sequence
  Description of Artificial Sequence: Synthetic oligonucleotide
yg

SEQ ID NO: 8911 - DNA, 2 bp, Artificial Sequence
  Description of Artificial Sequence: Synthetic oligonucleotide
yg

SEQ ID NO: 8912 - DNA, 2 bp, Artificial Sequence
  Description of Artificial Sequence: Synthetic oligonucleotide
yg

SEQ ID NO: 8913 - DNA, 2 bp, Artificial Sequence
  Description of Artificial Sequence: Synthetic oligonucleotide
yg

SEQ ID NO: 8914 - DNA, 2 bp, Artificial Sequence
  Description of Artificial Sequence: Synthetic oligonucleotide
yg

SEQ ID NO: 8915 - DNA, 2 bp, Artificial Sequence
  Description of Artificial Sequence: Synthetic oligonucleotide
yg

SEQ ID NO: 8916 - DNA, 102 bp, Artificial Sequence
  Description of Artificial Sequence: Synthetic polynucleotide
ygttgagttygygttgaataagattttttygtagttttgygtttygygtygggtgaaggggygtgtttttgtaggygttyggggttyggtttggagttggyg

SEQ ID NO: 8917 - DNA, 24 bp, Artificial Sequence
  Description of Artificial Sequence: Synthetic oligonucleotide
ygtaaygattygttgtygtttayg

SEQ ID NO: 8918 - DNA, 521 bp, Artificial Sequence
  Description of Artificial Sequence: Synthetic polynucleotide
ygtggtgggggtgttagttgtaggggtgttttyggtgggtgggagttggtggtttttygttggtgttatgggattygtatgttygttttgygtttttyggtttttgagtttataggtygggattttgtttgttagtygygtgygttgtygtttaatttttgtaggygtagagygygyggyggyggtgatagagaattttgtttggttgtttaaatatagttttttgtagaaggattttgygttyggggaaggggaggaatttttttttttttgggygttygtttttttygttatggttyggtttttatattygtttatatttggtygtagyggggygttyggggggaggggttgaggtygygtttttygtygttttttgggygygggttaggyggggaggaggggggygtttyggtygtgtgtttaggattgttttttagyggttattygggttttagttttttaggtttggttttgataggygggyggagtagttagtgygagatagggaggtyggtgyg

SEQ ID NO: 8919 - DNA, 1484 bp, Artificial Sequence
  Description of Artificial Sequence: Synthetic polynucleotide
ygtaagggygtyggggagygggaggggygttgggggyggtaaggggttttagattttaggttaygaattgtttttttttttttygggtaagagtttygttttttttaattgatagaaatttattggggtaggggggygagtggggagagaggtygtttagggttygttattggttgygtttttttyggttttggtttgggaagyggttttgggtttttygggygagtagtttgggygtyggygttttttgygaggaagatygyggggtgayggtyggtattygttyggttgggtygygttgtygtttygatttatttttttttygygttygygtttttttttttttttttattaggagttygggattyggagagggygygggaggtaggtataygggttygattttattttagygtttatyggggaygygggygggyggygaygggaygyggygggggygyggggygggygyggttatggagtagtagyggyggyggyggyggyggyggyggtaatattagygatygygggyggaygagygggygggtagggtygtygggtttagyggatygaattgtatagtttagtaaaagygttttygtttttygygygtygttttttgygagtttaaatttattaatattttttaaygttttaatttattttttgaagaaaagtaaaaaaaaaaaaaaaaaaaaaaaaaaaagtaaaaaaagaaaaagtattgatyggagagayggggatatatatatatatatatatatatatatatatataaaattttttttggtttttgttaaaattagtagggttygtygygygtttgtgtgttagtgtgtgygagtgtgtgtgygtgygggygtgtgtgtgtgaatgtgattattttaggatttttygggtttyggagaygttatttttttttttgatatttttttttataaatyggtggygyggyggaggyggtagagtygggygggaagygyggggtyggtyggggygttygtygttygtygtygttttygygygttygggggtttyggygtttttygagttagggyggttagttygyggttygtygtttgatagatgtttatygttatggagttgtygtagtagtatttttgggggttygggygagygaygggagtygggatttgagygagygtyggggttagyggagtyggagtygtygggatatgggtgagtaygygyggygattttggttygggagttygggygtttagttttttttygygtygygggttttygtattttyggaatygggggygaygtgtgtgttttgtatgtaaaagtttaygtygttttgttgggtttttgattttgtattyggygggaagggggagatygggtygagggggygggatgtyggttygggygaggttgtaggagatgggygygatttyggygggtyggygggtgggyggygatgttggtttaattggagtggttygttggtggyggyg

SEQ ID NO: 8920 - DNA, 34 bp, Artificial Sequence
  Description of Artificial Sequence: Synthetic oligonucleotide
ygygtygttygttttygtttttttygttttttyg

SEQ ID NO: 8921 - DNA, 14 bp, Artificial Sequence
  Description of Artificial Sequence: Synthetic oligonucleotide
yggygaggggttyg

SEQ ID NO: 8922 - DNA, 37 bp, Artificial Sequence
  Description of Artificial Sequence: Synthetic oligonucleotide
ygtggygygtttattttayggtgttgaagagtagtyg

SEQ ID NO: 8923 - DNA, 34 bp, Artificial Sequence
  Description of Artificial Sequence: Synthetic oligonucleotide
ygggatttgttygtttttttgtttttggttgtyg

SEQ ID NO: 8924 - DNA, 538 bp, Artificial Sequence
  Description of Artificial Sequence: Synthetic polynucleotide
ygyggggttattttatygygagtttttttygtagttyggttygggttatttygattygttaggtttaatttaataattataatatyggaaaaggaagtaaaggtygaagtttattygyggttttgaggtttgtgggaaaygtagtttaataaygaaagagttttgaagtttaagyggagttygttggtygtaggggtygtattaygttttagattttggagttttygggtgygtagatttttgttattagtagaggttgtygttgygygttttttaggygyggaagaggyggttggtggtttttgayggtaaggtgaagtygaggtagtaatygggaatttaggttgggaggatagaatggggaataggaagttggggygagggtggttttgggggaggtggggggtygyggaattttaggtggtttttgttttatttttggaaagaatyggaagttygggtyggggagggtgaagggagtygyggattyggttgtttagtygaggaggaaattyggattttaggttgagggaggtyg

SEQ ID NO: 8925 - DNA, 109 bp, Artificial Sequence
  Description of Artificial Sequence: Synthetic polynucleotide
yggygttyggagygttggattatattttttagaggtatygttttyggagygtagttttattttygttagtttgygagatttggaggtttygygtggggagagggtygyg

SEQ ID NO: 8926 - DNA, 901 bp, Artificial Sequence
  Description of Artificial Sequence: Synthetic polynucleotide
ygygyggggtttyggggtyggttttttttygtygggygtttygggttygtygttygggtttttygyggatagyggtyggtygygtaggtttayggygygtattaggtygttygttagtttttttagttttttyggtygtagygtttygagtygygyggygtygyggaaygygtttagggtttyggggaggyggtyggygygggttagygygttttttagttttaggtataggtygyggttyggttgygttagttyggttagtatggagygaaagagttyggttgttatttygtagtygttygygyggaaggtttygtygtttttttttaagygttgggygatyggtttygygyggtygtagttaggatattggggyggyggyggyggygggatyggttyggggtttattatygyggggttgygaygaygygggttyggagygaaggygyggagtagggaggatgygttgttgttgggaattggtyggygggagygyggttttagttttygttagtagttaygygygtttgggggyggygygttgygagyggttgagatygygggygggggygggygtttggtttgggtagygtttttagygyggtgtgggyggygagtttygtagggttgtaatygtttyggggtgggggtygggataggtatygygggygtaatttgagtttttgtttaygygtagyggttttttagtttygtyggtttaggtaatttaggtygttgyggtaaygtagtgatygygttttaggttygygttttttgygatgttttttttattygtttgagggtttttgygygattgygygygygttttttgtttgtygttttttygtagaggtgtyggggttttgggagtaggtggttttggtygygggttgttggygyg

SEQ ID NO: 8927 - DNA, 15 bp, Artificial Sequence
  Description of Artificial Sequence: Synthetic oligonucleotide
ygggyggygygggyg

SEQ ID NO: 8928 - DNA, 383 bp, Artificial Sequence
  Description of Artificial Sequence: Synthetic polynucleotide
ygggatattttygaaggyggygygttggaggyggggagyggtyggggygtayggagagggyggggagttygygggagggggaggagggggaggagggggaggaggygygaggtgggggggagygyggygggyggtagggagggagygggagggaggtaagaaagtagtagaaagtgaggttggtaggyggyggtaaaggagtyggygygyggyggyggtaggaagtttgtgttygagaatagtagaaataagagttagggagggatygyggtygyggyggyggyggygagagygaaagaggaaattgtagaggaggaagttgygtygtagttygagtygttyggtattttygtygtttttgygttygygtygygttttyggyg

SEQ ID NO: 8929 - DNA, 4 bp, Artificial Sequence
  Description of Artificial Sequence: Synthetic oligonucleotide
ygyg

SEQ ID NO: 8930 - DNA, 624 bp, Artificial Sequence
  Description of Artificial Sequence: Synthetic polynucleotide
ygyggaggtgggygagygggygtgygygtatttatttgtyggygygagggagtgtygggggggaagggagtggtttttaaaagggggaggggagaaggtagggggyggggagaagtyggttttttaggattyggttgyggyggygagggaggaggaagaagyggaggaggyggttttygygttygtagggtygtgttatttgttygttygttygttygttygttygttygttgygtygygttgtygatygttagtatgttgtygagagtgggttgtttygygttgtygttgtygtygtygtygttgttgtygttgttgttgttgttattgggygygagtggyggyggyggyggggygygygyggaggtgttgtttygttgttygttttgtatattygagygtttggtygtttgygggttttygtyggttgygtygttygtygyggtggtygtagtggtyggaggygttygtatgttatgygyggagttygttygggagtygggttgyggttgttgttyggtgtgygttyggttggagggygaggygtgyggygtttatatttygygttgyggttaggggttgygttgttatttttattygggtttygagttgtttttgtaggyg

SEQ ID NO: 8931 - DNA, 94 bp, Artificial Sequence
  Description of Artificial Sequence: Synthetic oligonucleotide
ygagatagttagygagtttaggyggtttttgtagygttgggagaggaatgtgygygaaattaattagagygaaattagtyggaggagtyggtyg

SEQ ID NO: 8932 - DNA, 63 bp, Artificial Sequence
  Description of Artificial Sequence: Synthetic oligonucleotide
ygtgtagggygtagagttgggtygagtygtygtyggygttaygygagtttygtagtygtygyg

SEQ ID NO: 8933 - DNA, 41 bp, Artificial Sequence
  Description of Artificial Sequence: Synthetic oligonucleotide
ygtygyggtttttggggttttygtttttttgttygttatyg

SEQ ID NO: 8934 - DNA, 1041 bp, Artificial Sequence
  Description of Artificial Sequence: Synthetic polynucleotide
ygygtagggatygggtygggtagagtygggyggggtggagaggtaagyggagygygyggtggggttgaggggaggygtggggygagtgttygttgttygttttttagtttttttgtttttaygttttttygttygtagtygttygtagttyggyggtgtagttgtgttggattyggyggygtygtagttttttatygttttttgatgttattggggtgygggggttygggyggttyggtgygygggttaatagttgtayggttttygyggtttagyggygtagggyggggygygtttgatagttttttygtttttygygttagttgattggyggttygagyggtttyggagyggyggaggtttggyggagygttggagyggagtgggayggttagtttgggtttattttygtattttgtaggtttyggtttaygtaygttygtttggagtgygygttttatttttaggttaaattatygttttttttttttygygtattttttttttttagttttttttgtattttatttttatttygtgttatttttaaggaggtttagaatgagygtygggataaygttttttgggttttttgtttttaagyggttttygtttagtgggygaygttttgtgtgttttygyggtttttggtygtgtgtgtygtgygtttttgtttttggagatttgygygtatttgtatgttggggagggygggttygaggtttygagagttgtgtttagatttaatttttaattttaggggattttttttaggttaagygagggttttttttggygggtgtagtygtagagttttgaggttygattttattggtttygtygtttttygygtttattttatygtataatgtttatagtgaaggygaygggaaaagtagtagtttaaaggttttgaatttttttttttygttataygtayggaattttgagttttyggagtttyggggtygaggtyggttygggayggtgtttygagtagttttttattgttggggagtyggttttgtttttgtttgaayg

SEQ ID NO: 8935 - DNA, 23 bp, Artificial Sequence
  Description of Artificial Sequence: Synthetic oligonucleotide
ygttttyggttygggttatggyg

SEQ ID NO: 8936 - DNA, 515 bp, Artificial Sequence
  Description of Artificial Sequence: Synthetic polynucleotide
ygtagtagaatattttgatttaaaataaaaatattatgataaaaatattttaggaggtagtyggttttatttygtttaaagtyggatttygtttagtttygtgaaagygaaggagtattagygttttttgatttygtatagttttttyggtagagayggttygttttttttaagaatyggaagtyggatagygttaggaygttttattttttttatttgggatttagagaggtagyggttaaggatagggttttygtygaggttatygggtagygtttaggtttyggtttttgggaggggagtagygggggaggggtayggggaggggygagggyggggygygtttgggtttyggygttgggttttttttttgttygtttygggggatatttataggatttttgtagatttttgtygaggtaggatggaggtttgtagggatgtatygygggttygygattygggyggtyggaatatagttttttttggtyggagatyggttyggtygtgagtyg

SEQ ID NO: 8937 - DNA, 1017 bp, Artificial Sequence
  Description of Artificial Sequence: Synthetic polynucleotide
ygggttaggtttgyggaggaygttttygggygygtatatatagttygaggaygygttttgtattttaagaygtagggtyggattttatttygaaatttggtttttatagttttaggtygaattgtgtttggtttttagttttygagttygagttttaygtygtaaagagatggggttttattgtgtttagttggttttttagtayggaygtgtatttttttttggtttgttttttgttaaaaatyggtagtgygtttygtttttttgtttagtygtagtttgtygttttttagataaaaagyggygatygyggttyggttattygagtttygtygygttgygtttttgttgggyggtttatagatggtgtttagtayggggtygygtygagggygggggygggaggtygygaagagggtygggygggaggggaggagayggyggagtagttaattygygygyggtttattagttgatygtttttgtttatattaggtgtaygtyggttgyggggagtataaagyggggygtatygygggygtyggtaaygagtyggtgaaygaggygaggttygtgygttygyggttgtaagygttygtttggyggggagaggggtygayggygttagttygggyggyggtatttttaggygtttggggygttttttttyggatttggtygttygttgtttygttttttgtattttattttttygatttttttttttagttttgtttttttttgttttggtttttgagagtygattgagtttagtttygtgtagtagyggttgtttgtgtygtygtttagttttyggttttggtgttttttygggggtgttttaaggagttagtgygygttgygggttgggaaggaggygtygtttagttagttttttttttttttttygttttttttttttttttgttgttgttgtygtygtygtygtygtgggtgtygggttygygygtattttaatatttttattagttgggtttyggggtaagtttttggtyg

SEQ ID NO: 8938 - DNA, 8 bp, Artificial Sequence
  Description of Artificial Sequence: Synthetic oligonucleotide
ygygttyg

SEQ ID NO: 8939 - DNA, 54 bp, Artificial Sequence
  Description of Artificial Sequence: Synthetic oligonucleotide
ygagygtaggygggyggagagtagattaygyggaagaggtygagagagaaagyg

SEQ ID NO: 8940 - DNA, 10 bp, Artificial Sequence
  Description of Artificial Sequence: Synthetic oligonucleotide
ygygttgtyg

SEQ ID NO: 8941 - DNA, 26 bp, Artificial Sequence
  Description of Artificial Sequence: Synthetic oligonucleotide
ygggtaggttygattaggyggtygyg

SEQ ID NO: 8942 - DNA, 934 bp, Artificial Sequence
  Description of Artificial Sequence: Synthetic polynucleotide
ygaatttyggyggtygtygygttttttygtttygyggagatygaygtaggygttygttttygaggtygaagggtattgggyggygagggttgyggtagttggygatttygggggygtttgygyggygygygttagaygaggttgtttyggyggttatttygygatttygygtygtygggatttgygygyggagaaygtyggttttggagggagtaygtttttttaaagtgtagaggagggttyggyggygygttttygyggaaattttttttattgtagttatttyggatgtygatttagtagtttgtttttygagaaaagagaggggatttgggtagaagggtttygtttgttttaaaagaaggtgtaaggattagaagataaygaaaygtttattttttgaagggtgggaaaaaaagaaaaagaaaaaggagttatttaygttggagatgttygttttagatttttttatttttttttttttygtttyggttttttttttygaggtttatttaatttgttagagaaggaggaggagtagaagatgggggtygaggaggaggggaagagaaagagaagtttgttaagaataaagtttttgtyggtaagygyggggatttygtagtggagggtattgyggagtttyggggagttatagygggggtttygggtttaaatgtttttgttyggagttygagtygatatatatatttagttygatttttttttgttttyggttygagttttttagtttggttygtyggttygtygttttgtaygttttygtyggttagttttgttaaagtaaagagttgygttttttgagttygttyggtygaggggaggggaygtttygagtttggtygygtgygaggtttygggygygttttggtttttyggttygagagygygtagttygggtttttttttygyg

SEQ ID NO: 8943 - DNA, 279 bp, Artificial Sequence
  Description of Artificial Sequence: Synthetic polynucleotide
ygyggggtaaggaattygygggtagttattttygttaggggtagggttyggttagttaggygygagaaggttaggygaggtygattgygyggggtgaagaygttaggtygatagttgygggttttatygttagttttgaygygagtttgygttttggygayggyggagggygggtagggggygygggygttgttayggygtttgtttagaatyggtygggaaygtygygggygggttttttyggtttttygtttttttagttttgtttttaggttttyg

SEQ ID NO: 8944 - DNA, 2 bp, Artificial Sequence
  Description of Artificial Sequence: Synthetic oligonucleotide
yg

SEQ ID NO: 8945 - DNA, 9 bp, Artificial Sequence
  Description of Artificial Sequence: Synthetic oligonucleotide
ygtttygyg

SEQ ID NO: 8946 - DNA, 11 bp, Artificial Sequence
  Description of Artificial Sequence: Synthetic oligonucleotide
ygagygtatyg

SEQ ID NO: 8947 - DNA, 30 bp, Artificial Sequence
  Description of Artificial Sequence: Synthetic oligonucleotide
ygtttgtaattttagttatttaggaggtyg

SEQ ID NO: 8948 - DNA, 10 bp, Artificial Sequence
  Description of Artificial Sequence: Synthetic oligonucleotide
ygttttygyg

SEQ ID NO: 8949 - DNA, 56 bp, Artificial Sequence
  Description of Artificial Sequence: Synthetic oligonucleotide
yggygtttgatgagyggygggttyggataygaggggayggggtygatttgtgggyg

SEQ ID NO: 8950 - DNA, 98 bp, Artificial Sequence
  Description of Artificial Sequence: Synthetic oligonucleotide
yggttagtagggyggggtaggaggttgggagagggaygggtgygggggtgggggagaggaagggagyggttaygtgtgaggggyggttygaggttayg

SEQ ID NO: 8951 - DNA, 33 bp, Artificial Sequence
  Description of Artificial Sequence: Synthetic oligonucleotide
ygggaggaygygtaggggyggtygtygtygtyg

SEQ ID NO: 8952 - DNA, 48 bp, Artificial Sequence
  Description of Artificial Sequence: Synthetic oligonucleotide
ygttttattttttttattatataygtattttttattttaattttttyg

SEQ ID NO: 8953 - DNA, 93 bp, Artificial Sequence
  Description of Artificial Sequence: Synthetic oligonucleotide
ygatttgtttyggtygtattygttttygttttagtaygygaygttgttyggygygatttttgttttttyggtttagttttatygttgttttyg

SEQ ID NO: 8954 - DNA, 2 bp, Artificial Sequence
  Description of Artificial Sequence: Synthetic oligonucleotide
yg

SEQ ID NO: 8955 - DNA, 2 bp, Artificial Sequence
  Description of Artificial Sequence: Synthetic oligonucleotide
yg

SEQ ID NO: 8956 - DNA, 2 bp, Artificial Sequence
  Description of Artificial Sequence: Synthetic oligonucleotide
yg

SEQ ID NO: 8957 - DNA, 2 bp, Artificial Sequence
  Description of Artificial Sequence: Synthetic oligonucleotide
yg

SEQ ID NO: 8958 - DNA, 2 bp, Artificial Sequence
  Description of Artificial Sequence: Synthetic oligonucleotide
yg

SEQ ID NO: 8959 - DNA, 2 bp, Artificial Sequence
  Description of Artificial Sequence: Synthetic oligonucleotide
yg

SEQ ID NO: 8960 - DNA, 2 bp, Artificial Sequence
  Description of Artificial Sequence: Synthetic oligonucleotide
yg

SEQ ID NO: 8961 - DNA, 42 bp, Artificial Sequence
  Description of Artificial Sequence: Synthetic oligonucleotide
yggagygaggygygygttyggttagagagygagygygtaayg

SEQ ID NO: 8962 - DNA, 2 bp, Artificial Sequence
  Description of Artificial Sequence: Synthetic oligonucleotide
yg

SEQ ID NO: 8963 - DNA, 2 bp, Artificial Sequence
  Description of Artificial Sequence: Synthetic oligonucleotide
yg

SEQ ID NO: 8964 - DNA, 2 bp, Artificial Sequence
  Description of Artificial Sequence: Synthetic oligonucleotide
yg

SEQ ID NO: 8965 - DNA, 2 bp, Artificial Sequence
  Description of Artificial Sequence: Synthetic oligonucleotide
yg

SEQ ID NO: 8966 - DNA, 2 bp, Artificial Sequence
  Description of Artificial Sequence: Synthetic oligonucleotide
yg

SEQ ID NO: 8967 - DNA, 2 bp, Artificial Sequence
  Description of Artificial Sequence: Synthetic oligonucleotide
yg

SEQ ID NO: 8968 - DNA, 2 bp, Artificial Sequence
  Description of Artificial Sequence: Synthetic oligonucleotide
yg

SEQ ID NO: 8969 - DNA, 2 bp, Artificial Sequence
  Description of Artificial Sequence: Synthetic oligonucleotide
yg

SEQ ID NO: 8970 - DNA, 2 bp, Artificial Sequence
  Description of Artificial Sequence: Synthetic oligonucleotide
yg

SEQ ID NO: 8971 - DNA, 2 bp, Artificial Sequence
  Description of Artificial Sequence: Synthetic oligonucleotide
yg

SEQ ID NO: 8972 - DNA, 40 bp, Artificial Sequence
  Description of Artificial Sequence: Synthetic oligonucleotide
yggygtattggygttgggagtagggtygtatttyggygyg

SEQ ID NO: 8973 - DNA, 2 bp, Artificial Sequence
  Description of Artificial Sequence: Synthetic oligonucleotide
yg

SEQ ID NO: 8974 - DNA, 2 bp, Artificial Sequence
  Description of Artificial Sequence: Synthetic oligonucleotide
yg

SEQ ID NO: 8975 - DNA, 2 bp, Artificial Sequence
  Description of Artificial Sequence: Synthetic oligonucleotide
yg

SEQ ID NO: 8976 - DNA, 2 bp, Artificial Sequence
  Description of Artificial Sequence: Synthetic oligonucleotide
yg

SEQ ID NO: 8977 - DNA, 2 bp, Artificial Sequence
  Description of Artificial Sequence: Synthetic oligonucleotide
yg

SEQ ID NO: 8978 - DNA, 2 bp, Artificial Sequence
  Description of Artificial Sequence: Synthetic oligonucleotide
yg

SEQ ID NO: 8979 - DNA, 2 bp, Artificial Sequence
  Description of Artificial Sequence: Synthetic oligonucleotide
yg

SEQ ID NO: 8980 - DNA, 2 bp, Artificial Sequence
  Description of Artificial Sequence: Synthetic oligonucleotide
yg

SEQ ID NO: 8981 - DNA, 2 bp, Artificial Sequence
  Description of Artificial Sequence: Synthetic oligonucleotide
yg

SEQ ID NO: 8982 - DNA, 2 bp, Artificial Sequence
  Description of Artificial Sequence: Synthetic oligonucleotide
yg

SEQ ID NO: 8983 - DNA, 2 bp, Artificial Sequence
  Description of Artificial Sequence: Synthetic oligonucleotide
yg

SEQ ID NO: 8984 - DNA, 2 bp, Artificial Sequence
  Description of Artificial Sequence: Synthetic oligonucleotide
yg

SEQ ID NO: 8985 - DNA, 2 bp, Artificial Sequence
  Description of Artificial Sequence: Synthetic oligonucleotide
yg

SEQ ID NO: 8986 - DNA, 2 bp, Artificial Sequence
  Description of Artificial Sequence: Synthetic oligonucleotide
yg

SEQ ID NO: 8987 - DNA, 2 bp, Artificial Sequence
  Description of Artificial Sequence: Synthetic oligonucleotide
yg

SEQ ID NO: 8988 - DNA, 2 bp, Artificial Sequence
  Description of Artificial Sequence: Synthetic oligonucleotide
yg

SEQ ID NO: 8989 - DNA, 2 bp, Artificial Sequence
  Description of Artificial Sequence: Synthetic oligonucleotide
yg

SEQ ID NO: 8990 - DNA, 2 bp, Artificial Sequence
  Description of Artificial Sequence: Synthetic oligonucleotide
yg

SEQ ID NO: 8991 - DNA, 2 bp, Artificial Sequence
  Description of Artificial Sequence: Synthetic oligonucleotide
yg

SEQ ID NO: 8992 - DNA, 2 bp, Artificial Sequence
  Description of Artificial Sequence: Synthetic oligonucleotide
yg

SEQ ID NO: 8993 - DNA, 2 bp, Artificial Sequence
  Description of Artificial Sequence: Synthetic oligonucleotide
yg

SEQ ID NO: 8994 - DNA, 42 bp, Artificial Sequence
  Description of Artificial Sequence: Synthetic oligonucleotide
ygggygggyggygttyggtttgagggagyggggyggttttyg

SEQ ID NO: 8995 - DNA, 2 bp, Artificial Sequence
  Description of Artificial Sequence: Synthetic oligonucleotide
yg

SEQ ID NO: 8996 - DNA, 2 bp, Artificial Sequence
  Description of Artificial Sequence: Synthetic oligonucleotide
yg

SEQ ID NO: 8997 - DNA, 2 bp, Artificial Sequence
  Description of Artificial Sequence: Synthetic oligonucleotide
yg

SEQ ID NO: 8998 - DNA, 2 bp, Artificial Sequence
  Description of Artificial Sequence: Synthetic oligonucleotide
yg

SEQ ID NO: 8999 - DNA, 2 bp, Artificial Sequence
  Description of Artificial Sequence: Synthetic oligonucleotide
yg

SEQ ID NO: 9000 - DNA, 2 bp, Artificial Sequence
  Description of Artificial Sequence: Synthetic oligonucleotide
yg

SEQ ID NO: 9001 - DNA, 2 bp, Artificial Sequence
  Description of Artificial Sequence: Synthetic oligonucleotide
yg

SEQ ID NO: 9002 - DNA, 2 bp, Artificial Sequence
  Description of Artificial Sequence: Synthetic oligonucleotide
yg

SEQ ID NO: 9003 - DNA, 2 bp, Artificial Sequence
  Description of Artificial Sequence: Synthetic oligonucleotide
yg

SEQ ID NO: 9004 - DNA, 2 bp, Artificial Sequence
  Description of Artificial Sequence: Synthetic oligonucleotide
yg

SEQ ID NO: 9005 - DNA, 20 bp, Artificial Sequence
  Description of Artificial Sequence: Synthetic oligonucleotide
cgtggtgcgcgcggcgggcg

SEQ ID NO: 9006 - DNA, 116 bp, Artificial Sequence
  Description of Artificial Sequence: Synthetic polynucleotide
cgagcgtcgtgggcggggttttagggcggcggcgtttcgcggggagggtttttcgtgttgggggcgaggttattcgaggtagtttttcgttcgtttttaatttcgtttcgttttcg

SEQ ID NO: 9007 - DNA, 2 bp, Artificial Sequence
  Description of Artificial Sequence: Synthetic oligonucleotide
cg

SEQ ID NO: 9008 - DNA, 2 bp, Artificial Sequence
  Description of Artificial Sequence: Synthetic oligonucleotide
cg

SEQ ID NO: 9009 - DNA, 2 bp, Artificial Sequence
  Description of Artificial Sequence: Synthetic oligonucleotide
cg

SEQ ID NO: 9010 - DNA, 2 bp, Artificial Sequence
  Description of Artificial Sequence: Synthetic oligonucleotide
cg

SEQ ID NO: 9011 - DNA, 2 bp, Artificial Sequence
  Description of Artificial Sequence: Synthetic oligonucleotide
cg

SEQ ID NO: 9012 - DNA, 2 bp, Artificial Sequence
  Description of Artificial Sequence: Synthetic oligonucleotide
cg

SEQ ID NO: 9013 - DNA, 2 bp, Artificial Sequence
  Description of Artificial Sequence: Synthetic oligonucleotide
cg

SEQ ID NO: 9014 - DNA, 2 bp, Artificial Sequence
  Description of Artificial Sequence: Synthetic oligonucleotide
cg

SEQ ID NO: 9015 - DNA, 2 bp, Artificial Sequence
  Description of Artificial Sequence: Synthetic oligonucleotide
cg

SEQ ID NO: 9016 - DNA, 2 bp, Artificial Sequence
  Description of Artificial Sequence: Synthetic oligonucleotide
cg

SEQ ID NO: 9017 - DNA, 44 bp, Artificial Sequence
  Description of Artificial Sequence: Synthetic oligonucleotide
cgcgcgtttttcgggtttcgttcgtattttttacgcgtttttcg

SEQ ID NO: 9018 - DNA, 2 bp, Artificial Sequence
  Description of Artificial Sequence: Synthetic oligonucleotide
cg

SEQ ID NO: 9019 - DNA, 2 bp, Artificial Sequence
  Description of Artificial Sequence: Synthetic oligonucleotide
cg

SEQ ID NO: 9020 - DNA, 2 bp, Artificial Sequence
  Description of Artificial Sequence: Synthetic oligonucleotide
cg

SEQ ID NO: 9021 - DNA, 2 bp, Artificial Sequence
  Description of Artificial Sequence: Synthetic oligonucleotide
cg

SEQ ID NO: 9022 - DNA, 2 bp, Artificial Sequence
  Description of Artificial Sequence: Synthetic oligonucleotide
cg

SEQ ID NO: 9023 - DNA, 2 bp, Artificial Sequence
  Description of Artificial Sequence: Synthetic oligonucleotide
cg

SEQ ID NO: 9024 - DNA, 2 bp, Artificial Sequence
  Description of Artificial Sequence: Synthetic oligonucleotide
cg

SEQ ID NO: 9025 - DNA, 2 bp, Artificial Sequence
  Description of Artificial Sequence: Synthetic oligonucleotide
cg

SEQ ID NO: 9026 - DNA, 2 bp, Artificial Sequence
  Description of Artificial Sequence: Synthetic oligonucleotide
tg

SEQ ID NO: 9027 - DNA, 2 bp, Artificial Sequence
  Description of Artificial Sequence: Synthetic oligonucleotide
cg

SEQ ID NO: 9028 - DNA, 34 bp, Artificial Sequence
  Description of Artificial Sequence: Synthetic oligonucleotide
cgtttgttcggcggttttagaaggtcgggttgcg

SEQ ID NO: 9029 - DNA, 2 bp, Artificial Sequence
  Description of Artificial Sequence: Synthetic oligonucleotide
cg

SEQ ID NO: 9030 - DNA, 2 bp, Artificial Sequence
  Description of Artificial Sequence: Synthetic oligonucleotide
cg

SEQ ID NO: 9031 - DNA, 2 bp, Artificial Sequence
  Description of Artificial Sequence: Synthetic oligonucleotide
cg

SEQ ID NO: 9032 - DNA, 2 bp, Artificial Sequence
  Description of Artificial Sequence: Synthetic oligonucleotide
cg

SEQ ID NO: 9033 - DNA, 2 bp, Artificial Sequence
  Description of Artificial Sequence: Synthetic oligonucleotide
cg

SEQ ID NO: 9034 - DNA, 2 bp, Artificial Sequence
  Description of Artificial Sequence: Synthetic oligonucleotide
cg

SEQ ID NO: 9035 - DNA, 2 bp, Artificial Sequence
  Description of Artificial Sequence: Synthetic oligonucleotide
cg

SEQ ID NO: 9036 - DNA, 2 bp, Artificial Sequence
  Description of Artificial Sequence: Synthetic oligonucleotide
cg

SEQ ID NO: 9037 - DNA, 2 bp, Artificial Sequence
  Description of Artificial Sequence: Synthetic oligonucleotide
cg

SEQ ID NO: 9038 - DNA, 2 bp, Artificial Sequence
  Description of Artificial Sequence: Synthetic oligonucleotide
cg

SEQ ID NO: 9039 - DNA, 211 bp, Artificial Sequence
  Description of Artificial Sequence: Synthetic polynucleotide
cgattttcggcgtagatatagaggtcgtttttagtttcgtcgtttcgtggtttcgttttcgttgtacgtttttttatttttcggatttcgtagggtcgcggcggatacggttcgatcggggacgtgaacgcgtagaattatattttttagcgtttcgttcgcgttggaattatatttttcggggggttcggcggtgtattcgtcggggtcg

SEQ ID NO: 9040 - DNA, 2 bp, Artificial Sequence
  Description of Artificial Sequence: Synthetic oligonucleotide
cg

SEQ ID NO: 9041 - DNA, 2 bp, Artificial Sequence
  Description of Artificial Sequence: Synthetic oligonucleotide
cg

SEQ ID NO: 9042 - DNA, 2 bp, Artificial Sequence
  Description of Artificial Sequence: Synthetic oligonucleotide
cg

SEQ ID NO: 9043 - DNA, 2 bp, Artificial Sequence
  Description of Artificial Sequence: Synthetic oligonucleotide
cg

SEQ ID NO: 9044 - DNA, 2 bp, Artificial Sequence
  Description of Artificial Sequence: Synthetic oligonucleotide
cg

SEQ ID NO: 9045 - DNA, 2 bp, Artificial Sequence
  Description of Artificial Sequence: Synthetic oligonucleotide
cg

SEQ ID NO: 9046 - DNA, 2 bp, Artificial Sequence
  Description of Artificial Sequence: Synthetic oligonucleotide
cg

SEQ ID NO: 9047 - DNA, 2 bp, Artificial Sequence
  Description of Artificial Sequence: Synthetic oligonucleotide
cg

SEQ ID NO: 9048 - DNA, 2 bp, Artificial Sequence
  Description of Artificial Sequence: Synthetic oligonucleotide
cg

SEQ ID NO: 9049 - DNA, 2 bp, Artificial Sequence
  Description of Artificial Sequence: Synthetic oligonucleotide
cg

SEQ ID NO: 9050 - DNA, 95 bp, Artificial Sequence
  Description of Artificial Sequence: Synthetic oligonucleotide
cgggaaaaggggcgcggaagaggggcggggcgggttacggcgcgtagggtttttttttttcgtttcggatttaattaattgggtttgagtttttg

SEQ ID NO: 9051 - DNA, 2 bp, Artificial Sequence
  Description of Artificial Sequence: Synthetic oligonucleotide
cg

SEQ ID NO: 9052 - DNA, 2 bp, Artificial Sequence
  Description of Artificial Sequence: Synthetic oligonucleotide
cg

SEQ ID NO: 9053 - DNA, 2 bp, Artificial Sequence
  Description of Artificial Sequence: Synthetic oligonucleotide
cg

SEQ ID NO: 9054 - DNA, 2 bp, Artificial Sequence
  Description of Artificial Sequence: Synthetic oligonucleotide
cg

SEQ ID NO: 9055 - DNA, 2 bp, Artificial Sequence
  Description of Artificial Sequence: Synthetic oligonucleotide
cg

SEQ ID NO: 9056 - DNA, 2 bp, Artificial Sequence
  Description of Artificial Sequence: Synthetic oligonucleotide
cg

SEQ ID NO: 9057 - DNA, 2 bp, Artificial Sequence
  Description of Artificial Sequence: Synthetic oligonucleotide
cg

SEQ ID NO: 9058 - DNA, 2 bp, Artificial Sequence
  Description of Artificial Sequence: Synthetic oligonucleotide
cg

SEQ ID NO: 9059 - DNA, 2 bp, Artificial Sequence
  Description of Artificial Sequence: Synthetic oligonucleotide
cg

SEQ ID NO: 9060 - DNA, 2 bp, Artificial Sequence
  Description of Artificial Sequence: Synthetic oligonucleotide
cg

SEQ ID NO: 9061 - DNA, 264 bp, Artificial Sequence
  Description of Artificial Sequence: Synthetic polynucleotide
cgggttgtaaggcggtgtattacgtgtgcgcgtttagtatgtacgttagcgtgttgtttatcggtttgtttagtttgtagcgttgtttcgtagttattcgtttttttttggcgtttcggttgcgtagttcggttttggttcgtcgtttgttgttggcggtttggttggtcgttttgttgttcgtcgtttcggtcgtcgtttatcgttatttgtggagggatcgcgtatgttagttgtgttattcgtcgtcggtttacgtcgtcg

SEQ ID NO: 9062 - DNA, 2 bp, Artificial Sequence
  Description of Artificial Sequence: Synthetic oligonucleotide
cg

SEQ ID NO: 9063 - DNA, 2 bp, Artificial Sequence
  Description of Artificial Sequence: Synthetic oligonucleotide
cg

SEQ ID NO: 9064 - DNA, 2 bp, Artificial Sequence
  Description of Artificial Sequence: Synthetic oligonucleotide
cg

SEQ ID NO: 9065 - DNA, 2 bp, Artificial Sequence
  Description of Artificial Sequence: Synthetic oligonucleotide
cg

SEQ ID NO: 9066 - DNA, 2 bp, Artificial Sequence
  Description of Artificial Sequence: Synthetic oligonucleotide
cg

SEQ ID NO: 9067 - DNA, 2 bp, Artificial Sequence
  Description of Artificial Sequence: Synthetic oligonucleotide
cg

SEQ ID NO: 9068 - DNA, 2 bp, Artificial Sequence
  Description of Artificial Sequence: Synthetic oligonucleotide
cg

SEQ ID NO: 9069 - DNA, 2 bp, Artificial Sequence
  Description of Artificial Sequence: Synthetic oligonucleotide
cg

SEQ ID NO: 9070 - DNA, 2 bp, Artificial Sequence
  Description of Artificial Sequence: Synthetic oligonucleotide
cg

SEQ ID NO: 9071 - DNA, 2 bp, Artificial Sequence
  Description of Artificial Sequence: Synthetic oligonucleotide
cg

SEQ ID NO: 9072 - DNA, 59 bp, Artificial Sequence
  Description of Artificial Sequence: Synthetic oligonucleotide
cgtttttcgtttcggagttgtcggcggtatgattcgatacgtcggggcgttcgcgcgcg

SEQ ID NO: 9073 - DNA, 2 bp, Artificial Sequence
  Description of Artificial Sequence: Synthetic oligonucleotide
cg

SEQ ID NO: 9074 - DNA, 2 bp, Artificial Sequence
  Description of Artificial Sequence: Synthetic oligonucleotide
cg

SEQ ID NO: 9075 - DNA, 2 bp, Artificial Sequence
  Description of Artificial Sequence: Synthetic oligonucleotide
cg

SEQ ID NO: 9076 - DNA, 2 bp, Artificial Sequence
  Description of Artificial Sequence: Synthetic oligonucleotide
cg

SEQ ID NO: 9077 - DNA, 2 bp, Artificial Sequence
  Description of Artificial Sequence: Synthetic oligonucleotide
cg

SEQ ID NO: 9078 - DNA, 2 bp, Artificial Sequence
  Description of Artificial Sequence: Synthetic oligonucleotide
cg

SEQ ID NO: 9079 - DNA, 2 bp, Artificial Sequence
  Description of Artificial Sequence: Synthetic oligonucleotide
cg

SEQ ID NO: 9080 - DNA, 2 bp, Artificial Sequence
  Description of Artificial Sequence: Synthetic oligonucleotide
cg

SEQ ID NO: 9081 - DNA, 2 bp, Artificial Sequence
  Description of Artificial Sequence: Synthetic oligonucleotide
cg

SEQ ID NO: 9082 - DNA, 2 bp, Artificial Sequence
  Description of Artificial Sequence: Synthetic oligonucleotide
cg

SEQ ID NO: 9083 - DNA, 4 bp, Artificial Sequence
  Description of Artificial Sequence: Synthetic oligonucleotide
cgcg

SEQ ID NO: 9084 - DNA, 2 bp, Artificial Sequence
  Description of Artificial Sequence: Synthetic oligonucleotide
cg

SEQ ID NO: 9085 - DNA, 2 bp, Artificial Sequence
  Description of Artificial Sequence: Synthetic oligonucleotide
cg

SEQ ID NO: 9086 - DNA, 2 bp, Artificial Sequence
  Description of Artificial Sequence: Synthetic oligonucleotide
cg

SEQ ID NO: 9087 - DNA, 2 bp, Artificial Sequence
  Description of Artificial Sequence: Synthetic oligonucleotide
cg

SEQ ID NO: 9088 - DNA, 2 bp, Artificial Sequence
  Description of Artificial Sequence: Synthetic oligonucleotide
cg

SEQ ID NO: 9089 - DNA, 2 bp, Artificial Sequence
  Description of Artificial Sequence: Synthetic oligonucleotide
cg

SEQ ID NO: 9090 - DNA, 2 bp, Artificial Sequence
  Description of Artificial Sequence: Synthetic oligonucleotide
cg

SEQ ID NO: 9091 - DNA, 2 bp, Artificial Sequence
  Description of Artificial Sequence: Synthetic oligonucleotide
cg

SEQ ID NO: 9092 - DNA, 2 bp, Artificial Sequence
  Description of Artificial Sequence: Synthetic oligonucleotide
cg

SEQ ID NO: 9093 - DNA, 2 bp, Artificial Sequence
  Description of Artificial Sequence: Synthetic oligonucleotide
cg

SEQ ID NO: 9094 - DNA, 324 bp, Artificial Sequence
  Description of Artificial Sequence: Synthetic polynucleotide
cggcgaaggtttcgtgttttacgagattttttttgttgtattcgaagttatttattatttttatggtcgcgttttcggggtatatagcggacgggcgggcggcgtagtgcggcgtaggtattagtatcgcggtttcgcgggttcggagcgcgttagcgtgcggcgggtttggggtagtcgtagtttcgggttcgggcggatttttatgtcgagagatcggagcggaaattggggaagttgtcgcgcggagttagggttagcgaggttcggttcggtttttgtcgtttatggttcggtttgtcgtcggtcgttggttgtttggcg

SEQ ID NO: 9095 - DNA, 2 bp, Artificial Sequence
  Description of Artificial Sequence: Synthetic oligonucleotide
cg

SEQ ID NO: 9096 - DNA, 2 bp, Artificial Sequence
  Description of Artificial Sequence: Synthetic oligonucleotide
cg

SEQ ID NO: 9097 - DNA, 2 bp, Artificial Sequence
  Description of Artificial Sequence: Synthetic oligonucleotide
cg

SEQ ID NO: 9098 - DNA, 2 bp, Artificial Sequence
  Description of Artificial Sequence: Synthetic oligonucleotide
cg

SEQ ID NO: 9099 - DNA, 2 bp, Artificial Sequence
  Description of Artificial Sequence: Synthetic oligonucleotide
cg

SEQ ID NO: 9100 - DNA, 2 bp, Artificial Sequence
  Description of Artificial Sequence: Synthetic oligonucleotide
cg

SEQ ID NO: 9101 - DNA, 2 bp, Artificial Sequence
  Description of Artificial Sequence: Synthetic oligonucleotide
cg

SEQ ID NO: 9102 - DNA, 102 bp, Artificial Sequence
  Description of Artificial Sequence: Synthetic polynucleotide
cgttgagttcgcgttgaataagattttttcgtagttttgcgtttcgcgtcgggtgaaggggcgtgtttttgtaggcgttcggggttcggtttggagttggcg

SEQ ID NO: 9103 - DNA, 24 bp, Artificial Sequence
  Description of Artificial Sequence: Synthetic oligonucleotide
cgtaacgattcgttgtcgtttacg

SEQ ID NO: 9104 - DNA, 521 bp, Artificial Sequence
  Description of Artificial Sequence: Synthetic polynucleotide
cgtggtgggggtgttagttgtaggggtgttttcggtgggtgggagttggtggtttttcgttggtgttatgggattcgtatgttcgttttgcgtttttcggtttttgagtttataggtcgggattttgtttgttagtcgcgtgcgttgtcgtttaatttttgtaggcgtagagcgcgcggcggcggtgatagagaattttgtttggttgtttaaatatagttttttgtagaaggattttgcgttcggggaaggggaggaatttttttttttttgggcgttcgtttttttcgttatggttcggtttttatattcgtttatatttggtcgtagcggggcgttcggggggaggggttgaggtcgcgtttttcgtcgttttttgggcgcgggttaggcggggaggaggggggcgtttcggtcgtgtgtttaggattgttttttagcggttattcgggttttagttttttaggtttggttttgataggcgggcggagtagttagtgcgagatagggaggtcggtgcg

SEQ ID NO: 9105 - DNA, 1484 bp, Artificial Sequence
  Description of Artificial Sequence: Synthetic polynucleotide
cgtaagggcgtcggggagcgggaggggcgttgggggcggtaaggggttttagattttaggttacgaattgtttttttttttttcgggtaagagtttcgttttttttaattgatagaaatttattggggtaggggggcgagtggggagagaggtcgtttagggttcgttattggttgcgtttttttcggttttggtttgggaagcggttttgggtttttcgggcgagtagtttgggcgtcggcgttttttgcgaggaagatcgcggggtgacggtcggtattcgttcggttgggtcgcgttgtcgtttcgatttatttttttttcgcgttcgcgtttttttttttttttttattaggagttcgggattcggagagggcgcgggaggtaggtatacgggttcgattttattttagcgtttatcggggacgcgggcgggcggcgacgggacgcggcgggggcgcggggcgggcgcggttatggagtagtagcggcggcggcggcggcggcggcggtaatattagcgatcgcgggcggacgagcgggcgggtagggtcgtcgggtttagcggatcgaattgtatagtttagtaaaagcgttttcgtttttcgcgcgtcgttttttgcgagtttaaatttattaatattttttaacgttttaatttattttttgaagaaaagtaaaaaaaaaaaaaaaaaaaaaaaaaaaagtaaaaaaagaaaaagtattgatcggagagacggggatatatatatatatatatatatatatatatatataaaattttttttggtttttgttaaaattagtagggttcgtcgcgcgtttgtgtgttagtgtgtgcgagtgtgtgtgcgtgcgggcgtgtgtgtgtgaatgtgattattttaggatttttcgggtttcggagacgttatttttttttttgatatttttttttataaatcggtggcgcggcggaggcggtagagtcgggcgggaagcgcggggtcggtcggggcgttcgtcgttcgtcgtcgttttcgcgcgttcgggggtttcggcgtttttcgagttagggcggttagttcgcggttcgtcgtttgatagatgtttatcgttatggagttgtcgtagtagtatttttgggggttcgggcgagcgacgggagtcgggatttgagcgagcgtcggggttagcggagtcggagtcgtcgggatatgggtgagtacgcgcggcgattttggttcgggagttcgggcgtttagttttttttcgcgtcgcgggttttcgtattttcggaatcgggggcgacgtgtgtgttttgtatgtaaaagtttacgtcgttttgttgggtttttgattttgtattcggcgggaagggggagatcgggtcgagggggcgggatgtcggttcgggcgaggttgtaggagatgggcgcgatttcggcgggtcggcgggtgggcggcgatgttggtttaattggagtggttcgttggtggcggcg

SEQ ID NO: 9106 - DNA, 34 bp, Artificial Sequence
  Description of Artificial Sequence: Synthetic oligonucleotide
cgcgtcgttcgttttcgtttttttcgttttttcg

SEQ ID NO: 9107 - DNA, 14 bp, Artificial Sequence
  Description of Artificial Sequence: Synthetic oligonucleotide
cggcgaggggttcg

SEQ ID NO: 9108 - DNA, 37 bp, Artificial Sequence
  Description of Artificial Sequence: Synthetic oligonucleotide
cgtggcgcgtttattttacggtgttgaagagtagtcg

SEQ ID NO: 9109 - DNA, 34 bp, Artificial Sequence
  Description of Artificial Sequence: Synthetic oligonucleotide
cgggatttgttcgtttttttgtttttggttgtcg

SEQ ID NO: 9110 - DNA, 538 bp, Artificial Sequence
  Description of Artificial Sequence: Synthetic polynucleotide
cgcggggttattttatcgcgagtttttttcgtagttcggttcgggttatttcgattcgttaggtttaatttaataattataatatcggaaaaggaagtaaaggtcgaagtttattcgcggttttgaggtttgtgggaaacgtagtttaataacgaaagagttttgaagtttaagcggagttcgttggtcgtaggggtcgtattacgttttagattttggagttttcgggtgcgtagatttttgttattagtagaggttgtcgttgcgcgttttttaggcgcggaagaggcggttggtggtttttgacggtaaggtgaagtcgaggtagtaatcgggaatttaggttgggaggatagaatggggaataggaagttggggcgagggtggttttgggggaggtggggggtcgcggaattttaggtggtttttgttttatttttggaaagaatcggaagttcgggtcggggagggtgaagggagtcgcggattcggttgtttagtcgaggaggaaattcggattttaggttgagggaggtcg

SEQ ID NO: 9111 - DNA, 109 bp, Artificial Sequence
  Description of Artificial Sequence: Synthetic polynucleotide
cggcgttcggagcgttggattatattttttagaggtatcgttttcggagcgtagttttattttcgttagtttgcgagatttggaggtttcgcgtggggagagggtcgcg

SEQ ID NO: 9112 - DNA, 901 bp, Artificial Sequence
  Description of Artificial Sequence: Synthetic polynucleotide
cgcgcggggtttcggggtcggttttttttcgtcgggcgtttcgggttcgtcgttcgggtttttcgcggatagcggtcggtcgcgtaggtttacggcgcgtattaggtcgttcgttagtttttttagttttttcggtcgtagcgtttcgagtcgcgcggcgtcgcggaacgcgtttagggtttcggggaggcggtcggcgcgggttagcgcgttttttagttttaggtataggtcgcggttcggttgcgttagttcggttagtatggagcgaaagagttcggttgttatttcgtagtcgttcgcgcggaaggtttcgtcgtttttttttaagcgttgggcgatcggtttcgcgcggtcgtagttaggatattggggcggcggcggcggcgggatcggttcggggtttattatcgcggggttgcgacgacgcgggttcggagcgaaggcgcggagtagggaggatgcgttgttgttgggaattggtcggcgggagcgcggttttagttttcgttagtagttacgcgcgtttgggggcggcgcgttgcgagcggttgagatcgcgggcgggggcgggcgtttggtttgggtagcgtttttagcgcggtgtgggcggcgagtttcgtagggttgtaatcgtttcggggtgggggtcgggataggtatcgcgggcgtaatttgagtttttgtttacgcgtagcggttttttagtttcgtcggtttaggtaatttaggtcgttgcggtaacgtagtgatcgcgttttaggttcgcgttttttgcgatgttttttttattcgtttgagggtttttgcgcgattgcgcgcgcgttttttgtttgtcgttttttcgtagaggtgtcggggttttgggagtaggtggttttggtcgcgggttgttggcgcg

SEQ ID NO: 9113 - DNA, 15 bp, Artificial Sequence
  Description of Artificial Sequence: Synthetic oligonucleotide
cgggcggcgcgggcg

SEQ ID NO: 9114 - DNA, 383 bp, Artificial Sequence
  Description of Artificial Sequence: Synthetic polynucleotide
cgggatattttcgaaggcggcgcgttggaggcggggagcggtcggggcgtacggagagggcggggagttcgcgggagggggaggagggggaggagggggaggaggcgcgaggtgggggggagcgcggcgggcggtagggagggagcgggagggaggtaagaaagtagtagaaagtgaggttggtaggcggcggtaaaggagtcggcgcgcggcggcggtaggaagtttgtgttcgagaatagtagaaataagagttagggagggatcgcggtcgcggcggcggcggcgagagcgaaagaggaaattgtagaggaggaagttgcgtcgtagttcgagtcgttcggtattttcgtcgtttttgcgttcgcgtcgcgttttcggcg

SEQ ID NO: 9115 - DNA, 4 bp, Artificial Sequence
  Description of Artificial Sequence: Synthetic oligonucleotide
cgcg

SEQ ID NO: 9116 - DNA, 624 bp, Artificial Sequence
  Description of Artificial Sequence: Synthetic polynucleotide
cgcggaggtgggcgagcgggcgtgcgcgtatttatttgtcggcgcgagggagtgtcgggggggaagggagtggtttttaaaagggggaggggagaaggtagggggcggggagaagtcggttttttaggattcggttgcggcggcgagggaggaggaagaagcggaggaggcggttttcgcgttcgtagggtcgtgttatttgttcgttcgttcgttcgttcgttcgttcgttgcgtcgcgttgtcgatcgttagtatgttgtcgagagtgggttgtttcgcgttgtcgttgtcgtcgtcgtcgttgttgtcgttgttgttgttgttattgggcgcgagtggcggcggcggcggggcgcgcgcggaggtgttgtttcgttgttcgttttgtatattcgagcgtttggtcgtttgcgggttttcgtcggttgcgtcgttcgtcgcggtggtcgtagtggtcggaggcgttcgtatgttatgcgcggagttcgttcgggagtcgggttgcggttgttgttcggtgtgcgttcggttggagggcgaggcgtgcggcgtttatatttcgcgttgcggttaggggttgcgttgttatttttattcgggtttcgagttgtttttgtaggcg

SEQ ID NO: 9117 - DNA, 94 bp, Artificial Sequence
  Description of Artificial Sequence: Synthetic oligonucleotide
cgagatagttagcgagtttaggcggtttttgtagcgttgggagaggaatgtgcgcgaaattaattagagcgaaattagtcggaggagtcggtcg

SEQ ID NO: 9118 - DNA, 63 bp, Artificial Sequence
  Description of Artificial Sequence: Synthetic oligonucleotide
cgtgtagggcgtagagttgggtcgagtcgtcgtcggcgttacgcgagtttcgtagtcgtcgcg

SEQ ID NO: 9119 - DNA, 41 bp, Artificial Sequence
  Description of Artificial Sequence: Synthetic oligonucleotide
cgtcgcggtttttggggttttcgtttttttgttcgttatcg

SEQ ID NO: 9120 - DNA, 1041 bp, Artificial Sequence
  Description of Artificial Sequence: Synthetic polynucleotide
cgcgtagggatcgggtcgggtagagtcgggcggggtggagaggtaagcggagcgcgcggtggggttgaggggaggcgtggggcgagtgttcgttgttcgttttttagtttttttgtttttacgttttttcgttcgtagtcgttcgtagttcggcggtgtagttgtgttggattcggcggcgtcgtagttttttatcgttttttgatgttattggggtgcgggggttcgggcggttcggtgcgcgggttaatagttgtacggttttcgcggtttagcggcgtagggcggggcgcgtttgatagttttttcgtttttcgcgttagttgattggcggttcgagcggtttcggagcggcggaggtttggcggagcgttggagcggagtgggacggttagtttgggtttattttcgtattttgtaggtttcggtttacgtacgttcgtttggagtgcgcgttttatttttaggttaaattatcgttttttttttttcgcgtattttttttttttagttttttttgtattttatttttatttcgtgttatttttaaggaggtttagaatgagcgtcgggataacgttttttgggttttttgtttttaagcggttttcgtttagtgggcgacgttttgtgtgttttcgcggtttttggtcgtgtgtgtcgtgcgtttttgtttttggagatttgcgcgtatttgtatgttggggagggcgggttcgaggtttcgagagttgtgtttagatttaatttttaattttaggggattttttttaggttaagcgagggttttttttggcgggtgtagtcgtagagttttgaggttcgattttattggtttcgtcgtttttcgcgtttattttatcgtataatgtttatagtgaaggcgacgggaaaagtagtagtttaaaggttttgaatttttttttttcgttatacgtacggaattttgagttttcggagtttcggggtcgaggtcggttcgggacggtgtttcgagtagttttttattgttggggagtcggttttgtttttgtttgaacg

SEQ ID NO: 9121 - DNA, 23 bp, Artificial Sequence
  Description of Artificial Sequence: Synthetic oligonucleotide
cgttttcggttcgggttatggcg

SEQ ID NO: 9122 - DNA, 515 bp, Artificial Sequence
  Description of Artificial Sequence: Synthetic polynucleotide
cgtagtagaatattttgatttaaaataaaaatattatgataaaaatattttaggaggtagtcggttttatttcgtttaaagtcggatttcgtttagtttcgtgaaagcgaaggagtattagcgttttttgatttcgtatagttttttcggtagagacggttcgttttttttaagaatcggaagtcggatagcgttaggacgttttattttttttatttgggatttagagaggtagcggttaaggatagggttttcgtcgaggttatcgggtagcgtttaggtttcggtttttgggaggggagtagcgggggaggggtacggggaggggcgagggcggggcgcgtttgggtttcggcgttgggttttttttttgttcgtttcgggggatatttataggatttttgtagatttttgtcgaggtaggatggaggtttgtagggatgtatcgcgggttcgcgattcgggcggtcggaatatagttttttttggtcggagatcggttcggtcgtgagtcg

SEQ ID NO: 9123 - DNA, 1017 bp, Artificial Sequence
  Description of Artificial Sequence: Synthetic polynucleotide
cgggttaggtttgcggaggacgttttcgggcgcgtatatatagttcgaggacgcgttttgtattttaagacgtagggtcggattttatttcgaaatttggtttttatagttttaggtcgaattgtgtttggtttttagttttcgagttcgagttttacgtcgtaaagagatggggttttattgtgtttagttggttttttagtacggacgtgtatttttttttggtttgttttttgttaaaaatcggtagtgcgtttcgtttttttgtttagtcgtagtttgtcgttttttagataaaaagcggcgatcgcggttcggttattcgagtttcgtcgcgttgcgtttttgttgggcggtttatagatggtgtttagtacggggtcgcgtcgagggcgggggcgggaggtcgcgaagagggtcgggcgggaggggaggagacggcggagtagttaattcgcgcgcggtttattagttgatcgtttttgtttatattaggtgtacgtcggttgcggggagtataaagcggggcgtatcgcgggcgtcggtaacgagtcggtgaacgaggcgaggttcgtgcgttcgcggttgtaagcgttcgtttggcggggagaggggtcgacggcgttagttcgggcggcggtatttttaggcgtttggggcgttttttttcggatttggtcgttcgttgtttcgttttttgtattttattttttcgatttttttttttagttttgtttttttttgttttggtttttgagagtcgattgagtttagtttcgtgtagtagcggttgtttgtgtcgtcgtttagttttcggttttggtgttttttcgggggtgttttaaggagttagtgcgcgttgcgggttgggaaggaggcgtcgtttagttagttttttttttttttttcgttttttttttttttttgttgttgttgtcgtcgtcgtcgtcgtgggtgtcgggttcgcgcgtattttaatatttttattagttgggtttcggggtaagtttttggtcg

SEQ ID NO: 9124 - DNA, 8 bp, Artificial Sequence
  Description of Artificial Sequence: Synthetic oligonucleotide
cgcgttcg

SEQ ID NO: 9125 - DNA, 54 bp, Artificial Sequence
  Description of Artificial Sequence: Synthetic oligonucleotide
cgagcgtaggcgggcggagagtagattacgcggaagaggtcgagagagaaagcg

SEQ ID NO: 9126 - DNA, 10 bp, Artificial Sequence
  Description of Artificial Sequence: Synthetic oligonucleotide
cgcgttgtcg

SEQ ID NO: 9127 - DNA, 26 bp, Artificial Sequence
  Description of Artificial Sequence: Synthetic oligonucleotide
cgggtaggttcgattaggcggtcgcg

SEQ ID NO: 9128 - DNA, 934 bp, Artificial Sequence
  Description of Artificial Sequence: Synthetic polynucleotide
cgaatttcggcggtcgtcgcgttttttcgtttcgcggagatcgacgtaggcgttcgttttcgaggtcgaagggtattgggcggcgagggttgcggtagttggcgatttcgggggcgtttgcgcggcgcgcgttagacgaggttgtttcggcggttatttcgcgatttcgcgtcgtcgggatttgcgcgcggagaacgtcggttttggagggagtacgtttttttaaagtgtagaggagggttcggcggcgcgttttcgcggaaattttttttattgtagttatttcggatgtcgatttagtagtttgtttttcgagaaaagagaggggatttgggtagaagggtttcgtttgttttaaaagaaggtgtaaggattagaagataacgaaacgtttattttttgaagggtgggaaaaaaagaaaaagaaaaaggagttatttacgttggagatgttcgttttagatttttttatttttttttttttcgtttcggttttttttttcgaggtttatttaatttgttagagaaggaggaggagtagaagatgggggtcgaggaggaggggaagagaaagagaagtttgttaagaataaagtttttgtcggtaagcgcggggatttcgtagtggagggtattgcggagtttcggggagttatagcgggggtttcgggtttaaatgtttttgttcggagttcgagtcgatatatatatttagttcgatttttttttgttttcggttcgagttttttagtttggttcgtcggttcgtcgttttgtacgttttcgtcggttagttttgttaaagtaaagagttgcgttttttgagttcgttcggtcgaggggaggggacgtttcgagtttggtcgcgtgcgaggtttcgggcgcgttttggtttttcggttcgagagcgcgtagttcgggtttttttttcgcg

SEQ ID NO: 9129 - DNA, 279 bp, Artificial Sequence
  Description of Artificial Sequence: Synthetic polynucleotide
cgcggggtaaggaattcgcgggtagttattttcgttaggggtagggttcggttagttaggcgcgagaaggttaggcgaggtcgattgcgcggggtgaagacgttaggtcgatagttgcgggttttatcgttagttttgacgcgagtttgcgttttggcgacggcggagggcgggtagggggcgcgggcgttgttacggcgtttgtttagaatcggtcgggaacgtcgcgggcgggttttttcggtttttcgtttttttagttttgtttttaggttttcg

SEQ ID NO: 9130 - DNA, 2 bp, Artificial Sequence
  Description of Artificial Sequence: Synthetic oligonucleotide
cg

SEQ ID NO: 9131 - DNA, 9 bp, Artificial Sequence
  Description of Artificial Sequence: Synthetic oligonucleotide
cgtttcgcg

SEQ ID NO: 9132 - DNA, 11 bp, Artificial Sequence
  Description of Artificial Sequence: Synthetic oligonucleotide
cgagcgtatcg

SEQ ID NO: 9133 - DNA, 30 bp, Artificial Sequence
  Description of Artificial Sequence: Synthetic oligonucleotide
cgtttgtaattttagttatttaggaggtcg

SEQ ID NO: 9134 - DNA, 10 bp, Artificial Sequence
  Description of Artificial Sequence: Synthetic oligonucleotide
cgttttcgcg

SEQ ID NO: 9135 - DNA, 56 bp, Artificial Sequence
  Description of Artificial Sequence: Synthetic oligonucleotide
cggcgtttgatgagcggcgggttcggatacgaggggacggggtcgatttgtgggcg

SEQ ID NO: 9136 - DNA, 98 bp, Artificial Sequence
  Description of Artificial Sequence: Synthetic oligonucleotide
cggttagtagggcggggtaggaggttgggagagggacgggtgcgggggtgggggagaggaagggagcggttacgtgtgaggggcggttcgaggttacg

SEQ ID NO: 9137 - DNA, 33 bp, Artificial Sequence
  Description of Artificial Sequence: Synthetic oligonucleotide
cgggaggacgcgtaggggcggtcgtcgtcgtcg

SEQ ID NO: 9138 - DNA, 48 bp, Artificial Sequence
  Description of Artificial Sequence: Synthetic oligonucleotide
cgttttattttttttattatatacgtattttttattttaattttttcg

SEQ ID NO: 9139 - DNA, 93 bp, Artificial Sequence
  Description of Artificial Sequence: Synthetic oligonucleotide
cgatttgtttcggtcgtattcgttttcgttttagtacgcgacgttgttcggcgcgatttttgttttttcggtttagttttatcgttgttttcg

SEQ ID NO: 9140 - DNA, 2 bp, Artificial Sequence
  Description of Artificial Sequence: Synthetic oligonucleotide
cg

SEQ ID NO: 9141 - DNA, 2 bp, Artificial Sequence
  Description of Artificial Sequence: Synthetic oligonucleotide
cg

SEQ ID NO: 9142 - DNA, 2 bp, Artificial Sequence
  Description of Artificial Sequence: Synthetic oligonucleotide
cg

SEQ ID NO: 9143 - DNA, 2 bp, Artificial Sequence
  Description of Artificial Sequence: Synthetic oligonucleotide
cg

SEQ ID NO: 9144 - DNA, 2 bp, Artificial Sequence
  Description of Artificial Sequence: Synthetic oligonucleotide
cg

SEQ ID NO: 9145 - DNA, 2 bp, Artificial Sequence
  Description of Artificial Sequence: Synthetic oligonucleotide
cg

SEQ ID NO: 9146 - DNA, 2 bp, Artificial Sequence
  Description of Artificial Sequence: Synthetic oligonucleotide
cg

SEQ ID NO: 9147 - DNA, 42 bp, Artificial Sequence
  Description of Artificial Sequence: Synthetic oligonucleotide
cggagcgaggcgcgcgttcggttagagagcgagcgcgtaacg

SEQ ID NO: 9148 - DNA, 2 bp, Artificial Sequence
  Description of Artificial Sequence: Synthetic oligonucleotide
cg

SEQ ID NO: 9149 - DNA, 2 bp, Artificial Sequence
  Description of Artificial Sequence: Synthetic oligonucleotide
cg

SEQ ID NO: 9150 - DNA, 2 bp, Artificial Sequence
  Description of Artificial Sequence: Synthetic oligonucleotide
cg

SEQ ID NO: 9151 - DNA, 2 bp, Artificial Sequence
  Description of Artificial Sequence: Synthetic oligonucleotide
cg

SEQ ID NO: 9152 - DNA, 2 bp, Artificial Sequence
  Description of Artificial Sequence: Synthetic oligonucleotide
cg

SEQ ID NO: 9153 - DNA, 2 bp, Artificial Sequence
  Description of Artificial Sequence: Synthetic oligonucleotide
cg

SEQ ID NO: 9154 - DNA, 2 bp, Artificial Sequence
  Description of Artificial Sequence: Synthetic oligonucleotide
cg

SEQ ID NO: 9155 - DNA, 2 bp, Artificial Sequence
  Description of Artificial Sequence: Synthetic oligonucleotide
cg

SEQ ID NO: 9156 - DNA, 2 bp, Artificial Sequence
  Description of Artificial Sequence: Synthetic oligonucleotide
cg

SEQ ID NO: 9157 - DNA, 2 bp, Artificial Sequence
  Description of Artificial Sequence: Synthetic oligonucleotide
cg

SEQ ID NO: 9158 - DNA, 40 bp, Artificial Sequence
  Description of Artificial Sequence: Synthetic oligonucleotide
cggcgtattggcgttgggagtagggtcgtatttcggcgcg

SEQ ID NO: 9159 - DNA, 2 bp, Artificial Sequence
  Description of Artificial Sequence: Synthetic oligonucleotide
cg

SEQ ID NO: 9160 - DNA, 2 bp, Artificial Sequence
  Description of Artificial Sequence: Synthetic oligonucleotide
cg

SEQ ID NO: 9161 - DNA, 2 bp, Artificial Sequence
  Description of Artificial Sequence: Synthetic oligonucleotide
cg

SEQ ID NO: 9162 - DNA, 2 bp, Artificial Sequence
  Description of Artificial Sequence: Synthetic oligonucleotide
cg

SEQ ID NO: 9163 - DNA, 2 bp, Artificial Sequence
  Description of Artificial Sequence: Synthetic oligonucleotide
cg

SEQ ID NO: 9164 - DNA, 2 bp, Artificial Sequence
  Description of Artificial Sequence: Synthetic oligonucleotide
cg

SEQ ID NO: 9165 - DNA, 2 bp, Artificial Sequence
  Description of Artificial Sequence: Synthetic oligonucleotide
cg

SEQ ID NO: 9166 - DNA, 2 bp, Artificial Sequence
  Description of Artificial Sequence: Synthetic oligonucleotide
cg

SEQ ID NO: 9167 - DNA, 2 bp, Artificial Sequence
  Description of Artificial Sequence: Synthetic oligonucleotide
cg

SEQ ID NO: 9168 - DNA, 2 bp, Artificial Sequence
  Description of Artificial Sequence: Synthetic oligonucleotide
cg

SEQ ID NO: 9169 - DNA, 2 bp, Artificial Sequence
  Description of Artificial Sequence: Synthetic oligonucleotide
cg

SEQ ID NO: 9170 - DNA, 2 bp, Artificial Sequence
  Description of Artificial Sequence: Synthetic oligonucleotide
cg

SEQ ID NO: 9171 - DNA, 2 bp, Artificial Sequence
  Description of Artificial Sequence: Synthetic oligonucleotide
cg

SEQ ID NO: 9172 - DNA, 2 bp, Artificial Sequence
  Description of Artificial Sequence: Synthetic oligonucleotide
cg

SEQ ID NO: 9173 - DNA, 2 bp, Artificial Sequence
  Description of Artificial Sequence: Synthetic oligonucleotide
cg

SEQ ID NO: 9174 - DNA, 2 bp, Artificial Sequence
  Description of Artificial Sequence: Synthetic oligonucleotide
cg

SEQ ID NO: 9175 - DNA, 2 bp, Artificial Sequence
  Description of Artificial Sequence: Synthetic oligonucleotide
cg

SEQ ID NO: 9176 - DNA, 2 bp, Artificial Sequence
  Description of Artificial Sequence: Synthetic oligonucleotide
cg

SEQ ID NO: 9177 - DNA, 2 bp, Artificial Sequence
  Description of Artificial Sequence: Synthetic oligonucleotide
cg

SEQ ID NO: 9178 - DNA, 2 bp, Artificial Sequence
  Description of Artificial Sequence: Synthetic oligonucleotide
cg

SEQ ID NO: 9179 - DNA, 2 bp, Artificial Sequence
  Description of Artificial Sequence: Synthetic oligonucleotide
cg

SEQ ID NO: 9180 - DNA, 42 bp, Artificial Sequence
  Description of Artificial Sequence: Synthetic oligonucleotide
cgggcgggcggcgttcggtttgagggagcggggcggttttcg

SEQ ID NO: 9181 - DNA, 2 bp, Artificial Sequence
  Description of Artificial Sequence: Synthetic oligonucleotide
cg

SEQ ID NO: 9182 - DNA, 2 bp, Artificial Sequence
  Description of Artificial Sequence: Synthetic oligonucleotide
cg

SEQ ID NO: 9183 - DNA, 2 bp, Artificial Sequence
  Description of Artificial Sequence: Synthetic oligonucleotide
cg

SEQ ID NO: 9184 - DNA, 2 bp, Artificial Sequence
  Description of Artificial Sequence: Synthetic oligonucleotide
cg

SEQ ID NO: 9185 - DNA, 2 bp, Artificial Sequence
  Description of Artificial Sequence: Synthetic oligonucleotide
cg

SEQ ID NO: 9186 - DNA, 2 bp, Artificial Sequence
  Description of Artificial Sequence: Synthetic oligonucleotide
cg

SEQ ID NO: 9187 - DNA, 2 bp, Artificial Sequence
  Description of Artificial Sequence: Synthetic oligonucleotide
cg

SEQ ID NO: 9188 - DNA, 2 bp, Artificial Sequence
  Description of Artificial Sequence: Synthetic oligonucleotide
cg

SEQ ID NO: 9189 - DNA, 2 bp, Artificial Sequence
  Description of Artificial Sequence: Synthetic oligonucleotide
cg

SEQ ID NO: 9190 - DNA, 2 bp, Artificial Sequence
  Description of Artificial Sequence: Synthetic oligonucleotide
cg

SEQ ID NO: 9191 - DNA, 20 bp, Artificial Sequence
  Description of Artificial Sequence: Synthetic oligonucleotide
ygttygtygygygtattayg

SEQ ID NO: 9192 - DNA, 116 bp, Artificial Sequence
  Description of Artificial Sequence: Synthetic polynucleotide
ygagagyggggyggggttgggggygggyggggagttgtttygggtggtttygtttttagtayggaggatttttttygygaggygtygtygttttggagtttygtttayggygttyg

SEQ ID NO: 9193 - DNA, 2 bp, Artificial Sequence
  Description of Artificial Sequence: Synthetic oligonucleotide
yg

SEQ ID NO: 9194 - DNA, 2 bp, Artificial Sequence
  Description of Artificial Sequence: Synthetic oligonucleotide
yg

SEQ ID NO: 9195 - DNA, 2 bp, Artificial Sequence
  Description of Artificial Sequence: Synthetic oligonucleotide
yg

SEQ ID NO: 9196 - DNA, 2 bp, Artificial Sequence
  Description of Artificial Sequence: Synthetic oligonucleotide
yg

SEQ ID NO: 9197 - DNA, 2 bp, Artificial Sequence
  Description of Artificial Sequence: Synthetic oligonucleotide
yg

SEQ ID NO: 9198 - DNA, 2 bp, Artificial Sequence
  Description of Artificial Sequence: Synthetic oligonucleotide
yg

SEQ ID NO: 9199 - DNA, 2 bp, Artificial Sequence
  Description of Artificial Sequence: Synthetic oligonucleotide
yg

SEQ ID NO: 9200 - DNA, 2 bp, Artificial Sequence
  Description of Artificial Sequence: Synthetic oligonucleotide
yg

SEQ ID NO: 9201 - DNA, 2 bp, Artificial Sequence
  Description of Artificial Sequence: Synthetic oligonucleotide
yg

SEQ ID NO: 9202 - DNA, 2 bp, Artificial Sequence
  Description of Artificial Sequence: Synthetic oligonucleotide
yg

SEQ ID NO: 9203 - DNA, 44 bp, Artificial Sequence
  Description of Artificial Sequence: Synthetic oligonucleotide
yggggggygygtgaggggtgygagyggggttyggggggygygyg

SEQ ID NO: 9204 - DNA, 2 bp, Artificial Sequence
  Description of Artificial Sequence: Synthetic oligonucleotide
yg

SEQ ID NO: 9205 - DNA, 2 bp, Artificial Sequence
  Description of Artificial Sequence: Synthetic oligonucleotide
yg

SEQ ID NO: 9206 - DNA, 2 bp, Artificial Sequence
  Description of Artificial Sequence: Synthetic oligonucleotide
yg

SEQ ID NO: 9207 - DNA, 2 bp, Artificial Sequence
  Description of Artificial Sequence: Synthetic oligonucleotide
yg

SEQ ID NO: 9208 - DNA, 2 bp, Artificial Sequence
  Description of Artificial Sequence: Synthetic oligonucleotide
yg

SEQ ID NO: 9209 - DNA, 2 bp, Artificial Sequence
  Description of Artificial Sequence: Synthetic oligonucleotide
yg

SEQ ID NO: 9210 - DNA, 2 bp, Artificial Sequence
  Description of Artificial Sequence: Synthetic oligonucleotide
yg

SEQ ID NO: 9211 - DNA, 2 bp, Artificial Sequence
  Description of Artificial Sequence: Synthetic oligonucleotide
yg

SEQ ID NO: 9212 - DNA, 2 bp, Artificial Sequence
  Description of Artificial Sequence: Synthetic oligonucleotide
yg

SEQ ID NO: 9213 - DNA, 2 bp, Artificial Sequence
  Description of Artificial Sequence: Synthetic oligonucleotide
yg

SEQ ID NO: 9214 - DNA, 34 bp, Artificial Sequence
  Description of Artificial Sequence: Synthetic oligonucleotide
ygtagttygattttttagagtygtygagtagayg

SEQ ID NO: 9215 - DNA, 2 bp, Artificial Sequence
  Description of Artificial Sequence: Synthetic oligonucleotide
yg

SEQ ID NO: 9216 - DNA, 2 bp, Artificial Sequence
  Description of Artificial Sequence: Synthetic oligonucleotide
yg

SEQ ID NO: 9217 - DNA, 2 bp, Artificial Sequence
  Description of Artificial Sequence: Synthetic oligonucleotide
yg

SEQ ID NO: 9218 - DNA, 2 bp, Artificial Sequence
  Description of Artificial Sequence: Synthetic oligonucleotide
yg

SEQ ID NO: 9219 - DNA, 2 bp, Artificial Sequence
  Description of Artificial Sequence: Synthetic oligonucleotide
yg

SEQ ID NO: 9220 - DNA, 2 bp, Artificial Sequence
  Description of Artificial Sequence: Synthetic oligonucleotide
yg

SEQ ID NO: 9221 - DNA, 2 bp, Artificial Sequence
  Description of Artificial Sequence: Synthetic oligonucleotide
yg

SEQ ID NO: 9222 - DNA, 2 bp, Artificial Sequence
  Description of Artificial Sequence: Synthetic oligonucleotide
yg

SEQ ID NO: 9223 - DNA, 2 bp, Artificial Sequence
  Description of Artificial Sequence: Synthetic oligonucleotide
yg

SEQ ID NO: 9224 - DNA, 2 bp, Artificial Sequence
  Description of Artificial Sequence: Synthetic oligonucleotide
yg

SEQ ID NO: 9225 - DNA, 211 bp, Artificial Sequence
  Description of Artificial Sequence: Synthetic polynucleotide
ygatttyggygggtgtatygtygagtttttygggaagtgtagttttagygygagygggaygttgggaaatgtagttttgygygtttaygttttygatygggtygtgttygtygyggttttgygaggttygaggggtaagggagygtgtagygggggygggattaygaggyggyggggttgggggyggtttttgtgtttgygtyggggatyg

SEQ ID NO: 9226 - DNA, 2 bp, Artificial Sequence
  Description of Artificial Sequence: Synthetic oligonucleotide
yg

SEQ ID NO: 9227 - DNA, 2 bp, Artificial Sequence
  Description of Artificial Sequence: Synthetic oligonucleotide
yg

SEQ ID NO: 9228 - DNA, 2 bp, Artificial Sequence
  Description of Artificial Sequence: Synthetic oligonucleotide
yg

SEQ ID NO: 9229 - DNA, 2 bp, Artificial Sequence
  Description of Artificial Sequence: Synthetic oligonucleotide
yg

SEQ ID NO: 9230 - DNA, 2 bp, Artificial Sequence
  Description of Artificial Sequence: Synthetic oligonucleotide
yg

SEQ ID NO: 9231 - DNA, 2 bp, Artificial Sequence
  Description of Artificial Sequence: Synthetic oligonucleotide
yg

SEQ ID NO: 9232 - DNA, 2 bp, Artificial Sequence
  Description of Artificial Sequence: Synthetic oligonucleotide
yg

SEQ ID NO: 9233 - DNA, 2 bp, Artificial Sequence
  Description of Artificial Sequence: Synthetic oligonucleotide
yg

SEQ ID NO: 9234 - DNA, 2 bp, Artificial Sequence
  Description of Artificial Sequence: Synthetic oligonucleotide
yg

SEQ ID NO: 9235 - DNA, 2 bp, Artificial Sequence
  Description of Artificial Sequence: Synthetic oligonucleotide
yg

SEQ ID NO: 9236 - DNA, 95 bp, Artificial Sequence
  Description of Artificial Sequence: Synthetic oligonucleotide
yggaagtttaagtttaattaattgagttygaggygggagggaagggttttgygygtygtggttygtttygtttttttttygygttttttttttyg

SEQ ID NO: 9237 - DNA, 2 bp, Artificial Sequence
  Description of Artificial Sequence: Synthetic oligonucleotide
yg

SEQ ID NO: 9238 - DNA, 2 bp, Artificial Sequence
  Description of Artificial Sequence: Synthetic oligonucleotide
yg

SEQ ID NO: 9239 - DNA, 2 bp, Artificial Sequence
  Description of Artificial Sequence: Synthetic oligonucleotide
yg

SEQ ID NO: 9240 - DNA, 2 bp, Artificial Sequence
  Description of Artificial Sequence: Synthetic oligonucleotide
yg

SEQ ID NO: 9241 - DNA, 2 bp, Artificial Sequence
  Description of Artificial Sequence: Synthetic oligonucleotide
yg

SEQ ID NO: 9242 - DNA, 2 bp, Artificial Sequence
  Description of Artificial Sequence: Synthetic oligonucleotide
yg

SEQ ID NO: 9243 - DNA, 2 bp, Artificial Sequence
  Description of Artificial Sequence: Synthetic oligonucleotide
yg

SEQ ID NO: 9244 - DNA, 2 bp, Artificial Sequence
  Description of Artificial Sequence: Synthetic oligonucleotide
yg

SEQ ID NO: 9245 - DNA, 2 bp, Artificial Sequence
  Description of Artificial Sequence: Synthetic oligonucleotide
yg

SEQ ID NO: 9246 - DNA, 2 bp, Artificial Sequence
  Description of Artificial Sequence: Synthetic oligonucleotide
yg

SEQ ID NO: 9247 - DNA, 264 bp, Artificial Sequence
  Description of Artificial Sequence: Synthetic polynucleotide
yggyggygtggatyggygaygggtggtatagttggtataygyggtttttttataggtggyggtagayggyggtygggayggygagtaatagggyggttagttagatygttagtagtaggyggygggttagggtygggttgygtagtygaggygttaggaaggggygggtgattgygaggtagygttgtaggttgagtaggtyggtgagtagtaygttggygtatatgttgagygygtataygtagtatatygttttgtagttyg

SEQ ID NO: 9248 - DNA, 2 bp, Artificial Sequence
  Description of Artificial Sequence: Synthetic oligonucleotide
yg

SEQ ID NO: 9249 - DNA, 2 bp, Artificial Sequence
  Description of Artificial Sequence: Synthetic oligonucleotide
yg

SEQ ID NO: 9250 - DNA, 2 bp, Artificial Sequence
  Description of Artificial Sequence: Synthetic oligonucleotide
yg

SEQ ID NO: 9251 - DNA, 2 bp, Artificial Sequence
  Description of Artificial Sequence: Synthetic oligonucleotide
yg

SEQ ID NO: 9252 - DNA, 2 bp, Artificial Sequence
  Description of Artificial Sequence: Synthetic oligonucleotide
yg

SEQ ID NO: 9253 - DNA, 2 bp, Artificial Sequence
  Description of Artificial Sequence: Synthetic oligonucleotide
yg

SEQ ID NO: 9254 - DNA, 2 bp, Artificial Sequence
  Description of Artificial Sequence: Synthetic oligonucleotide
yg

SEQ ID NO: 9255 - DNA, 2 bp, Artificial Sequence
  Description of Artificial Sequence: Synthetic oligonucleotide
yg

SEQ ID NO: 9256 - DNA, 2 bp, Artificial Sequence
  Description of Artificial Sequence: Synthetic oligonucleotide
yg

SEQ ID NO: 9257 - DNA, 2 bp, Artificial Sequence
  Description of Artificial Sequence: Synthetic oligonucleotide
yg

SEQ ID NO: 9258 - DNA, 59 bp, Artificial Sequence
  Description of Artificial Sequence: Synthetic oligonucleotide
ygygygygggygtttyggygtgtyggattatgtygtyggtagtttygggayggggaayg

SEQ ID NO: 9259 - DNA, 2 bp, Artificial Sequence
  Description of Artificial Sequence: Synthetic oligonucleotide
yg

SEQ ID NO: 9260 - DNA, 2 bp, Artificial Sequence
  Description of Artificial Sequence: Synthetic oligonucleotide
yg

SEQ ID NO: 9261 - DNA, 2 bp, Artificial Sequence
  Description of Artificial Sequence: Synthetic oligonucleotide
yg

SEQ ID NO: 9262 - DNA, 2 bp, Artificial Sequence
  Description of Artificial Sequence: Synthetic oligonucleotide
yg

SEQ ID NO: 9263 - DNA, 2 bp, Artificial Sequence
  Description of Artificial Sequence: Synthetic oligonucleotide
yg

SEQ ID NO: 9264 - DNA, 2 bp, Artificial Sequence
  Description of Artificial Sequence: Synthetic oligonucleotide
yg

SEQ ID NO: 9265 - DNA, 2 bp, Artificial Sequence
  Description of Artificial Sequence: Synthetic oligonucleotide
yg

SEQ ID NO: 9266 - DNA, 2 bp, Artificial Sequence
  Description of Artificial Sequence: Synthetic oligonucleotide
yg

SEQ ID NO: 9267 - DNA, 2 bp, Artificial Sequence
  Description of Artificial Sequence: Synthetic oligonucleotide
yg

SEQ ID NO: 9268 - DNA, 2 bp, Artificial Sequence
  Description of Artificial Sequence: Synthetic oligonucleotide
yg

SEQ ID NO: 9269 - DNA, 4 bp, Artificial Sequence
  Description of Artificial Sequence: Synthetic oligonucleotide
ygyg

SEQ ID NO: 9270 - DNA, 2 bp, Artificial Sequence
  Description of Artificial Sequence: Synthetic oligonucleotide
yg

SEQ ID NO: 9271 - DNA, 2 bp, Artificial Sequence
  Description of Artificial Sequence: Synthetic oligonucleotide
yg

SEQ ID NO: 9272 - DNA, 2 bp, Artificial Sequence
  Description of Artificial Sequence: Synthetic oligonucleotide
yg

SEQ ID NO: 9273 - DNA, 2 bp, Artificial Sequence
  Description of Artificial Sequence: Synthetic oligonucleotide
yg

SEQ ID NO: 9274 - DNA, 2 bp, Artificial Sequence
  Description of Artificial Sequence: Synthetic oligonucleotide
yg

SEQ ID NO: 9275 - DNA, 2 bp, Artificial Sequence
  Description of Artificial Sequence: Synthetic oligonucleotide
yg

SEQ ID NO: 9276 - DNA, 2 bp, Artificial Sequence
  Description of Artificial Sequence: Synthetic oligonucleotide
yg

SEQ ID NO: 9277 - DNA, 2 bp, Artificial Sequence
  Description of Artificial Sequence: Synthetic oligonucleotide
yg

SEQ ID NO: 9278 - DNA, 2 bp, Artificial Sequence
  Description of Artificial Sequence: Synthetic oligonucleotide
yg

SEQ ID NO: 9279 - DNA, 2 bp, Artificial Sequence
  Description of Artificial Sequence: Synthetic oligonucleotide
yg

SEQ ID NO: 9280 - DNA, 324 bp, Artificial Sequence
  Description of Artificial Sequence: Synthetic polynucleotide
ygttagatagttagyggtyggyggtaggtygggttatgagyggtaggggtygggtygggtttygttgattttggtttygygyggtagtttttttagttttygtttyggtttttyggtatgagagttygttygggttyggggttgyggttgttttagattygtygtaygttggygygtttygggttygyggagtygyggtgttgatatttgygtygtattgygtygttygttygttygttgtgtgtttygggggygyggttatggaggtggtgggtgatttygagtatagtaagagggatttygtgggatayggggttttygtyg

SEQ ID NO: 9281 - DNA, 2 bp, Artificial Sequence
  Description of Artificial Sequence: Synthetic oligonucleotide
yg

SEQ ID NO: 9282 - DNA, 2 bp, Artificial Sequence
  Description of Artificial Sequence: Synthetic oligonucleotide
yg

SEQ ID NO: 9283 - DNA, 2 bp, Artificial Sequence
  Description of Artificial Sequence: Synthetic oligonucleotide
yg

SEQ ID NO: 9284 - DNA, 2 bp, Artificial Sequence
  Description of Artificial Sequence: Synthetic oligonucleotide
yg

SEQ ID NO: 9285 - DNA, 2 bp, Artificial Sequence
  Description of Artificial Sequence: Synthetic oligonucleotide
yg

SEQ ID NO: 9286 - DNA, 2 bp, Artificial Sequence
  Description of Artificial Sequence: Synthetic oligonucleotide
yg

SEQ ID NO: 9287 - DNA, 2 bp, Artificial Sequence
  Description of Artificial Sequence: Synthetic oligonucleotide
yg

SEQ ID NO: 9288 - DNA, 102 bp, Artificial Sequence
  Description of Artificial Sequence: Synthetic polynucleotide
ygttagttttaggtygagtttygagygtttgtaggaataygtttttttattyggygygggaygtagagttgygagagaattttgtttagygyggatttaayg

SEQ ID NO: 9289 - DNA, 24 bp, Artificial Sequence
  Description of Artificial Sequence: Synthetic oligonucleotide
ygtgggyggtagygagtygttgyg

SEQ ID NO: 9290 - DNA, 521 bp, Artificial Sequence
  Description of Artificial Sequence: Synthetic polynucleotide
ygtatyggtttttttgtttygtattggttgtttygttygtttgttaaggttaggtttggggggttggggttygagtggtygttgggggatagttttgggtataygatyggagygtttttttttttttygtttggttygygtttaggggayggygagagaygyggttttagttttttttttygggygtttygttgyggttagatgtgggyggatgtggaggtygggttatggygaggagggygggygtttagaggggaagagattttttttttttttygggygtagggtttttttgtaggaggttgtatttgggtagttaaataaagttttttgttatygtygtygygygttttgygtttgtaagggttaaayggtagygtaygyggttggtaggtaggatttyggtttgtgggtttaagagtygaggggygtagggygaatatgygagttttatggtattagygagaggttattaatttttatttatygagggtatttttgtagttaatatttttattayg

SEQ ID NO: 9291 - DNA, 1484 bp, Artificial Sequence
  Description of Artificial Sequence: Synthetic polynucleotide
ygtygttattaaygagttattttaattgagttagtatygtygtttattygtyggttygtyggaatygygtttattttttgtaatttygttyggatyggtatttygttttttyggttyggttttttttttttygtygggtgtaaagttaaagatttagtaaggygaygtgaatttttgtatgtagggtatataygtygttttyggtttygggagtgygggggttygyggygyggagggaggttgggygttygggttttygggttaaggtygtygygygtgtttatttatgtttyggyggtttyggtttygttggtttyggygttygtttagatttyggttttygtygttygttygagtttttaaaggtgttgttgyggtaattttatggygatgagtatttgttaaayggygagtygygagttggtygttttagttyggggggygtyggggttttygggygygyggaggyggyggygagyggygggygtttyggtyggtttygygtttttygttygattttgtygttttygtygygttatygatttatggagagagatattaagggggaaaatggygttttyggagttygaggagttttggagtaattatatttatatatataygttygtaygtatatatattygtatatattggtatataggygygyggygagttttgttaattttagtaggagttaaaaaaaattttatatatatatatatatatatatatatatatatattttygttttttygattaatgttttttttttttttgtttttttttttttttttttttttttttttgtttttttttaaaggatgggttggagygttaaaaaatgttggtgggtttgggttygtaggaggyggygygyggagggygagggygtttttgttgagttgtgtagttyggttygttgagttyggyggttttgttygttygttygttygttygyggtygttagtgttgtygtygtygtygtygtygtygtygttgttgttttatggtygygttygtttygygttttygtygygtttygtygtygttygttygygttttyggtgagygttggagtggggtygggttygtgtgtttgtttttygygtttttttygaatttyggatttttagtgaaaggaagggggagggygygggygyggaagggaggtggatyggagyggtagygyggtttagtygaaygggtatygatygttatttygygatttttttygtagggggygtyggygtttaagttgttygttyggagggtttagagtygttttttagattagagtygggggaggygtagttagtagygagttttgagygatttttttttttattygtttttttgttttagtgaatttttgttagttgaagggagyggggtttttgttyggggaaaaggaaaatagttygtggtttgggatttgggattttttgtygtttttagygtttttttygtttttyggygtttttgyg

SEQ ID NO: 9292 - DNA, 34 bp, Artificial Sequence
  Description of Artificial Sequence: Synthetic oligonucleotide
yggggaggyggggggagygggagygggygaygyg

SEQ ID NO: 9293 - DNA, 14 bp, Artificial Sequence
  Description of Artificial Sequence: Synthetic oligonucleotide
ygagtttttygtyg

SEQ ID NO: 9294 - DNA, 37 bp, Artificial Sequence
  Description of Artificial Sequence: Synthetic oligonucleotide
yggttgttttttagtatygtggagtgggygygttayg

SEQ ID NO: 9295 - DNA, 34 bp, Artificial Sequence
  Description of Artificial Sequence: Synthetic oligonucleotide
yggtagttaaagataaagaagyggataaatttyg

SEQ ID NO: 9296 - DNA, 538 bp, Artificial Sequence
  Description of Artificial Sequence: Synthetic polynucleotide
yggttttttttagtttggggttygggtttttttttyggttgagtagtygggttygygattttttttatttttttyggttygggttttyggttttttttagaggtgaggtaggggttatttagaatttygyggttttttattttttttaagattattttygttttagttttttgttttttattttgtttttttaatttgggttttygattattgtttygattttattttgtygttagggattattagtygtttttttygygtttaggggaygygtagyggtagtttttgttgatggtaagggtttgygtattyggaaattttagggtttggggygtggtgyggtttttgyggttagygggtttygtttgagttttagggttttttygttgttggattaygttttttataggttttagggtygyggatgaatttygatttttgttttttttttyggtgttgtggttattgagttaagtttggygagtygaggtgattygggtygggttgygggaggagttygyggtgaggtggtttygyg

SEQ ID NO: 9297 - DNA, 109 bp, Artificial Sequence
  Description of Artificial Sequence: Synthetic polynucleotide
ygyggttttttttttaygygaggtttttaaatttygtaaattaayggaaatgaagttaygtttygggagyggtgtttttgggaaatgtagtttagygtttyggaygtyg

SEQ ID NO: 9298 - DNA, 901 bp, Artificial Sequence
  Description of Artificial Sequence: Synthetic polynucleotide
ygygttagtagttygyggttaaggttatttgtttttagggtttyggtatttttgyggggaggyggtaggtagaggaygygygygtagtygygtaggagtttttaggygagtgggggaagtatygtaagagaygyggatttggagygyggttattgygttatygtagygatttgggttatttaagtyggygggattgagaggtygttgygygtgggtaggggtttagattgygttygyggtgtttgtttyggtttttatttyggaaygattgtagttttgyggggttygtygtttatatygygttgaggaygttgtttaagttaggygttygttttygttygyggttttagtygttygtagygygtygtttttagaygygygtggttgttggygagggttgagatygygttttygtyggttagtttttagtagtagygtattttttttgtttygygttttygtttyggattygygtygtygtagtttygyggtgatgagtttygagtyggtttygtygtygtygtygttttagtgttttggttgygatygygyggagtygatygtttagygtttagaggagggygaygaggtttttygygygggygattaygagatggtagtygagttttttygttttatgttagtygggttggygtagtyggatygyggtttgtgtttgaggttgggggaygygttggttygygtyggtygttttttygaagttttgggygygtttygyggygtygygyggttyggggygttgyggtyggaggagttggaagagttggygggyggtttggtgygygtygtgggtttgygygatyggtygttgttygyggagaattygggyggygagttygaggygttyggygagggagggtyggtttyggagtttygygyg

SEQ ID NO: 9299 - DNA, 15 bp, Artificial Sequence
  Description of Artificial Sequence: Synthetic oligonucleotide
ygttygygtygttyg

SEQ ID NO: 9300 - DNA, 383 bp, Artificial Sequence
  Description of Artificial Sequence: Synthetic polynucleotide
ygtygggggygyggygygggygtagaggyggyggggatgtygggyggttygggttgyggygtagtttttttttttgtagttttttttttygttttygtygtygtygtygyggtygyggtttttttttggtttttatttttgttgttttygggtatagattttttgtygtygtygygygtyggtttttttgtygtygtttgttagttttattttttgttatttttttgtttttttttygttttttttttgtygttygtygygtttttttttatttygygttttttttttttttttttttttttttttttttygygggtttttygtttttttygtgygtttyggtygtttttygtttttagygygtygttttyggggatgtttyg

SEQ ID NO: 9301 - DNA, 4 bp, Artificial Sequence
  Description of Artificial Sequence: Synthetic oligonucleotide
ygyg

SEQ ID NO: 9302 - DNA, 624 bp, Artificial Sequence
  Description of Artificial Sequence: Synthetic polynucleotide
ygtttgtaggggtagttyggagttygggtggggatagtagygtagtttttggtygtagygyggggtgtagaygtygtaygtttygttttttagtygggygtatatygagtagtagtygtagttyggttttyggaygagtttygygtatggtatgygggygttttyggttattgyggttatygyggygggyggygtaatyggygggggttygtaggyggttaggygttygggtgtgtagggygggtagyggaatagtattttygygygygtttygtygtygtygttattygygtttagtagtagtagtagtagyggtagtagyggyggyggyggtagyggtagygyggggtagtttattttyggtagtatgttggyggtyggtagygyggygtggygggygagygagygagygggygggygggtaggtggtayggttttgygagygygggagtygtttttttygttttttttttttttttygtygtygtagtygggttttaaagggtyggttttttttygttttttgttttttttttttttttttttggagattatttttttttttttygatattttttygygtyggtaagtgagtgygygtaygttygttygtttattttygyg

SEQ ID NO: 9303 - DNA, 94 bp, Artificial Sequence
  Description of Artificial Sequence: Synthetic oligonucleotide
yggtyggttttttyggttgatttygttttggttgatttygygtatattttttttttagygttgtaaggatygtttgaattygttggttatttyg

SEQ ID NO: 9304 - DNA, 63 bp, Artificial Sequence
  Description of Artificial Sequence: Synthetic oligonucleotide
ygyggyggttgygggattygygtggygtyggygayggttyggtttagttttgygttttgtayg

SEQ ID NO: 9305 - DNA, 41 bp, Artificial Sequence
  Description of Artificial Sequence: Synthetic oligonucleotide
ygatggyggataagagggyggggattttagaagtygyggyg

SEQ ID NO: 9306 - DNA, 1041 bp, Artificial Sequence
  Description of Artificial Sequence: Synthetic polynucleotide
ygtttaaataaaaatagggtyggttttttagtagtggagagttattyggagtatygtttygggtyggtttyggtttygaggtttygggggtttaggatttygtgygtgtggyggggaagaggaatttagagtttttgggttgttgtttttttygtygtttttattgtgaatattgtgyggtggggtgaaygyggggagyggyggggttagtggagtygaattttagggttttgygattgtattygttaggaggggttttygtttggtttgagaaaggttttttgaggttaagagttgggtttgaatataattttyggagtttygagttygttttttttaatatataaataygygtagatttttagaaataggaaygtaygatatatayggttagaagtygygaggatatatagagygtygtttattgggygggggtygtttgggaataaagggtttaggaggygttgtttyggygtttattttgagtttttttgggggtgataygggatgggggtggggtgtaaagggaattgagggaggagagtgygygaggaggggaaagyggtgatttggtttagaggtggggygygtattttaggygagygtgygtgggtygggatttgtagggtaygggggtgggtttaggttggtygttttatttygttttagygtttygttaggttttygtygtttyggggtygttygggtygttagttagttgaygyggggggygggggagttgttaggygygtttygttttgygtygttgggtygyggaggtygtgtagttattggttygygtatygggtygttygggttttygtattttagtgatattaggaggygataaaaggttgyggygtygtyggatttagtatagttgtatygtygagttgygagyggttgygagygagagagygtaagagtaagagagttagagagygagtaaygggtattygttttaygtttttttttagttttatygygygtttygtttgtttttttatttygttygattttattyggttyggtttttgygyg

SEQ ID NO: 9307 - DNA, 23 bp, Artificial Sequence
  Description of Artificial Sequence: Synthetic oligonucleotide
ygttatggttygagtygaaggyg

SEQ ID NO: 9308 - DNA, 515 bp, Artificial Sequence
  Description of Artificial Sequence: Synthetic polynucleotide
ygatttaygatygggtygattttyggttagaaagaattatgtttyggtygttygggtygygggttygyggtgtatttttgtaggtttttattttgtttyggtagaggtttgtaagaattttgtgggtgtttttyggagygggtagaggaggagtttagygtygaggtttaggygygtttygttttygttttttttygtgtttttttttygttgttttttttttaaaggtygagatttggaygttgttyggtggtttyggygggggttttgtttttggtygttgtttttttgaattttaggtgagaagaataaaaygttttgaygttgttyggttttyggtttttggagaggaygggtygtttttgtygagagaattgtgyggaattaggaagygttggtgttttttygtttttaygggattaagygaaattyggttttaaaygaagtaaagtyggttgttttttggagtatttttgttatagtatttttattttgggttagggtattttgttgyg

SEQ ID NO: 9309 - DNA, 1017 bp, Artificial Sequence
  Description of Artificial Sequence: Synthetic polynucleotide
yggttagggatttatttygaggtttagttggtgggggtgttggggtgygygyggattyggtatttayggyggyggyggyggtagtagtagtaggaggaggagaaagaygaggaggaggaggaggattagttgagyggygttttttttttagttygtagygygtattggttttttggggtattttygggagagtattaagatyggagattaggyggygatataggtaatygttgttgtayggggttgggtttagtyggtttttagaggttagggtagggggaggtaggattgggaaggagggtyggagaagtggggtgtagagggyggggtagygagyggttaggttyggaggaaggygttttaggygtttagggatgtygtygttygggttgaygtygtyggttttttttttygttaggygggygtttgtagtygygggygtaygggtttygtttygtttatyggttygttgtyggygttygyggtgygtttygttttgtgtttttygtagtyggygtgtatttggtgtaagtaaaggyggttagttgatgggtygygygyggattggttgtttygtygtttttttttttttygttygatttttttygyggtttttygttttygttttyggygyggtttygtgttgggtattatttgtggatygtttaataaaggygtagygyggyggggttygggtggtygggtygyggtygtygttttttgtttaggggayggtaggttgyggttgggtagggaggygaagygtattgtyggtttttagtaaaagatagattaaaagaaaatataygttygtgttaggaggttagttaggtataatggggttttatttttttgyggygtagaattygggttygggggttgagaattagatatagttyggtttggggttgtgggagttaagtttyggggtgaaattygattttgygttttaaaatatagggygygttttygggttgtgtgtgygygttygggggygtttttygtagatttggttyg

SEQ ID NO: 9310 - DNA, 8 bp, Artificial Sequence
  Description of Artificial Sequence: Synthetic oligonucleotide
ygagygyg

SEQ ID NO: 9311 - DNA, 54 bp, Artificial Sequence
  Description of Artificial Sequence: Synthetic oligonucleotide
ygttttttttttyggtttttttygygtggtttgtttttygttygtttgygttyg

SEQ ID NO: 9312 - DNA, 10 bp, Artificial Sequence
  Description of Artificial Sequence: Synthetic oligonucleotide
ygataaygyg

SEQ ID NO: 9313 - DNA, 26 bp, Artificial Sequence
  Description of Artificial Sequence: Synthetic oligonucleotide
ygyggtygtttggtygaatttgttyg

SEQ ID NO: 9314 - DNA, 934 bp, Artificial Sequence
  Description of Artificial Sequence: Synthetic polynucleotide
ygyggaggagggattygggttgygygttttygggtygaggaattaggaygygttyggagtttygtaygyggttaagttyggggygtttttttttttyggtygggygaatttaaggggygtagttttttgttttgatagagttggtyggyggaggygtgtagagyggygagtyggygagttaggttgagaaattygagtygggaataaagaggggtyggattgagtgtgtgtgtyggttygagtttygggtagaggtatttgggttygaggttttygttgtgatttttygagatttygtagtgttttttattgyggagttttygygtttgtyggtaaaaattttatttttggtaaatttttttttttttttttttttttttyggtttttattttttgttttttttttttttttagtagattaaatgagtttygagaagaaaaatygaagygaaagggaagaaaataagaagatttaaaayggatatttttagygtgggtggttttttttttttttttttttttttttattttttaggaagtggaygtttygttattttttgatttttgtatttttttttggggtaaayggggtttttttgtttagatttttttttttttttyggaaaataaattattaagtyggtattyggggtaattatagtggagagggttttygyggagaygygtygtyggatttttttttgtattttggggaggygtgttttttttagaatyggygtttttygygygtaaatttyggygaygyggggtygyggggtggtygtyggggtagtttygtttagygygygtygygtagaygttttyggagtygttagttatygtagttttygtygtttagtgtttttyggtttygggggygggygtttgygtyggttttygygaagygggaaagygyggyggtygtygggattyg

SEQ ID NO: 9315 - DNA, 279 bp, Artificial Sequence
  Description of Artificial Sequence: Synthetic polynucleotide
yggaggtttgagagtagggttggaggggyggaggatyggggagattygttygyggygttttyggtyggttttgagtaggygtygtggtagygttygygttttttgttygtttttygtygtygttaggaygtaggttygygttagggttggyggtagggttygtagttgtyggtttggygtttttatttygygtagtyggtttygtttagttttttygygtttgattggtyggattttgtttttggyggaggtaattgttygyggattttttatttygyg

SEQ ID NO: 9316 - DNA, 2 bp, Artificial Sequence
  Description of Artificial Sequence: Synthetic oligonucleotide
yg

SEQ ID NO: 9317 - DNA, 9 bp, Artificial Sequence
  Description of Artificial Sequence: Synthetic oligonucleotide
ygyggggyg

SEQ ID NO: 9318 - DNA, 11 bp, Artificial Sequence
  Description of Artificial Sequence: Synthetic oligonucleotide
ygatgygttyg

SEQ ID NO: 9319 - DNA, 30 bp, Artificial Sequence
  Description of Artificial Sequence: Synthetic oligonucleotide
yggttttttgagtagttgagattataagyg

SEQ ID NO: 9320 - DNA, 10 bp, Artificial Sequence
  Description of Artificial Sequence: Synthetic oligonucleotide
ygygggagyg

SEQ ID NO: 9321 - DNA, 56 bp, Artificial Sequence
  Description of Artificial Sequence: Synthetic oligonucleotide
ygtttataaatyggtttygttttttygtgttygggttygtygtttattagaygtyg

SEQ ID NO: 9322 - DNA, 98 bp, Artificial Sequence
  Description of Artificial Sequence: Synthetic oligonucleotide
ygtgatttygggtygttttttataygtgatygtttttttttttttttttattttygtattygttttttttttagttttttgtttygttttgttggtyg

SEQ ID NO: 9323 - DNA, 33 bp, Artificial Sequence
  Description of Artificial Sequence: Synthetic oligonucleotide
ygayggyggyggtygtttttgygygttttttyg

SEQ ID NO: 9324 - DNA, 48 bp, Artificial Sequence
  Description of Artificial Sequence: Synthetic oligonucleotide
ygaaggaattggggtggggggtgygtgtgtggtggagggggtgggayg

SEQ ID NO: 9325 - DNA, 93 bp, Artificial Sequence
  Description of Artificial Sequence: Synthetic oligonucleotide
ygagggtagyggtggggttgggtygggggagtaggggtygygtygggtagygtygygtgttggagyggaggygggtgyggtyggggtaggtyg

SEQ ID NO: 9326 - DNA, 2 bp, Artificial Sequence
  Description of Artificial Sequence: Synthetic oligonucleotide
yg

SEQ ID NO: 9327 - DNA, 2 bp, Artificial Sequence
  Description of Artificial Sequence: Synthetic oligonucleotide
yg

SEQ ID NO: 9328 - DNA, 2 bp, Artificial Sequence
  Description of Artificial Sequence: Synthetic oligonucleotide
yg

SEQ ID NO: 9329 - DNA, 2 bp, Artificial Sequence
  Description of Artificial Sequence: Synthetic oligonucleotide
yg

SEQ ID NO: 9330 - DNA, 2 bp, Artificial Sequence
  Description of Artificial Sequence: Synthetic oligonucleotide
yg

SEQ ID NO: 9331 - DNA, 2 bp, Artificial Sequence
  Description of Artificial Sequence: Synthetic oligonucleotide
yg

SEQ ID NO: 9332 - DNA, 2 bp, Artificial Sequence
  Description of Artificial Sequence: Synthetic oligonucleotide
yg

SEQ ID NO: 9333 - DNA, 42 bp, Artificial Sequence
  Description of Artificial Sequence: Synthetic oligonucleotide
ygttgygygttygttttttggtygggygygygtttygtttyg

SEQ ID NO: 9334 - DNA, 2 bp, Artificial Sequence
  Description of Artificial Sequence: Synthetic oligonucleotide
yg

SEQ ID NO: 9335 - DNA, 2 bp, Artificial Sequence
  Description of Artificial Sequence: Synthetic oligonucleotide
yg

SEQ ID NO: 9336 - DNA, 2 bp, Artificial Sequence
  Description of Artificial Sequence: Synthetic oligonucleotide
yg

SEQ ID NO: 9337 - DNA, 2 bp, Artificial Sequence
  Description of Artificial Sequence: Synthetic oligonucleotide
yg

SEQ ID NO: 9338 - DNA, 2 bp, Artificial Sequence
  Description of Artificial Sequence: Synthetic oligonucleotide
yg

SEQ ID NO: 9339 - DNA, 2 bp, Artificial Sequence
  Description of Artificial Sequence: Synthetic oligonucleotide
yg

SEQ ID NO: 9340 - DNA, 2 bp, Artificial Sequence
  Description of Artificial Sequence: Synthetic oligonucleotide
yg

SEQ ID NO: 9341 - DNA, 2 bp, Artificial Sequence
  Description of Artificial Sequence: Synthetic oligonucleotide
yg

SEQ ID NO: 9342 - DNA, 2 bp, Artificial Sequence
  Description of Artificial Sequence: Synthetic oligonucleotide
yg

SEQ ID NO: 9343 - DNA, 2 bp, Artificial Sequence
  Description of Artificial Sequence: Synthetic oligonucleotide
yg

SEQ ID NO: 9344 - DNA, 40 bp, Artificial Sequence
  Description of Artificial Sequence: Synthetic oligonucleotide
ygygtyggagtgyggttttgtttttagygttagtgygtyg

SEQ ID NO: 9345 - DNA, 2 bp, Artificial Sequence
  Description of Artificial Sequence: Synthetic oligonucleotide
yg

SEQ ID NO: 9346 - DNA, 2 bp, Artificial Sequence
  Description of Artificial Sequence: Synthetic oligonucleotide
yg

SEQ ID NO: 9347 - DNA, 2 bp, Artificial Sequence
  Description of Artificial Sequence: Synthetic oligonucleotide
yg

SEQ ID NO: 9348 - DNA, 2 bp, Artificial Sequence
  Description of Artificial Sequence: Synthetic oligonucleotide
yg

SEQ ID NO: 9349 - DNA, 2 bp, Artificial Sequence
  Description of Artificial Sequence: Synthetic oligonucleotide
yg

SEQ ID NO: 9350 - DNA, 2 bp, Artificial Sequence
  Description of Artificial Sequence: Synthetic oligonucleotide
yg

SEQ ID NO: 9351 - DNA, 2 bp, Artificial Sequence
  Description of Artificial Sequence: Synthetic oligonucleotide
yg

SEQ ID NO: 9352 - DNA, 2 bp, Artificial Sequence
  Description of Artificial Sequence: Synthetic oligonucleotide
yg

SEQ ID NO: 9353 - DNA, 2 bp, Artificial Sequence
  Description of Artificial Sequence: Synthetic oligonucleotide
yg

SEQ ID NO: 9354 - DNA, 2 bp, Artificial Sequence
  Description of Artificial Sequence: Synthetic oligonucleotide
yg

SEQ ID NO: 9355 - DNA, 2 bp, Artificial Sequence
  Description of Artificial Sequence: Synthetic oligonucleotide
yg

SEQ ID NO: 9356 - DNA, 2 bp, Artificial Sequence
  Description of Artificial Sequence: Synthetic oligonucleotide
yg

SEQ ID NO: 9357 - DNA, 2 bp, Artificial Sequence
  Description of Artificial Sequence: Synthetic oligonucleotide
yg

SEQ ID NO: 9358 - DNA, 2 bp, Artificial Sequence
  Description of Artificial Sequence: Synthetic oligonucleotide
yg

SEQ ID NO: 9359 - DNA, 2 bp, Artificial Sequence
  Description of Artificial Sequence: Synthetic oligonucleotide
yg

SEQ ID NO: 9360 - DNA, 2 bp, Artificial Sequence
  Description of Artificial Sequence: Synthetic oligonucleotide
yg

SEQ ID NO: 9361 - DNA, 2 bp, Artificial Sequence
  Description of Artificial Sequence: Synthetic oligonucleotide
yg

SEQ ID NO: 9362 - DNA, 2 bp, Artificial Sequence
  Description of Artificial Sequence: Synthetic oligonucleotide
yg

SEQ ID NO: 9363 - DNA, 2 bp, Artificial Sequence
  Description of Artificial Sequence: Synthetic oligonucleotide
yg

SEQ ID NO: 9364 - DNA, 2 bp, Artificial Sequence
  Description of Artificial Sequence: Synthetic oligonucleotide
yg

SEQ ID NO: 9365 - DNA, 2 bp, Artificial Sequence
  Description of Artificial Sequence: Synthetic oligonucleotide
yg

SEQ ID NO: 9366 - DNA, 42 bp, Artificial Sequence
  Description of Artificial Sequence: Synthetic oligonucleotide
yggagatygtttygtttttttagatygaaygtygttygttyg

SEQ ID NO: 9367 - DNA, 2 bp, Artificial Sequence
  Description of Artificial Sequence: Synthetic oligonucleotide
yg

SEQ ID NO: 9368 - DNA, 2 bp, Artificial Sequence
  Description of Artificial Sequence: Synthetic oligonucleotide
yg

SEQ ID NO: 9369 - DNA, 2 bp, Artificial Sequence
  Description of Artificial Sequence: Synthetic oligonucleotide
yg

SEQ ID NO: 9370 - DNA, 2 bp, Artificial Sequence
  Description of Artificial Sequence: Synthetic oligonucleotide
yg

SEQ ID NO: 9371 - DNA, 2 bp, Artificial Sequence
  Description of Artificial Sequence: Synthetic oligonucleotide
yg

SEQ ID NO: 9372 - DNA, 2 bp, Artificial Sequence
  Description of Artificial Sequence: Synthetic oligonucleotide
yg

SEQ ID NO: 9373 - DNA, 2 bp, Artificial Sequence
  Description of Artificial Sequence: Synthetic oligonucleotide
yg

SEQ ID NO: 9374 - DNA, 2 bp, Artificial Sequence
  Description of Artificial Sequence: Synthetic oligonucleotide
yg

SEQ ID NO: 9375 - DNA, 2 bp, Artificial Sequence
  Description of Artificial Sequence: Synthetic oligonucleotide
yg

SEQ ID NO: 9376 - DNA, 2 bp, Artificial Sequence
  Description of Artificial Sequence: Synthetic oligonucleotide
yg

SEQ ID NO: 9377 - DNA, 20 bp, Artificial Sequence
  Description of Artificial Sequence: Synthetic oligonucleotide
cgttcgtcgcgcgtattacg

SEQ ID NO: 9378 - DNA, 116 bp, Artificial Sequence
  Description of Artificial Sequence: Synthetic polynucleotide
cgagagcggggcggggttgggggcgggcggggagttgtttcgggtggtttcgtttttagtacggaggatttttttcgcgaggcgtcgtcgttttggagtttcgtttacggcgttcg

SEQ ID NO: 9379 - DNA, 2 bp, Artificial Sequence
  Description of Artificial Sequence: Synthetic oligonucleotide
cg

SEQ ID NO: 9380 - DNA, 2 bp, Artificial Sequence
  Description of Artificial Sequence: Synthetic oligonucleotide
cg

SEQ ID NO: 9381 - DNA, 2 bp, Artificial Sequence
  Description of Artificial Sequence: Synthetic oligonucleotide
cg

SEQ ID NO: 9382 - DNA, 2 bp, Artificial Sequence
  Description of Artificial Sequence: Synthetic oligonucleotide
cg

SEQ ID NO: 9383 - DNA, 2 bp, Artificial Sequence
  Description of Artificial Sequence: Synthetic oligonucleotide
cg

SEQ ID NO: 9384 - DNA, 2 bp, Artificial Sequence
  Description of Artificial Sequence: Synthetic oligonucleotide
cg

SEQ ID NO: 9385 - DNA, 2 bp, Artificial Sequence
  Description of Artificial Sequence: Synthetic oligonucleotide
cg

SEQ ID NO: 9386 - DNA, 2 bp, Artificial Sequence
  Description of Artificial Sequence: Synthetic oligonucleotide
cg

SEQ ID NO: 9387 - DNA, 2 bp, Artificial Sequence
  Description of Artificial Sequence: Synthetic oligonucleotide
cg

SEQ ID NO: 9388 - DNA, 2 bp, Artificial Sequence
  Description of Artificial Sequence: Synthetic oligonucleotide
cg

SEQ ID NO: 9389 - DNA, 44 bp, Artificial Sequence
  Description of Artificial Sequence: Synthetic oligonucleotide
cggggggcgcgtgaggggtgcgagcggggttcggggggcgcgcg

SEQ ID NO: 9390 - DNA, 2 bp, Artificial Sequence
  Description of Artificial Sequence: Synthetic oligonucleotide
cg

SEQ ID NO: 9391 - DNA, 2 bp, Artificial Sequence
  Description of Artificial Sequence: Synthetic oligonucleotide
cg

SEQ ID NO: 9392 - DNA, 2 bp, Artificial Sequence
  Description of Artificial Sequence: Synthetic oligonucleotide
cg

SEQ ID NO: 9393 - DNA, 2 bp, Artificial Sequence
  Description of Artificial Sequence: Synthetic oligonucleotide
cg

SEQ ID NO: 9394 - DNA, 2 bp, Artificial Sequence
  Description of Artificial Sequence: Synthetic oligonucleotide
cg

SEQ ID NO: 9395 - DNA, 2 bp, Artificial Sequence
  Description of Artificial Sequence: Synthetic oligonucleotide
cg

SEQ ID NO: 9396 - DNA, 2 bp, Artificial Sequence
  Description of Artificial Sequence: Synthetic oligonucleotide
cg

SEQ ID NO: 9397 - DNA, 2 bp, Artificial Sequence
  Description of Artificial Sequence: Synthetic oligonucleotide
cg

SEQ ID NO: 9398 - DNA, 2 bp, Artificial Sequence
  Description of Artificial Sequence: Synthetic oligonucleotide
cg

SEQ ID NO: 9399 - DNA, 2 bp, Artificial Sequence
  Description of Artificial Sequence: Synthetic oligonucleotide
cg

SEQ ID NO: 9400 - DNA, 34 bp, Artificial Sequence
  Description of Artificial Sequence: Synthetic oligonucleotide
cgtagttcgattttttagagtcgtcgagtagacg

SEQ ID NO: 9401 - DNA, 2 bp, Artificial Sequence
  Description of Artificial Sequence: Synthetic oligonucleotide
cg

SEQ ID NO: 9402 - DNA, 2 bp, Artificial Sequence
  Description of Artificial Sequence: Synthetic oligonucleotide
cg

SEQ ID NO: 9403 - DNA, 2 bp, Artificial Sequence
  Description of Artificial Sequence: Synthetic oligonucleotide
cg

SEQ ID NO: 9404 - DNA, 2 bp, Artificial Sequence
  Description of Artificial Sequence: Synthetic oligonucleotide
cg

SEQ ID NO: 9405 - DNA, 2 bp, Artificial Sequence
  Description of Artificial Sequence: Synthetic oligonucleotide
cg

SEQ ID NO: 9406 - DNA, 2 bp, Artificial Sequence
  Description of Artificial Sequence: Synthetic oligonucleotide
cg

SEQ ID NO: 9407 - DNA, 2 bp, Artificial Sequence
  Description of Artificial Sequence: Synthetic oligonucleotide
cg

SEQ ID NO: 9408 - DNA, 2 bp, Artificial Sequence
  Description of Artificial Sequence: Synthetic oligonucleotide
cg

SEQ ID NO: 9409 - DNA, 2 bp, Artificial Sequence
  Description of Artificial Sequence: Synthetic oligonucleotide
cg

SEQ ID NO: 9410 - DNA, 2 bp, Artificial Sequence
  Description of Artificial Sequence: Synthetic oligonucleotide
cg

SEQ ID NO: 9411 - DNA, 211 bp, Artificial Sequence
  Description of Artificial Sequence: Synthetic polynucleotide
cgatttcggcgggtgtatcgtcgagtttttcgggaagtgtagttttagcgcgagcgggacgttgggaaatgtagttttgcgcgtttacgttttcgatcgggtcgtgttcgtcgcggttttgcgaggttcgaggggtaagggagcgtgtagcgggggcgggattacgaggcggcggggttgggggcggtttttgtgtttgcgtcggggatcg

SEQ ID NO: 9412 - DNA, 2 bp, Artificial Sequence
  Description of Artificial Sequence: Synthetic oligonucleotide
cg

SEQ ID NO: 9413 - DNA, 2 bp, Artificial Sequence
  Description of Artificial Sequence: Synthetic oligonucleotide
cg

SEQ ID NO: 9414 - DNA, 2 bp, Artificial Sequence
  Description of Artificial Sequence: Synthetic oligonucleotide
cg

SEQ ID NO: 9415 - DNA, 2 bp, Artificial Sequence
  Description of Artificial Sequence: Synthetic oligonucleotide
cg

SEQ ID NO: 9416 - DNA, 2 bp, Artificial Sequence
  Description of Artificial Sequence: Synthetic oligonucleotide
cg

SEQ ID NO: 9417 - DNA, 2 bp, Artificial Sequence
  Description of Artificial Sequence: Synthetic oligonucleotide
cg

SEQ ID NO: 9418 - DNA, 2 bp, Artificial Sequence
  Description of Artificial Sequence: Synthetic oligonucleotide
cg

SEQ ID NO: 9419 - DNA, 2 bp, Artificial Sequence
  Description of Artificial Sequence: Synthetic oligonucleotide
cg

SEQ ID NO: 9420 - DNA, 2 bp, Artificial Sequence
  Description of Artificial Sequence: Synthetic oligonucleotide
cg

SEQ ID NO: 9421 - DNA, 2 bp, Artificial Sequence
  Description of Artificial Sequence: Synthetic oligonucleotide
cg

SEQ ID NO: 9422 - DNA, 95 bp, Artificial Sequence
  Description of Artificial Sequence: Synthetic oligonucleotide
cggaagtttaagtttaattaattgagttcgaggcgggagggaagggttttgcgcgtcgtggttcgtttcgtttttttttcgcgttttttttttcg

SEQ ID NO: 9423 - DNA, 2 bp, Artificial Sequence
  Description of Artificial Sequence: Synthetic oligonucleotide
cg

SEQ ID NO: 9424 - DNA, 2 bp, Artificial Sequence
  Description of Artificial Sequence: Synthetic oligonucleotide
cg

SEQ ID NO: 9425 - DNA, 2 bp, Artificial Sequence
  Description of Artificial Sequence: Synthetic oligonucleotide
cg

SEQ ID NO: 9426 - DNA, 2 bp, Artificial Sequence
  Description of Artificial Sequence: Synthetic oligonucleotide
cg

SEQ ID NO: 9427 - DNA, 2 bp, Artificial Sequence
  Description of Artificial Sequence: Synthetic oligonucleotide
cg

SEQ ID NO: 9428 - DNA, 2 bp, Artificial Sequence
  Description of Artificial Sequence: Synthetic oligonucleotide
cg

SEQ ID NO: 9429 - DNA, 2 bp, Artificial Sequence
  Description of Artificial Sequence: Synthetic oligonucleotide
cg

SEQ ID NO: 9430 - DNA, 2 bp, Artificial Sequence
  Description of Artificial Sequence: Synthetic oligonucleotide
cg

SEQ ID NO: 9431 - DNA, 2 bp, Artificial Sequence
  Description of Artificial Sequence: Synthetic oligonucleotide
cg

SEQ ID NO: 9432 - DNA, 2 bp, Artificial Sequence
  Description of Artificial Sequence: Synthetic oligonucleotide
cg

SEQ ID NO: 9433 - DNA, 264 bp, Artificial Sequence
  Description of Artificial Sequence: Synthetic polynucleotide
cggcggcgtggatcggcgacgggtggtatagttggtatacgcggtttttttataggtggcggtagacggcggtcgggacggcgagtaatagggcggttagttagatcgttagtagtaggcggcgggttagggtcgggttgcgtagtcgaggcgttaggaaggggcgggtgattgcgaggtagcgttgtaggttgagtaggtcggtgagtagtacgttggcgtatatgttgagcgcgtatacgtagtatatcgttttgtagttcg

SEQ ID NO: 9434 - DNA, 2 bp, Artificial Sequence
  Description of Artificial Sequence: Synthetic oligonucleotide
cg

SEQ ID NO: 9435 - DNA, 2 bp, Artificial Sequence
  Description of Artificial Sequence: Synthetic oligonucleotide
cg

SEQ ID NO: 9436 - DNA, 2 bp, Artificial Sequence
  Description of Artificial Sequence: Synthetic oligonucleotide
cg

SEQ ID NO: 9437 - DNA, 2 bp, Artificial Sequence
  Description of Artificial Sequence: Synthetic oligonucleotide
cg

SEQ ID NO: 9438 - DNA, 2 bp, Artificial Sequence
  Description of Artificial Sequence: Synthetic oligonucleotide
cg

SEQ ID NO: 9439 - DNA, 2 bp, Artificial Sequence
  Description of Artificial Sequence: Synthetic oligonucleotide
cg

SEQ ID NO: 9440 - DNA, 2 bp, Artificial Sequence
  Description of Artificial Sequence: Synthetic oligonucleotide
cg

SEQ ID NO: 9441 - DNA, 2 bp, Artificial Sequence
  Description of Artificial Sequence: Synthetic oligonucleotide
cg

SEQ ID NO: 9442 - DNA, 2 bp, Artificial Sequence
  Description of Artificial Sequence: Synthetic oligonucleotide
cg

SEQ ID NO: 9443 - DNA, 2 bp, Artificial Sequence
  Description of Artificial Sequence: Synthetic oligonucleotide
cg

SEQ ID NO: 9444 - DNA, 59 bp, Artificial Sequence
  Description of Artificial Sequence: Synthetic oligonucleotide
cgcgcgcgggcgtttcggcgtgtcggattatgtcgtcggtagtttcgggacggggaacg

SEQ ID NO: 9445 - DNA, 2 bp, Artificial Sequence
  Description of Artificial Sequence: Synthetic oligonucleotide
cg

SEQ ID NO: 9446 - DNA, 2 bp, Artificial Sequence
  Description of Artificial Sequence: Synthetic oligonucleotide
cg

SEQ ID NO: 9447 - DNA, 2 bp, Artificial Sequence
  Description of Artificial Sequence: Synthetic oligonucleotide
cg

SEQ ID NO: 9448 - DNA, 2 bp, Artificial Sequence
  Description of Artificial Sequence: Synthetic oligonucleotide
cg

SEQ ID NO: 9449 - DNA, 2 bp, Artificial Sequence
  Description of Artificial Sequence: Synthetic oligonucleotide
cg

SEQ ID NO: 9450 - DNA, 2 bp, Artificial Sequence
  Description of Artificial Sequence: Synthetic oligonucleotide
cg

SEQ ID NO: 9451 - DNA, 2 bp, Artificial Sequence
  Description of Artificial Sequence: Synthetic oligonucleotide
cg

SEQ ID NO: 9452 - DNA, 2 bp, Artificial Sequence
  Description of Artificial Sequence: Synthetic oligonucleotide
cg

SEQ ID NO: 9453 - DNA, 2 bp, Artificial Sequence
  Description of Artificial Sequence: Synthetic oligonucleotide
cg

SEQ ID NO: 9454 - DNA, 2 bp, Artificial Sequence
  Description of Artificial Sequence: Synthetic oligonucleotide
cg

SEQ ID NO: 9455 - DNA, 4 bp, Artificial Sequence
  Description of Artificial Sequence: Synthetic oligonucleotide
cgcg

SEQ ID NO: 9456 - DNA, 2 bp, Artificial Sequence
  Description of Artificial Sequence: Synthetic oligonucleotide
cg

SEQ ID NO: 9457 - DNA, 2 bp, Artificial Sequence
  Description of Artificial Sequence: Synthetic oligonucleotide
cg

SEQ ID NO: 9458 - DNA, 2 bp, Artificial Sequence
  Description of Artificial Sequence: Synthetic oligonucleotide
cg

SEQ ID NO: 9459 - DNA, 2 bp, Artificial Sequence
  Description of Artificial Sequence: Synthetic oligonucleotide
cg

SEQ ID NO: 9460 - DNA, 2 bp, Artificial Sequence
  Description of Artificial Sequence: Synthetic oligonucleotide
cg

SEQ ID NO: 9461 - DNA, 2 bp, Artificial Sequence
  Description of Artificial Sequence: Synthetic oligonucleotide
cg

SEQ ID NO: 9462 - DNA, 2 bp, Artificial Sequence
  Description of Artificial Sequence: Synthetic oligonucleotide
cg

SEQ ID NO: 9463 - DNA, 2 bp, Artificial Sequence
  Description of Artificial Sequence: Synthetic oligonucleotide
cg

SEQ ID NO: 9464 - DNA, 2 bp, Artificial Sequence
  Description of Artificial Sequence: Synthetic oligonucleotide
cg

SEQ ID NO: 9465 - DNA, 2 bp, Artificial Sequence
  Description of Artificial Sequence: Synthetic oligonucleotide
cg

SEQ ID NO: 9466 - DNA, 324 bp, Artificial Sequence
  Description of Artificial Sequence: Synthetic polynucleotide
cgttagatagttagcggtcggcggtaggtcgggttatgagcggtaggggtcgggtcgggtttcgttgattttggtttcgcgcggtagtttttttagttttcgtttcggtttttcggtatgagagttcgttcgggttcggggttgcggttgttttagattcgtcgtacgttggcgcgtttcgggttcgcggagtcgcggtgttgatatttgcgtcgtattgcgtcgttcgttcgttcgttgtgtgtttcgggggcgcggttatggaggtggtgggtgatttcgagtatagtaagagggatttcgtgggatacggggttttcgtcg

SEQ ID NO: 9467 - DNA, 2 bp, Artificial Sequence
  Description of Artificial Sequence: Synthetic oligonucleotide
cg

SEQ ID NO: 9468 - DNA, 2 bp, Artificial Sequence
  Description of Artificial Sequence: Synthetic oligonucleotide
cg

SEQ ID NO: 9469 - DNA, 2 bp, Artificial Sequence
  Description of Artificial Sequence: Synthetic oligonucleotide
cg

SEQ ID NO: 9470 - DNA, 2 bp, Artificial Sequence
  Description of Artificial Sequence: Synthetic oligonucleotide
cg

SEQ ID NO: 9471 - DNA, 2 bp, Artificial Sequence
  Description of Artificial Sequence: Synthetic oligonucleotide
cg

SEQ ID NO: 9472 - DNA, 2 bp, Artificial Sequence
  Description of Artificial Sequence: Synthetic oligonucleotide
cg

SEQ ID NO: 9473 - DNA, 2 bp, Artificial Sequence
  Description of Artificial Sequence: Synthetic oligonucleotide
cg

SEQ ID NO: 9474 - DNA, 102 bp, Artificial Sequence
  Description of Artificial Sequence: Synthetic polynucleotide
cgttagttttaggtcgagtttcgagcgtttgtaggaatacgtttttttattcggcgcgggacgtagagttgcgagagaattttgtttagcgcggatttaacg

SEQ ID NO: 9475 - DNA, 24 bp, Artificial Sequence
  Description of Artificial Sequence: Synthetic oligonucleotide
cgtgggcggtagcgagtcgttgcg

SEQ ID NO: 9476 - DNA, 521 bp, Artificial Sequence
  Description of Artificial Sequence: Synthetic polynucleotide
cgtatcggtttttttgtttcgtattggttgtttcgttcgtttgttaaggttaggtttggggggttggggttcgagtggtcgttgggggatagttttgggtatacgatcggagcgtttttttttttttcgtttggttcgcgtttaggggacggcgagagacgcggttttagttttttttttcgggcgtttcgttgcggttagatgtgggcggatgtggaggtcgggttatggcgaggagggcgggcgtttagaggggaagagattttttttttttttcgggcgtagggtttttttgtaggaggttgtatttgggtagttaaataaagttttttgttatcgtcgtcgcgcgttttgcgtttgtaagggttaaacggtagcgtacgcggttggtaggtaggatttcggtttgtgggtttaagagtcgaggggcgtagggcgaatatgcgagttttatggtattagcgagaggttattaatttttatttatcgagggtatttttgtagttaatatttttattacg

SEQ ID NO: 9477 - DNA, 1484 bp, Artificial Sequence
  Description of Artificial Sequence: Synthetic polynucleotide
cgtcgttattaacgagttattttaattgagttagtatcgtcgtttattcgtcggttcgtcggaatcgcgtttattttttgtaatttcgttcggatcggtatttcgttttttcggttcggttttttttttttcgtcgggtgtaaagttaaagatttagtaaggcgacgtgaatttttgtatgtagggtatatacgtcgttttcggtttcgggagtgcgggggttcgcggcgcggagggaggttgggcgttcgggttttcgggttaaggtcgtcgcgcgtgtttatttatgtttcggcggtttcggtttcgttggtttcggcgttcgtttagatttcggttttcgtcgttcgttcgagtttttaaaggtgttgttgcggtaattttatggcgatgagtatttgttaaacggcgagtcgcgagttggtcgttttagttcggggggcgtcggggttttcgggcgcgcggaggcggcggcgagcggcgggcgtttcggtcggtttcgcgtttttcgttcgattttgtcgttttcgtcgcgttatcgatttatggagagagatattaagggggaaaatggcgttttcggagttcgaggagttttggagtaattatatttatatatatacgttcgtacgtatatatattcgtatatattggtatataggcgcgcggcgagttttgttaattttagtaggagttaaaaaaaattttatatatatatatatatatatatatatatatatattttcgttttttcgattaatgttttttttttttttgtttttttttttttttttttttttttttttgtttttttttaaaggatgggttggagcgttaaaaaatgttggtgggtttgggttcgtaggaggcggcgcgcggagggcgagggcgtttttgttgagttgtgtagttcggttcgttgagttcggcggttttgttcgttcgttcgttcgttcgcggtcgttagtgttgtcgtcgtcgtcgtcgtcgtcgtcgttgttgttttatggtcgcgttcgtttcgcgttttcgtcgcgtttcgtcgtcgttcgttcgcgttttcggtgagcgttggagtggggtcgggttcgtgtgtttgtttttcgcgtttttttcgaatttcggatttttagtgaaaggaagggggagggcgcgggcgcggaagggaggtggatcggagcggtagcgcggtttagtcgaacgggtatcgatcgttatttcgcgatttttttcgtagggggcgtcggcgtttaagttgttcgttcggagggtttagagtcgttttttagattagagtcgggggaggcgtagttagtagcgagttttgagcgatttttttttttattcgtttttttgttttagtgaatttttgttagttgaagggagcggggtttttgttcggggaaaaggaaaatagttcgtggtttgggatttgggattttttgtcgtttttagcgtttttttcgtttttcggcgtttttgcg

SEQ ID NO: 9478 - DNA, 34 bp, Artificial Sequence; identical to SEQ ID NO: 8734
  Description of Artificial Sequence: Synthetic oligonucleotide

SEQ ID NO: 9479 - DNA, 14 bp, Artificial Sequence
  Description of Artificial Sequence: Synthetic oligonucleotide
cgagtttttcgtcg

SEQ ID NO: 9480 - DNA, 37 bp, Artificial Sequence
  Description of Artificial Sequence: Synthetic oligonucleotide
cggttgttttttagtatcgtggagtgggcgcgttacg

SEQ ID NO: 9481 - DNA, 34 bp, Artificial Sequence
  Description of Artificial Sequence: Synthetic oligonucleotide
cggtagttaaagataaagaagcggataaatttcg

SEQ ID NO: 9482 - DNA, 538 bp, Artificial Sequence
  Description of Artificial Sequence: Synthetic polynucleotide
cggttttttttagtttggggttcgggtttttttttcggttgagtagtcgggttcgcgattttttttatttttttcggttcgggttttcggttttttttagaggtgaggtaggggttatttagaatttcgcggttttttattttttttaagattattttcgttttagttttttgttttttattttgtttttttaatttgggttttcgattattgtttcgattttattttgtcgttagggattattagtcgtttttttcgcgtttaggggacgcgtagcggtagtttttgttgatggtaagggtttgcgtattcggaaattttagggtttggggcgtggtgcggtttttgcggttagcgggtttcgtttgagttttagggttttttcgttgttggattacgttttttataggttttagggtcgcggatgaatttcgatttttgttttttttttcggtgttgtggttattgagttaagtttggcgagtcgaggtgattcgggtcgggttgcgggaggagttcgcggtgaggtggtttcgcg

SEQ ID NO: 9483 - DNA, 109 bp, Artificial Sequence
  Description of Artificial Sequence: Synthetic polynucleotide
cgcggttttttttttacgcgaggtttttaaatttcgtaaattaacggaaatgaagttacgtttcgggagcggtgtttttgggaaatgtagtttagcgtttcggacgtcg

SEQ ID NO: 9484 - DNA, 901 bp, Artificial Sequence
  Description of Artificial Sequence: Synthetic polynucleotide
cgcgttagtagttcgcggttaaggttatttgtttttagggtttcggtatttttgcggggaggcggtaggtagaggacgcgcgcgtagtcgcgtaggagtttttaggcgagtgggggaagtatcgtaagagacgcggatttggagcgcggttattgcgttatcgtagcgatttgggttatttaagtcggcgggattgagaggtcgttgcgcgtgggtaggggtttagattgcgttcgcggtgtttgtttcggtttttatttcggaacgattgtagttttgcggggttcgtcgtttatatcgcgttgaggacgttgtttaagttaggcgttcgttttcgttcgcggttttagtcgttcgtagcgcgtcgtttttagacgcgcgtggttgttggcgagggttgagatcgcgttttcgtcggttagtttttagtagtagcgtattttttttgtttcgcgttttcgtttcggattcgcgtcgtcgtagtttcgcggtgatgagtttcgagtcggtttcgtcgtcgtcgtcgttttagtgttttggttgcgatcgcgcggagtcgatcgtttagcgtttagaggagggcgacgaggtttttcgcgcgggcgattacgagatggtagtcgagttttttcgttttatgttagtcgggttggcgtagtcggatcgcggtttgtgtttgaggttgggggacgcgttggttcgcgtcggtcgttttttcgaagttttgggcgcgtttcgcggcgtcgcgcggttcggggcgttgcggtcggaggagttggaagagttggcgggcggtttggtgcgcgtcgtgggtttgcgcgatcggtcgttgttcgcggagaattcgggcggcgagttcgaggcgttcggcgagggagggtcggtttcggagtttcgcgcg

SEQ ID NO: 9485 - DNA, 15 bp, Artificial Sequence
  Description of Artificial Sequence: Synthetic oligonucleotide
cgttcgcgtcgttcg

SEQ ID NO: 9486 - DNA, 383 bp, Artificial Sequence
  Description of Artificial Sequence: Synthetic polynucleotide
cgtcgggggcgcggcgcgggcgtagaggcggcggggatgtcgggcggttcgggttgcggcgtagtttttttttttgtagttttttttttcgttttcgtcgtcgtcgtcgcggtcgcggtttttttttggtttttatttttgttgttttcgggtatagattttttgtcgtcgtcgcgcgtcggtttttttgtcgtcgtttgttagttttattttttgttatttttttgtttttttttcgttttttttttgtcgttcgtcgcgtttttttttatttcgcgttttttttttttttttttttttttttttttttcgcgggtttttcgtttttttcgtgcgtttcggtcgtttttcgtttttagcgcgtcgttttcggggatgtttcg

SEQ ID NO: 9487 - DNA, 4 bp, Artificial Sequence
  Description of Artificial Sequence: Synthetic oligonucleotide
cgcg

SEQ ID NO: 9488 - DNA, 624 bp, Artificial Sequence
  Description of Artificial Sequence: Synthetic polynucleotide
cgtttgtaggggtagttcggagttcgggtggggatagtagcgtagtttttggtcgtagcgcggggtgtagacgtcgtacgtttcgttttttagtcgggcgtatatcgagtagtagtcgtagttcggttttcggacgagtttcgcgtatggtatgcgggcgttttcggttattgcggttatcgcggcgggcggcgtaatcggcgggggttcgtaggcggttaggcgttcgggtgtgtagggcgggtagcggaatagtattttcgcgcgcgtttcgtcgtcgtcgttattcgcgtttagtagtagtagtagtagcggtagtagcggcggcggcggtagcggtagcgcggggtagtttattttcggtagtatgttggcggtcggtagcgcggcgtggcgggcgagcgagcgagcgggcgggcgggtaggtggtacggttttgcgagcgcgggagtcgtttttttcgttttttttttttttttcgtcgtcgtagtcgggttttaaagggtcggttttttttcgttttttgttttttttttttttttttttggagattatttttttttttttcgatattttttcgcgtcggtaagtgagtgcgcgtacgttcgttcgtttattttcgcg

SEQ ID NO: 9489 - DNA, 94 bp, Artificial Sequence
  Description of Artificial Sequence: Synthetic oligonucleotide
cggtcggttttttcggttgatttcgttttggttgatttcgcgtatattttttttttagcgttgtaaggatcgtttgaattcgttggttatttcg

SEQ ID NO: 9490 - DNA, 63 bp, Artificial Sequence
  Description of Artificial Sequence: Synthetic oligonucleotide
cgcggcggttgcgggattcgcgtggcgtcggcgacggttcggtttagttttgcgttttgtacg

SEQ ID NO: 9491 - DNA, 41 bp, Artificial Sequence
  Description of Artificial Sequence: Synthetic oligonucleotide
cgatggcggataagagggcggggattttagaagtcgcggcg

SEQ ID NO: 9492 - DNA, 1041 bp, Artificial Sequence
  Description of Artificial Sequence: Synthetic polynucleotide
cgtttaaataaaaatagggtcggttttttagtagtggagagttattcggagtatcgtttcgggtcggtttcggtttcgaggtttcgggggtttaggatttcgtgcgtgtggcggggaagaggaatttagagtttttgggttgttgtttttttcgtcgtttttattgtgaatattgtgcggtggggtgaacgcggggagcggcggggttagtggagtcgaattttagggttttgcgattgtattcgttaggaggggttttcgtttggtttgagaaaggttttttgaggttaagagttgggtttgaatataattttcggagtttcgagttcgttttttttaatatataaatacgcgtagatttttagaaataggaacgtacgatatatacggttagaagtcgcgaggatatatagagcgtcgtttattgggcgggggtcgtttgggaataaagggtttaggaggcgttgtttcggcgtttattttgagtttttttgggggtgatacgggatgggggtggggtgtaaagggaattgagggaggagagtgcgcgaggaggggaaagcggtgatttggtttagaggtggggcgcgtattttaggcgagcgtgcgtgggtcgggatttgtagggtacgggggtgggtttaggttggtcgttttatttcgttttagcgtttcgttaggttttcgtcgtttcggggtcgttcgggtcgttagttagttgacgcggggggcgggggagttgttaggcgcgtttcgttttgcgtcgttgggtcgcggaggtcgtgtagttattggttcgcgtatcgggtcgttcgggttttcgtattttagtgatattaggaggcgataaaaggttgcggcgtcgtcggatttagtatagttgtatcgtcgagttgcgagcggttgcgagcgagagagcgtaagagtaagagagttagagagcgagtaacgggtattcgttttacgtttttttttagttttatcgcgcgtttcgtttgtttttttatttcgttcgattttattcggttcggtttttgcgcg

SEQ ID NO: 9493 - DNA, 23 bp, Artificial Sequence
  Description of Artificial Sequence: Synthetic oligonucleotide
cgttatggttcgagtcgaaggcg

SEQ ID NO: 9494 - DNA, 515 bp, Artificial Sequence
  Description of Artificial Sequence: Synthetic polynucleotide
cgatttacgatcgggtcgattttcggttagaaagaattatgtttcggtcgttcgggtcgcgggttcgcggtgtatttttgtaggtttttattttgtttcggtagaggtttgtaagaattttgtgggtgtttttcggagcgggtagaggaggagtttagcgtcgaggtttaggcgcgtttcgttttcgttttttttcgtgtttttttttcgttgttttttttttaaaggtcgagatttggacgttgttcggtggtttcggcgggggttttgtttttggtcgttgtttttttgaattttaggtgagaagaataaaacgttttgacgttgttcggttttcggtttttggagaggacgggtcgtttttgtcgagagaattgtgcggaattaggaagcgttggtgttttttcgtttttacgggattaagcgaaattcggttttaaacgaagtaaagtcggttgttttttggagtatttttgttatagtatttttattttgggttagggtattttgttgcg

SEQ ID NO: 9495 - DNA, 1017 bp, Artificial Sequence
  Description of Artificial Sequence: Synthetic polynucleotide
cggttagggatttatttcgaggtttagttggtgggggtgttggggtgcgcgcggattcggtatttacggcggcggcggcggtagtagtagtaggaggaggagaaagacgaggaggaggaggaggattagttgagcggcgttttttttttagttcgtagcgcgtattggttttttggggtattttcgggagagtattaagatcggagattaggcggcgatataggtaatcgttgttgtacggggttgggtttagtcggtttttagaggttagggtagggggaggtaggattgggaaggagggtcggagaagtggggtgtagagggcggggtagcgagcggttaggttcggaggaaggcgttttaggcgtttagggatgtcgtcgttcgggttgacgtcgtcggttttttttttcgttaggcgggcgtttgtagtcgcgggcgtacgggtttcgtttcgtttatcggttcgttgtcggcgttcgcggtgcgtttcgttttgtgtttttcgtagtcggcgtgtatttggtgtaagtaaaggcggttagttgatgggtcgcgcgcggattggttgtttcgtcgtttttttttttttcgttcgatttttttcgcggtttttcgttttcgttttcggcgcggtttcgtgttgggtattatttgtggatcgtttaataaaggcgtagcgcggcggggttcgggtggtcgggtcgcggtcgtcgttttttgtttaggggacggtaggttgcggttgggtagggaggcgaagcgtattgtcggtttttagtaaaagatagattaaaagaaaatatacgttcgtgttaggaggttagttaggtataatggggttttatttttttgcggcgtagaattcgggttcgggggttgagaattagatatagttcggtttggggttgtgggagttaagtttcggggtgaaattcgattttgcgttttaaaatatagggcgcgttttcgggttgtgtgtgcgcgttcgggggcgtttttcgtagatttggttcg

SEQ ID NO: 9496 - DNA, 8 bp, Artificial Sequence
  Description of Artificial Sequence: Synthetic oligonucleotide
cgagcgcg

SEQ ID NO: 9497 - DNA, 54 bp, Artificial Sequence
  Description of Artificial Sequence: Synthetic oligonucleotide
cgttttttttttcggtttttttcgcgtggtttgtttttcgttcgtttgcgttcg

SEQ ID NO: 9498 - DNA, 10 bp, Artificial Sequence
  Description of Artificial Sequence: Synthetic oligonucleotide
cgataacgcg

SEQ ID NO: 9499 - DNA, 26 bp, Artificial Sequence
  Description of Artificial Sequence: Synthetic oligonucleotide
cgcggtcgtttggtcgaatttgttcg

SEQ ID NO: 9500 - DNA, 934 bp, Artificial Sequence
  Description of Artificial Sequence: Synthetic polynucleotide
cgcggaggagggattcgggttgcgcgttttcgggtcgaggaattaggacgcgttcggagtttcgtacgcggttaagttcggggcgtttttttttttcggtcgggcgaatttaaggggcgtagttttttgttttgatagagttggtcggcggaggcgtgtagagcggcgagtcggcgagttaggttgagaaattcgagtcgggaataaagaggggtcggattgagtgtgtgtgtcggttcgagtttcgggtagaggtatttgggttcgaggttttcgttgtgatttttcgagatttcgtagtgttttttattgcggagttttcgcgtttgtcggtaaaaattttatttttggtaaatttttttttttttttttttttttttcggtttttattttttgttttttttttttttttagtagattaaatgagtttcgagaagaaaaatcgaagcgaaagggaagaaaataagaagatttaaaacggatatttttagcgtgggtggttttttttttttttttttttttttttattttttaggaagtggacgtttcgttattttttgatttttgtatttttttttggggtaaacggggtttttttgtttagatttttttttttttttcggaaaataaattattaagtcggtattcggggtaattatagtggagagggttttcgcggagacgcgtcgtcggatttttttttgtattttggggaggcgtgttttttttagaatcggcgtttttcgcgcgtaaatttcggcgacgcggggtcgcggggtggtcgtcggggtagtttcgtttagcgcgcgtcgcgtagacgttttcggagtcgttagttatcgtagttttcgtcgtttagtgtttttcggtttcgggggcgggcgtttgcgtcggttttcgcgaagcgggaaagcgcggcggtcgtcgggattcg

SEQ ID NO: 9501 - DNA, 279 bp, Artificial Sequence
  Description of Artificial Sequence: Synthetic polynucleotide
cggaggtttgagagtagggttggaggggcggaggatcggggagattcgttcgcggcgttttcggtcggttttgagtaggcgtcgtggtagcgttcgcgttttttgttcgtttttcgtcgtcgttaggacgtaggttcgcgttagggttggcggtagggttcgtagttgtcggtttggcgtttttatttcgcgtagtcggtttcgtttagttttttcgcgtttgattggtcggattttgtttttggcggaggtaattgttcgcggattttttatttcgcg

SEQ ID NO: 9502 - DNA, 2 bp, Artificial Sequence
  Description of Artificial Sequence: Synthetic oligonucleotide
cg

SEQ ID NO: 9503 - DNA, 9 bp, Artificial Sequence
  Description of Artificial Sequence: Synthetic oligonucleotide
cgcggggcg

SEQ ID NO: 9504 - DNA, 11 bp, Artificial Sequence
  Description of Artificial Sequence: Synthetic oligonucleotide
cgatgcgttcg

SEQ ID NO: 9505 - DNA, 30 bp, Artificial Sequence
  Description of Artificial Sequence: Synthetic oligonucleotide
cggttttttgagtagttgagattataagcg

SEQ ID NO: 9506 - DNA, 10 bp, Artificial Sequence
  Description of Artificial Sequence: Synthetic oligonucleotide
cgcgggagcg

SEQ ID NO: 9507 - DNA, 56 bp, Artificial Sequence
  Description of Artificial Sequence: Synthetic oligonucleotide
cgtttataaatcggtttcgttttttcgtgttcgggttcgtcgtttattagacgtcg

SEQ ID NO: 9508 - DNA, 98 bp, Artificial Sequence
  Description of Artificial Sequence: Synthetic oligonucleotide
cgtgatttcgggtcgttttttatacgtgatcgtttttttttttttttttattttcgtattcgttttttttttagttttttgtttcgttttgttggtcg

SEQ ID NO: 9509 - DNA, 33 bp, Artificial Sequence
  Description of Artificial Sequence: Synthetic oligonucleotide
cgacggcggcggtcgtttttgcgcgttttttcg

SEQ ID NO: 9510 - DNA, 48 bp, Artificial Sequence; identical to SEQ ID NO: 8766
  Description of Artificial Sequence: Synthetic oligonucleotide

SEQ ID NO: 9511 - DNA, 93 bp, Artificial Sequence
  Description of Artificial Sequence: Synthetic oligonucleotide
cgagggtagcggtggggttgggtcgggggagtaggggtcgcgtcgggtagcgtcgcgtgttggagcggaggcgggtgcggtcggggtaggtcg

SEQ ID NO: 9512 - DNA, 2 bp, Artificial Sequence
  Description of Artificial Sequence: Synthetic oligonucleotide
cg

SEQ ID NO: 9513 - DNA, 2 bp, Artificial Sequence
  Description of Artificial Sequence: Synthetic oligonucleotide
cg

SEQ ID NO: 9514 - DNA, 2 bp, Artificial Sequence
  Description of Artificial Sequence: Synthetic oligonucleotide
cg

SEQ ID NO: 9515 - DNA, 2 bp, Artificial Sequence
  Description of Artificial Sequence: Synthetic oligonucleotide
cg

SEQ ID NO: 9516 - DNA, 2 bp, Artificial Sequence
  Description of Artificial Sequence: Synthetic oligonucleotide
cg

SEQ ID NO: 9517 - DNA, 2 bp, Artificial Sequence
  Description of Artificial Sequence: Synthetic oligonucleotide
cg

SEQ ID NO: 9518 - DNA, 2 bp, Artificial Sequence
  Description of Artificial Sequence: Synthetic oligonucleotide
cg

SEQ ID NO: 9519 - DNA, 42 bp, Artificial Sequence
  Description of Artificial Sequence: Synthetic oligonucleotide
cgttgcgcgttcgttttttggtcgggcgcgcgtttcgtttcg

SEQ ID NO: 9520 - DNA, 2 bp, Artificial Sequence
  Description of Artificial Sequence: Synthetic oligonucleotide
cg

SEQ ID NO: 9521 - DNA, 2 bp, Artificial Sequence
  Description of Artificial Sequence: Synthetic oligonucleotide
cg

SEQ ID NO: 9522 - DNA, 2 bp, Artificial Sequence
  Description of Artificial Sequence: Synthetic oligonucleotide
cg

SEQ ID NO: 9523 - DNA, 2 bp, Artificial Sequence
  Description of Artificial Sequence: Synthetic oligonucleotide
cg

SEQ ID NO: 9524 - DNA, 2 bp, Artificial Sequence
  Description of Artificial Sequence: Synthetic oligonucleotide
cg

SEQ ID NO: 9525 - DNA, 2 bp, Artificial Sequence
  Description of Artificial Sequence: Synthetic oligonucleotide
cg

SEQ ID NO: 9526 - DNA, 2 bp, Artificial Sequence
  Description of Artificial Sequence: Synthetic oligonucleotide
cg

SEQ ID NO: 9527 - DNA, 2 bp, Artificial Sequence
  Description of Artificial Sequence: Synthetic oligonucleotide
cg

SEQ ID NO: 9528 - DNA, 2 bp, Artificial Sequence
  Description of Artificial Sequence: Synthetic oligonucleotide
cg

SEQ ID NO: 9529 - DNA, 2 bp, Artificial Sequence
  Description of Artificial Sequence: Synthetic oligonucleotide
cg

SEQ ID NO: 9530 - DNA, 40 bp, Artificial Sequence
  Description of Artificial Sequence: Synthetic oligonucleotide
cgcgtcggagtgcggttttgtttttagcgttagtgcgtcg

SEQ ID NO: 9531 - DNA, 2 bp, Artificial Sequence
  Description of Artificial Sequence: Synthetic oligonucleotide
cg

SEQ ID NO: 9532 - DNA, 2 bp, Artificial Sequence
  Description of Artificial Sequence: Synthetic oligonucleotide
cg

SEQ ID NO: 9533 - DNA, 2 bp, Artificial Sequence
  Description of Artificial Sequence: Synthetic oligonucleotide
cg

SEQ ID NO: 9534 - DNA, 2 bp, Artificial Sequence
  Description of Artificial Sequence: Synthetic oligonucleotide
cg

SEQ ID NO: 9535 - DNA, 2 bp, Artificial Sequence
  Description of Artificial Sequence: Synthetic oligonucleotide
cg

SEQ ID NO: 9536 - DNA, 2 bp, Artificial Sequence
  Description of Artificial Sequence: Synthetic oligonucleotide
cg

SEQ ID NO: 9537 - DNA, 2 bp, Artificial Sequence
  Description of Artificial Sequence: Synthetic oligonucleotide
cg

SEQ ID NO: 9538 - DNA, 2 bp, Artificial Sequence
  Description of Artificial Sequence: Synthetic oligonucleotide
cg

SEQ ID NO: 9539 - DNA, 2 bp, Artificial Sequence
  Description of Artificial Sequence: Synthetic oligonucleotide
cg

SEQ ID NO: 9540 - DNA, 2 bp, Artificial Sequence
  Description of Artificial Sequence: Synthetic oligonucleotide
cg

SEQ ID NO: 9541 - DNA, 2 bp, Artificial Sequence
  Description of Artificial Sequence: Synthetic oligonucleotide
cg

SEQ ID NO: 9542 - DNA, 2 bp, Artificial Sequence
  Description of Artificial Sequence: Synthetic oligonucleotide
cg

SEQ ID NO: 9543 - DNA, 2 bp, Artificial Sequence
  Description of Artificial Sequence: Synthetic oligonucleotide
cg

SEQ ID NO: 9544 - DNA, 2 bp, Artificial Sequence
  Description of Artificial Sequence: Synthetic oligonucleotide
cg

SEQ ID NO: 9545 - DNA, 2 bp, Artificial Sequence
  Description of Artificial Sequence: Synthetic oligonucleotide
cg

SEQ ID NO: 9546 - DNA, 2 bp, Artificial Sequence
  Description of Artificial Sequence: Synthetic oligonucleotide
cg

SEQ ID NO: 9547 - DNA, 2 bp, Artificial Sequence
  Description of Artificial Sequence: Synthetic oligonucleotide
cg

SEQ ID NO: 9548 - DNA, 2 bp, Artificial Sequence
  Description of Artificial Sequence: Synthetic oligonucleotide
cg

SEQ ID NO: 9549 - DNA, 2 bp, Artificial Sequence
  Description of Artificial Sequence: Synthetic oligonucleotide
cg

SEQ ID NO: 9550 - DNA, 2 bp, Artificial Sequence
  Description of Artificial Sequence: Synthetic oligonucleotide
cg

SEQ ID NO: 9551 - DNA, 2 bp, Artificial Sequence
  Description of Artificial Sequence: Synthetic oligonucleotide
cg

SEQ ID NO: 9552 - DNA, 42 bp, Artificial Sequence
  Description of Artificial Sequence: Synthetic oligonucleotide
cggagatcgtttcgtttttttagatcgaacgtcgttcgttcg

SEQ ID NO: 9553 - DNA, 2 bp, Artificial Sequence
  Description of Artificial Sequence: Synthetic oligonucleotide
cg

SEQ ID NO: 9554 - DNA, 2 bp, Artificial Sequence
  Description of Artificial Sequence: Synthetic oligonucleotide
cg

SEQ ID NO: 9555 - DNA, 2 bp, Artificial Sequence
  Description of Artificial Sequence: Synthetic oligonucleotide
cg

SEQ ID NO: 9556 - DNA, 2 bp, Artificial Sequence
  Description of Artificial Sequence: Synthetic oligonucleotide
cg

SEQ ID NO: 9557 - DNA, 2 bp, Artificial Sequence
  Description of Artificial Sequence: Synthetic oligonucleotide
cg

SEQ ID NO: 9558 - DNA, 2 bp, Artificial Sequence
  Description of Artificial Sequence: Synthetic oligonucleotide
cg

SEQ ID NO: 9559 - DNA, 2 bp, Artificial Sequence
  Description of Artificial Sequence: Synthetic oligonucleotide
cg

SEQ ID NO: 9560 - DNA, 2 bp, Artificial Sequence
  Description of Artificial Sequence: Synthetic oligonucleotide
cg

SEQ ID NO: 9561 - DNA, 2 bp, Artificial Sequence
  Description of Artificial Sequence: Synthetic oligonucleotide
cg

SEQ ID NO: 9562 - DNA, 2 bp, Artificial Sequence
  Description of Artificial Sequence: Synthetic oligonucleotide
cg

SEQ ID NO: 9563 - DNA, 219 bp, Homo sapiens
cctagggagggggcgggaggcctcccctgcccagctccgagccggtggtgcagcgtccgcccccggtcgcgggcgcagactggcggccgcctccgggccacgtggtgcgcgcggcgggcgcgtccgaggagcctgcggctgctcctggctcacagcgctccgggcgaggagagcgggcggacgccgggggctgggccggtgcgggcggcgaggcaggcg

SEQ ID NO: 9564 - DNA, 315 bp, Homo sapiens
cgagccccgagccccgccccgggggcctcatcccgccccttcgcgtccgcggctcgttttcccccactgagcgcccagctcccgcagtttccccggccgtcgagcgccgtgggcggggctccagggcggcggcgcctcgcggggagggtcctccgtgctgggggcgaggccacccgaggcagctccccgcccgcccccaaccccgccccgctctcggagcctataaagggaggcgacccgcggcccgcccggctggcatcccccagccgccgccagccccgccgaggggagccagcgccgtctctgaggggcgtc

SEQ ID NO: 9565 - DNA, 201 bp, Homo sapiens
gcacccggcccagggctggagctggctgcagggctggcccgcggcgacctgggcagggtggcggctgctccctctcctcccaccccgccccgaggcgcagcgcgcggcagagcggctcggtgcccggcgggcgggcggcccgggcgggcctgcggtcgggatgaggacggcgcctccgctgcagagcgctggggcggcgcg

SEQ ID NO: 9566 - DNA, 201 bp, Homo sapiens
aataatagggacgctgagaataacaactacgaccagcacggcgaaggcgcccctctcgcgggtcagaggtcggcgccccagctccgcagaacccggcgcccggccagcgccccctggcagcccctcccggcagcctcaggtccccaagacctgcaggcccgccccgaagccccccgtccgcccctcacggccgctccgagc

SEQ ID NO: 9567 - DNA, 201 bp, Homo sapiens
cgcgcaccctccccgcccgcctgcccgcggttctcctcctgctcccggagcgccagtcgccccaccccgtgaccggctccccgtcttgtcccgcaggacccgcccggacgggaccacgccgccgccgccgccgccgccgcccggagccgcgcttcgggtcctgcctgagccgagccgcgcgcggggccgcagtcaccgccg

SEQ ID NO: 9568 - DNA, 201 bp, Homo sapiens
atagagttgcttttccctttcttgggctttgcaagtctccgaattggaggcggaaatgggggaagggttggaagttgtgtgtgaaaaacaattattgcaacgggttttccccaggagcttagtccggcctgcatcctggtggaactgctgttaccggtccacagcgcccaggccgagccggcagggctgggcgggaggctt

SEQ ID NO: 9569 - DNA, 201 bp, Homo sapiens
cagccaccgcggcggctgcggcggcggcatctccgcctccactcccgcccgggactgccccccactgtctccccgcccctcccggacagtgagcccgcggcggggcgggggaaggagccgcccccaccccctccaagcccacccctaaagagatccctcctcccctcccccgccgcctggcgcggagccgggacgatgctg

SEQ ID NO: 9570 - DNA, 201 bp, Homo sapiens
aacaagcagcccgggagataccctcccctttcccagcccccgctcctccaccttgctaccccctagcccgtgaccagctgcctcccctccccctcgcgggcgctcagggttgagcaaacactccgggccgcccgccccgccaccagctggctccgaccggcgcaccgctggcgatcccccaggcaattcggcgtcatgaga

SEQ ID NO: 9571 - DNA, 201 bp, Homo sapiens
cgtggcctggccgaggagccaatgggccgggaggggcgcgcgggggaggagctcaggtgcagagtgccgattggccagttcgccctccggtatgcagatacggtgggagtcacgtgctaggggccgggacgacttcctgttggaggccaacgcggggcggggaagggggcgcgagcgccccgtctggctgaagcgggggga

SEQ ID NO: 9572 - DNA, 201 bp, Homo sapiens
ggaggaggggaggcgttgcccgacgcgccctttcaagtctccgcgctcccccccggcggcggctgcccgggggcggtggctcggcgtcgcctcccccgaccgccccctccagggcccctcctccgtgccgcggccaggctgcccggccggcggcgcgctggaaatatgaagagacgctgcagctgcggtggcggtggcggc

SEQ ID NO: 9573 - DNA, 201 bp, Homo sapiens
cccatctgggacgcgatccacaggggcgctgtcccgtcctgcgggaagaggaggcggcggccgccgtgactggggcgcccggccccacccgctcacagaacgtctttaacaccaggggtctgaaagcgaaaactccgggaaggcactccctgaccgcagatcacactctgcagctgatccacaccgcccaggaggcagtga

SEQ ID NO: 9574 - DNA, 201 bp, Homo sapiens
acaaaagagcagctcccgcggagcgggtccagagtctgcccggactgtccgatggccctcggccctctgagcgccgcggctgccgggctttgtgtccgcgcggggggcgggaaggacggccggggtccccagtgcgcgtcccgcggagcggcgcgcggcgcccgaactggaaagttgtcgccggcgcctgtcgcctccacg

SEQ ID NO: 9575 - DNA, 243 bp, Homo sapiens
gctaaggcccggaccgtcatcccagcaacagcctcagtcatgtgaccggcaatggcggcgctgacgagaggtaggtgagcccggcgccccccacacccaccgcgcgccccccgggccccgctcgcacccctcacgcgccccccgctcccccggcgccccctcctccacctcccctccccgcgcgcggctccgggctccccgctccgtgcccggccgatcatctttctagcaccctccagcctt

SEQ ID NO: 9576 - DNA, 201 bp, Homo sapiens
cagcccgctcacctcttcctggagaagcccgacgcagcgcccgccactccctcccctccgtgtgcagctccccggctctaaagcactcacttgtctaacccgattctcaccctacaagaccgcaaccggccatcacttctgccctccgccaggacaccgaggccagctgtgtcactgccccgaggggttgcaggtgcagag

SEQ ID NO: 9577 - DNA, 201 bp, Homo sapiens
tcgcagcaccggtcaccccactgccaagggtgttctttgtacctgttgcgatattttgggtcgttttcagcccagtttgcacagcacccttggccacgttcgcagcaccggtgaccccactgcagacagtgtccttggtaccggtcagcacggtcttggccgtgtctacacccatctggacggcccccttggccacattcg

SEQ ID NO: 9578 - DNA, 201 bp, Homo sapiens
tcccgggccgaggggaacccgcgaccggacttgtgggggagaatgaggatgaaaacgtggagcttccattgtctagggtttgaccggccgacagggatttcgacgggggaccggggatctggggagggggtcgcactttctcgcctctttcgcggcttcccggcttctgcttgcttccctgaccgttcccaggggcgcggc

SEQ ID NO: 9579 - DNA, 201 bp, Homo sapiens
agccggggcagaaggaggagcctgaaggtccaccatggggtggaggctgcctgctcgcgggcccgcccccagagcccggggctcatcacgctgctctatgcgcctctgttggctcctgccaaacagtccctcccttctgtgcctcagtttcctggctgtaaaaagggggtgctcacagagcccccttgaggagtcgtcaca

SEQ ID NO: 9580 - DNA, 201 bp, Homo sapiens
ttggcttttacctggtctgcgagaaatcaaactttgggcacaagtcatgaagccgacaagcccgggagacacagtgtcagaattacaaggtgagatcagccgcccggccaagctatcttctcgctagcaggtgaggcccgtgaacagccaagctccccttggcacggcggaaccgcagtggacgcgtggaggggctccgta

SEQ ID NO: 9581 - DNA, 201 bp, Homo sapiens
aaccctccactcaccaacgccggcgccgccatgggcccagggggctgggtgaggccgtgagagtcggcgaggaagccggtcctgcgggctcggccgaccccgggctccggctctgggctgcgagggacctcagtccccgccgtcgtgtaaaatgcacacaaggttcgcggcgccgcctctgcgcgccgtgaggacacaggg

SEQ ID NO: 9582 - DNA, 201 bp, Homo sapiens
gacagaaggggagagtggccaggaaggaggggaggatggacacagggcgtctgcagaattggtgggcagatggacggagggacgggccgtgcagtgcagccggcggggccagggccaggccgagggcgcgaggtggcagccggcccggggaggcggaggctgagcgagcggtggtgtttgtggagctgtcggctgcggtgg

SEQ ID NO: 9583 - DNA, 201 bp, Homo sapiens
ggggctgggacgccccggcggagcaggcggcggcggtggcgagttggggagccctaggctcggcgctgccggaggggcccgagccgagccgcctgcgccccggccgggcagcgccgggcccgcttcccgcggggccacgccctgtcaaactttgttgcggcggctagcgcagcgggcccgcaagcgggcgggaggggcgcc

SEQ ID NO: 9584 - DNA, 201 bp, Homo sapiens
ttactggtgagcttggtagggcacagagaggatggcactaccagctggagggggacaggccccaaccatgagcccaggatgcagagagcggcagggatcaccggagcccccccggctctggtgtcttggctcttcctgcacacggtctccacatgacgcccagcaagccggatctcaatttgttcacccatcctttatttt

SEQ ID NO: 9585 - DNA, 201 bp, Homo sapiens
gaggccaaggcgggcagaccactcgaggtcaggagccagagaccagcccggtcaacagggcgaaaccccgtctcctccaaaaatacaaaaaccagtcaggcgtggcggcgcccgcccgcaatcccaggcacttggcaggccgaggcaggagaaccacgggagcccggggcagggaggctgcagtgacccgagaccacggca

SEQ ID NO: 9586 - DNA, 233 bp, Homo sapiens
ggagagagagagagagagagagagacggagtcggagagggagggagcgagagaaagcgagagctcctcgccaccctccgccgcctctagaattcaccgggcgtctgctcggcggctctagaaggtcgggctgcgctgtgggctgcggggagccggaggcctcttgattggctctttgacgctttcggaccaattgtgttgctgcataggcgtggttttcacaggtcgagtgct

SEQ ID NO: 9587 - DNA, 201 bp, Homo sapiens
cgcggcacagccactttctccgccgaggcggtaccctaaccctgtgcctccccaggatcgcgggctgcaggcactcggttcccgaagcggaggccggagccgcgcggagaagccaacggtaatgacgccccctgccgaccttcaggaggggataggctgagggcctggacgaggtcggaagcgcttctactgcagctccgg

SEQ ID NO: 9588 - DNA, 201 bp, Homo sapiens
tcctgagaagcagcagcagctggcctgcctgttgccccgcccccgtgcatggctgcccagcgctggccccagtgcccagcgtctccgcccagcacccccccggccctccctccccaccccccgcctccgagctgcggggagtcccagcctgggatctttgcctcatgtccttgggctcctgccctggctggcccgtccccc

SEQ ID NO: 9589 - DNA, 201 bp, Homo sapiens
ggccccgccgggccggtcgctgcgagcctcgccccggtctcggccaccgccggggaggacgacgacgacgtggtgggggacgtgctggcactgctggccgcgcccctggccccggggccgcgggcgccgcgcgtggaggccgctttcctctgccgcctgcgccgggacgcgttggtggagcggcgcgcgctgcacgagctt

SEQ ID NO: 9590 - DNA, 201 bp, Homo sapiens
tttcctccagtacactttatgcaaaagtcagtaaaaatatttctcctataagtctaaacaaatgtttaaaaatatgtaagttaggaagttatttccaacacgcatattcttttcacatgcagaagtaatggtgagaatttttcatatcctttgcagcagactcccggccccggggctgggccctcagcaagctcattcctg

SEQ ID NO: 9591 - DNA, 201 bp, Homo sapiens
ctcggccgtacccccgccccacccccacggcagggcccccagtgcttgatcaagttcaagctcgagctcctcggcgcgctgcccaccggctgcccctccgcgcccctcccccttccccatccgcaccgtctcgctcttcactcttcctttgtctctttcccaccacttagtttacaccccctccgccctcctccccgcccc

SEQ ID NO: 9592 - DNA, 201 bp, Homo sapiens
gggactgggaacgggatagggacgcgccccaactcactcagcggtggagctggggggcggcgcggtcacgtgggatggcgggcagctcaggggatccgggcgacggggtctggcgggcagggttgttccagccgcctttataaagccggcctccccgacccctcctcctctctgcagctctcccctcctcccttgggggct

SEQ ID NO: 9593 - DNA, 201 bp, Homo sapiens
cagccacccacctgccccccacgccccactcaccagcgcgcacggccccggcaacctcacccggagcggggcgccgccgccgcctctgccgcagcccggccgggccgctgggcgcaggggactccgcgccgccgctgccgctgccgccgccgccgccgccgctgccgctgctgcatcccccggcgagcgctgctgctcctc

SEQ ID NO: 9594 - DNA, 201 bp, Homo sapiens
tttgggggacgccggacgccatgttgtggaaaataaccgataatgtcaagtacgaagaggactgcgaggtgagctggggctccggggtgcagccccgccccgccgaggacagtccgggaggcaggggccactggaccgaggtcggggacgagggcataggagccctggcctctcggtgggacgggatccacttctccggac

SEQ ID NO: 9595 - DNA, 201 bp, Homo sapiens
gggagggaagaaggaggcggcgagcgggaagaggaagaagacgcaggcagcgctaggcgagctcaggggcgccgggagcgcggagctcgggctacggactcgcgggagttcactgcgcctccgggccctggagggctgcccctgcccgcaggcccgggcgcttccgccaggaggcgacagcgccatgttcctccaggttcc

SEQ ID NO: 9596 - DNA, 201 bp, Homo sapiens
ttcagccggtccctcgcatgactggatcacatgagggacccaagcccggccagctgccacctttcggaccacatgcgtgctcagggaccgctctccaactcggcatggggacttggaaaaaaagatcagggcagagggactggggccgggcccggtgaccgctcctcggcaaccaaaggacagtaaaggacggtccctgac

SEQ ID NO: 9597 - DNA, 410 bp, Homo sapiens
cgcatgcgcccaggccggtccgcaggcctttctcgccccagccggcagccagctcgttcgcgctggggtcaccgcgagccggtccgcagcggggtcaccgcgatccccggcgcagacacagaggccgcccccagccccgccgcctcgtggtcccgcccccgctgcacgctcccttacccctcggacctcgcagggccgcggcggacacggcccgatcggggacgtgaacgcgcagaactacatttcccagcgtcccgctcgcgctggaactacacttcccggggggctcggcggtgcacccgccggggtcgcggattggaggtttccggttggaaaagccccttggcggctaactggggaggactggaagaaatctaggatggagccagcactgctggcccaacatgtct

SEQ ID NO: 9598 - DNA, 201 bp, Homo sapiens
aagtccttgggaaagatccgtcccattcccggaagctagagggcgttagttgtcgggttgaaaaggggtgtggggaggggaagcagctttaccccgggctcggagtttgcaggagagagaagtggggagcaagaagtgaacctcaggggctcacagggttcccgcagatgctcaggccggccaggaatgcatctctggctc

SEQ ID NO: 9599 - DNA, 201 bp, Homo sapiens
tctaccacgtcggggcgacccgctgcctgagcgagcacgccccgcacctcctccgcgacgcgcgcatgttgttcggcgcttcggccggggcgttgcactgcgtcggcgtcctctccggtatcccgctgggtgcgtctggggacgctgcccgggctccacgtgcggagtgggtgccccctaggccggggagcgggggatccc

SEQ ID NO: 9600 - DNA, 201 bp, Homo sapiens
actcttggatcaggaaacagtgtgtgtgtacacgagagagagggacagagagaggggggacatgtggagtgcactggaaccaccataacccccatgaaggcggcaccggagttattggcattatttgtgcaactcttcttcatgcttgacgtcgtttcaaaataaagagtgagctgagcaaatcaactcggcagggcacat

SEQ ID NO: 9601 - DNA, 201 bp, Homo sapiens
gcggcggggctgggtctggggctggacgttgacctaggaccccgcccctgcccgccctgcgccgcgcccctcccgggccggccttgaccgagcagctccacgcgggcccggggctcgtccacccgacaggagcggggggctgcagcccacgagcccacgagcccgcagcgacgcacccggagtgtaacctcgcagagtcac

SEQ ID NO: 9602 - DNA, 201 bp, Homo sapiens
gcaccgcgcggcggcgcctggcgggcactgttgcccgcggagggacggtgggggggtttcagcagctggcgggggtggagggggcgggagagggagcctgcgccgggctgagcctggaggtgcggggcgggctcggggagcgctcttggggctcctcctgccacagccggggcggctggaactctctccctttctccctcc

SEQ ID NO: 9603 - DNA, 201 bp, Homo sapiens
gccgcgccgccgggcctcggggacacccctcgccgcctcccccgactcgcgccgccggggccgccgggccgcagggcacggggccggcgcggggggggagcggagaggggctggggagccccaggggtccggggcccgcccgcgggggatgggcagggaccccgggccgcgtggggtgcgggggccgcccgcattgaggac

SEQ ID NO: 9604 - DNA, 201 bp, Homo sapiens
ttcccttttaaaaagagcctcccagagctgtcgaaatctccgcggggtgaaagctaaacttttggagtcgctgtgtagccgggtagaggacacggcggcgcgagccggaaagataagtgtccaggcgaatgggaaaggaaagatcttaatttttgttcctactgttagctgaatgtccataaaaatcaaagggaatgcggg

SEQ ID NO: 9605 - DNA, 201 bp, Homo sapiens
atggctcactgcgcaagctcacacccagtcccaggaagcgagccccacgtcgccccagctctgcattcacagccgccaagcggtcccggaagccgaatgccggataggtcaaagacagcgccgctgctccggcactgccgccagagggcgcggagtcgccgtgttggcctgcacctcccttgtcacgtcagccgaacggct

SEQ ID NO: 9606 - DNA, 201 bp, Homo sapiens
gcggcccggaaatgagcgccctccggggacagggggctctgcggggcggcgacagctggattcccagcgcgcacaaagcctgcgggaggatccattgtagcggtcgctcctccccgcttagcgagggcgggcgcaggggcgggggatgtcgaagggtcaggtttgtccaggccgcgccaccttcgtttcagacgttcagtt

SEQ ID NO: 9607 - DNA, 201 bp, Homo sapiens
cctcgagggccgcgcgggctcaggcgcccacggccccgcagcgccgcgcttctcgcgagaacgcagagacccgggtccgccctgagccgccgattgcgggcgggagccggcgggcaaggcgcgcggccggcagccggagcggcgcgtaacgcagctgagtgaggtcgtcggtggaggcacggagcagcaggcgcccggggc

SEQ ID NO: 9608 - DNA, 294 bp, Homo sapiens
tcccgcgaaggccccggcccggccgggcggggtggggcggccccggcctcattaatcagcggcttgttgtggatgccggcggaggagatgccacccagggcgggaaaaggggcgcggaagaggggcggggcgggccacggcgcgcagggcccttccctcccgcctcggactcaattaattgggcttgagcttccgccggggagggggcgccgggcggggccgcggctgggcggggcgggggatcgggatcggcggcgggggctgcggccttgcagtggaagcatgggcggcgag

SEQ ID NO: 9609 - DNA, 201 bp, Homo sapiens
gtgtggaggctcacgcagcgcttctggctggaacggggaagcctgcacttagctttgggagtgggtttgggagagggaggaggagccgccgggagtctggcgggagggcggtgttcccgtctgggttcctctctgctgtcccagccccggtagcttccacagcagcctcgaagggtgagaatttgctcttctatggacttg

SEQ ID NO: 9610 - DNA, 201 bp, Homo sapiens
cttcccagcctccagagcaagccaatcagggacacgctctcgtggcccagttcggaaacaatgcttggtgggaacctgcaatcttggctgccggaaccttcggggaggattaacgccggcgcaccgtgcggccggggcggggcgccgcccaaactcaggccctgtgacagcgactgtggcggtctggaaagcgtgggcctc

SEQ ID NO: 9611 - DNA, 201 bp, Homo sapiens
aaccacccccaaaataacccctccggggggtgagaggcaattataaccccagcgagcggagggcgcgggggatgggcgccgggcgggcgggggcggggagcgcggcgcgggtccccaggtggcgagcggaggtgctcccgccgcggggggaggggcgggggcgcacgcggccggcggcggggggaggcggcgcgcggggga

SEQ ID NO: 9612 - DNA, 201 bp, Homo sapiens
aggccttcgcacccaccgcgtgggctcctgccctggcctcacctgcccccgacactccccgtccccgcgatgcccaactccggcccgagaaggctggccgcgacctcgcccggtacccgccgccccgacaccaccattcgcctcctcgacctcccccggcgccgctgcccacccgcccctcgccccgctcaccggggccgc

SEQ ID NO: 9613 - DNA, 201 bp, Homo sapiens
ggggacgcccgcccctcttccgggcagccccttccacccaggcgggatctgggtccccgctggactcagggccgccttcccgcaggcggggccggcccggcgcgcaccttgtctcggatgccctggcgcacggcctcgcgctccgcctccatcttggcgtacttggccttgcgctcctcctccgcctggcgcagcgcctcc

SEQ ID NO: 9614 - DNA, 201 bp, Homo sapiens
cactttttctttgcgcgtctgtcccttcctcgcctgcaggatttcgctcctggcccgtcctccccttccctgctgggcaggctcttccggagcccacccccggcggcggcggcggtagccgcggccgcggccgctggattccgagaggcgcggggaacttttttaccccctgccctggttttatctgtttcttttctcttt

SEQ ID NO: 9615 - DNA, 201 bp, Homo sapiens
cagggaatcacaaaagacggccggcggcgagcaggctggggtgacggggaccccgtggataacgggcttgaggacgcccagggcttcagccttttccaggcgtccctcgccggggcaacgcagagcagctgccgttcttcccgcgccccagcagatggtggtgtcagcccggcctcgtgcccggccgccgctgcgcccgcg

SEQ ID NO: 9616 - DNA, 201 bp, Homo sapiens
ccagataggcatggtcaaggcagcctgtgactcatttcacaaaaccagagactcttgttctttgtggagcaagacttcccggaggctagagcaggatgatcgtcaacttttctccttagagccggttcagtctgataaagcaggggccaccccggagtttggaggggaagagagcccaggcacaaggccatccctgggaaa

SEQ ID NO: 9617 - DNA, 201 bp, Homo sapiens
gggcgcgcggcgccctccatccacgcccggccggggcgcggcgcggcggcgggcacccggacggccggcggaggcaggccggcccgggtactagcctgggcggcccgcgggccggggcggcggcggggtggcggtggcggcggcagcagcgcggagccggtgggcgcagccgcgcgccaggccggcggtcggggtttgggg

SEQ ID NO: 9618 - DNA, 201 bp, Homo sapiens
cttgccacagacaagtccccgaagccgccttggtgcaggccacctggtttcccagcccctggtgtgtggtcagtgcctggtgttcctggaaagccactcccgggcagctcctgacagtgcgacccggcgcccaagcagcctgggaccttgcgcggacctgaccccttcagaccgcaggcagtctgggaggaggtccggccg

SEQ ID NO: 9619 - DNA, 463 bp, Homo sapiens
acgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgct

SEQ ID NO: 9620 - DNA, 201 bp, Homo sapiens
accgggagtgcccagcgacttcaggccagctcgggggaaagaagcggccgccgccgccgaggctctctggcctcgggactccggcgctgcctcttcctcccgcacctgctggggtgggctggagccgtaaccgaatcccggccgcggcgcctgcaaagtttttccctcgaagctccgcggctccagtccactggcgtcccc

SEQ ID NO: 9621 - DNA, 201 bp, Homo sapiens
gctccacagccccggccagaacttggtgggggacgcggggggggggtgtttgacggggagggggcacagtcctttcgggccaacttccacattcctgctccgcccaggcggggggtgagtcggggtgagcagccggctccaagctggccggcttcctggaaagggagggccagcaggagaactgcagatcctcccagccct

SEQ ID NO: 9622 - DNA, 201 bp, Homo sapiens
gggaccgcttcaagcagttcgtcaacaacgtggcggtggtgaaggagctcgacggcgtcaagttcgtggtgctgaggaagaagccccggcccccggagcccgagcccgcacccttcggccccccgggggcagcggcccagccgtcgaaacccacttcgacggtcttgccgcggagcgcctctgccccgggagctccgccct

SEQ ID NO: 9623 - DNA, 201 bp, Homo sapiens
gcttccagaggcccagccctgtcccctactacacacagctaccaccccacccgcccctggggctcggctgcccttcccggtgtctcttaaacccctcccccgacctgggtgttaagcccacccacctcccggcgccgcccccggtcgaacagcctcttgcccttccttcgcctgggccggagccccccgcagcctcctccg

SEQ ID NO: 9624 - DNA, 201 bp, Homo sapiens
ggtccggcttggggctgggctggggagcgcggcggctgcggctggggcacggggcggccgggtgagctggccggcgctcgctctctccattcagtgagcacggcagacaccggagacgcggggcccacccctccggcccccccccgaccaagaaacgccaactccgcctcccattggctgcgccgcgcgtcatgtcgacta

SEQ ID NO: 9625 - DNA, 201 bp, Homo sapiens
accgagcccaaaagccgccggcggcacatcccagcggcctccctcctcccgggctgggattcgcctctgcaagaaacgtcatgttttctctcccagacatcgttccgggagccccagatgtaaaatcagaggtctcttatctggcattattgatctctgtgctaataaaatgtcagtccccaagggaaaacttaaaaaaag

SEQ ID NO: 9626 - DNA, 201 bp, Homo sapiens
gccgcgcgggacggggcagggacctcgagaacaccggggacttgcgggccggtggccccgggcaggccacttctgacgcgggtgcgaggccttccgcgggcgtgcacggttgggccggagccgcgccgggggccgggacacgcctggggtcagcgctggcgtcgccgctcgggtggggtgggccgggttcgggtccagtct

SEQ ID NO: 9627 - DNA, 201 bp, Homo sapiens
ggcggcgcgcggcagagctgggtctcccgccaggtggccgggggtgtgccctcagggtaccctacccgctacccccgcgcctccagtcccggcggccgcgcggaccccgcccctgctgaccccggcgcacgctcccgcgccgcgcgcagcctcccgcctcccgccgaccccgccgcgccgccggcagccctccccagcccc

SEQ ID NO: 9628 - DNA, 201 bp, Homo sapiens
tcctccctctgctgttccaaaacacccttcgacgccagcaaaatacaatgcgcctcggccgccgtaaacagccgggagggagagcacacattcggcgcggcgcggccgccggctcggctcccacccccttcccgttcctagaaaatgccataaaagcgggcagggcgcggggagggcggctgcgcgcccggcggccggggc

SEQ ID NO: 9629 - DNA, 201 bp, Homo sapiens
agccaggaaatgcggggcctggtggggtgaggagcacggggttcctccttcatcctcgcggggactttgccaccggctcagtgtggaggcctcaccgtcccgcccggatccgtggggctccgacagtgtggcccctgcgaggaccccccccatcctcctcgccctggggctgctgcgggagggcgcccgggcagcactagg

SEQ ID NO: 9630 - DNA, 258 bp, Homo sapiens
gcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacggggtaagtccgggcggccgccccctcctccctcgcgatccccacggcccgcgtcctggccgccccactccacttcttgtcccagagag

SEQ ID NO: 9631 - DNA, 201 bp, Homo sapiens
ccgacggccaaggaaagcccaccagccctccgcaccgtgggcgacgggccaagacccggccctaaacggccagacccagcccctagtcggctgccgcccccgccccacgcaggcgcgctccggggccctcccctcccccaccgcgcgctcgcggggcccgacgggggcggagcgaccctcggaaggggcgtggcgaccggg

SEQ ID NO: 9632 - DNA, 201 bp, Homo sapiens
agggggacggccagacgggatgtcggaagccaagggacgcagaggccggcgggtggcggcgatggagaggacagatccggctcccagaggaggtcgtgagcgcggggcctgcgccggccggaggagggacccggggggctgcaatatggctgctcgggcgccgtcccctccctgccaagccagggctctggggagctgctg

SEQ ID NO: 9633 - DNA, 201 bp, Homo sapiens
cccgtcgcgccccggccgggatggacccacacgcccgatgagccccgcgccggcggctgcgagcgccgagcctccccctgctgcggccccagccgccccccgcgcgcccggctccgcggaccaggacccctgggctccccggctgagggcgcggccgctccggagaggccgagcggggacgggcccgagatggcgcgggga

SEQ ID NO: 9634 - DNA, 201 bp, Homo sapiens
cagtcaggacagtacaaaatctctttatcgctcattttctgtaaaaaatcgtggctctcggcggaccctggagataggaggtgcaaagggcgctcacacgcggcccgggtccgcggccgagagctggggggatctggagcggggccgggtcgcaagaagaccctgaccctgctccggcgctggggcgcgtgctaagggccc

SEQ ID NO: 9635 - DNA, 201 bp, Homo sapiens
tgccgggctcgacgtgcacagtccagcgctcctccccactagttactgcccaggccccccgatcctgcacccgccggaatgagagaaagtagcccctcgccgcccagctcccgggtagctgctccggccgggccttgcgttggtgagaaagttccatctagaggcggccgcgcgcaactgcaggcggcgccctaggcccgg

SEQ ID NO: 9636 - DNA, 201 bp, Homo sapiens
cgcgggtaaggaaagcgcgcaggccctgcagacctctccaccccggccccctggcccggctcgcccctccgccccggggcggcggcttcctgctctgcagcgagcgtccgcaggagggacgccaggaccccggacgccacctctgaggtctctctgcacctgggtctctgacagccgggaacaggcaggaggtggggcgag

SEQ ID NO: 9637 - DNA, 201 bp, Homo sapiens
gtgggaggccggcagcgcgggcgccgcgtccccggaggagctcgcgtcccctgaggagcgcgcgtgcccggaagagcccgcggcgccgtcccccgaaccgcgcgtttggcttgaggaccccgcgtcccccgaggagcccggggagcccgcgcccgtacccccggggttcggggcggtgtacggggagccggacctggtgct

SEQ ID NO: 9638 - DNA, 201 bp, Homo sapiens
agtgcggatttcggtcgcgtgcggctctgaccgcgtcgccccatccctggcggggccacgcacggacgccatggctggcgccgcggagccgggcgatgcgcgcggactctcccggggccctgactgtccctgagtcctccctgcggggggcgtgcgcggcccgccccccgcggcgccacgcggcccctcctcggccgggga

SEQ ID NO: 9639 - DNA, 201 bp, Homo sapiens
gcctgcggagggtgggaccccacagcttgtccacctgcccaggctgagacctcgtgtcctagtcctggatgccccacgggtttctcgtcccgggcagcggcgcacgggaggagaagactcccggtctgcagtcagacctccctctgagaccctccctagctcaggcttagagctttgggatttttctcgatcctttctagc

SEQ ID NO: 9640 - DNA, 201 bp, Homo sapiens
ccggcccctcctcccgcggggggctccgtcccgcgccccgtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggc

SEQ ID NO: 9641 - DNA, 203 bp, Homo sapiens
gcgagcggctacggggtggggagcaaggggcgcgcgggcggcaggcatggaacggacgcggcgcatctcgcccaccgcgggacgcccggacggcggccggcgcgcgcggcccgcctcgagcccgagagggcggggagacaatgcctgtccggcggggcagtccaggccgcacgctcccgcccgcggacacgggccgctcctac

SEQ ID NO: 9642 - DNA, 201 bp, Homo sapiens
tcgtggagccgcgctaggccacggggtcccggccagacgggagcgccagcccctccccctgtcccgatgtccccaaacccaggctcagcccctccctccccgacccgatgacacccctgggtcctagaatgctgctgggggcgggagaccggagaagaagcaggtgcacggggaggtgggtgtcctgccctctgcgaggag

SEQ ID NO: 9643 - DNA, 201 bp, Homo sapiens
cctgggggggcgggccggacctgaaggccacaggcctcctcctgcgcctacccctcctgcaacccccacagcctcccccgccgaccccttcatgcccccccgcccccctgcccggcgctcctccccggccgcgggctaattggctgtgacagctggagccctgggcagctgagcggtgtcactgcaaattaggcaggcgct

SEQ ID NO: 9644 - DNA, 201 bp, Homo sapiens
ctggaagggcgggggcggtgacagcggcaggggcgggacccggaggcggggcgtttgctcacgtcgtccagtagcggagggaggcgcggtcccagctccgcgctcaggagccgcacaggcgcccggggccgcagcaggagcctcctcagggcgcccagcgctgcacccacgagccgcgcgtcgccttcgcccagtgcgccc

SEQ ID NO: 9645 - DNA, 201 bp, Homo sapiens
ccgcaccccgcccgcctgctcttcaccggccaggccctgccgggtcgccgcggcctcggcgccccaccccctcccgggccagcggggggctgggagggggcgaggaggaagggggttctcctctcccctccccggagggggccgcagcggcggctccggctcctcctctccctcacaccccctcccgcccccctctacctg

SEQ ID NO: 9646 - DNA, 201 bp, Homo sapiens
ccggagggagggggcaaaggaagaaaaagaaagcgcgctcggaaagccggcttgggtcctgctaattattctgaaggcaaagtacctgcactctccccgccgaggctggctggcggcgccgcgccggaggggaggaggctcgggaggaggaggagaaagagcagcgggaggactcgggctgggaggggagcgcagggttgg

SEQ ID NO: 9647 - DNA, 201 bp, Homo sapiens
tcgccggggagccgcaaagcctgacggaagaggctgcggttctcgcgcttcagccgccggttctcgagccgcagccgggcgttctcctgacgcagccgcgcgttctgccggtcccactcgtcccgcgcacggatggcctccaagtggctcgccgccaggtcggcaaaccgctcctccagctgctgtcgggcgccgtccgcg

SEQ ID NO: 9648 - DNA, 201 bp, Homo sapiens
gcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcggtgagtgcgcggactgaggcggggaggcggg

SEQ ID NO: 9649 - DNA, 201 bp, Homo sapiens
gcgtcagacttcctcactatactctcccaccccaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggcca

SEQ ID NO: 9650 - DNA, 201 bp, Homo sapiens
aaccatcagagaatcctctcaaaaacacagacccgatgaggagtggcttccccgcctttcccctgtgccgagaagggatcccggtcgccaacaacaaagacgcttcccgctcccctccccccgccggcccgggctcgtccctcccgcgctgcggctcccggcctagcgccccctccccgagccgggctgcggcgtccccaa

SEQ ID NO: 9651 - DNA, 201 bp, Homo sapiens
ggagggccgcggagacgcaggcgctccgggtcgcccgcgctgcccctgtctgccccgtgcgggagccggggtccctggctccctggctccctggctcccgcggcccgggcgaacccagagcgcacccgtacgccggccccggccggtccctagcgcccgggctccacgggccgcgcccccacgcggcgcctcccagagacc

SEQ ID NO: 9652 - DNA, 523 bp, Homo sapiens
ctgcgccaagtttcagaaccacctagccccgtgcctgccgcccggggcccggcctcgccccggccggcgctcacctggcggtgccgcccccggaagaccacggcgaaggccccgtgtcccacgagatccctcttgctgtactcgaagtcacccaccacctccatggccgcgcccccggggcacacagcggacgggcgggcggcgcagtgcggcgcaggtatcagcaccgcggctccgcgggcccggagcgcgccagcgtgcggcgggtctggggcagccgcagccccgggcccgggcggactctcatgccgagagaccggagcggaaactggggaagctgccgcgcggagccagggtcagcgaggcccggcccggcccctgccgctcatggcccggcctgccgccggccgctggctgtctggcgaagcggcctcggcgctgccgggccaggggtgccgtcaccgtcactgtgcgcgcccagagccgcacacgcgctctgaggcagtgaggggcccggtactct

SEQ ID NO: 9653 - DNA, 201 bp, Homo sapiens
cggcccgtatccctccgccgccagccccagctctaaacccggcggctcagcgggcgcaccatggcactggagtagcgcggggagcgcgcccggagccccgcggcccgctgcgccccgcccgggaccccgctgcgccgcgcgccccccccgcggcccgcggggccgcccctgcacccccaccccctcccccgcctgccgccg

SEQ ID NO: 9654 - DNA, 201 bp, Homo sapiens
gcctccgcccaagtgtggctcccttgggcccacaccccatcaggccagcaaggagggggatagcggggggcggggcaggtgctgggactccgggcaggtgcggggaaggcagggggcggggggggaaggggttgggcgatgcaggtgttgggggccgggacagttgcgggggtaggcaggtaccgggaaggcgggagggcg

SEQ ID NO: 9655 - DNA, 201 bp, Homo sapiens
cgcagatcctgggccccggccttgctatccagggggaccttccctaacgatgggaccggtgctcggagtggagtatggggagtgcgccttcgggagtcggcgctggccggatatgtgacaactgtgggtcgctggaggcccgcctgcgctgggatagggcctggacttcacgtgcgtcgcctgtgttccgtcagaccgggg

SEQ ID NO: 9656 - DNA, 201 bp, Homo sapiens
gggtcggctccgcggccgacctggggcaccgcgccggggtgaggcctggcgaggaggcgaaggctgcaggcgtgaggtgaaggccgcaggccggccgggccgattttcgctatgtaaatatcggtgagggggggggagggacgggggacaagatggcggcggctcggcgcctgctgcaggggacgatagagggggttgccg

SEQ ID NO: 9657 - DNA, 201 bp, Homo sapiens
ccctcgcgcccctcccgcgccctacatccaccgcccggcggagggggctcagtccgcagccgccgccgccaccgccgcgcctcggcctcggtgcaggcagcggccgccgccgccgagacagctgcgcgggcgagcatccccacgcagtaagcccgctttctttccgcttgtgcgcgcgtgtgtgcctcccgcccgccggcg

SEQ ID NO: 9658 - DNA, 201 bp, Homo sapiens
gcgggggcccttcacgtggcggaggcttcccggcctgggggccacgggcccggaggaatttgcctggaagttttccatcacggcagagccttctggagctcgccccgtgctcgacaaggggagccccagacttgatttctccagcagccccgcggggcggggccgagaaggggcgggcgggcggaggacgctggcgggaga

SEQ ID NO: 9659 - DNA, 201 bp, Homo sapiens
aatgtgattatagttaacacatgacccttctagcgtcccagccagtgtttttcctgacctctgttctttggagaggaggatggaagggaggggtccggcacgctgctggcattttgctgtgtcctgcagcccctttccgggacacctgggttcacacagctttttagcttacataactggtgcagattttctgtgtggaga

SEQ ID NO: 9660 - DNA, 301 bp, Homo sapiens
tttttttccaatttctggcggcgggcggctggggaagcagctctgtggtctcccggcgggtgaggccgagacagagaccaacctctaggcggcgccctggcgttgagtccgcgctgaacaagattctctcgcagctctgcgtcccgcgccgggtgaaggggcgtgttcctgcaggcgctcggggctcggcctggagctggcggccggcacgtcgcctttggcgccctctgccaaccaagagaaacacggttaaatgagtgcgctgggacagaaatccacagctaatcaaggccccatccgc

SEQ ID NO: 9661 - DNA, 223 bp, Homo sapiens
gcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctgg

SEQ ID NO: 9662 - DNA, 720 bp, Homo sapiens
gacagccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctg

SEQ ID NO: 9663 - DNA, 1683 bp, Homo sapiens
tagtggcagtgttgagcccaggaatacgcgcggagcccgcggcgatccccgcggccgctcagtcttcgcggcggactccggcgcgcaggagccactgggccgcaagggcgccggggagcgggaggggcgctgggggcggcaaggggtcccagatcccaggccacgaactgttttccttttccccgggcaagagccccgctcccttcaactgacagaaattcactggggcaggggggcgagtggggagagaggtcgctcagggctcgctactggctgcgcctcccccggctctggtctgggaagcggctctgggccctccgggcgagcagcttgggcgccggcgccccctgcgaggaagatcgcggggtgacggtcggtacccgttcggctgggccgcgctgccgctccgatccacctcccttccgcgcccgcgccctcccccttcctttcactaggagtccgggattcggagagggcgcgggaggcaggcacacgggcccgaccccactccagcgctcaccggggacgcgggcgggcggcgacgggacgcggcgggggcgcggggcgggcgcggccatggagcagcagcggcggcggcggcggcggcggcggcaacactagcgaccgcgggcggacgagcgggcgggcagggccgccgggctcagcggaccgaactgcacagctcagcaaaagcgccctcgccctccgcgcgccgcctcctgcgagcccaaacccaccaacattttttaacgctccaacccatcctttgaagaaaagcaaaaaaaaaaaaaaaaaaaaaaaaaaaagcaaaaaaagaaaaagcattgatcggagagacggggatatatatatatatatatatatatatatatatataaaattttttttggctcctgctaaaattagcagggctcgccgcgcgcctgtgtgccagtgtgtgcgagtgtgtgtgcgtgcgggcgtgtgtgtgtgaatgtgattactccaggactcctcgggctccggagacgccattttcccccttgatatctctctccataaatcggtggcgcggcggaggcggcagagtcgggcgggaagcgcggggccggccggggcgcccgccgctcgccgccgcctccgcgcgcccgggggccccggcgccccccgagctagggcggccagctcgcggctcgccgtttgacagatgctcatcgccatggagttgccgcagcagcacctttgggggctcgggcgagcgacgggagccgggatctgagcgagcgccggggccagcggagccggagccgccgggacatgggtgagcacgcgcggcgaccttggcccgggagcccgggcgcccagcctccctccgcgccgcgggcccccgcactcccggaaccgggggcgacgtgtgtgccctgcatgcaaaagttcacgtcgccttgctgggtctttgactttgcacccggcgggaagggggagaccgggccgagggggcgggatgccggtccgggcgaggttgcaggagatgggcgcgattccggcgggccggcgggtgggcggcgatgctggctcaattggagtggctcgttggtggcggcgatggtggaagctttgggctggagggctgggagcttattgagtttcgcctaatctgatctaccccccctccgccccccgccttttgcaccctccctcggt

SEQ ID NO: 9664 - DNA, 233 bp, Homo sapiens
ccccgcccgggccgctcggctcggctgtgctctgctcggctagggcgggcgggtccgcccctcctccggccggcgccctccccctggctccccccttccccgcgtcgcccgctcccgctccccccgcctccccggcgccggcgcagcccccgcgaacccgggcgcaccaccccgggtgtcccggcctggggaccgctgccgccccggccgctgctcctttaatctttttgttt

SEQ ID NO: 9665 - DNA, 213 bp, Homo sapiens
gactgcgcgtgcgtagagcacgccggcgcggccccgggactctcgcgataactgtactgagataaagtgtggcaactcgagctggctggtgattcatcctcggcgaggggctcgcgtgtgggccacgtcgccgtctccaccgggaaagcggggaccagtggggggggcccagctgcagggtagtgggaggatgctgtttgctttgggggaagg

SEQ ID NO: 9666 - DNA, 236 bp, Homo sapiens
ggcagcgccgcctgcgccgcgttcagcacgaagagctcgctccagctcaggcgcagcagcgccacctggtcggccaccggcagctcggggaagaagggcgcgtggcgcgcccactccacggtgctgaagagcagccgcgccgccagctcgcacacgttgtcgatgcccagcaccgcgcccgccgcgccgccccctgcgccgaagcgtccggccgccgcagggtagggctcagcgcg

SEQ ID NO: 9667 - DNA, 233 bp, Homo sapiens
gagggtggggttttaaacgttatccaatcagcgacgctgggctgggaactgtccaatcaggcacgcagcttgagcggagaggacggcttccgggatgtggcgggatttgtccgcttctttgtctttggctgccgctggaactccgggtctcgtcttcactgctctgtgtcctctgctcctagaggcccagcctctggtcctgtgacctgcaggtattgggaatccacagctaa

SEQ ID NO: 9668 - DNA, 737 bp, Homo sapiens
aatgacgtcgtaaacaatagcactaaccaccatcgtccgcagctcccgcgtacagaggcctcaggctcccggctccacgtggaccgacctcgcccggcagcgcggggccacctcaccgcgagctcctcccgcagcccggcccgggtcacctcgactcgccaggcttaactcaataaccacaacaccggaaaaggaagcaaaggtcgaagttcatccgcggccctgaggcctgtgggaaacgtagtccaacaacgaaagagccctgaagctcaagcggagcccgctggccgcaggggccgcaccacgccccagaccctggagtttccgggtgcgcagacccttgccatcagcagaggctgccgctgcgcgtcccctaggcgcggaagaggcggctggtggtccctgacggcaaggtgaagtcgaggcagtaatcgggaacccaggttgggaggacagaatggggaacaggaagctggggcgagggtggtcttgggggaggtggggggccgcggaattctaggtggcccctgcctcacctctggaaagaaccggaagcccgggccggggagggtgaagggagtcgcggacccggctgctcagccgaggaggaaacccggaccccaggctgagggaggccgaagaaggaactggagggccgggctgggaaggcctgaagcgggtacagcctttaggctggggagggtcgaggggagaactcggagcctgagtcgggcgag

SEQ ID NO: 9669 - DNA, 308 bp, Homo sapiens
tccacaggccgagcccacgagcccctcgaggggtgagcggcccgggcctcctggcgttctggccggctagccaagcgctggactacatttcccagaggcacggcgtccggagcgctggactacatttcccagaggcaccgctcccggagcgtagcttcatttccgttagtttgcgagatttggaggcctcgcgtggggagagggccgcgtctgtggaggagcttggctccgcacctgctgggctggcgaacccgaaattgggcttggaacccgggagccagatcttggaccctgaactgcacctctgt

SEQ ID NO: 9670 - DNA, 1100 bp, Homo sapiens
ctggctccacgcagcgcttgcagactgtgagcccgcagggcagcgtcaccggcttatgcagcagccgccggcagcgcgggcagccgagcaggtcgcggggcgcgcggggctccggggccggccctccctcgccgggcgcctcgggctcgccgcccgggttctccgcggacagcggccggtcgcgcaggcccacggcgcgcaccaggccgcccgccagctcttccagctcctccggccgcagcgccccgagccgcgcggcgccgcggaacgcgcccagggcttcggggaggcggccggcgcgggccagcgcgtcccccagcctcaggcacaggccgcggtccggctgcgccagcccggctagcatggagcgaaagagctcggctgccatctcgtagtcgcccgcgcggaaggcctcgtcgccctcctctaagcgctgggcgatcggctccgcgcggtcgcagccaggacactggggcggcggcggcggcgggaccggctcggggctcatcaccgcggggctgcgacgacgcgggtccggagcgaaggcgcggagcagggaggatgcgctgctgctgggaactggccggcgggagcgcggtctcagccctcgccagcagccacgcgcgtctgggggcggcgcgctgcgagcggctgagaccgcgggcgggggcgggcgcctggcttgggcagcgtcctcagcgcggtgtgggcggcgagccccgcagggctgcaatcgttccggggtgggggccgggacaggcaccgcgggcgcaatctgagcccctgcccacgcgcagcggcctctcagtcccgccggcttaggtaacccaggtcgctgcggtaacgcagtgaccgcgctccaggtccgcgtctcttgcgatgcttcccccactcgcctgagggctcctgcgcgactgcgcgcgcgtcctctgcctgccgcctccccgcagaggtgccggggccctgggagcaggtggccttggccgcgggctgctggcgcgccggcaccgcggcacctgctcttccccagaggcctggccgcccccacaacctgtggctccgcttaagcaagaacccaggaaaagtcaccaaacgcatca

SEQ ID NO: 9671 - DNA, 214 bp, Homo sapiens
ggcgagagcaaaaaaaaaaaaaaaaaaaaaaaaaaaaaccctaactgtaaatattatttggaggtgggcgagggcgcggcgtgcgcgcggcggcgggtggcgggcggcgcgggcgcccttgcggggattcccggtctctcagcgcgccctagtggacgccctgcctttcgctggctccccgtgctcgttacaatctgcaatatattatttcttc

SEQ ID NO: 9672 - DNA, 582 bp, Homo sapiens
ctctcccgcgtgcgccccgcacctgccgggggcccgtacccgccctcgccggggctccagggggcacgacggccgtggcccggcgctcttgggaggggagcgggacatccccgaaggcggcgcgctggaggcggggagcggccggggcgcacggagagggcggggagcccgcgggagggggaggagggggaggagggggaggaggcgcgaggtgggggggagcgcggcgggcggcagggagggagcgggagggaggcaagaaagtagcagaaagtgaggctggcaggcggcggcaaaggagccggcgcgcggcggcggcaggaagtctgtgcccgagaacagcagaaataagagccagggagggaccgcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagct

SEQ ID NO: 9673 - DNA, 203 bp, Homo sapiens
ggcgacactcgcgccagctcccgggacggctgggctcgggctggtcgccgacctccgaccctccactagatgcctggcagagcccggcgcgtccggagcccgcgcccctcagagggaaggggtcgcgcgtcgccgcggcggccctgaggctgacggtcgggaggtgaaaggccggagtgcggggtcaggacgcctcctggagg

SEQ ID NO: 9674 - DNA, 823 bp, Homo sapiens
cgagttatccgtattctccttcaggagtcatagtcaggccagaagagtgcggagggacggggcccgggaagagcagggaacccccagagcccgcagccaacgcggaggtgggcgagcgggcgtgcgcgcactcacttgccggcgcgagggagtgtcgggggggaagggagtggtctccaaaagggggaggggagaaggcagggggcggggagaagccggccctttaggacccggctgcggcggcgagggaggaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcaggtaacgcggtctggaacaagtagttg

SEQ ID NO: 9675 - DNA, 293 bp, Homo sapiens
ccgcgcggccctcataatgcagggactcctctgagtggtggccgtcctcgtcccagccctcggtcacccgcagcttcacaccgggccactggttcatcaccgagatagccagcgagttcaggcggtccttgcagcgctgggagaggaatgtgcgcgaaatcaaccagagcgaaatcagccggaggagccggccgaggtgcaggtgtaggcgcagcctcgcccagaactctcccgccacacccaagggagctggaagcccgggagggtgctgtccctctcccttaggaacagag

SEQ ID NO: 9676 - DNA, 262 bp, Homo sapiens
cggacgcgctgattggctccaggggaagcgggaggcgagaacaatggccccctccccccgttaaaagggagcggctgccgggcccggggacagggacgcgcgtgcagggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgc

SEQ ID NO: 9677 - DNA, 240 bp, Homo sapiens
ccgctgcggggtggagggacccgcgccccccagcttctcgggcccgggccgcggggaccgtgcgcgcgtccccctcccgggcaaggccgggcggcgggcgcgccgcggcttctggggtccccgccctcttgtccgccatcgcctgcgggagcctctggcctggaggggctcggggcgcgctggcgactgcgggctcggcgacaggggcggctggtggcgggaggacagtgggaggaaggc

SEQ ID NO: 9678 - DNA, 1240 bp, Homo sapiens
agcgggccggggccgccggccaagcctttgtctggggacgcggcggcgcgccggagagtcccgaggctgcctgcaccgccccagagctctgggctgtgcccgcgcagggaccgggccgggtagagtcgggcggggtggagaggcaagcggagcgcgcggtggggctgaggggaggcgtggggcgagtgcccgttgctcgctctctagctctcttgctcttacgctctctcgctcgcagccgctcgcagctcggcggtgcagctgtgctggatccggcggcgccgcagccttttatcgcctcctgatgtcactggggtgcgggggcccgggcggcccggtgcgcgggccaatagctgcacggcctccgcggcccagcggcgcagggcggggcgcgcctgacagctcccccgccccccgcgtcagctgactggcggcccgagcggccccggagcggcggaggcctggcggagcgctggagcggagtgggacggccagcctgggcccacccccgtaccctgcaggtcccggcccacgcacgctcgcctggagtgcgcgccccacctctaggccaaatcaccgctttcccctcctcgcgcactctcctccctcagttccctttgcaccccacccccatcccgtgtcacccccaaggaggctcagaatgagcgccgggacaacgcctcctgggccctttgttcccaagcggcccccgcccagtgggcgacgctctgtgtgtcctcgcggcttctggccgtgtgtgtcgtgcgttcctgtttctggagatctgcgcgtatttgtatgttggggagggcgggctcgaggctccgagagttgtgttcagacccaactcttaacctcaggggacctttctcaggccaagcgagggcccctcctggcgggtgcagtcgcagagccctgaggttcgactccactggccccgccgctccccgcgttcaccccaccgcacaatgttcacagtgaaggcgacgggaaaagcagcagcccaaaggctctgaattcctcttccccgccacacgcacggaatcctgagcccccggagcctcggggccgaggccggcccgggacggtgctccgagtagctctccactgctggggagccggccctgtttttgtttgaacgttttgtaacgattaagcagatcccggcgtcagcccgccgcggagaggctcaaacaggcataaagtgcgaccccaagtggccactgtgcgcaaaggcgcc

SEQ ID NO: 9679 - DNA, 222 bp, Homo sapiens
gggcgacctgctgcttccgagtgttcctgggctgcgccttcttctcctacttgggcggccgcgccaagcgcagaggccgcgggcgctccggggccagaggcgccttcggctcgggccatggcgcccggcgccgggggcgcgaggagcggctcatctagtcagaccccccaccccgccaccgccaccagacaccaccatcgctgtgtagtgtgggtttttatt

SEQ ID NO: 9680 - DNA, 714 bp, Homo sapiens
ttcagggaaagtctttgaaagtacaatccggaaaactcagcaattcttaaaaaaaaatggctttccgctgttataagcctccttcctaagactcagggtccgcagcagaataccctgacccaaaataaaaatactatgacaaaaatactccaggaggcagccggctttacttcgtttaaagccggatttcgcttagtcccgtgaaagcgaaggagcaccagcgcttcctgattccgcacagttctctcggcagagacggcccgtcctctccaagaaccggaagccggacagcgtcaggacgttttattcttctcacctgggattcagagaggcagcggccaaggacagggcccccgccgaggccaccgggcagcgtccaggtctcggcctttgggaggggagcagcgggggaggggcacggggaggggcgagggcggggcgcgcctgggcctcggcgctgggctcctcctctgcccgctccgggggacacccacaggattcttgcagacctctgccgaggcaggatggaggcctgcagggatgcaccgcgggcccgcgacccgggcggccggaacatagttctttctggccggagatcggcccggtcgtgagtcgtgtctgtgccaggccccccacgctgtgctccagggcctcagtgcccggcgcgccgggggctgtatcgccagccacttggggcaggaaaaaggaatcaca

SEQ ID NO: 9681 - DNA, 1216 bp, Homo sapiens
aagtttcagaaacgttttcggaaagcctcctccaatgggaagcgacttcgccgctgagttaagcgtccgaatcctccttcccgcggcagggacaccggcccgggccaggtctgcggaggacgcccccgggcgcgcacacacagcccgaggacgcgccctgtattttaagacgcagggtcggatttcaccccgaaacttggctcccacagccccaggccgaactgtgtctggttctcagcccccgagcccgagttctacgccgcaaagagatggggccccattgtgcctagctggcctcctagcacggacgtgtattttcttttggtctgtcttttgctaaaaaccggcagtgcgcttcgcctccctgcccagccgcagcctgccgtcccctagacaaaaagcggcgaccgcggcccggccacccgagccccgccgcgctgcgcctttgttgggcggtccacagatggtgcccagcacggggccgcgccgagggcgggggcgggaggccgcgaagagggtcgggcgggaggggaggagacggcggagcagccaatccgcgcgcggcccatcagctgaccgcctttgcttacaccaggtgcacgccggctgcggggagcacaaagcggggcgcaccgcgggcgccggcaacgagccggtgaacgaggcgaggcccgtgcgcccgcggctgcaagcgcccgcctggcggggagaggggccgacggcgtcagcccgggcggcggcatccctaggcgcctggggcgccttcctccggacctggccgctcgctgccccgccctctgcaccccacttctccgaccctccttcccagtcctgcctccccctgccctggcctctgagagccgactgagcccagccccgtgcagcagcggttgcctgtgtcgccgcctagtctccggtcttggtgctctcccgggggtgccccaaggagccagtgcgcgctgcgggctgggaaggaggcgccgctcagctagtcctcctcctcctcctcgtctttctcctcctcctgctgctgctgccgccgccgccgccgtgggtgccgggtccgcgcgcaccccaacacccccaccagctgggcctcggggtaagtccctggccggccgcgccgcggcaggaggtgtgggaggcagcgaggggaagtcgaggcaaacttggtggcgtgggagaccctacggggtctggggaacctcagggtaag

SEQ ID NO: 9682 - DNA, 207 bp, Homo sapiens
agttccccgcaaattccgcccttcccgcctggcacggttcccttgcaccgctgtgctccgctcccaggtttctgcccgccaagaatgcttgccccgggggcgcgctcgctggtcaggaacctgtcggcagcccccgggaacccctgaggatgcggaggtgggcccgagagctgcggcttcgatgccggggtgggagctaggcaggcc

SEQ ID NO: 9683 - DNA, 253 bp, Homo sapiens
acgtccagggacaaactgggagccgtgactgtcaggccgcgcggaggctgccctggccgcctttgcggtcaggtgaaggcgcagaggcagggaggccgggcgagcgcaggcgggcggagagcagaccacgcggaagaggccgagagagaaagcggggcacccggccgggggggtcatttacaagggacgctgggcacgaaggaggctggggcgaagatgagtccaggggttgggttgagagcgctgcgcagcc

SEQ ID NO: 9684 - DNA, 209 bp, Homo sapiens
ggacggcctgtgagggatgcgccgcccactgccccgcgccgcctgaccgtccccgcctcgactcgcggtgcgccacagccgggcccgcggccgtccccgccgcgttgtcgcccggtcgccgcgcccgcggggccgcgcccggcacggccatgtggacccccacggaggaggagaaatacggcgtaggtaggtgaggctcaggcctggcc

SEQ ID NO: 9685 - DNA, 225 bp, Homo sapiens
cgctcggccccgtcccgcaggctgcaggcggccctggagggggcgccctcgccgagcgcgcgccccgcgccgccgccccggactcctccccggcgccgcgcgggcaggttcgaccaggcggccgcgggctccggttcccggccagctccccagggcccgcggcccgccccgccccgcgcgcccgccccgctgcgcaactcgacccaagttggaagccgatcgcag

SEQ ID NO: 9686 - DNA, 1133 bp, Homo sapiens
aaggagagttggaagggttcgtgcagcaggacagcgggcggaagcggggcgggcgagcgcggggccgccggccggcagccggagcagctgccgcggcgcccgaatcccggcggccgccgcgctttcccgcttcgcggagaccgacgcaggcgcccgcccccgaggccgaagggcactgggcggcgagggctgcggtagctggcgactccgggggcgtctgcgcggcgcgcgctagacgaggctgccccggcggccaccccgcgaccccgcgtcgccgggatttgcgcgcggagaacgccggttctggagggagcacgcctccccaaagtgcagaggagggtccggcggcgcgtctccgcggaaaccctctccactgtagttaccccggatgccgacttagtagtttgttttccgagaaaagagaggggatctgggcagaagggccccgtttgccccaaaagaaggtgcaaggatcagaagataacgaaacgtccacttcctgaagggtgggaaaaaaagaaaaagaaaaaggagccacccacgctggagatgtccgttttagatcttcttattttcttccctttcgcttcggtttttcttctcgaggctcatttaatctgctagagaaggaggaggagcagaagatgggggccgaggaggaggggaagagaaagagaagtttgccaagaataaagtttttgccggcaagcgcggggactccgcagtggagggcactgcggagtctcggggagtcacagcgggggcctcgggcccaaatgcctctgcccggagctcgagccgacacacacactcagtccgacccctctttgttcccggctcgagtttctcagcctggctcgccggctcgccgctctgcacgcctccgccggccagctctgtcaaagcaaagagctgcgccccttgagttcgcccggccgaggggaggggacgccccgagcttggccgcgtgcgaggctccgggcgcgtcctggttcctcggcccgagagcgcgcagcccgggtccctcctccgcgccctgccccgcaggtgagcggctgcgcctccccactgcttctcctcctcccgcgcctcgccggcgctgaaaagctacccacttgcgtcgcttctcctcc

SEQ ID NO: 9687 - DNA, 478 bp, Homo sapiens
cggcccgggaggcggaaggtcgcggacctgcccgacagaagagtagatgaggggagaccgaggacgcccgggtccggggagcttacgaggaggccaggatcgcggggtaaggaatccgcgggcagttacctccgccaggggcagggtccggccagtcaggcgcgagaaggctaggcgaggccgactgcgcggggtgaagacgccaggccgacagctgcgggccctaccgccagccctgacgcgagcctgcgtcctggcgacggcggagggcgggcagggggcgcgggcgctgccacggcgcctgctcagaaccggccgggaacgccgcgggcgggtctccccggtcctccgcccctccagccctgctctcaggcctccgcccgggccctctaagctgccagccgcgcccgcctccgggctcctcgcccctcctcccgcgcgctcccctcctcagcggccgccggaccccctcagttca

SEQ ID NO: 9688 - DNA, 201 bp, Homo sapiens
ccgtacgcggagtccataagttgtctgtgtcgtcactttctcggttctggcaccgctagtatctcctaggaacttcctaaacccgttttacggtgcagaacggtaattgcaccgagcctctgtgccaactagtacttccgtaataccgttagccggctcttttcctgtcacaacacattaaaacgtgttaaaacacattaa

SEQ ID NO: 9689 - DNA, 208 bp, Homo sapiens
gatgagcgccgtgtagtactcctggctcgcgttgtctgcccgtgccggccacaggctgcaggtcagcagggcgagcgcggcgagccgggcagggcccgcccgccccgcgcagctcatcgtccctccggcagccgccgctgctcgcggaccgggctccggggccggcgcctagaggcggggcgggcgcggcccgggcggcggcgggagc

SEQ ID NO: 9690 - DNA, 210 bp, Homo sapiens
actccgtatacgtgtacaaggtgctgaaacaggtccaccccgacaccggcatctcctctaaagccatggggatcatgaattcctttgtcaacgacatcttcgagcgcatcgccggcgaggcttcccgcctggcgcattacaacaagcgctcgaccatcacctccagggagatccagacggccgtgcgcctgctgcttcccggggagctgg

SEQ ID NO: 9691 - DNA, 229 bp, Homo sapiens
tggctcacctgagctcaggggtttgagaccaggatgaccaatatggtgaaaccctgtctctactaaaaaatacaaaaattagccgggctatggtggctgacgcttgtaatctcagctactcaggaggccgaggcaggagaatcacttgaacccaggagcggacgttgcagcgaccggagatcgtaccaccgcactccagcccgggcgagagggagaccctgtcttaaaa

SEQ ID NO: 9692 - DNA, 209 bp, Homo sapiens
aggcgggggagagagatgacgctggcggacgtggccagcgcgggggccgggcggtgcgctgcaggccatctgccggcgccctgagacccaggagcctccgcgctcccgcgtgggcctcacagggccggtccacagctccaacatagtagctgaactcccttcgttgcgttcctctttttctggaggggaatgttagaagagagagagag

SEQ ID NO: 9693 - DNA, 255 bp, Homo sapiens
gaaggggcctggagtcttcctcctggggcattgtgctgggaccttgaggactggggacccggagggagggtaggcgtgccctcaactcgctgcgccggaacggcgtctgatgagcggcgggcccggacacgaggggacggggccgatttgtgggcggggccttggcgccgtactaaaaccgcgtggggcggaggccggcagaggtcgcgtagcgggcccagggtagggagtggctttgactcgctgcggaataac

SEQ ID NO: 9694 - DNA, 297 bp, Homo sapiens
aggccccgcccactcgacgtaatttgcccgcccctctccaccctccgaagggtggagcctgaggccccgcctccaagcggcctctccccggagtgcctggcggccagcagggcggggcaggaggctgggagagggacgggtgcgggggtgggggagaggaagggagcggtcacgtgtgaggggcggcccgaggtcacgtgacggagcgccggagcggagggagccggggctgggagttctcctgagggaagaggagtggagtaggggggacgcggcggcggcgttgacaatggtgag

SEQ ID NO: 9695 - DNA, 232 bp, Homo sapiens
gtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagaggaggaggaggaggaggaaggggcttggagcgacta

SEQ ID NO: 9696 - DNA, 247 bp, Homo sapiens
ccgcgcccgcagccgcgttcctgtctccccgacctccgcacccccacttggcccggcctcctcgccttcctcccggctcctcccctcaggacacctgtgtcgtcccaccccctccaccacacacgcaccccccaccccaattccttcgcctccctgtcctccctcccccgccggtctcccctccccgctgctgccccgagagcccgatgtgggagggaaggcgcgggggaggggaggccgcgaaggg

SEQ ID NO: 9697 - DNA, 292 bp, Homo sapiens
gccccccgagccccctgcggcgactccgattcacccccgcgggtgcggggcgcggacccgcccggcccagctcctgctccccaggcgcttcctcctcccgcgacctgccccggccgcacccgcctccgctccagcacgcgacgctgcccggcgcgacccctgctcccccggcccagccccaccgctgccctcgactcaatcccagttgaacgcccgcagcctcagtcccacccccggcccagccccagcgcccccagtcccacccccggccccagcttcagcctcagcgccc

SEQ ID NO: 9698 - DNA, 201 bp, Homo sapiens
gcagctcggccaacggacgggccagctggttcccttcaggggcagccttgccccctctcccgccccgtctccctcccccccaccacaccgggctgtaacccgagccgccgagccactgcctcccctccggatcctccccggaggctctgcggcccgggcccccgcgccttgctgccccatgcagccctgagccccacagca

SEQ ID NO: 9699 - DNA, 201 bp, Homo sapiens
ggccacgcgtgtttctggcgcgagtgtgcggggccaggccgggagggcgtgcgcggaccgggcgtgtttacgcgcggcagggaggggccacgagggtgcgcgcgtttctggcgcgagtgggaagtgtggggatccggcgggcccggtgtgaggggcgtgtttctggggcgagagtggggagtgagtgtgaggagcaagggt

SEQ ID NO: 9700 - DNA, 201 bp, Homo sapiens
gggcgcggccgggcaggttggggggcaggtaggggccgcttccgcggggcgggaatcccgcgccccctccccccgagcctcaccttttatggtaaagcggcgcggggcggcggggcggagggagccgagggggcggggagggcggacgggcggaggggacgggaggcccagcggctccgggctccgctggctcgggcgtcg

SEQ ID NO: 9701 - DNA, 201 bp, Homo sapiens
acccccttcctccatcctccctcttcttcccccattgtcctccccatccttcccttcctcccgcctcctcccctggctcctcctctccccgtccgggactcggggggaggcgcgctgggtggtccggcagccgggggcgggcggtagcctgcaggcgtaattggcatgcacgccgttgtagctgagaccgcttaataaagc

SEQ ID NO: 9702 - DNA, 201 bp, Homo sapiens
ccgtttccgccaaaggcttttccaaggggtcgtcccagggccccgctccgtgtcccgccccggcgcccaccccggcgcccgcctcctcctcctcctgctgcggctccggcaggggctgctgcggcgactcaggctgctgcggctccagctccaccagttgctgctgcttcccaaggagacgccgccgacagcggagtagtg

SEQ ID NO: 9703 - DNA, 201 bp, Homo sapiens
gtgcggccggggcgctgcccggcagtgcggtgtccacgggactgacaggcaggcaggccgcgggctgggatccggacaccaaagcaaaagcaccgctgggcgccggaggagccgcggggcttccatccttcctttgactgatttttaaattttaatttgtattttccccgccgccccgccccttttcctccgaccccgccc

SEQ ID NO: 9704 - DNA, 201 bp, Homo sapiens
catcgcgccgtgcgtccgcgcccggccgccaggtgccccagtagcccgaccgccgagatgcccagcccgccggggctccgggcgctatggctttgcgccgcgctgtgcgcttcccggagggccggcggcgccccccagcccggcccggggcccaccgcctgcccggccccctgccactgccaggaggacggcatcatgctg

SEQ ID NO: 9705 - DNA, 241 bp, Homo sapiens
ctgcgcgccctggcggcaggaggcggggccgggggcggggcgtgagctggccggggcggggcctatggaggggcgggaccgcggcgccctataagtactgcggagcgaggcgcgcgcccggccagagagcgagcgcgcaacggcggcgacggcggcgaccccaccgcgcatcctgccaggcctccggcgcccagcgccccacgcgcccccgcgcccccgcgcccccgcgcccctttcttcg

SEQ ID NO: 9706 - DNA, 201 bp, Homo sapiens
ggcggcaggcggcgcggcgggctgggcgcggcggtggttaggtcggtgcggttgtagtccatgcacagcgtgtcagggttgccttgctcgggcagccggtcgcagcgcatgcggtcgggccaggcgaagccgtactggcgcatgagcggcgcgcagccggccttggcgcgctcgcacaccgagcggcagggcggcagcggc

SEQ ID NO: 9707 - DNA, 201 bp, Homo sapiens
aagtggggtgaaaatgacctcagtgaatagcccagctccctgggacagtggcctggtatttttgacgtgggagtggcgtctgctctgactcaacctggaccggcccagggacaacacctccttcggagtagccgctttgtttcgtttcgagcagcccagctgcgttctgcatgaccgaattggacacctctcacttcctct

SEQ ID NO: 9708 - DNA, 201 bp, Homo sapiens
cccgcgcctgctccgcaccacggagccgggcctccagagcagcaaggtcaccaggtggcggtgctggcgcagcaggcggagcgccgggtgcgcggggtcgcgcctctggccctcgaaggtgatgaagatgggtctgcgggtgagctccagcagccggcacaggccctccctgcggggcgggaccgtcaggggggtgggtgc

SEQ ID NO: 9709 - DNA, 201 bp, Homo sapiens
acggctgggccccaggagacactcggaggggtccgcgggctcggcccggtccctccgctggggggttaccagccggccggcagcgagatacccagaggcccgtttttccaccgcgttgccatagcaacggcctggccggctgcgccccgggccgcccgccccatcccgcgggcccgccctgagccagtgactccagggacc

SEQ ID NO: 9710 - DNA, 201 bp, Homo sapiens
tccagatggtttcaatcactggaggaaaaaagcggctcttctggtatgcgtgaaaagccggagctgggagagtctgggaaaagctgcctgcaccgcccgccggccttcaaacaaaccgatgagctctttcccttctcccagttctcgggcctcgggggagccctacaaaacccaaatgaaattcaaagaagctacttttgg

SEQ ID NO: 9711 - DNA, 201 bp, Homo sapiens
ccacaaagcatcagtggtgtctccccgaggaatccaagaccccccggccggttgccaagccgccggaatttcagcaggagaggaaggctcaccctcccaccgcatggcgatgcccgggagactggagaagctcaggcaggcttggaagccaatccccggcatacagcagctctcgggaatgcagagccctagagcaagacc

SEQ ID NO: 9712 - DNA, 201 bp, Homo sapiens
tagtagagacggggtttcaacatgttgcccagggtggtttcgaactcctgagctcaggcaatccgcccacctcatcctcccaaagtactgggattacaggcgtgagtcaccgcgcccggtctgacagcctttccagaatgaagtttgtctcggaaaaaagagccctggccagtgtctcctctggggatcagcggaaagcac

SEQ ID NO: 9713 - DNA, 201 bp, Homo sapiens
aggggagctgaggggcggagtcaccggggcgcgcccccgcggctgcgctcctccccgccggggagcgcgggcacgtaactcggagggtgctgggccggcccggagcacgcgagcagcgggaggagggaccggggaatgactgacggaggcgggccgtagaggccgctgtgccccgccggcccgcacccggccggagtgtgc

SEQ ID NO: 9714 - DNA, 201 bp, Homo sapiens
ggtccccgcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtgagtacgcggcggcggtgcgcggggg

SEQ ID NO: 9715 - DNA, 201 bp, Homo sapiens
cggggagggaggcttccggaaccccgagagagcacccgtgcctcgcgggccccgtgccccgtccccgggctccccttcctctaacgcaggggacccagcccggggcagtgccgggcactggcgctggcgccccgctcagccctgcgatccttctccgccccgcccctccccgctccgccccgcccctccccgctccgcccc

SEQ ID NO: 9716 - DNA, 239 bp, Homo sapiens
agagggcgagcgagagagagacacacacacacacgcacacgcacacgcaggttacatgaatgggaggcggtagccaatcctacgaggccggcgagccgcgcggcgcactggcgctgggagcagggccgcactccggcgcgggggggcgccacgcaggtgatgggcgcctctccgggggccacgcgcggccgctccctcaccccagtctcggttcctctgtctccttcccccttcctctc

SEQ ID NO: 9717 - DNA, 201 bp, Homo sapiens
ttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaaga

SEQ ID NO: 9718 - DNA, 201 bp, Homo sapiens
ctgccggggagaacatgcaccaggtggctgatggctctgtggatgtggtggtctgcaccctggtgctgtgctctgtgaagaaccaggagcggattctccgcgaggtgtgcagagtgctgagaccggtgagtgaaagggtgtgaggaggactagttagtagcagctattatcatagagggcaggcctgtcaatttcaggtgg

SEQ ID NO: 9719 - DNA, 201 bp, Homo sapiens
gaggcggaactcaacggaagtgaagaaaagactaacgggaaagaaggacgagtacgcggtcccgggacagacctccaaagcttcttcctgcgccccctggcggccggagggggagcagcgcggacacgtcccccggccaaccgttggttaccaggctggagtggggtttttttctgttgttttccatgagactactgtttt

SEQ ID NO: 9720 - DNA, 201 bp, Homo sapiens
gcgatcacgggccccggcgaagatgcgtcgcctgagcgcccgcgcggcccccgtccggggcgggcgtgacccctgctgaacggagacctcccctcccccccgacttcggacggcgcaggccggcgccaggatagccctcaccgacagcgccccttcccacccggagagaggcatcgacccccaaggagggcttcgtcaggc

SEQ ID NO: 9721 - DNA, 201 bp, Homo sapiens
tcgcccccgccgctcggggcaggcgcgccgatggcgtttctgaggtgacgccgcccacaccgggcttctccgggggcggaggaaacacctatgaaccctccggcagccttccttgccgggcgccaggtaagcagcggttccgggcgcggcggggcgccgcgggaacggtgcacattggtcgaaatctattgcttctcaaga

SEQ ID NO: 9722 - DNA, 201 bp, Homo sapiens
cccgccacttggggcgcctggggggctctggggcgggggaggcgggggctttgtctaactccgccactgccaccaccggccaggccgcggcttggcaacccgtgaacaggaggcagggctgcagggcgtgagggatgatgacaaggaagccggaggagcagcggcggcagcggagagtccatcttggatgcaaatggcagg

SEQ ID NO: 9723 - DNA, 201 bp, Homo sapiens
accccgcgccctgcgccttaaccaggactgctccgcgcgcccctgagcctcgggctccggcccggacctgcagcctcccaggtggctgggaaggtaggtgcgtcgctgtccccggcgcgcggcgtcccgcgaggtcttcagccctcgccctggtggatccccgctgggtgggagccgggagtggaggcggccgccctaggg

SEQ ID NO: 9724 - DNA, 201 bp, Homo sapiens
cgactcggccgtgagcgtgccccgctgcagctcgctgcccgccaggtccgggtggcagcgcaggatgccctcctggcctgcggagaagcacagacaccggcgggagcgcgtcaaccgcgcccgtcccgcaccgcgcactcgagggggcgcgtaggccgcgcccggcccccctgccccgccccgccccgcccggccccaaag

SEQ ID NO: 9725 - DNA, 201 bp, Homo sapiens
cggcctgggaaggcttcggctcctcggctgcggctccagcccggacggcgccgcgcaactttgccatccttctggcccagccccggctacaggaggaccccgcgggcaacgcgcggagttcctggcacttcccggcggtgtctcttgttgtctgcccggggaccgacttcgcatgctctcaggctgacctgtccaagcccg

SEQ ID NO: 9726 - DNA, 201 bp, Homo sapiens
gcaacctcggcggagtcggcgcctctgggcacctctggcttccgcgccccggccgcacggtgaccacccgggaggggatcccgggcgccccgcaacctcccggcccccgtgggccttcgggtcgccccgcttcccgccgccgcgtacccttcgcgcctcccggccctcggtgccggcccccgccccgcgtagctccgagtc

SEQ ID NO: 9727 - DNA, 201 bp, Homo sapiens
aggaagcccgaggtcggggcgttaccccaagggccctcccgcttcccctccgagggcagagaggcgtccgcgcccggacgcactgcgggaacacctggagcgccggcggagctcggctgtccccgcgggagggagcccgacgcgcatccttgggacccggacccggcgcccgcgcctcgggacggatttctgcctcggctg

SEQ ID NO: 9728 - DNA, 201 bp, Homo sapiens
ccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtg

SEQ ID NO: 9729 - DNA, 201 bp, Homo sapiens
cacgcctggggcggccgggggcggggcctggctggaattgacgcgtggagctccggtggagggggcggggcctggctgggccgctgcctacagcggcttccggggcttggaggtcacggggctcggaggtcacggggctcggaggtcacggggctggctgtgtggggggctcaggggcgtagagtggccaagcagcggtct

SEQ ID NO: 9730 - DNA, 201 bp, Homo sapiens
ggccctgcagccctgcagcgttcggggcggtgcaggagccccggggtgccgcggcgcccgcccggctgcatcgctggtcccccggctcgggctccaggcccggcgcctcccacccccaggccgcgcgcgtcccgccctcccgacgacccccagccccgggcctccgccacttacgagtccccgtcctcggtgagctgctgc

SEQ ID NO: 9731 - DNA, 201 bp, Homo sapiens
gcgctcccgggggctgcgccgtgccgcctgttgtgcgcgcgcagaggccggacagcccggctgcgggaagggacccgagcgcagggtctgccccgcgtcccggaaagtgcctagtctgcggagccggaggttgagctggggcagatcggcgccagacgggggcctgggtgagatacgagttgggggtgcggcctgcagaat

SEQ ID NO: 9732 - DNA, 201 bp, Homo sapiens
ctctccctatcacccccccgcccccccacctctctcctttttctgctctgcaggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcct

SEQ ID NO: 9733 - DNA, 201 bp, Homo sapiens
gctcgtgccgctgctgctggctccagcgcccgggtcctcggtgagtgcggtcctgccccggcccccggaggaacctgcaggggagtcgggggcggggacgcgcgggcccgcaggcaacgtccccaggaaaggggcgatgtcagggaagctgggctgggaggaggcgagcccgcaccgctgagctccctcagaaagggctgg

SEQ ID NO: 9734 - DNA, 201 bp, Homo sapiens
cgctgggcgtcgcccgccggtctaggcgcgcgaacctggcgttcccagtgaatcacccgcggcccgggcgcccgggttcgggaccggccccctcccctcccgctgagccgcggccgagctggctccctgcaccctacccagcgtcgccgggacgcgatcacaccgagatggcaccgagcctccttcaaaggcttcggcttg

SEQ ID NO: 9735 - DNA, 201 bp, Homo sapiens
gcctcagtctctgggccggaagccccctctcctcccccgccgcagccccctcctagtccctctccctccgccgatgcgggaaaccttctccgccccgtcccgccctcttcctccagttgcatctccgcccggctcctccgtccagtctccaacccaggccccgcccctccccacccatttcccgccctgggccgggccccc

SEQ ID NO: 9736 - DNA, 201 bp, Homo sapiens
gatggcgacgcggatctgcaccgccgtcttgggcccgggccgagcctccccgccggactgggccatggctcgcgggactgcggcgccgccggggtcctcacgccgcaaggcccagccagccggtcggcagcgactgcgacgagggggcgggggcggtgcgagcgcgcctgccgctcggcccaggggagggacaggggtcgc

SEQ ID NO: 9737 - DNA, 201 bp, Homo sapiens
gtctgtctcgccgcccgggctttgtggctggccacccgcgagctcgcctcgcctcctctgccccggcccgtccggcccgtcccggggctcccgccgcaaccgagcggagcccagcgacccgccgggcttacatcagcggccgcctcccccgaagcgccctccggcagcgctcgggctcccgcgccccggaatattcatgaa

SEQ ID NO: 9738 - DNA, 241 bp, Homo sapiens
cgcgctggcccggcccccagctcctccggccgccgccccccgcccgccgcgccgcggcgccaggagggcggggccggggcgcgcgccgctcctcagcaagcgggcgggcggcgttcggtctgagggagcggggcggtctccgccggcgtcgcgcgcgctgtgtgtgagcggggtcgcgcgcgcgcgcggcaggcgagtgagggaacgaggagcggccgggtgtgagtgtgtgggagtgaga

SEQ ID NO: 9739 - DNA, 201 bp, Homo sapiens
ggtgccaagcgtggggcgcgggcccgcggcgggagctgtccgcgaaacctagtgctgaagtaggcgcggacgtgcccggtgcctggcgcgtggtagcaggcgcccggtgccccggccggcgaagaccatggcgttcatggtgaagaccatggtgggcggccagctgaagaacctcactgggagcctgggaggcggcgagga

SEQ ID NO: 9740 - DNA, 201 bp, Homo sapiens
gcgcgggacggagctccatgaaagttggaagaagtgattacaaatcgggacccgactctcgcagccttggcgctcgcccctccacgcaggcccgggatgccggcctcagcccccagatgtcgggaagacggcgccggccagtccaaggaagagcttccaggaggctggggagcaagggtgccgggctcctcatgccgggtc

SEQ ID NO: 9741 - DNA, 201 bp, Homo sapiens
ccctgctggccagagccgggcacgggccgggcgggcggcggggatcgtgaccgcggctgcgtgcgtccgcgtccgggcgcttctgtgcggggtcctggcacgccggcgggggcgacccgggtgccggcccgtgcgggcgacacgcgcgtctctgcggggctgcgcggggtccggagcggctgggggctctctgccgggcgc

SEQ ID NO: 9742 - DNA, 201 bp, Homo sapiens
cagaccccgccggccggcgcgccacccgcgccagcaccatggacagcggccgccccagccgcgcgctcagggccaggcccgggctggcttccaccgcggacggctgcggggtcggggcagccccgcaatcccaaatcccggcagcccccgctcagcagggaggggccccgggggcgaagagtgggggagaagccgggaagg

SEQ ID NO: 9743 - DNA, 201 bp, Homo sapiens
gtgtgagtctcgggggtccgggccggcggccctgccagccgggtcgtgcggttgcgggggtggggcggcggcgccgctgccatattagccccgggagcggcgagagggaggctggggtgggggcgcgaggggggcggcgcgaggggggccgattctgcgggcaggtgacatcacacctcgaaggccccagtgcgcgggcgg

SEQ ID NO: 9744 - DNA, 201 bp, Homo sapiens
gccgcgccatggtgagccgggcggggcaggccgcgcgctcgggccgggcgggggcgccggggcccgggggcgggaagggggaggccaggacgaggaggggcgcgcgcggcggcggggccgggccggggtctgcgggcgggggaggggcggcccggcgggcgcggctcgggggagggtccgttccaggggccgcgcccgcgg

SEQ ID NO: 9745 - DNA, 201 bp, Homo sapiens
caaccgggcacccccgcgcgcacacgcccgtgcccacgtgtgcacgctcacacccttgcacacacccaggcgcgcgctggcacacttacccggagaacttcgcacacacacgcactcgcaaacacgcgggctccctgcgccaccaggaagcagccgccagaatcgccgggtgttccccaactactcctgggagacctggcc

SEQ ID NO: 9746 - DNA, 201 bp, Homo sapiens
acacgacatggccaagcgccgccgcccgaaccggccgccgccgacaccccgctccggcccggggctgaggaggaagccgagaaggaggaggaggaggcggcggcggagggcgggggaagaggacggccgttccgggttccgcctgagcccgcagggcaggacgagggagcggcgcggtgagagaggcggatgaaggcgagg

SEQ ID NO: 9747 - DNA, 201 bp, Homo sapiens
cgcgcacagcggcggcgagtgggtcgtgcacgcggatgcggggtgggagtgggggcgcacgcgcgggcgtgggcgagcgggccccggcagtgcacacacacggcaggggcgggcgacagatgcagtgcgtgcgccggagcccaagcgcacaaacggaaagagcgggcgcggtgcgcaggggcgggcgcccagcgggcttgg

SEQ ID NO: 9748 - DNA, 201 bp, Homo sapiens
cctcaggggagctaagcagctcgcctgaagccccccatctggaaatgacgtgtttaactcggcgcccctgcagctccggccgcccttttttgtttaactccgcgcccctccagctccggccgcccttttcgtcgctctcccctcgcggtcgctcacccctgagatccctggttccactgagacgctcagcttcattcggca

SEQ ID NO: 9749 - DNA, 219 bp, Homo sapiens
cgcctgcctcgccgcccgcaccggcccagcccccggcgtccgcccgctctcctcgcccggagcgctgtgagccaggagcagccgcaggctcctcggacgcgcccgccgcgcgcaccacgtggcccggaggcggccgccagtctgcgcccgcgaccgggggcggacgctgcaccaccggctcggagctgggcaggggaggcctcccgccccctccctagg

SEQ ID NO: 9750 - DNA, 315 bp, Homo sapiens
gacgcccctcagagacggcgctggctcccctcggcggggctggcggcggctgggggatgccagccgggcgggccgcgggtcgcctccctttataggctccgagagcggggcggggttgggggcgggcggggagctgcctcgggtggcctcgcccccagcacggaggaccctccccgcgaggcgccgccgccctggagccccgcccacggcgctcgacggccggggaaactgcgggagctgggcgctcagtgggggaaaacgagccgcggacgcgaaggggcgggatgaggcccccggggcggggctcggggctcg

SEQ ID NO: 9751 - DNA, 201 bp, Homo sapiens
cgcgccgccccagcgctctgcagcggaggcgccgtcctcatcccgaccgcaggcccgcccgggccgcccgcccgccgggcaccgagccgctctgccgcgcgctgcgcctcggggcggggtgggaggagagggagcagccgccaccctgcccaggtcgccgcgggccagccctgcagccagctccagccctgggccgggtgc

SEQ ID NO: 9752 - DNA, 201 bp, Homo sapiens
gctcggagcggccgtgaggggcggacggggggcttcggggcgggcctgcaggtcttggggacctgaggctgccgggaggggctgccagggggcgctggccgggcgccgggttctgcggagctggggcgccgacctctgacccgcgagaggggcgccttcgccgtgctggtcgtagttgttattctcagcgtccctattatt

SEQ ID NO: 9753 - DNA, 201 bp, Homo sapiens
cggcggtgactgcggccccgcgcgcggctcggctcaggcaggacccgaagcgcggctccgggcggcggcggcggcggcggcggcgtggtcccgtccgggcgggtcctgcgggacaagacggggagccggtcacggggtggggcgactggcgctccgggagcaggaggagaaccgcgggcaggcgggcggggagggtgcgcg

SEQ ID NO: 9754 - DNA, 201 bp, Homo sapiens
aagcctcccgcccagccctgccggctcggcctgggcgctgtggaccggtaacagcagttccaccaggatgcaggccggactaagctcctggggaaaacccgttgcaataattgtttttcacacacaacttccaacccttcccccatttccgcctccaattcggagacttgcaaagcccaagaaagggaaaagcaactctat

SEQ ID NO: 9755 - DNA, 201 bp, Homo sapiens
cagcatcgtcccggctccgcgccaggcggcgggggaggggaggagggatctctttaggggtgggcttggagggggtgggggcggctccttcccccgccccgccgcgggctcactgtccgggaggggcggggagacagtggggggcagtcccgggcgggagtggaggcggagatgccgccgccgcagccgccgcggtggctg

SEQ ID NO: 9756 - DNA, 201 bp, Homo sapiens
tctcatgacgccgaattgcctgggggatcgccagcggtgcgccggtcggagccagctggtggcggggcgggcggcccggagtgtttgctcaaccctgagcgcccgcgagggggaggggaggcagctggtcacgggctagggggtagcaaggtggaggagcgggggctgggaaaggggagggtatctcccgggctgcttgtt

SEQ ID NO: 9757 - DNA, 201 bp, Homo sapiens
tccccccgcttcagccagacggggcgctcgcgcccccttccccgccccgcgttggcctccaacaggaagtcgtcccggcccctagcacgtgactcccaccgtatctgcataccggagggcgaactggccaatcggcactctgcacctgagctcctcccccgcgcgcccctcccggcccattggctcctcggccaggccacg

SEQ ID NO: 9758 - DNA, 201 bp, Homo sapiens
gccgccaccgccaccgcagctgcagcgtctcttcatatttccagcgcgccgccggccgggcagcctggccgcggcacggaggaggggccctggagggggcggtcgggggaggcgacgccgagccaccgcccccgggcagccgccgccgggggggagcgcggagacttgaaagggcgcgtcgggcaacgcctcccctcctcc

SEQ ID NO: 9759 - DNA, 201 bp, Homo sapiens
tcactgcctcctgggcggtgtggatcagctgcagagtgtgatctgcggtcagggagtgccttcccggagttttcgctttcagacccctggtgttaaagacgttctgtgagcgggtggggccgggcgccccagtcacggcggccgccgcctcctcttcccgcaggacgggacagcgcccctgtggatcgcgtcccagatggg

SEQ ID NO: 9760 - DNA, 201 bp, Homo sapiens
cgtggaggcgacaggcgccggcgacaactttccagttcgggcgccgcgcgccgctccgcgggacgcgcactggggaccccggccgtccttcccgccccccgcgcggacacaaagcccggcagccgcggcgctcagagggccgagggccatcggacagtccgggcagactctggacccgctccgcgggagctgctcttttgt

SEQ ID NO: 9761 - DNA, 243 bp, Homo sapiens
aaggctggagggtgctagaaagatgatcggccgggcacggagcggggagcccggagccgcgcgcggggaggggaggtggaggagggggcgccgggggagcggggggcgcgtgaggggtgcgagcggggcccggggggcgcgcggtgggtgtggggggcgccgggctcacctacctctcgtcagcgccgccattgccggtcacatgactgaggctgttgctgggatgacggtccgggccttagc

SEQ ID NO: 9762 - DNA, 201 bp, Homo sapiens
ctctgcacctgcaacccctcggggcagtgacacagctggcctcggtgtcctggcggagggcagaagtgatggccggttgcggtcttgtagggtgagaatcgggttagacaagtgagtgctttagagccggggagctgcacacggaggggagggagtggcgggcgctgcgtcgggcttctccaggaagaggtgagcgggctg

SEQ ID NO: 9763 - DNA, 201 bp, Homo sapiens
cgaatgtggccaagggggccgtccagatgggtgtagacacggccaagaccgtgctgaccggtaccaaggacactgtctgcagtggggtcaccggtgctgcgaacgtggccaagggtgctgtgcaaactgggctgaaaacgacccaaaatatcgcaacaggtacaaagaacacccttggcagtggggtgaccggtgctgcga

SEQ ID NO: 9764 - DNA, 201 bp, Homo sapiens
gccgcgcccctgggaacggtcagggaagcaagcagaagccgggaagccgcgaaagaggcgagaaagtgcgaccccctccccagatccccggtcccccgtcgaaatccctgtcggccggtcaaaccctagacaatggaagctccacgttttcatcctcattctcccccacaagtccggtcgcgggttcccctcggcccggga

SEQ ID NO: 9765 - DNA, 201 bp, Homo sapiens
tgtgacgactcctcaagggggctctgtgagcaccccctttttacagccaggaaactgaggcacagaagggagggactgtttggcaggagccaacagaggcgcatagagcagcgtgatgagccccgggctctgggggcgggcccgcgagcaggcagcctccaccccatggtggaccttcaggctcctccttctgccccggct

SEQ ID NO: 9766 - DNA, 201 bp, Homo sapiens
tacggagcccctccacgcgtccactgcggttccgccgtgccaaggggagcttggctgttcacgggcctcacctgctagcgagaagatagcttggccgggcggctgatctcaccttgtaattctgacactgtgtctcccgggcttgtcggcttcatgacttgtgcccaaagtttgatttctcgcagaccaggtaaaagccaa

SEQ ID NO: 9767 - DNA, 201 bp, Homo sapiens
ccctgtgtcctcacggcgcgcagaggcggcgccgcgaaccttgtgtgcattttacacgacggcggggactgaggtccctcgcagcccagagccggagcccggggtcggccgagcccgcaggaccggcttcctcgccgactctcacggcctcacccagccccctgggcccatggcggcgccggcgttggtgagtggagggtt

SEQ ID NO: 9768 - DNA, 201 bp, Homo sapiens
ccaccgcagccgacagctccacaaacaccaccgctcgctcagcctccgcctccccgggccggctgccacctcgcgccctcggcctggccctggccccgccggctgcactgcacggcccgtccctccgtccatctgcccaccaattctgcagacgccctgtgtccatcctcccctccttcctggccactctccccttctgtc

SEQ ID NO: 9769 - DNA, 201 bp, Homo sapiens
ggcgcccctcccgcccgcttgcgggcccgctgcgctagccgccgcaacaaagtttgacagggcgtggccccgcgggaagcgggcccggcgctgcccggccggggcgcaggcggctcggctcgggcccctccggcagcgccgagcctagggctccccaactcgccaccgccgccgcctgctccgccggggcgtcccagcccc

SEQ ID NO: 9770 - DNA, 201 bp, Homo sapiens
aaaataaaggatgggtgaacaaattgagatccggcttgctgggcgtcatgtggagaccgtgtgcaggaagagccaagacaccagagccgggggggctccggtgatccctgccgctctctgcatcctgggctcatggttggggcctgtccccctccagctggtagtgccatcctctctgtgccctaccaagctcaccagtaa

SEQ ID NO: 9771 - DNA, 201 bp, Homo sapiens
tgccgtggtctcgggtcactgcagcctccctgccccgggctcccgtggttctcctgcctcggcctgccaagtgcctgggattgcgggcgggcgccgccacgcctgactggtttttgtatttttggaggagacggggtttcgccctgttgaccgggctggtctctggctcctgacctcgagtggtctgcccgccttggcctc

SEQ ID NO: 9772 - DNA, 233 bp, Homo sapiens
agcactcgacctgtgaaaaccacgcctatgcagcaacacaattggtccgaaagcgtcaaagagccaatcaagaggcctccggctccccgcagcccacagcgcagcccgaccttctagagccgccgagcagacgcccggtgaattctagaggcggcggagggtggcgaggagctctcgctttctctcgctccctccctctccgactccgtctctctctctctctctctctctcc

SEQ ID NO: 9773 - DNA, 201 bp, Homo sapiens
ccggagctgcagtagaagcgcttccgacctcgtccaggccctcagcctatcccctcctgaaggtcggcagggggcgtcattaccgttggcttctccgcgcggctccggcctccgcttcgggaaccgagtgcctgcagcccgcgatcctggggaggcacagggttagggtaccgcctcggcggagaaagtggctgtgccgcg

SEQ ID NO: 9774 - DNA, 201 bp, Homo sapiens
gggggacgggccagccagggcaggagcccaaggacatgaggcaaagatcccaggctgggactccccgcagctcggaggcggggggtggggagggagggccgggggggtgctgggcggagacgctgggcactggggccagcgctgggcagccatgcacgggggcggggcaacaggcaggccagctgctgctgcttctcagga

SEQ ID NO: 9775 - DNA, 201 bp, Homo sapiens
aagctcgtgcagcgcgcgccgctccaccaacgcgtcccggcgcaggcggcagaggaaagcggcctccacgcgcggcgcccgcggccccggggccaggggcgcggccagcagtgccagcacgtcccccaccacgtcgtcgtcgtcctccccggcggtggccgagaccggggcgaggctcgcagcgaccggcccggcggggcc

SEQ ID NO: 9776 - DNA, 201 bp, Homo sapiens
caggaatgagcttgctgagggcccagccccggggccgggagtctgctgcaaaggatatgaaaaattctcaccattacttctgcatgtgaaaagaatatgcgtgttggaaataacttcctaacttacatatttttaaacatttgtttagacttataggagaaatatttttactgacttttgcataaagtgtactggaggaaa

SEQ ID NO: 9777 - DNA, 201 bp, Homo sapiens
ggggcggggaggagggcggagggggtgtaaactaagtggtgggaaagagacaaaggaagagtgaagagcgagacggtgcggatggggaagggggaggggcgcggaggggcagccggtgggcagcgcgccgaggagctcgagcttgaacttgatcaagcactgggggccctgccgtgggggtggggcgggggtacggccgag

SEQ ID NO: 9778 - DNA, 201 bp, Homo sapiens
agcccccaagggaggaggggagagctgcagagaggaggaggggtcggggaggccggctttataaaggcggctggaacaaccctgcccgccagaccccgtcgcccggatcccctgagctgcccgccatcccacgtgaccgcgccgccccccagctccaccgctgagtgagttggggcgcgtccctatcccgttcccagtccc

SEQ ID NO: 9779 - DNA, 201 bp, Homo sapiens
gaggagcagcagcgctcgccgggggatgcagcagcggcagcggcggcggcggcggcggcagcggcagcggcggcgcggagtcccctgcgcccagcggcccggccgggctgcggcagaggcggcggcggcgccccgctccgggtgaggttgccggggccgtgcgcgctggtgagtggggcgtggggggcaggtgggtggctg

SEQ ID NO: 9780 - DNA, 201 bp, Homo sapiens
gtccggagaagtggatcccgtcccaccgagaggccagggctcctatgccctcgtccccgacctcggtccagtggcccctgcctcccggactgtcctcggcggggcggggctgcaccccggagccccagctcacctcgcagtcctcttcgtacttgacattatcggttattttccacaacatggcgtccggcgtcccccaaa

SEQ ID NO: 9781 - DNA, 201 bp, Homo sapiens
ggaacctggaggaacatggcgctgtcgcctcctggcggaagcgcccgggcctgcgggcaggggcagccctccagggcccggaggcgcagtgaactcccgcgagtccgtagcccgagctccgcgctcccggcgcccctgagctcgcctagcgctgcctgcgtcttcttcctcttcccgctcgccgcctccttcttccctccc

SEQ ID NO: 9782 - DNA, 201 bp, Homo sapiens
gtcagggaccgtcctttactgtcctttggttgccgaggagcggtcaccgggcccggccccagtccctctgccctgatctttttttccaagtccccatgccgagttggagagcggtccctgagcacgcatgtggtccgaaaggtggcagctggccgggcttgggtccctcatgtgatccagtcatgcgagggaccggctgaa

SEQ ID NO: 9783 - DNA, 410 bp, Homo sapiens
agacatgttgggccagcagtgctggctccatcctagatttcttccagtcctccccagttagccgccaaggggcttttccaaccggaaacctccaatccgcgaccccggcgggtgcaccgccgagccccccgggaagtgtagttccagcgcgagcgggacgctgggaaatgtagttctgcgcgttcacgtccccgatcgggccgtgtccgccgcggccctgcgaggtccgaggggtaagggagcgtgcagcgggggcgggaccacgaggcggcggggctgggggcggcctctgtgtctgcgccggggatcgcggtgaccccgctgcggaccggctcgcggtgaccccagcgcgaacgagctggctgccggctggggcgagaaaggcctgcggaccggcctgggcgcatgcg

SEQ ID NO: 9784 - DNA, 201 bp, Homo sapiens
gagccagagatgcattcctggccggcctgagcatctgcgggaaccctgtgagcccctgaggttcacttcttgctccccacttctctctcctgcaaactccgagcccggggtaaagctgcttcccctccccacaccccttttcaacccgacaactaacgccctctagcttccgggaatgggacggatctttcccaaggactt

SEQ ID NO: 9785 - DNA, 201 bp, Homo sapiens
gggatcccccgctccccggcctagggggcacccactccgcacgtggagcccgggcagcgtccccagacgcacccagcgggataccggagaggacgccgacgcagtgcaacgccccggccgaagcgccgaacaacatgcgcgcgtcgcggaggaggtgcggggcgtgctcgctcaggcagcgggtcgccccgacgtggtaga

SEQ ID NO: 9786 - DNA, 201 bp, Homo sapiens
atgtgccctgccgagttgatttgctcagctcactctttattttgaaacgacgtcaagcatgaagaagagttgcacaaataatgccaataactccggtgccgccttcatgggggttatggtggttccagtgcactccacatgtcccccctctctctgtccctctctctcgtgtacacacacactgtttcctgatccaagagt

SEQ ID NO: 9787 - DNA, 201 bp, Homo sapiens
gtgactctgcgaggttacactccgggtgcgtcgctgcgggctcgtgggctcgtgggctgcagccccccgctcctgtcgggtggacgagccccgggcccgcgtggagctgctcggtcaaggccggcccgggaggggcgcggcgcagggcgggcaggggcggggtcctaggtcaacgtccagccccagacccagccccgccgc

SEQ ID NO: 9788 - DNA, 201 bp, Homo sapiens
ggagggagaaagggagagagttccagccgccccggctgtggcaggaggagccccaagagcgctccccgagcccgccccgcacctccaggctcagcccggcgcaggctccctctcccgccccctccacccccgccagctgctgaaacccccccaccgtccctccgcgggcaacagtgcccgccaggcgccgccgcgcggtgc

SEQ ID NO: 9789 - DNA, 201 bp, Homo sapiens
gtcctcaatgcgggcggcccccgcaccccacgcggcccggggtccctgcccatcccccgcgggcgggccccggacccctggggctccccagcccctctccgctccccccccgcgccggccccgtgccctgcggcccggcggccccggcggcgcgagtcgggggaggcggcgaggggtgtccccgaggcccggcggcgcggc

SEQ ID NO: 9790 - DNA, 201 bp, Homo sapiens
cccgcattccctttgatttttatggacattcagctaacagtaggaacaaaaattaagatctttcctttcccattcgcctggacacttatctttccggctcgcgccgccgtgtcctctacccggctacacagcgactccaaaagtttagctttcaccccgcggagatttcgacagctctgggaggctctttttaaaagggaa

SEQ ID NO: 9791 - DNA, 201 bp, Homo sapiens
agccgttcggctgacgtgacaagggaggtgcaggccaacacggcgactccgcgccctctggcggcagtgccggagcagcggcgctgtctttgacctatccggcattcggcttccgggaccgcttggcggctgtgaatgcagagctggggcgacgtggggctcgcttcctgggactgggtgtgagcttgcgcagtgagccat

SEQ ID NO: 9792 - DNA, 201 bp, Homo sapiens
aactgaacgtctgaaacgaaggtggcgcggcctggacaaacctgacccttcgacatcccccgcccctgcgcccgccctcgctaagcggggaggagcgaccgctacaatggatcctcccgcaggctttgtgcgcgctgggaatccagctgtcgccgccccgcagagccccctgtccccggagggcgctcatttccgggccgc

SEQ ID NO: 9793 - DNA, 201 bp, Homo sapiens
gccccgggcgcctgctgctccgtgcctccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagg

SEQ ID NO: 9794 - DNA, 294 bp, Homo sapiens
ctcgccgcccatgcttccactgcaaggccgcagcccccgccgccgatcccgatcccccgccccgcccagccgcggccccgcccggcgccccctccccggcggaagctcaagcccaattaattgagtccgaggcgggagggaagggccctgcgcgccgtggcccgccccgcccctcttccgcgccccttttcccgccctgggtggcatctcctccgccggcatccacaacaagccgctgattaatgaggccggggccgccccaccccgcccggccgggccggggccttcgcggga

SEQ ID NO: 9795 - DNA, 201 bp, Homo sapiens
caagtccatagaagagcaaattctcacccttcgaggctgctgtggaagctaccggggctgggacagcagagaggaacccagacgggaacaccgccctcccgccagactcccggcggctcctcctccctctcccaaacccactcccaaagctaagtgcaggcttccccgttccagccagaagcgctgcgtgagcctccacac

SEQ ID NO: 9796 - DNA, 201 bp, Homo sapiens
gaggcccacgctttccagaccgccacagtcgctgtcacagggcctgagtttgggcggcgccccgccccggccgcacggtgcgccggcgttaatcctccccgaaggttccggcagccaagattgcaggttcccaccaagcattgtttccgaactgggccacgagagcgtgtccctgattggcttgctctggaggctgggaag

SEQ ID NO: 9797 - DNA, 201 bp, Homo sapiens
tcccccgcgcgccgcctccccccgccgccggccgcgtgcgcccccgcccctccccccgcggcgggagcacctccgctcgccacctggggacccgcgccgcgctccccgcccccgcccgcccggcgcccatcccccgcgccctccgctcgctggggttataattgcctctcaccccccggaggggttattttgggggtggtt

SEQ ID NO: 9798 - DNA, 201 bp, Homo sapiens
gcggccccggtgagcggggcgaggggcgggtgggcagcggcgccgggggaggtcgaggaggcgaatggtggtgtcggggcggcgggtaccgggcgaggtcgcggccagccttctcgggccggagttgggcatcgcggggacggggagtgtcgggggcaggtgaggccagggcaggagcccacgcggtgggtgcgaaggcct

SEQ ID NO: 9799 - DNA, 201 bp, Homo sapiens
ggaggcgctgcgccaggcggaggaggagcgcaaggccaagtacgccaagatggaggcggagcgcgaggccgtgcgccagggcatccgagacaaggtgcgcgccgggccggccccgcctgcgggaaggcggccctgagtccagcggggacccagatcccgcctgggtggaaggggctgcccggaagaggggcgggcgtcccc

SEQ ID NO: 9800 - DNA, 201 bp, Homo sapiens
aaagagaaaagaaacagataaaaccagggcagggggtaaaaaagttccccgcgcctctcggaatccagcggccgcggccgcggctaccgccgccgccgccgggggtgggctccggaagagcctgcccagcagggaaggggaggacgggccaggagcgaaatcctgcaggcgaggaagggacagacgcgcaaagaaaaagtg

SEQ ID NO: 9801 - DNA, 201 bp, Homo sapiens
cgcgggcgcagcggcggccgggcacgaggccgggctgacaccaccatctgctggggcgcgggaagaacggcagctgctctgcgttgccccggcgagggacgcctggaaaaggctgaagccctgggcgtcctcaagcccgttatccacggggtccccgtcaccccagcctgctcgccgccggccgtcttttgtgattccctg

SEQ ID NO: 9802 - DNA, 201 bp, Homo sapiens
tttcccagggatggccttgtgcctgggctctcttcccctccaaactccggggtggcccctgctttatcagactgaaccggctctaaggagaaaagttgacgatcatcctgctctagcctccgggaagtcttgctccacaaagaacaagagtctctggttttgtgaaatgagtcacaggctgccttgaccatgcctatctgg

SEQ ID NO: 9803 - DNA, 201 bp, Homo sapiens
ccccaaaccccgaccgccggcctggcgcgcggctgcgcccaccggctccgcgctgctgccgccgccaccgccaccccgccgccgccccggcccgcgggccgcccaggctagtacccgggccggcctgcctccgccggccgtccgggtgcccgccgccgcgccgcgccccggccgggcgtggatggagggcgccgcgcgccc

SEQ ID NO: 9804 - DNA, 201 bp, Homo sapiens
cggccggacctcctcccagactgcctgcggtctgaaggggtcaggtccgcgcaaggtcccaggctgcttgggcgccgggtcgcactgtcaggagctgcccgggagtggctttccaggaacaccaggcactgaccacacaccaggggctgggaaaccaggtggcctgcaccaaggcggcttcggggacttgtctgtggcaag

SEQ ID NO: 9805 - DNA, 463 bp, Homo sapiens
agcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgt

SEQ ID NO: 9806 - DNA, 201 bp, Homo sapiens
ggggacgccagtggactggagccgcggagcttcgagggaaaaactttgcaggcgccgcggccgggattcggttacggctccagcccaccccagcaggtgcgggaggaagaggcagcgccggagtcccgaggccagagagcctcggcggcggcggccgcttctttcccccgagctggcctgaagtcgctgggcactcccggt

SEQ ID NO: 9807 - DNA, 201 bp, Homo sapiens
agggctgggaggatctgcagttctcctgctggccctccctttccaggaagccggccagcttggagccggctgctcaccccgactcaccccccgcctgggcggagcaggaatgtggaagttggcccgaaaggactgtgccccctccccgtcaaacaccccccccccgcgtcccccaccaagttctggccggggctgtggagc

SEQ ID NO: 9808 - DNA, 201 bp, Homo sapiens
agggcggagctcccggggcagaggcgctccgcggcaagaccgtcgaagtgggtttcgacggctgggccgctgcccccggggggccgaagggtgcgggctcgggctccgggggccggggcttcttcctcagcaccacgaacttgacgccgtcgagctccttcaccaccgccacgttgttgacgaactgcttgaagcggtccc

SEQ ID NO: 9809 - DNA, 201 bp, Homo sapiens
cggaggaggctgcggggggctccggcccaggcgaaggaagggcaagaggctgttcgaccgggggcggcgccgggaggtgggtgggcttaacacccaggtcgggggaggggtttaagagacaccgggaagggcagccgagccccaggggcgggtggggtggtagctgtgtgtagtaggggacagggctgggcctctggaagc

SEQ ID NO: 9810 - DNA, 201 bp, Homo sapiens
tagtcgacatgacgcgcggcgcagccaatgggaggcggagttggcgtttcttggtcgggggggggccggaggggtgggccccgcgtctccggtgtctgccgtgctcactgaatggagagagcgagcgccggccagctcacccggccgccccgtgccccagccgcagccgccgcgctccccagcccagccccaagccggacc

SEQ ID NO: 9811 - DNA, 201 bp, Homo sapiens
ctttttttaagttttcccttggggactgacattttattagcacagagatcaataatgccagataagagacctctgattttacatctggggctcccggaacgatgtctgggagagaaaacatgacgtttcttgcagaggcgaatcccagcccgggaggagggaggccgctgggatgtgccgccggcggcttttgggctcggt

SEQ ID NO: 9812 - DNA, 201 bp, Homo sapiens
agactggacccgaacccggcccaccccacccgagcggcgacgccagcgctgaccccaggcgtgtcccggcccccggcgcggctccggcccaaccgtgcacgcccgcggaaggcctcgcacccgcgtcagaagtggcctgcccggggccaccggcccgcaagtccccggtgttctcgaggtccctgccccgtcccgcgcggc

SEQ ID NO: 9813 - DNA, 201 bp, Homo sapiens
ggggctggggagggctgccggcggcgcggcggggtcggcgggaggcgggaggctgcgcgcggcgcgggagcgtgcgccggggtcagcaggggcggggtccgcgcggccgccgggactggaggcgcgggggtagcgggtagggtaccctgagggcacacccccggccacctggcgggagacccagctctgccgcgcgccgcc

SEQ ID NO: 9814 - DNA, 201 bp, Homo sapiens
gccccggccgccgggcgcgcagccgccctccccgcgccctgcccgcttttatggcattttctaggaacgggaagggggtgggagccgagccggcggccgcgccgcgccgaatgtgtgctctccctcccggctgtttacggcggccgaggcgcattgtattttgctggcgtcgaagggtgttttggaacagcagagggagga

SEQ ID NO: 9815 - DNA, 201 bp, Homo sapiens
cctagtgctgcccgggcgccctcccgcagcagccccagggcgaggaggatggggggggtcctcgcaggggccacactgtcggagccccacggatccgggcgggacggtgaggcctccacactgagccggtggcaaagtccccgcgaggatgaaggaggaaccccgtgctcctcaccccaccaggccccgcatttcctggct

SEQ ID NO: 9816 - DNA, 258 bp, Homo sapiens
ctctctgggacaagaagtggagtggggcggccaggacgcgggccgtggggatcgcgagggaggagggggcggccgcccggacttaccccgtggggtccccgcgcgcgggcgccccggcgtgtcggatcatgccgccggcagctccgggacggggaacggaggcgctcaggcgccgggccgcgcggaacgcggagtcccgggcgcccgcatgtccctggctctggccctctggaagggccaggccgccgctgccgccgc

SEQ ID NO: 9817 - DNA, 201 bp, Homo sapiens
cccggtcgccacgccccttccgagggtcgctccgcccccgtcgggccccgcgagcgcgcggtgggggaggggagggccccggagcgcgcctgcgtggggcgggggcggcagccgactaggggctgggtctggccgtttagggccgggtcttggcccgtcgcccacggtgcggagggctggtgggctttccttggccgtcgg

SEQ ID NO: 9818 - DNA, 201 bp, Homo sapiens
cagcagctccccagagccctggcttggcagggaggggacggcgcccgagcagccatattgcagccccccgggtccctcctccggccggcgcaggccccgcgctcacgacctcctctgggagccggatctgtcctctccatcgccgccacccgccggcctctgcgtcccttggcttccgacatcccgtctggccgtccccct

SEQ ID NO: 9819 - DNA, 201 bp, Homo sapiens
tccccgcgccatctcgggcccgtccccgctcggcctctccggagcggccgcgccctcagccggggagcccaggggtcctggtccgcggagccgggcgcgcggggggcggctggggccgcagcagggggaggctcggcgctcgcagccgccggcgcggggctcatcgggcgtgtgggtccatcccggccggggcgcgacggg

SEQ ID NO: 9820 - DNA, 201 bp, Homo sapiens
gggcccttagcacgcgccccagcgccggagcagggtcagggtcttcttgcgacccggccccgctccagatccccccagctctcggccgcggacccgggccgcgtgtgagcgccctttgcacctcctatctccagggtccgccgagagccacgattttttacagaaaatgagcgataaagagattttgtactgtcctgactg

SEQ ID NO: 9821 - DNA, 201 bp, Homo sapiens
ccgggcctagggcgccgcctgcagttgcgcgcggccgcctctagatggaactttctcaccaacgcaaggcccggccggagcagctacccgggagctgggcggcgaggggctactttctctcattccggcgggtgcaggatcggggggcctgggcagtaactagtggggaggagcgctggactgtgcacgtcgagcccggca

SEQ ID NO: 9822 - DNA, 201 bp, Homo sapiens
ctcgccccacctcctgcctgttcccggctgtcagagacccaggtgcagagagacctcagaggtggcgtccggggtcctggcgtccctcctgcggacgctcgctgcagagcaggaagccgccgccccggggcggaggggcgagccgggccagggggccggggtggagaggtctgcagggcctgcgcgctttccttacccgcg

SEQ ID NO: 9823 - DNA, 201 bp, Homo sapiens
agcaccaggtccggctccccgtacaccgccccgaaccccgggggtacgggcgcgggctccccgggctcctcgggggacgcggggtcctcaagccaaacgcgcggttcgggggacggcgccgcgggctcttccgggcacgcgcgctcctcaggggacgcgagctcctccggggacgcggcgcccgcgctgccggcctcccac

SEQ ID NO: 9824 - DNA, 201 bp, Homo sapiens
tccccggccgaggaggggccgcgtggcgccgcggggggcgggccgcgcacgccccccgcagggaggactcagggacagtcagggccccgggagagtccgcgcgcatcgcccggctccgcggcgccagccatggcgtccgtgcgtggccccgccagggatggggcgacgcggtcagagccgcacgcgaccgaaatccgcact

SEQ ID NO: 9825 - DNA, 201 bp, Homo sapiens
gctagaaaggatcgagaaaaatcccaaagctctaagcctgagctagggagggtctcagagggaggtctgactgcagaccgggagtcttctcctcccgtgcgccgctgcccgggacgagaaacccgtggggcatccaggactaggacacgaggtctcagcctgggcaggtggacaagctgtggggtcccaccctccgcaggc

SEQ ID NO: 9826 - DNA, 201 bp, Homo sapiens
gccgctgagtacgcgctccaggcaggctctgggaagtccgggatggaagcagctccctttctctcgccttcctccctcccctctcccctccctcctctccgcgcctctcctcctccctccgccctccctggacgtgggctgccggctgcagcccggagggacggggcgcgggacggagccccccgcgggaggaggggccgg

SEQ ID NO: 9827 - DNA, 203 bp, Homo sapiens
gtaggagcggcccgtgtccgcgggcgggagcgtgcggcctggactgccccgccggacaggcattgtctccccgccctctcgggctcgaggcgggccgcgcgcgccggccgccgtccgggcgtcccgcggtgggcgagatgcgccgcgtccgttccatgcctgccgcccgcgcgccccttgctccccaccccgtagccgctcgc

SEQ ID NO: 9828 - DNA, 201 bp, Homo sapiens
ctcctcgcagagggcaggacacccacctccccgtgcacctgcttcttctccggtctcccgcccccagcagcattctaggacccaggggtgtcatcgggtcggggagggaggggctgagcctgggtttggggacatcgggacagggggaggggctggcgctcccgtctggccgggaccccgtggcctagcgcggctccacga

SEQ ID NO: 9829 - DNA, 201 bp, Homo sapiens
agcgcctgcctaatttgcagtgacaccgctcagctgcccagggctccagctgtcacagccaattagcccgcggccggggaggagcgccgggcaggggggcgggggggcatgaaggggtcggcgggggaggctgtgggggttgcaggaggggtaggcgcaggaggaggcctgtggccttcaggtccggcccgcccccccagg

SEQ ID NO: 9830 - DNA, 201 bp, Homo sapiens
gggcgcactgggcgaaggcgacgcgcggctcgtgggtgcagcgctgggcgccctgaggaggctcctgctgcggccccgggcgcctgtgcggctcctgagcgcggagctgggaccgcgcctccctccgctactggacgacgtgagcaaacgccccgcctccgggtcccgcccctgccgctgtcaccgcccccgcccttccag

SEQ ID NO: 9831 - DNA, 201 bp, Homo sapiens
caggtagaggggggcgggagggggtgtgagggagaggaggagccggagccgccgctgcggccccctccggggaggggagaggagaacccccttcctcctcgccccctcccagccccccgctggcccgggagggggtggggcgccgaggccgcggcgacccggcagggcctggccggtgaagagcaggcgggcggggtgcgg

SEQ ID NO: 9832 - DNA, 201 bp, Homo sapiens
ccaaccctgcgctcccctcccagcccgagtcctcccgctgctctttctcctcctcctcccgagcctcctcccctccggcgcggcgccgccagccagcctcggcggggagagtgcaggtactttgccttcagaataattagcaggacccaagccggctttccgagcgcgctttctttttcttcctttgccccctccctccgg

SEQ ID NO: 9833 - DNA, 201 bp, Homo sapiens
cgcggacggcgcccgacagcagctggaggagcggtttgccgacctggcggcgagccacttggaggccatccgtgcgcgggacgagtgggaccggcagaacgcgcggctgcgtcaggagaacgcccggctgcggctcgagaaccggcggctgaagcgcgagaaccgcagcctcttccgtcaggctttgcggctccccggcga

SEQ ID NO: 9834 - DNA, 201 bp, Homo sapiens
cccgcctccccgcctcagtccgcgcactcaccgcgcacgcagagcagtgacatggccgaggatcgggcaagcctctgccgcgccccagccgcgccggaccgctccctctttcctctcagcaggtgccgcgactgctctcgttaccggccccacgggtctggcagctcctcatggtcccggtcgcaggtagcgtcccgccgc

SEQ ID NO: 9835 - DNA, 201 bp, Homo sapiens
tggccattgttgcgcaggcgcagttctgggagcggcgggagctggaagcccaggagttccagggggcgcagggccgggcagaaggcggcgagctgggggcggatatccaccggggactggaagcggcccgcgcaggctggggacacccggggccagggcgggtcgcctggggtgggagagtatagtgaggaagtctgacgc

SEQ ID NO: 9836 - DNA, 201 bp, Homo sapiens
ttggggacgccgcagcccggctcggggagggggcgctaggccgggagccgcagcgcgggagggacgagcccgggccggcggggggaggggagcgggaagcgtctttgttgttggcgaccgggatcccttctcggcacaggggaaaggcggggaagccactcctcatcgggtctgtgtttttgagaggattctctgatggtt

SEQ ID NO: 9837 - DNA, 201 bp, Homo sapiens
ggtctctgggaggcgccgcgtgggggcgcggcccgtggagcccgggcgctagggaccggccggggccggcgtacgggtgcgctctgggttcgcccgggccgcgggagccagggagccagggagccagggaccccggctcccgcacggggcagacaggggcagcgcgggcgacccggagcgcctgcgtctccgcggccctcc

SEQ ID NO: 9838 - DNA, 523 bp, Homo sapiens
agagtaccgggcccctcactgcctcagagcgcgtgtgcggctctgggcgcgcacagtgacggtgacggcacccctggcccggcagcgccgaggccgcttcgccagacagccagcggccggcggcaggccgggccatgagcggcaggggccgggccgggcctcgctgaccctggctccgcgcggcagcttccccagtttccgctccggtctctcggcatgagagtccgcccgggcccggggctgcggctgccccagacccgccgcacgctggcgcgctccgggcccgcggagccgcggtgctgatacctgcgccgcactgcgccgcccgcccgtccgctgtgtgccccgggggcgcggccatggaggtggtgggtgacttcgagtacagcaagagggatctcgtgggacacggggccttcgccgtggtcttccgggggcggcaccgccaggtgagcgccggccggggcgaggccgggccccgggcggcaggcacggggctaggtggttctgaaacttggcgcag

SEQ ID NO: 9839 - DNA, 201 bp, Homo sapiens
cggcggcaggcgggggagggggtgggggtgcaggggcggccccgcgggccgcggggggggcgcgcggcgcagcggggtcccgggcggggcgcagcgggccgcggggctccgggcgcgctccccgcgctactccagtgccatggtgcgcccgctgagccgccgggtttagagctggggctggcggcggagggatacgggccg

SEQ ID NO: 9840 - DNA, 201 bp, Homo sapiens
cgccctcccgccttcccggtacctgcctacccccgcaactgtcccggcccccaacacctgcatcgcccaaccccttccccccccgccccctgccttccccgcacctgcccggagtcccagcacctgccccgccccccgctatccccctccttgctggcctgatggggtgtgggcccaagggagccacacttgggcggaggc

SEQ ID NO: 9841 - DNA, 201 bp, Homo sapiens
ccccggtctgacggaacacaggcgacgcacgtgaagtccaggccctatcccagcgcaggcgggcctccagcgacccacagttgtcacatatccggccagcgccgactcccgaaggcgcactccccatactccactccgagcaccggtcccatcgttagggaaggtccccctggatagcaaggccggggcccaggatctgcg

SEQ ID NO: 9842 - DNA, 201 bp, Homo sapiens
cggcaaccccctctatcgtcccctgcagcaggcgccgagccgccgccatcttgtcccccgtccctccccccccctcaccgatatttacatagcgaaaatcggcccggccggcctgcggccttcacctcacgcctgcagccttcgcctcctcgccaggcctcaccccggcgcggtgccccaggtcggccgcggagccgaccc

SEQ ID NO: 9843 - DNA, 201 bp, Homo sapiens
cgccggcgggcgggaggcacacacgcgcgcacaagcggaaagaaagcgggcttactgcgtggggatgctcgcccgcgcagctgtctcggcggcggcggccgctgcctgcaccgaggccgaggcgcggcggtggcggcggcggctgcggactgagccccctccgccgggcggtggatgtagggcgcgggaggggcgcgaggg

SEQ ID NO: 9844 - DNA, 201 bp, Homo sapiens
tctcccgccagcgtcctccgcccgcccgccccttctcggccccgccccgcggggctgctggagaaatcaagtctggggctccccttgtcgagcacggggcgagctccagaaggctctgccgtgatggaaaacttccaggcaaattcctccgggcccgtggcccccaggccgggaagcctccgccacgtgaagggcccccgc

SEQ ID NO: 9845 - DNA, 201 bp, Homo sapiens
tctccacacagaaaatctgcaccagttatgtaagctaaaaagctgtgtgaacccaggtgtcccggaaaggggctgcaggacacagcaaaatgccagcagcgtgccggacccctcccttccatcctcctctccaaagaacagaggtcaggaaaaacactggctgggacgctagaagggtcatgtgttaactataatcacatt

SEQ ID NO: 9846 - DNA, 301 bp, Homo sapiens
gcggatggggccttgattagctgtggatttctgtcccagcgcactcatttaaccgtgtttctcttggttggcagagggcgccaaaggcgacgtgccggccgccagctccaggccgagccccgagcgcctgcaggaacacgccccttcacccggcgcgggacgcagagctgcgagagaatcttgttcagcgcggactcaacgccagggcgccgcctagaggttggtctctgtctcggcctcacccgccgggagaccacagagctgcttccccagccgcccgccgccagaaattggaaaaaaa

SEQ ID NO: 9847 - DNA, 223 bp, Homo sapiens
ccagagctgcacgtagatgaacacgaagagcagcgcgtagaacacggtgtagacgacggtgaggccaagcttcacgtaggggggcacggccggggtcagcgtgggcggcagcgagtcgttgcgggctgggtcccacggcggggtctccatcgggccgggggcgctgccgcgcggccggggacgctcgggcctcatcggggctcacggccgccgccgcccccgc

SEQ ID NO: 9848 - DNA, 720 bp, Homo sapiens
cagctgaatgaatgggggaggaaggcgggcgccggcccctccccgcgcgctgcgcccccgccccgcccccgcctcccgggcggatcaggttcccgcacccgcaccggcctccctgtctcgcactggctgctccgcccgcctgtcaaggccaggcctggggggctggggcccgagtggccgctgggggacagtcctgggcacacgaccggagcgcccccctcctccccgcctggcccgcgcccaggggacggcgagagacgcggcctcagcccctccccccgggcgccccgctgcggccagatgtgggcggatgtggaggccgggccatggcgaggagggcgggcgcccagaggggaagagattcctccccttccccgggcgcagggtccttctgcaggaggctgtatttgggcagccaaacaaagttctctgtcaccgccgccgcgcgctctgcgcctgcaagggttaaacggcagcgcacgcggctggcaggcaggatcccggcctgtgggctcaagagccgaggggcgcagggcgaacatgcgagtcccatggcaccagcgagaggccaccaactcccacccaccgagggcacccctgcagctaacacccccaccacgaccaccgccccgggggccaccgctgcaccctcctgggtgagccctggagaaggcactgtccgggagaaggggcacagggcggggatggaacacggctgtc

SEQ ID NO: 9849 - DNA, 1683 bp, Homo sapiens
accgagggagggtgcaaaaggcggggggcggagggggggtagatcagattaggcgaaactcaataagctcccagccctccagcccaaagcttccaccatcgccgccaccaacgagccactccaattgagccagcatcgccgcccacccgccggcccgccggaatcgcgcccatctcctgcaacctcgcccggaccggcatcccgccccctcggcccggtctcccccttcccgccgggtgcaaagtcaaagacccagcaaggcgacgtgaacttttgcatgcagggcacacacgtcgcccccggttccgggagtgcgggggcccgcggcgcggagggaggctgggcgcccgggctcccgggccaaggtcgccgcgcgtgctcacccatgtcccggcggctccggctccgctggccccggcgctcgctcagatcccggctcccgtcgctcgcccgagcccccaaaggtgctgctgcggcaactccatggcgatgagcatctgtcaaacggcgagccgcgagctggccgccctagctcggggggcgccggggcccccgggcgcgcggaggcggcggcgagcggcgggcgccccggccggccccgcgcttcccgcccgactctgccgcctccgccgcgccaccgatttatggagagagatatcaagggggaaaatggcgtctccggagcccgaggagtcctggagtaatcacattcacacacacacgcccgcacgcacacacactcgcacacactggcacacaggcgcgcggcgagccctgctaattttagcaggagccaaaaaaaattttatatatatatatatatatatatatatatatatatccccgtctctccgatcaatgctttttctttttttgcttttttttttttttttttttttttttttgcttttcttcaaaggatgggttggagcgttaaaaaatgttggtgggtttgggctcgcaggaggcggcgcgcggagggcgagggcgcttttgctgagctgtgcagttcggtccgctgagcccggcggccctgcccgcccgctcgtccgcccgcggtcgctagtgttgccgccgccgccgccgccgccgccgctgctgctccatggccgcgcccgccccgcgcccccgccgcgtcccgtcgccgcccgcccgcgtccccggtgagcgctggagtggggtcgggcccgtgtgcctgcctcccgcgccctctccgaatcccggactcctagtgaaaggaagggggagggcgcgggcgcggaagggaggtggatcggagcggcagcgcggcccagccgaacgggtaccgaccgtcaccccgcgatcttcctcgcagggggcgccggcgcccaagctgctcgcccggagggcccagagccgcttcccagaccagagccgggggaggcgcagccagtagcgagccctgagcgacctctctccccactcgcccccctgccccagtgaatttctgtcagttgaagggagcggggctcttgcccggggaaaaggaaaacagttcgtggcctgggatctgggaccccttgccgcccccagcgcccctcccgctccccggcgcccttgcggcccagtggctcctgcgcgccggagtccgccgcgaagactgagcggccgcggggatcgccgcgggctccgcgcgtattcctgggctcaacactgccacta

SEQ ID NO: 9850 - DNA, 233 bp, Homo sapiens
aaacaaaaagattaaaggagcagcggccggggcggcagcggtccccaggccgggacacccggggtggtgcgcccgggttcgcgggggctgcgccggcgccggggaggcggggggagcgggagcgggcgacgcggggaaggggggagccagggggagggcgccggccggaggaggggcggacccgcccgccctagccgagcagagcacagccgagccgagcggcccgggcgggg

SEQ ID NO: 9851 - DNA, 213 bp, Homo sapiens
ccttcccccaaagcaaacagcatcctcccactaccctgcagctgggccccccccactggtccccgctttcccggtggagacggcgacgtggcccacacgcgagcccctcgccgaggatgaatcaccagccagctcgagttgccacactttatctcagtacagttatcgcgagagtcccggggccgcgccggcgtgctctacgcacgcgcagtc

SEQ ID NO: 9852 - DNA, 236 bp, Homo sapiens
cgcgctgagccctaccctgcggcggccggacgcttcggcgcagggggcggcgcggcgggcgcggtgctgggcatcgacaacgtgtgcgagctggcggcgcggctgctcttcagcaccgtggagtgggcgcgccacgcgcccttcttccccgagctgccggtggccgaccaggtggcgctgctgcgcctgagctggagcgagctcttcgtgctgaacgcggcgcaggcggcgctgcc

SEQ ID NO: 9853 - DNA, 233 bp, Homo sapiens
ttagctgtggattcccaatacctgcaggtcacaggaccagaggctgggcctctaggagcagaggacacagagcagtgaagacgagacccggagttccagcggcagccaaagacaaagaagcggacaaatcccgccacatcccggaagccgtcctctccgctcaagctgcgtgcctgattggacagttcccagcccagcgtcgctgattggataacgtttaaaaccccaccctc

SEQ ID NO: 9854 - DNA, 737 bp, Homo sapiens
ctcgcccgactcaggctccgagttctcccctcgaccctccccagcctaaaggctgtacccgcttcaggccttcccagcccggccctccagttccttcttcggcctccctcagcctggggtccgggtttcctcctcggctgagcagccgggtccgcgactcccttcaccctccccggcccgggcttccggttctttccagaggtgaggcaggggccacctagaattccgcggccccccacctcccccaagaccaccctcgccccagcttcctgttccccattctgtcctcccaacctgggttcccgattactgcctcgacttcaccttgccgtcagggaccaccagccgcctcttccgcgcctaggggacgcgcagcggcagcctctgctgatggcaagggtctgcgcacccggaaactccagggtctggggcgtggtgcggcccctgcggccagcgggctccgcttgagcttcagggctctttcgttgttggactacgtttcccacaggcctcagggccgcggatgaacttcgacctttgcttccttttccggtgttgtggttattgagttaagcctggcgagtcgaggtgacccgggccgggctgcgggaggagctcgcggtgaggtggccccgcgctgccgggcgaggtcggtccacgtggagccgggagcctgaggcctctgtacgcgggagctgcggacgatggtggttagtgctattgtttacgacgtcatt

SEQ ID NO: 9855 - DNA, 308 bp, Homo sapiens
acagaggtgcagttcagggtccaagatctggctcccgggttccaagcccaatttcgggttcgccagcccagcaggtgcggagccaagctcctccacagacgcggccctctccccacgcgaggcctccaaatctcgcaaactaacggaaatgaagctacgctccgggagcggtgcctctgggaaatgtagtccagcgctccggacgccgtgcctctgggaaatgtagtccagcgcttggctagccggccagaacgccaggaggcccgggccgctcacccctcgaggggctcgtgggctcggcctgtgga

SEQ ID NO: 9856 - DNA, 1100 bp, Homo sapiens
tgatgcgtttggtgacttttcctgggttcttgcttaagcggagccacaggttgtgggggcggccaggcctctggggaagagcaggtgccgcggtgccggcgcgccagcagcccgcggccaaggccacctgctcccagggccccggcacctctgcggggaggcggcaggcagaggacgcgcgcgcagtcgcgcaggagccctcaggcgagtgggggaagcatcgcaagagacgcggacctggagcgcggtcactgcgttaccgcagcgacctgggttacctaagccggcgggactgagaggccgctgcgcgtgggcaggggctcagattgcgcccgcggtgcctgtcccggcccccaccccggaacgattgcagccctgcggggctcgccgcccacaccgcgctgaggacgctgcccaagccaggcgcccgcccccgcccgcggtctcagccgctcgcagcgcgccgcccccagacgcgcgtggctgctggcgagggctgagaccgcgctcccgccggccagttcccagcagcagcgcatcctccctgctccgcgccttcgctccggacccgcgtcgtcgcagccccgcggtgatgagccccgagccggtcccgccgccgccgccgccccagtgtcctggctgcgaccgcgcggagccgatcgcccagcgcttagaggagggcgacgaggccttccgcgcgggcgactacgagatggcagccgagctctttcgctccatgctagccgggctggcgcagccggaccgcggcctgtgcctgaggctgggggacgcgctggcccgcgccggccgcctccccgaagccctgggcgcgttccgcggcgccgcgcggctcggggcgctgcggccggaggagctggaagagctggcgggcggcctggtgcgcgccgtgggcctgcgcgaccggccgctgtccgcggagaacccgggcggcgagcccgaggcgcccggcgagggagggccggccccggagccccgcgcgccccgcgacctgctcggctgcccgcgctgccggcggctgctgcataagccggtgacgctgccctgcgggctcacagtctgcaagcgctgcgtggagccag

SEQ ID NO: 9857 - DNA, 214 bp, Homo sapiens
gaagaaataatatattgcagattgtaacgagcacggggagccagcgaaaggcagggcgtccactagggcgcgctgagagaccgggaatccccgcaagggcgcccgcgccgcccgccacccgccgccgcgcgcacgccgcgccctcgcccacctccaaataatatttacagttagggtttttttttttttttttttttttttttttgctctcgcc

SEQ ID NO: 9858 - DNA, 582 bp, Homo sapiens
agcttgctttttccaggaggagctgctctcgccgttctcccgggccatggccgacgagcgcggcgcggaggagcggccgggggcgcgctggggagggggcgccgggggcgcggcgcgggcgcagaggcggcggggatgccgggcggctcgggctgcggcgcagcttcctcctctgcagtttcctctttcgctctcgccgccgccgccgcggccgcggtccctccctggctcttatttctgctgttctcgggcacagacttcctgccgccgccgcgcgccggctcctttgccgccgcctgccagcctcactttctgctactttcttgcctccctcccgctccctccctgccgcccgccgcgctcccccccacctcgcgcctcctccccctcctccccctcctccccctcccgcgggctccccgccctctccgtgcgccccggccgctccccgcctccagcgcgccgccttcggggatgtcccgctcccctcccaagagcgccgggccacggccgtcgtgccccctggagccccggcgagggcgggtacgggcccccggcaggtgcggggcgcacgcgggagag

SEQ ID NO: 9859 - DNA, 203 bp, Homo sapiens
cctccaggaggcgtcctgaccccgcactccggcctttcacctcccgaccgtcagcctcagggccgccgcggcgacgcgcgaccccttccctctgaggggcgcgggctccggacgcgccgggctctgccaggcatctagtggagggtcggaggtcggcgaccagcccgagcccagccgtcccgggagctggcgcgagtgtcgcc

SEQ ID NO: 9860 - DNA, 823 bp, Homo sapiens
caactacttgttccagaccgcgttacctgcaacctgctccgggctggcgccatactcggcgtcccggcgcttctcacaagtgccctcgcccatgaccagcgcctgcaggggcagctcggagcccgggtggggatagcagcgcagcccctggccgcagcgcggggtgtagacgccgcacgcctcgccctccagccgggcgcacaccgagcagcagccgcagcccggctcccggacgagctccgcgcatggcatgcgggcgcctccggccactgcggccaccgcggcgggcggcgcaaccggcgggggcccgcaggcggccaggcgctcgggtgtgcagggcgggcagcggaacagcacctccgcgcgcgccccgccgccgccgccactcgcgcccagtagcagcagcagcagcggcagcagcggcggcggcggcagcggcagcgcggggcagcccactctcggcagcatgctggcggtcggcagcgcggcgcggcgggcgagcgagcgagcgggcgggcgggcaggtggcacggccctgcgagcgcgggagccgcctcctccgcttcttcctcctccctcgccgccgcagccgggtcctaaagggccggcttctccccgccccctgccttctcccctcccccttttggagaccactcccttcccccccgacactccctcgcgccggcaagtgagtgcgcgcacgcccgctcgcccacctccgcgttggctgcgggctctgggggttccctgctcttcccgggccccgtccctccgcactcttctggcctgactatgactcctgaaggagaatacggataactcg

SEQ ID NO: 9861 - DNA, 293 bp, Homo sapiens
ctctgttcctaagggagagggacagcaccctcccgggcttccagctcccttgggtgtggcgggagagttctgggcgaggctgcgcctacacctgcacctcggccggctcctccggctgatttcgctctggttgatttcgcgcacattcctctcccagcgctgcaaggaccgcctgaactcgctggctatctcggtgatgaaccagtggcccggtgtgaagctgcgggtgaccgagggctgggacgaggacggccaccactcagaggagtccctgcattatgagggccgcgcgg

SEQ ID NO: 9862 - DNA, 262 bp, Homo sapiens
gcggggcatgttggcgcggcccgagggcacggcactggctcggtcccccctccgcgctcggccccggcggccctcagtgcccccggcccattgcccgggcgcggcggctgcgggactcgcgtggcgccggcgacggctcggcccagctctgcgccctgcacgcgcgtccctgtccccgggcccggcagccgctcccttttaacggggggagggggccattgttctcgcctcccgcttcccctggagccaatcagcgcgtccg

SEQ ID NO: 9863 - DNA, 240 bp, Homo sapiens
gccttcctcccactgtcctcccgccaccagccgcccctgtcgccgagcccgcagtcgccagcgcgccccgagcccctccaggccagaggctcccgcaggcgatggcggacaagagggcggggaccccagaagccgcggcgcgcccgccgcccggccttgcccgggagggggacgcgcgcacggtccccgcggcccgggcccgagaagctggggggcgcgggtccctccaccccgcagcgg

SEQ ID NO: 9864 - DNA, 1240 bp, Homo sapiens
ggcgcctttgcgcacagtggccacttggggtcgcactttatgcctgtttgagcctctccgcggcgggctgacgccgggatctgcttaatcgttacaaaacgttcaaacaaaaacagggccggctccccagcagtggagagctactcggagcaccgtcccgggccggcctcggccccgaggctccgggggctcaggattccgtgcgtgtggcggggaagaggaattcagagcctttgggctgctgcttttcccgtcgccttcactgtgaacattgtgcggtggggtgaacgcggggagcggcggggccagtggagtcgaacctcagggctctgcgactgcacccgccaggaggggccctcgcttggcctgagaaaggtcccctgaggttaagagttgggtctgaacacaactctcggagcctcgagcccgccctccccaacatacaaatacgcgcagatctccagaaacaggaacgcacgacacacacggccagaagccgcgaggacacacagagcgtcgcccactgggcgggggccgcttgggaacaaagggcccaggaggcgttgtcccggcgctcattctgagcctccttgggggtgacacgggatgggggtggggtgcaaagggaactgagggaggagagtgcgcgaggaggggaaagcggtgatttggcctagaggtggggcgcgcactccaggcgagcgtgcgtgggccgggacctgcagggtacgggggtgggcccaggctggccgtcccactccgctccagcgctccgccaggcctccgccgctccggggccgctcgggccgccagtcagctgacgcggggggcgggggagctgtcaggcgcgccccgccctgcgccgctgggccgcggaggccgtgcagctattggcccgcgcaccgggccgcccgggcccccgcaccccagtgacatcaggaggcgataaaaggctgcggcgccgccggatccagcacagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcaggcagcctcgggactctccggcgcgccgccgcgtccccagacaaaggcttggccggcggccccggcccgct

SEQ ID NO: 9865 - DNA, 222 bp, Homo sapiens
aataaaaacccacactacacagcgatggtggtgtctggtggcggtggcggggtggggggtctgactagatgagccgctcctcgcgcccccggcgccgggcgccatggcccgagccgaaggcgcctctggccccggagcgcccgcggcctctgcgcttggcgcggccgcccaagtaggagaagaaggcgcagcccaggaacactcggaagcagcaggtcgccc

SEQ ID NO: 9866 - DNA, 714 bp, Homo sapiens
tgtgattcctttttcctgccccaagtggctggcgatacagcccccggcgcgccgggcactgaggccctggagcacagcgtggggggcctggcacagacacgactcacgaccgggccgatctccggccagaaagaactatgttccggccgcccgggtcgcgggcccgcggtgcatccctgcaggcctccatcctgcctcggcagaggtctgcaagaatcctgtgggtgtcccccggagcgggcagaggaggagcccagcgccgaggcccaggcgcgccccgccctcgcccctccccgtgcccctcccccgctgctcccctcccaaaggccgagacctggacgctgcccggtggcctcggcgggggccctgtccttggccgctgcctctctgaatcccaggtgagaagaataaaacgtcctgacgctgtccggcttccggttcttggagaggacgggccgtctctgccgagagaactgtgcggaatcaggaagcgctggtgctccttcgctttcacgggactaagcgaaatccggctttaaacgaagtaaagccggctgcctcctggagtatttttgtcatagtatttttattttgggtcagggtattctgctgcggaccctgagtcttaggaaggaggcttataacagcggaaagccatttttttttaagaattgctgagttttccggattgtactttcaaagactttccctgaa

SEQ ID NO: 9867 - DNA, 1216 bp, Homo sapiens
cttaccctgaggttccccagaccccgtagggtctcccacgccaccaagtttgcctcgacttcccctcgctgcctcccacacctcctgccgcggcgcggccggccagggacttaccccgaggcccagctggtgggggtgttggggtgcgcgcggacccggcacccacggcggcggcggcggcagcagcagcaggaggaggagaaagacgaggaggaggaggaggactagctgagcggcgcctccttcccagcccgcagcgcgcactggctccttggggcacccccgggagagcaccaagaccggagactaggcggcgacacaggcaaccgctgctgcacggggctgggctcagtcggctctcagaggccagggcagggggaggcaggactgggaaggagggtcggagaagtggggtgcagagggcggggcagcgagcggccaggtccggaggaaggcgccccaggcgcctagggatgccgccgcccgggctgacgccgtcggcccctctccccgccaggcgggcgcttgcagccgcgggcgcacgggcctcgcctcgttcaccggctcgttgccggcgcccgcggtgcgccccgctttgtgctccccgcagccggcgtgcacctggtgtaagcaaaggcggtcagctgatgggccgcgcgcggattggctgctccgccgtctcctcccctcccgcccgaccctcttcgcggcctcccgcccccgccctcggcgcggccccgtgctgggcaccatctgtggaccgcccaacaaaggcgcagcgcggcggggctcgggtggccgggccgcggtcgccgctttttgtctaggggacggcaggctgcggctgggcagggaggcgaagcgcactgccggtttttagcaaaagacagaccaaaagaaaatacacgtccgtgctaggaggccagctaggcacaatggggccccatctctttgcggcgtagaactcgggctcgggggctgagaaccagacacagttcggcctggggctgtgggagccaagtttcggggtgaaatccgaccctgcgtcttaaaatacagggcgcgtcctcgggctgtgtgtgcgcgcccgggggcgtcctccgcagacctggcccgggccggtgtccctgccgcgggaaggaggattcggacgcttaactcagcggcgaagtcgcttcccattggaggaggctttccgaaaacgtttctgaaactt

SEQ ID NO: 9868 - DNA, 207 bp, Homo sapiens
ggcctgcctagctcccaccccggcatcgaagccgcagctctcgggcccacctccgcatcctcaggggttcccgggggctgccgacaggttcctgaccagcgagcgcgcccccggggcaagcattcttggcgggcagaaacctgggagcggagcacagcggtgcaagggaaccgtgccaggcgggaagggcggaatttgcggggaact

SEQ ID NO: 9869 - DNA, 253 bp, Homo sapiens
ggctgcgcagcgctctcaacccaacccctggactcatcttcgccccagcctccttcgtgcccagcgtcccttgtaaatgacccccccggccgggtgccccgctttctctctcggcctcttccgcgtggtctgctctccgcccgcctgcgctcgcccggcctccctgcctctgcgccttcacctgaccgcaaaggcggccagggcagcctccgcgcggcctgacagtcacggctcccagtttgtccctggacgt

SEQ ID NO: 9870 - DNA, 209 bp, Homo sapiens
ggccaggcctgagcctcacctacctacgccgtatttctcctcctccgtgggggtccacatggccgtgccgggcgcggccccgcgggcgcggcgaccgggcgacaacgcggcggggacggccgcgggcccggctgtggcgcaccgcgagtcgaggcggggacggtcaggcggcgcggggcagtgggcggcgcatccctcacaggccgtcc

SEQ ID NO: 9871 - DNA, 225 bp, Homo sapiens
ctgcgatcggcttccaacttgggtcgagttgcgcagcggggcgggcgcgcggggcggggcgggccgcgggccctggggagctggccgggaaccggagcccgcggccgcctggtcgaacctgcccgcgcggcgccggggaggagtccggggcggcggcgcggggcgcgcgctcggcgagggcgccccctccagggccgcctgcagcctgcgggacggggccgagcg

SEQ ID NO: 9872 - DNA, 1133 bp, Homo sapiens
ggaggagaagcgacgcaagtgggtagcttttcagcgccggcgaggcgcgggaggaggagaagcagtggggaggcgcagccgctcacctgcggggcagggcgcggaggagggacccgggctgcgcgctctcgggccgaggaaccaggacgcgcccggagcctcgcacgcggccaagctcggggcgtcccctcccctcggccgggcgaactcaaggggcgcagctctttgctttgacagagctggccggcggaggcgtgcagagcggcgagccggcgagccaggctgagaaactcgagccgggaacaaagaggggtcggactgagtgtgtgtgtcggctcgagctccgggcagaggcatttgggcccgaggcccccgctgtgactccccgagactccgcagtgccctccactgcggagtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctt

SEQ ID NO: 9873 - DNA, 478 bp, Homo sapiens
tgaactgagggggtccggcggccgctgaggaggggagcgcgcgggaggaggggcgaggagcccggaggcgggcgcggctggcagcttagagggcccgggcggaggcctgagagcagggctggaggggcggaggaccggggagacccgcccgcggcgttcccggccggttctgagcaggcgccgtggcagcgcccgcgccccctgcccgccctccgccgtcgccaggacgcaggctcgcgtcagggctggcggtagggcccgcagctgtcggcctggcgtcttcaccccgcgcagtcggcctcgcctagccttctcgcgcctgactggccggaccctgcccctggcggaggtaactgcccgcggattccttaccccgcgatcctggcctcctcgtaagctccccggacccgggcgtcctcggtctcccctcatctactcttctgtcgggcaggtccgcgaccttccgcctcccgggccg

SEQ ID NO: 9874 - DNA, 201 bp, Homo sapiens
ttaatgtgttttaacacgttttaatgtgttgtgacaggaaaagagccggctaacggtattacggaagtactagttggcacagaggctcggtgcaattaccgttctgcaccgtaaaacgggtttaggaagttcctaggagatactagcggtgccagaaccgagaaagtgacgacacagacaacttatggactccgcgtacgg

SEQ ID NO: 9875 - DNA, 208 bp, Homo sapiens
gctcccgccgccgcccgggccgcgcccgccccgcctctaggcgccggccccggagcccggtccgcgagcagcggcggctgccggagggacgatgagctgcgcggggcgggcgggccctgcccggctcgccgcgctcgccctgctgacctgcagcctgtggccggcacgggcagacaacgcgagccaggagtactacacggcgctcatc

SEQ ID NO: 9876 - DNA, 210 bp, Homo sapiens
ccagctccccgggaagcagcaggcgcacggccgtctggatctccctggaggtgatggtcgagcgcttgttgtaatgcgccaggcgggaagcctcgccggcgatgcgctcgaagatgtcgttgacaaaggaattcatgatccccatggctttagaggagatgccggtgtcggggtggacctgtttcagcaccttgtacacgtatacggagt

SEQ ID NO: 9877 - DNA, 229 bp, Homo sapiens
ttttaagacagggtctccctctcgcccgggctggagtgcggtggtacgatctccggtcgctgcaacgtccgctcctgggttcaagtgattctcctgcctcggcctcctgagtagctgagattacaagcgtcagccaccatagcccggctaatttttgtattttttagtagagacagggtttcaccatattggtcatcctggtctcaaacccctgagctcaggtgagcca

SEQ ID NO: 9878 - DNA, 209 bp, Homo sapiens
ctctctctctcttctaacattcccctccagaaaaagaggaacgcaacgaagggagttcagctactatgttggagctgtggaccggccctgtgaggcccacgcgggagcgcggaggctcctgggtctcagggcgccggcagatggcctgcagcgcaccgcccggcccccgcgctggccacgtccgccagcgtcatctctctcccccgcct

SEQ ID NO: 9879 - DNA, 255 bp, Homo sapiens
gttattccgcagcgagtcaaagccactccctaccctgggcccgctacgcgacctctgccggcctccgccccacgcggttttagtacggcgccaaggccccgcccacaaatcggccccgtcccctcgtgtccgggcccgccgctcatcagacgccgttccggcgcagcgagttgagggcacgcctaccctccctccgggtccccagtcctcaaggtcccagcacaatgccccaggaggaagactccaggccccttc

SEQ ID NO: 9880 - DNA, 297 bp, Homo sapiens
ctcaccattgtcaacgccgccgccgcgtcccccctactccactcctcttccctcaggagaactcccagccccggctccctccgctccggcgctccgtcacgtgacctcgggccgcccctcacacgtgaccgctcccttcctctcccccacccccgcacccgtccctctcccagcctcctgccccgccctgctggccgccaggcactccggggagaggccgcttggaggcggggcctcaggctccacccttcggagggtggagaggggcgggcaaattacgtcgagtgggcggggcct

SEQ ID NO: 9881 - DNA, 232 bp, Homo sapiens
tagtcgctccaagccccttcctcctcctcctcctcctcttccgccccggaaagttagcgagcctccggcagcggccgcattttcgccccggtggcctgacgacggcggcggccgcccctgcgcgtcctcccgcctccctccggctcagcccagacgccgcagtggcggcaactgcggcagcggtggcggctctgactccgcgcactccgccccctctttccagccagctcac

SEQ ID NO: 9882 - DNA, 247 bp, Homo sapiens
cccttcgcggcctcccctcccccgcgccttccctcccacatcgggctctcggggcagcagcggggaggggagaccggcgggggagggaggacagggaggcgaaggaattggggtggggggtgcgtgtgtggtggagggggtgggacgacacaggtgtcctgaggggaggagccgggaggaaggcgaggaggccgggccaagtgggggtgcggaggtcggggagacaggaacgcggctgcgggcgcgg

SEQ ID NO: 9883 - DNA, 292 bp, Homo sapiens
gggcgctgaggctgaagctggggccgggggtgggactgggggcgctggggctgggccgggggtgggactgaggctgcgggcgttcaactgggattgagtcgagggcagcggtggggctgggccgggggagcaggggtcgcgccgggcagcgtcgcgtgctggagcggaggcgggtgcggccggggcaggtcgcgggaggaggaagcgcctggggagcaggagctgggccgggcgggtccgcgccccgcacccgcgggggtgaatcggagtcgccgcagggggctcggggggc

SEQ ID NO: 9884 - DNA, 201 bp, Homo sapiens
tgctgtggggctcagggctgcatggggcagcaaggcgcgggggcccgggccgcagagcctccggggaggatccggaggggaggcagtggctcggcggctcgggttacagcccggtgtggtgggggggagggagacggggcgggagagggggcaaggctgcccctgaagggaaccagctggcccgtccgttggccgagctgc

SEQ ID NO: 9885 - DNA, 201 bp, Homo sapiens
acccttgctcctcacactcactccccactctcgccccagaaacacgcccctcacaccgggcccgccggatccccacacttcccactcgcgccagaaacgcgcgcaccctcgtggcccctccctgccgcgcgtaaacacgcccggtccgcgcacgccctcccggcctggccccgcacactcgcgccagaaacacgcgtggcc

SEQ ID NO: 9886 - DNA, 201 bp, Homo sapiens
cgacgcccgagccagcggagcccggagccgctgggcctcccgtcccctccgcccgtccgccctccccgccccctcggctccctccgccccgccgccccgcgccgctttaccataaaaggtgaggctcggggggagggggcgcgggattcccgccccgcggaagcggcccctacctgccccccaacctgcccggccgcgccc

SEQ ID NO: 9887 - DNA, 201 bp, Homo sapiens
gctttattaagcggtctcagctacaacggcgtgcatgccaattacgcctgcaggctaccgcccgcccccggctgccggaccacccagcgcgcctccccccgagtcccggacggggagaggaggagccaggggaggaggcgggaggaagggaaggatggggaggacaatgggggaagaagagggaggatggaggaagggggt

SEQ ID NO: 9888 - DNA, 201 bp, Homo sapiens
cactactccgctgtcggcggcgtctccttgggaagcagcagcaactggtggagctggagccgcagcagcctgagtcgccgcagcagcccctgccggagccgcagcaggaggaggaggaggcgggcgccggggtgggcgccggggcgggacacggagcggggccctgggacgaccccttggaaaagcctttggcggaaacgg

SEQ ID NO: 9889 - DNA, 201 bp, Homo sapiens
gggcggggtcggaggaaaaggggcggggcggcggggaaaatacaaattaaaatttaaaaatcagtcaaaggaaggatggaagccccgcggctcctccggcgcccagcggtgcttttgctttggtgtccggatcccagcccgcggcctgcctgcctgtcagtcccgtggacaccgcactgccgggcagcgccccggccgcac

SEQ ID NO: 9890 - DNA, 201 bp, Homo sapiens
cagcatgatgccgtcctcctggcagtggcagggggccgggcaggcggtgggccccgggccgggctggggggcgccgccggccctccgggaagcgcacagcgcggcgcaaagccatagcgcccggagccccggcgggctgggcatctcggcggtcgggctactggggcacctggcggccgggcgcggacgcacggcgcgatg

SEQ ID NO: 9891 - DNA, 241 bp, Homo sapiens
cgaagaaaggggcgcgggggcgcgggggcgcgggggcgcgtggggcgctgggcgccggaggcctggcaggatgcgcggtggggtcgccgccgtcgccgccgttgcgcgctcgctctctggccgggcgcgcgcctcgctccgcagtacttatagggcgccgcggtcccgcccctccataggccccgccccggccagctcacgccccgcccccggccccgcctcctgccgccagggcgcgcag

SEQ ID NO: 9892 - DNA, 201 bp, Homo sapiens
gccgctgccgccctgccgctcggtgtgcgagcgcgccaaggccggctgcgcgccgctcatgcgccagtacggcttcgcctggcccgaccgcatgcgctgcgaccggctgcccgagcaaggcaaccctgacacgctgtgcatggactacaaccgcaccgacctaaccaccgccgcgcccagcccgccgcgccgcctgccgcc

SEQ ID NO: 9893 - DNA, 201 bp, Homo sapiens
agaggaagtgagaggtgtccaattcggtcatgcagaacgcagctgggctgctcgaaacgaaacaaagcggctactccgaaggaggtgttgtccctgggccggtccaggttgagtcagagcagacgccactcccacgtcaaaaataccaggccactgtcccagggagctgggctattcactgaggtcattttcaccccactt

SEQ ID NO: 9894 - DNA, 201 bp, Homo sapiens
gcacccacccccctgacggtcccgccccgcagggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtggtgcggagcaggcgcggg

SEQ ID NO: 9895 - DNA, 201 bp, Homo sapiens
ggtccctggagtcactggctcagggcgggcccgcgggatggggcgggcggcccggggcgcagccggccaggccgttgctatggcaacgcggtggaaaaacgggcctctgggtatctcgctgccggccggctggtaaccccccagcggagggaccgggccgagcccgcggacccctccgagtgtctcctggggcccagccgt

SEQ ID NO: 9896 - DNA, 201 bp, Homo sapiens
ccaaaagtagcttctttgaatttcatttgggttttgtagggctcccccgaggcccgagaactgggagaagggaaagagctcatcggtttgtttgaaggccggcgggcggtgcaggcagcttttcccagactctcccagctccggcttttcacgcataccagaagagccgcttttttcctccagtgattgaaaccatctgga

SEQ ID NO: 9897 - DNA, 201 bp, Homo sapiens
ggtcttgctctagggctctgcattcccgagagctgctgtatgccggggattggcttccaagcctgcctgagcttctccagtctcccgggcatcgccatgcggtgggagggtgagccttcctctcctgctgaaattccggcggcttggcaaccggccggggggtcttggattcctcggggagacaccactgatgctttgtgg

SEQ ID NO: 9898 - DNA, 201 bp, Homo sapiens
gtgctttccgctgatccccagaggagacactggccagggctcttttttccgagacaaacttcattctggaaaggctgtcagaccgggcgcggtgactcacgcctgtaatcccagtactttgggaggatgaggtgggcggattgcctgagctcaggagttcgaaaccaccctgggcaacatgttgaaaccccgtctctacta

SEQ ID NO: 9899 - DNA, 201 bp, Homo sapiens
gcacactccggccgggtgcgggccggcggggcacagcggcctctacggcccgcctccgtcagtcattccccggtccctcctcccgctgctcgcgtgctccgggccggcccagcaccctccgagttacgtgcccgcgctccccggcggggaggagcgcagccgcgggggcgcgccccggtgactccgcccctcagctcccct

SEQ ID NO: 9900 - DNA, 201 bp, Homo sapiens
cccccgcgcaccgccgccgcgtactcaccctcacgggtggagcggggcggggcagcacggttccgcgcgcagctccgatccgctaggcgcaccgaccggcggcgcagcgctggcgcgacggctcgactcggccgggtccctgtcccgggcgcgggtccggcctgggagcgggcgagtccgcctgcaggggaggcggggacc

SEQ ID NO: 9901 - DNA, 201 bp, Homo sapiens
ggggcggagcggggaggggcggggcggagcggggaggggcggggcggagaaggatcgcagggctgagcggggcgccagcgccagtgcccggcactgccccgggctgggtcccctgcgttagaggaaggggagcccggggacggggcacggggcccgcgaggcacgggtgctctctcggggttccggaagcctccctccccg

SEQ ID NO: 9902 - DNA, 239 bp, Homo sapiens
gagaggaagggggaaggagacagaggaaccgagactggggtgagggagcggccgcgcgtggcccccggagaggcgcccatcacctgcgtggcgcccccccgcgccggagtgcggccctgctcccagcgccagtgcgccgcgcggctcgccggcctcgtaggattggctaccgcctcccattcatgtaacctgcgtgtgcgtgtgcgtgtgtgtgtgtgtctctctctcgctcgccctct

SEQ ID NO: 9903 - DNA, 201 bp, Homo sapiens
tcttctcgtgggtggtctccgtgagctccttggttagcctctctatctcagtcttataatggtccaccgtctgcaatacctcttctgcggccatagccccggtggatggaggcaggagggggttacggggtgggggagatggatgcgaagctggcggggaaagggagaaggaaatgggaagggatgggtggaaacggaaaa

SEQ ID NO: 9904 - DNA, 201 bp, Homo sapiens
ccacctgaaattgacaggcctgccctctatgataatagctgctactaactagtcctcctcacaccctttcactcaccggtctcagcactctgcacacctcgcggagaatccgctcctggttcttcacagagcacagcaccagggtgcagaccaccacatccacagagccatcagccacctggtgcatgttctccccggcag

SEQ ID NO: 9905 - DNA, 201 bp, Homo sapiens
aaaacagtagtctcatggaaaacaacagaaaaaaaccccactccagcctggtaaccaacggttggccgggggacgtgtccgcgctgctccccctccggccgccagggggcgcaggaagaagctttggaggtctgtcccgggaccgcgtactcgtccttctttcccgttagtcttttcttcacttccgttgagttccgcctc

SEQ ID NO: 9906 - DNA, 201 bp, Homo sapiens
gcctgacgaagccctccttgggggtcgatgcctctctccgggtgggaaggggcgctgtcggtgagggctatcctggcgccggcctgcgccgtccgaagtcgggggggaggggaggtctccgttcagcaggggtcacgcccgccccggacgggggccgcgcgggcgctcaggcgacgcatcttcgccggggcccgtgatcgc

SEQ ID NO: 9907 - DNA, 201 bp, Homo sapiens
tcttgagaagcaatagatttcgaccaatgtgcaccgttcccgcggcgccccgccgcgcccggaaccgctgcttacctggcgcccggcaaggaaggctgccggagggttcataggtgtttcctccgcccccggagaagcccggtgtgggcggcgtcacctcagaaacgccatcggcgcgcctgccccgagcggcgggggcga

SEQ ID NO: 9908 - DNA, 201 bp, Homo sapiens
cctgccatttgcatccaagatggactctccgctgccgccgctgctcctccggcttccttgtcatcatccctcacgccctgcagccctgcctcctgttcacgggttgccaagccgcggcctggccggtggtggcagtggcggagttagacaaagcccccgcctcccccgccccagagccccccaggcgccccaagtggcggg

SEQ ID NO: 9909 - DNA, 201 bp, Homo sapiens
ccctagggcggccgcctccactcccggctcccacccagcggggatccaccagggcgagggctgaagacctcgcgggacgccgcgcgccggggacagcgacgcacctaccttcccagccacctgggaggctgcaggtccgggccggagcccgaggctcaggggcgcgcggagcagtcctggttaaggcgcagggcgcggggt

SEQ ID NO: 9910 - DNA, 201 bp, Homo sapiens
ctttggggccgggcggggcggggcggggcaggggggccgggcgcggcctacgcgccccctcgagtgcgcggtgcgggacgggcgcggttgacgcgctcccgccggtgtctgtgcttctccgcaggccaggagggcatcctgcgctgccacccggacctggcgggcagcgagctgcagcggggcacgctcacggccgagtcg

SEQ ID NO: 9911 - DNA, 201 bp, Homo sapiens
cgggcttggacaggtcagcctgagagcatgcgaagtcggtccccgggcagacaacaagagacaccgccgggaagtgccaggaactccgcgcgttgcccgcggggtcctcctgtagccggggctgggccagaaggatggcaaagttgcgcggcgccgtccgggctggagccgcagccgaggagccgaagccttcccaggccg

SEQ ID NO: 9912 - DNA, 201 bp, Homo sapiens
gactcggagctacgcggggcgggggccggcaccgagggccgggaggcgcgaagggtacgcggcggcgggaagcggggcgacccgaaggcccacgggggccgggaggttgcggggcgcccgggatcccctcccgggtggtcaccgtgcggccggggcgcggaagccagaggtgcccagaggcgccgactccgccgaggttgc

SEQ ID NO: 9913 - DNA, 201 bp, Homo sapiens
cagccgaggcagaaatccgtcccgaggcgcgggcgccgggtccgggtcccaaggatgcgcgtcgggctccctcccgcggggacagccgagctccgccggcgctccaggtgttcccgcagtgcgtccgggcgcggacgcctctctgccctcggaggggaagcgggagggcccttggggtaacgccccgacctcgggcttcct

SEQ ID NO: 9914 - DNA, 201 bp, Homo sapiens
cacaggtgctcccgtcgtaggtctcgcacacccactcatggcactcacacaggggcccgaagaacatgcccggctcagtcacgtggcagatgcagacgccgcagtcgcagcggccccggccgtggcacagcgcggcccccgggggctgcccaggtgcgcggcagcgtcgctccgactcggcccgggacagcctgcaggcgg

SEQ ID NO: 9915 - DNA, 201 bp, Homo sapiens
agaccgctgcttggccactctacgcccctgagccccccacacagccagccccgtgacctccgagccccgtgacctccgagccccgtgacctccaagccccggaagccgctgtaggcagcggcccagccaggccccgccccctccaccggagctccacgcgtcaattccagccaggccccgcccccggccgccccaggcgtg

SEQ ID NO: 9916 - DNA, 201 bp, Homo sapiens
gcagcagctcaccgaggacggggactcgtaagtggcggaggcccggggctgggggtcgtcgggagggcgggacgcgcgcggcctgggggtgggaggcgccgggcctggagcccgagccgggggaccagcgatgcagccgggcgggcgccgcggcaccccggggctcctgcaccgccccgaacgctgcagggctgcagggcc

SEQ ID NO: 9917 - DNA, 201 bp, Homo sapiens
attctgcaggccgcacccccaactcgtatctcacccaggcccccgtctggcgccgatctgccccagctcaacctccggctccgcagactaggcactttccgggacgcggggcagaccctgcgctcgggtcccttcccgcagccgggctgtccggcctctgcgcgcgcacaacaggcggcacggcgcagcccccgggagcgc

SEQ ID NO: 9918 - DNA, 201 bp, Homo sapiens
aggatggcgatggcattggcgcggatcttcctcatggtgggcagacgggcgccccaggtgggggactgggccggcgtgctctcggggccggggcgggggcgctcgcagccccagctgtttgttttcgctcgcgcctagctgctcagtcctgcagagcagaaaaaggagagaggtgggggggcgggggggtgatagggagag

SEQ ID NO: 9919 - DNA, 201 bp, Homo sapiens
ccagccctttctgagggagctcagcggtgcgggctcgcctcctcccagcccagcttccctgacatcgcccctttcctggggacgttgcctgcgggcccgcgcgtccccgcccccgactcccctgcaggttcctccgggggccggggcaggaccgcactcaccgaggacccgggcgctggagccagcagcagcggcacgagc

SEQ ID NO: 9920 - DNA, 201 bp, Homo sapiens
caagccgaagcctttgaaggaggctcggtgccatctcggtgtgatcgcgtcccggcgacgctgggtagggtgcagggagccagctcggccgcggctcagcgggaggggagggggccggtcccgaacccgggcgcccgggccgcgggtgattcactgggaacgccaggttcgcgcgcctagaccggcgggcgacgcccagcg

SEQ ID NO: 9921 - DNA, 201 bp, Homo sapiens
gggggcccggcccagggcgggaaatgggtggggaggggcggggcctgggttggagactggacggaggagccgggcggagatgcaactggaggaagagggcgggacggggcggagaaggtttcccgcatcggcggagggagagggactaggagggggctgcggcgggggaggagagggggcttccggcccagagactgaggc

SEQ ID NO: 9922 - DNA, 201 bp, Homo sapiens
gcgacccctgtccctcccctgggccgagcggcaggcgcgctcgcaccgcccccgccccctcgtcgcagtcgctgccgaccggctggctgggccttgcggcgtgaggaccccggcggcgccgcagtcccgcgagccatggcccagtccggcggggaggctcggcccgggcccaagacggcggtgcagatccgcgtcgccatc

SEQ ID NO: 9923 - DNA, 201 bp, Homo sapiens
ttcatgaatattccggggcgcgggagcccgagcgctgccggagggcgcttcgggggaggcggccgctgatgtaagcccggcgggtcgctgggctccgctcggttgcggcgggagccccgggacgggccggacgggccggggcagaggaggcgaggcgagctcgcgggtggccagccacaaagcccgggcggcgagacagac

SEQ ID NO: 9924 - DNA, 241 bp, Homo sapiens
tctcactcccacacactcacacccggccgctcctcgttccctcactcgcctgccgcgcgcgcgcgcgaccccgctcacacacagcgcgcgcgacgccggcggagaccgccccgctccctcagaccgaacgccgcccgcccgcttgctgaggagcggcgcgcgccccggccccgccctcctggcgccgcggcgcggcgggcggggggcggcggccggaggagctgggggccgggccagcgcg

SEQ ID NO: 9925 - DNA, 201 bp, Homo sapiens
tcctcgccgcctcccaggctcccagtgaggttcttcagctggccgcccaccatggtcttcaccatgaacgccatggtcttcgccggccggggcaccgggcgcctgctaccacgcgccaggcaccgggcacgtccgcgcctacttcagcactaggtttcgcggacagctcccgccgcgggcccgcgccccacgcttggcacc

SEQ ID NO: 9926 - DNA, 201 bp, Homo sapiens
gacccggcatgaggagcccggcacccttgctccccagcctcctggaagctcttccttggactggccggcgccgtcttcccgacatctgggggctgaggccggcatcccgggcctgcgtggaggggcgagcgccaaggctgcgagagtcgggtcccgatttgtaatcacttcttccaactttcatggagctccgtcccgcgc

SEQ ID NO: 9927 - DNA, 201 bp, Homo sapiens
gcgcccggcagagagcccccagccgctccggaccccgcgcagccccgcagagacgcgcgtgtcgcccgcacgggccggcacccgggtcgcccccgccggcgtgccaggaccccgcacagaagcgcccggacgcggacgcacgcagccgcggtcacgatccccgccgcccgcccggcccgtgcccggctctggccagcaggg

SEQ ID NO: 9928 - DNA, 201 bp, Homo sapiens
ccttcccggcttctcccccactcttcgcccccggggcccctccctgctgagcgggggctgccgggatttgggattgcggggctgccccgaccccgcagccgtccgcggtggaagccagcccgggcctggccctgagcgcgcggctggggcggccgctgtccatggtgctggcgcgggtggcgcgccggccggcggggtctg

SEQ ID NO: 9929 - DNA, 201 bp, Homo sapiens
ccgcccgcgcactggggccttcgaggtgtgatgtcacctgcccgcagaatcggcccccctcgcgccgcccccctcgcgcccccaccccagcctccctctcgccgctcccggggctaatatggcagcggcgccgccgccccacccccgcaaccgcacgacccggctggcagggccgccggcccggacccccgagactcacac

SEQ ID NO: 9930 - DNA, 201 bp, Homo sapiens
ccgcgggcgcggcccctggaacggaccctcccccgagccgcgcccgccgggccgcccctcccccgcccgcagaccccggcccggccccgccgccgcgcgcgcccctcctcgtcctggcctcccccttcccgcccccgggccccggcgcccccgcccggcccgagcgcgcggcctgccccgcccggctcaccatggcgcggc

SEQ ID NO: 9931 - DNA, 201 bp, Homo sapiens
ggccaggtctcccaggagtagttggggaacacccggcgattctggcggctgcttcctggtggcgcagggagcccgcgtgtttgcgagtgcgtgtgtgtgcgaagttctccgggtaagtgtgccagcgcgcgcctgggtgtgtgcaagggtgtgagcgtgcacacgtgggcacgggcgtgtgcgcgcgggggtgcccggttg

SEQ ID NO: 9932 - DNA, 201 bp, Homo sapiens
cctcgccttcatccgcctctctcaccgcgccgctccctcgtcctgccctgcgggctcaggcggaacccggaacggccgtcctcttcccccgccctccgccgccgcctcctcctcctccttctcggcttcctcctcagccccgggccggagcggggtgtcggcggcggccggttcgggcggcggcgcttggccatgtcgtgt

SEQ ID NO: 9933 - DNA, 201 bp, Homo sapiens
ccaagcccgctgggcgcccgcccctgcgcaccgcgcccgctctttccgtttgtgcgcttgggctccggcgcacgcactgcatctgtcgcccgcccctgccgtgtgtgtgcactgccggggcccgctcgcccacgcccgcgcgtgcgcccccactcccaccccgcatccgcgtgcacgacccactcgccgccgctgtgcgcg

SEQ ID NO: 9934 - DNA, 201 bp, Homo sapiens
tgccgaatgaagctgagcgtctcagtggaaccagggatctcaggggtgagcgaccgcgaggggagagcgacgaaaagggcggccggagctggaggggcgcggagttaaacaaaaaagggcggccggagctgcaggggcgccgagttaaacacgtcatttccagatggggggcttcaggcgagctgcttagctcccctgagg

SEQ ID NO: 9935 - DNA, 219 bp, Artificial Sequence
  Description of Artificial Sequence: Synthetic polynucleotide
tttagggagggggygggaggttttttttgtttagtttygagtyggtggtgtagygttygttttyggtygygggygtagattggyggtygttttygggttaygtggtgygygyggygggygygttygaggagtttgyggttgtttttggtttatagygtttygggygaggagagygggyggaygtygggggttgggtyggtgygggyggygaggtaggyg

SEQ ID NO: 9936 - DNA, 315 bp, Artificial Sequence
  Description of Artificial Sequence: Synthetic polynucleotide
ygagtttygagtttygtttygggggttttatttygttttttygygttygyggttygtttttttttattgagygtttagttttygtagttttttyggtygtygagygtygtgggyggggttttagggyggyggygtttygyggggagggtttttygtgttgggggygaggttattygaggtagtttttygttygtttttaatttygtttygttttyggagtttataaagggaggygattygyggttygttyggttggtattttttagtygtygttagtttygtygaggggagttagygtygtttttgaggggygtt

SEQ ID NO: 9937 - DNA, 201 bp, Artificial Sequence
  Description of Artificial Sequence: Synthetic polynucleotide
gtattyggtttagggttggagttggttgtagggttggttygyggygatttgggtagggtggyggttgttttttttttttttatttygtttygaggygtagygygyggtagagyggttyggtgttyggygggygggyggttygggygggtttgyggtygggatgaggayggygttttygttgtagagygttggggyggygyg

SEQ ID NO: 9938 - DNA, 201 bp, Artificial Sequence
  Description of Artificial Sequence: Synthetic polynucleotide
aataatagggaygttgagaataataattaygattagtayggygaaggygtttttttygygggttagaggtyggygttttagtttygtagaattyggygttyggttagygttttttggtagtttttttyggtagttttaggtttttaagatttgtaggttygtttygaagtttttygttygttttttayggtygtttygagt

SEQ ID NO: 9939 - DNA, 201 bp, Artificial Sequence
  Description of Artificial Sequence: Synthetic polynucleotide
ygygtatttttttygttygtttgttygyggttttttttttgttttyggagygttagtygttttatttygtgatyggtttttygttttgtttygtaggattygttyggaygggattaygtygtygtygtygtygtygtygttyggagtygygtttygggttttgtttgagtygagtygygygyggggtygtagttatygtyg

SEQ ID NO: 9940 - DNA, 201 bp, Artificial Sequence
  Description of Artificial Sequence: Synthetic polynucleotide
atagagttgttttttttttttttgggttttgtaagttttygaattggaggyggaaatgggggaagggttggaagttgtgtgtgaaaaataattattgtaaygggttttttttaggagtttagttyggtttgtattttggtggaattgttgttatyggtttatagygtttaggtygagtyggtagggttgggygggaggttt

SEQ ID NO: 9941 - DNA, 201 bp, Artificial Sequence
  Description of Artificial Sequence: Synthetic polynucleotide
tagttatygyggyggttgyggyggyggtattttygtttttattttygttygggattgttttttattgttttttygtttttttyggatagtgagttygyggyggggygggggaaggagtygtttttattttttttaagtttatttttaaagagatttttttttttttttttygtygtttggygyggagtygggaygatgttg

SEQ ID NO: 9942 - DNA, 201 bp, Artificial Sequence
  Description of Artificial Sequence: Synthetic polynucleotide
aataagtagttygggagatattttttttttttttagttttygtttttttattttgttattttttagttygtgattagttgttttttttttttttygygggygtttagggttgagtaaatatttygggtygttygtttygttattagttggtttygatyggygtatygttggygattttttaggtaattyggygttatgaga

SEQ ID NO: 9943 - DNA, 201 bp, Artificial Sequence
  Description of Artificial Sequence: Synthetic polynucleotide
ygtggtttggtygaggagttaatgggtygggaggggygygygggggaggagtttaggtgtagagtgtygattggttagttygtttttyggtatgtagatayggtgggagttaygtgttaggggtygggaygattttttgttggaggttaaygyggggyggggaagggggygygagygtttygtttggttgaagygggggga

SEQ ID NO: 9944 - DNA, 201 bp, Artificial Sequence
  Description of Artificial Sequence: Synthetic polynucleotide
ggaggaggggaggygttgttygaygygtttttttaagttttygygttttttttyggyggyggttgttygggggyggtggttyggygtygtttttttygatygttttttttagggtttttttttygtgtygyggttaggttgttyggtyggyggygygttggaaatatgaagagaygttgtagttgyggtggyggtggyggt

SEQ ID NO: 9945 - DNA, 201 bp, Artificial Sequence
  Description of Artificial Sequence: Synthetic polynucleotide
tttatttgggaygygatttataggggygttgtttygttttgygggaagaggaggyggyggtygtygtgattggggygttyggttttattygtttatagaaygtttttaatattaggggtttgaaagygaaaatttygggaaggtattttttgatygtagattatattttgtagttgatttatatygtttaggaggtagtga

SEQ ID NO: 9946 - DNA, 201 bp, Artificial Sequence
  Description of Artificial Sequence: Synthetic polynucleotide
ataaaagagtagttttygyggagygggtttagagtttgttyggattgttygatggttttyggttttttgagygtygyggttgtygggttttgtgttygygyggggggygggaaggayggtyggggtttttagtgygygtttygyggagyggygygyggygttygaattggaaagttgtygtyggygtttgtygtttttayg

SEQ ID NO: 9947 - DNA, 243 bp, Artificial Sequence
  Description of Artificial Sequence: Synthetic polynucleotide
gttaaggttyggatygttattttagtaatagttttagttatgtgatyggtaatggyggygttgaygagaggtaggtgagttyggygttttttatatttatygygygtttttygggtttygttygtattttttaygygtttttygttttttyggygtttttttttttattttttttttttgygygyggtttygggtttttygtttygtgttyggtygattatttttttagtattttttagtttt

SEQ ID NO: 9948 - DNA, 201 bp, Artificial Sequence
  Description of Artificial Sequence: Synthetic polynucleotide
tagttygtttatttttttttggagaagttygaygtagygttygttattttttttttttygtgtgtagtttttyggttttaaagtatttatttgtttaattygatttttattttataagatygtaatyggttattatttttgtttttygttaggatatygaggttagttgtgttattgtttygaggggttgtaggtgtagag

SEQ ID NO: 9949 - DNA, 201 bp, Artificial Sequence
  Description of Artificial Sequence: Synthetic polynucleotide
tygtagtatyggttattttattgttaagggtgttttttgtatttgttgygatattttgggtygtttttagtttagtttgtatagtatttttggttaygttygtagtatyggtgattttattgtagatagtgtttttggtatyggttagtayggttttggtygtgtttatatttatttggayggtttttttggttatattyg

SEQ ID NO: 9950 - DNA, 201 bp, Artificial Sequence
  Description of Artificial Sequence: Synthetic polynucleotide
tttygggtygaggggaattygygatyggatttgtgggggagaatgaggatgaaaaygtggagtttttattgtttagggtttgatyggtygatagggatttygaygggggatyggggatttggggagggggtygtattttttygtttttttygyggtttttyggtttttgtttgtttttttgatygtttttaggggygyggc

SEQ ID NO: 9951 - DNA, 201 bp, Artificial Sequence
  Description of Artificial Sequence: Synthetic polynucleotide
agtyggggtagaaggaggagtttgaaggtttattatggggtggaggttgtttgttygygggttygtttttagagttyggggtttattaygttgttttatgygtttttgttggtttttgttaaatagttttttttttttgtgttttagttttttggttgtaaaaagggggtgtttatagagtttttttgaggagtygttata

SEQ ID NO: 9952 - DNA, 201 bp, Artificial Sequence
  Description of Artificial Sequence: Synthetic polynucleotide
ttggtttttatttggtttgygagaaattaaattttgggtataagttatgaagtygataagttygggagatatagtgttagaattataaggtgagattagtygttyggttaagttattttttygttagtaggtgaggttygtgaatagttaagttttttttggtayggyggaatygtagtggaygygtggaggggtttygta

SEQ ID NO: 9953 - DNA, 201 bp, Artificial Sequence
  Description of Artificial Sequence: Synthetic polynucleotide
aattttttatttattaaygtyggygtygttatgggtttagggggttgggtgaggtygtgagagtyggygaggaagtyggttttgygggttyggtygatttygggtttyggttttgggttgygagggattttagttttygtygtygtgtaaaatgtatataaggttygyggygtygtttttgygygtygtgaggatataggg

SEQ ID NO: 9954 - DNA, 201 bp, Artificial Sequence
  Description of Artificial Sequence: Synthetic polynucleotide
gatagaaggggagagtggttaggaaggaggggaggatggatatagggygtttgtagaattggtgggtagatggayggagggaygggtygtgtagtgtagtyggyggggttagggttaggtygagggygygaggtggtagtyggttyggggaggyggaggttgagygagyggtggtgtttgtggagttgtyggttgyggtgg

SEQ ID NO: 9955 - DNA, 201 bp, Artificial Sequence
  Description of Artificial Sequence: Synthetic polynucleotide
ggggttgggaygtttyggyggagtaggyggyggyggtggygagttggggagttttaggttyggygttgtyggaggggttygagtygagtygtttgygtttyggtygggtagygtygggttygtttttygyggggttaygttttgttaaattttgttgyggyggttagygtagygggttygtaagygggygggaggggygtc

SEQ ID NO: 9956 - DNA, 201 bp, Artificial Sequence
  Description of Artificial Sequence: Synthetic polynucleotide
ttattggtgagtttggtagggtatagagaggatggtattattagttggagggggataggttttaattatgagtttaggatgtagagagyggtagggattatyggagttttttyggttttggtgttttggttttttttgtatayggtttttatatgaygtttagtaagtyggattttaatttgtttatttattttttatttt

SEQ ID NO: 9957 - DNA, 201 bp, Artificial Sequence
  Description of Artificial Sequence: Synthetic polynucleotide
gaggttaaggygggtagattattygaggttaggagttagagattagttyggttaatagggygaaatttygttttttttaaaaatataaaaattagttaggygtggyggygttygttygtaattttaggtatttggtaggtygaggtaggagaattaygggagttyggggtagggaggttgtagtgattygagattayggta

SEQ ID NO: 9958 - DNA, 233 bp, Artificial Sequence
  Description of Artificial Sequence: Synthetic polynucleotide
ggagagagagagagagagagagagayggagtyggagagggagggagygagagaaagygagagtttttygttatttttygtygtttttagaatttatygggygtttgttyggyggttttagaaggtygggttgygttgtgggttgyggggagtyggaggttttttgattggttttttgaygttttyggattaattgtgttgttgtataggygtggtttttataggtygagtgtt

SEQ ID NO: 9959 - DNA, 201 bp, Artificial Sequence
  Description of Artificial Sequence: Synthetic polynucleotide
ygyggtatagttatttttttygtygaggyggtattttaattttgtgtttttttaggatygygggttgtaggtattyggttttygaagyggaggtyggagtygygyggagaagttaayggtaatgaygttttttgtygatttttaggaggggataggttgagggtttggaygaggtyggaagygtttttattgtagtttygg

SEQ ID NO: 9960 - DNA, 201 bp, Artificial Sequence
  Description of Artificial Sequence: Synthetic polynucleotide
ttttgagaagtagtagtagttggtttgtttgttgtttygttttygtgtatggttgtttagygttggttttagtgtttagygttttygtttagtattttttyggttttttttttttatttttygttttygagttgyggggagttttagtttgggatttttgttttatgtttttgggtttttgttttggttggttygtttttt

SEQ ID NO: 9961 - DNA, 201 bp, Artificial Sequence
  Description of Artificial Sequence: Synthetic polynucleotide
ggtttygtygggtyggtygttgygagtttygtttyggtttyggttatygtyggggaggaygaygaygaygtggtgggggaygtgttggtattgttggtygygtttttggtttyggggtygygggygtygygygtggaggtygtttttttttgtygtttgygtygggaygygttggtggagyggygygygttgtaygagttt

SEQ ID NO: 9962 - DNA, 201 bp, Artificial Sequence
  Description of Artificial Sequence: Synthetic polynucleotide
ttttttttagtatattttatgtaaaagttagtaaaaatattttttttataagtttaaataaatgtttaaaaatatgtaagttaggaagttatttttaataygtatattttttttatatgtagaagtaatggtgagaattttttatattttttgtagtagattttyggtttyggggttgggtttttagtaagtttatttttg

SEQ ID NO: 9963 - DNA, 201 bp, Artificial Sequence
  Description of Artificial Sequence: Synthetic polynucleotide
ttyggtygtattttygttttatttttayggtagggtttttagtgtttgattaagtttaagttygagtttttyggygygttgtttatyggttgttttttygygttttttttttttttttattygtatygtttygttttttattttttttttgttttttttttattatttagtttatatttttttygttttttttttygtttt

SEQ ID NO: 9964 - DNA, 201 bp, Artificial Sequence
  Description of Artificial Sequence: Synthetic polynucleotide
gggattgggaaygggatagggaygygttttaatttatttagyggtggagttggggggyggygyggttaygtgggatggygggtagtttaggggattygggygayggggtttggygggtagggttgttttagtygtttttataaagtyggttttttygatttttttttttttttgtagtttttttttttttttttgggggtt

SEQ ID NO: 9965 - DNA, 201 bp, Artificial Sequence
  Description of Artificial Sequence: Synthetic polynucleotide
tagttatttatttgttttttaygttttatttattagygygtayggtttyggtaattttattyggagyggggygtygtygtygtttttgtygtagttyggtygggtygttgggygtaggggatttygygtygtygttgtygttgtygtygtygtygtygtygttgtygttgttgtatttttyggygagygttgttgtttttt

SEQ ID NO: 9966 - DNA, 201 bp, Artificial Sequence
  Description of Artificial Sequence: Synthetic polynucleotide
tttgggggaygtyggaygttatgttgtggaaaataatygataatgttaagtaygaagaggattgygaggtgagttggggtttyggggtgtagtttygtttygtygaggatagttygggaggtaggggttattggatygaggtyggggaygagggtataggagttttggtttttyggtgggaygggatttattttttyggat

SEQ ID NO: 9967 - DNA, 201 bp, Artificial Sequence
  Description of Artificial Sequence: Synthetic polynucleotide
gggagggaagaaggaggyggygagygggaagaggaagaagaygtaggtagygttaggygagtttaggggygtygggagygyggagttygggttayggattygygggagtttattgygttttygggttttggagggttgtttttgttygtaggttygggygttttygttaggaggygatagygttatgtttttttaggtttt

SEQ ID NO: 9968 - DNA, 201 bp, Artificial Sequence
  Description of Artificial Sequence: Synthetic polynucleotide
tttagtyggtttttygtatgattggattatatgagggatttaagttyggttagttgttatttttyggattatatgygtgtttagggatygttttttaattyggtatggggatttggaaaaaaagattagggtagagggattggggtygggttyggtgatygtttttyggtaattaaaggatagtaaaggayggtttttgat

SEQ ID NO: 9969 - DNA, 410 bp, Artificial Sequence
  Description of Artificial Sequence: Synthetic polynucleotide
ygtatgygtttaggtyggttygtaggtttttttygttttagtyggtagttagttygttygygttggggttatygygagtyggttygtagyggggttatygygattttyggygtagatatagaggtygtttttagtttygtygtttygtggtttygttttygttgtaygtttttttatttttyggatttygtagggtygyggyggatayggttygatyggggaygtgaaygygtagaattatattttttagygtttygttygygttggaattatatttttyggggggttyggyggtgtattygtyggggtygyggattggaggttttyggttggaaaagttttttggyggttaattggggaggattggaagaaatttaggatggagttagtattgttggtttaatatgttt

SEQ ID NO: 9970 - DNA, 201 bp, Artificial Sequence
  Description of Artificial Sequence: Synthetic polynucleotide
aagtttttgggaaagattygttttattttyggaagttagagggygttagttgtygggttgaaaaggggtgtggggaggggaagtagttttatttygggttyggagtttgtaggagagagaagtggggagtaagaagtgaattttaggggtttatagggttttygtagatgtttaggtyggttaggaatgtatttttggttt

SEQ ID NO: 9971 - DNA, 201 bp, Artificial Sequence
  Description of Artificial Sequence: Synthetic polynucleotide
tttattaygtyggggygattygttgtttgagygagtaygtttygtatttttttygygaygygygtatgttgttyggygtttyggtyggggygttgtattgygtyggygtttttttyggtatttygttgggtgygtttggggaygttgttygggttttaygtgyggagtgggtgttttttaggtyggggagygggggatttt

SEQ ID NO: 9972 - DNA, 201 bp, Artificial Sequence
  Description of Artificial Sequence: Synthetic polynucleotide
atttttggattaggaaatagtgtgtgtgtataygagagagagggatagagagaggggggatatgtggagtgtattggaattattataatttttatgaaggyggtatyggagttattggtattatttgtgtaatttttttttatgtttgaygtygttttaaaataaagagtgagttgagtaaattaattyggtagggtatat

SEQ ID NO: 9973 - DNA, 201 bp, Artificial Sequence
  Description of Artificial Sequence: Synthetic polynucleotide
gyggyggggttgggtttggggttggaygttgatttaggatttygtttttgttygttttgygtygygtttttttygggtyggttttgatygagtagttttaygygggttyggggttygtttattygataggagyggggggttgtagtttaygagtttaygagttygtagygaygtattyggagtgtaatttygtagagttac

SEQ ID NO: 9974 - DNA, 201 bp, Artificial Sequence
  Description of Artificial Sequence: Synthetic polynucleotide
gtatygygyggyggygtttggygggtattgttgttygyggagggayggtgggggggttttagtagttggygggggtggagggggygggagagggagtttgygtygggttgagtttggaggtgyggggygggttyggggagygtttttggggttttttttgttatagtyggggyggttggaatttttttttttttttttttt

SEQ ID NO: 9975 - DNA, 201 bp, Artificial Sequence
  Description of Artificial Sequence: Synthetic polynucleotide
gtygygtygtygggtttyggggatatttttygtygtttttttygattygygtygtyggggtygtygggtygtagggtayggggtyggygyggggggggagyggagaggggttggggagttttaggggttyggggttygttygygggggatgggtagggatttygggtygygtggggtgygggggtygttygtattgaggac

SEQ ID NO: 9976 - DNA, 201 bp, Artificial Sequence
  Description of Artificial Sequence: Synthetic polynucleotide
tttttttttaaaaagagttttttagagttgtygaaattttygyggggtgaaagttaaatttttggagtygttgtgtagtygggtagaggatayggyggygygagtyggaaagataagtgtttaggygaatgggaaaggaaagattttaatttttgtttttattgttagttgaatgtttataaaaattaaagggaatgyggg

SEQ ID NO: 9977 - DNA, 201 bp, Artificial Sequence
  Description of Artificial Sequence: Synthetic polynucleotide
atggtttattgygtaagtttatatttagttttaggaagygagttttaygtygttttagttttgtatttatagtygttaagyggtttyggaagtygaatgtyggataggttaaagatagygtygttgtttyggtattgtygttagagggygyggagtygtygtgttggtttgtattttttttgttaygttagtygaayggtt

SEQ ID NO: 9978 - DNA, 201 bp, Artificial Sequence
  Description of Artificial Sequence: Synthetic polynucleotide
gyggttyggaaatgagygtttttyggggatagggggttttgyggggyggygatagttggatttttagygygtataaagtttgygggaggatttattgtagyggtygttttttttygtttagygagggygggygtaggggygggggatgtygaagggttaggtttgtttaggtygygttattttygttttagaygtttagtt

SEQ ID NO: 9979 - DNA, 201 bp, Artificial Sequence
  Description of Artificial Sequence: Synthetic polynucleotide
tttygagggtygygygggtttaggygtttayggtttygtagygtygygtttttygygagaaygtagagattygggttygttttgagtygtygattgygggygggagtyggygggtaaggygygyggtyggtagtyggagyggygygtaaygtagttgagtgaggtygtyggtggaggtayggagtagtaggygttyggggc

SEQ ID NO: 9980 - DNA, 294 bp, Artificial Sequence
  Description of Artificial Sequence: Synthetic polynucleotide
tttygygaaggtttyggttyggtygggyggggtggggyggtttyggttttattaattagyggtttgttgtggatgtyggyggaggagatgttatttagggygggaaaaggggygyggaagaggggyggggygggttayggygygtagggtttttttttttygtttyggatttaattaattgggtttgagtttttgtyggggagggggygtygggyggggtygyggttgggyggggygggggatygggatyggyggygggggttgyggttttgtagtggaagtatgggyggygag

SEQ ID NO: 9981 - DNA, 201 bp, Artificial Sequence
  Description of Artificial Sequence: Synthetic polynucleotide
gtgtggaggtttaygtagygtttttggttggaayggggaagtttgtatttagttttgggagtgggtttgggagagggaggaggagtygtygggagtttggygggagggyggtgttttygtttgggtttttttttgttgttttagtttyggtagtttttatagtagtttygaagggtgagaatttgtttttttatggatttg

SEQ ID NO: 9982 - DNA, 201 bp, Artificial Sequence
  Description of Artificial Sequence: Synthetic polynucleotide
ttttttagtttttagagtaagttaattagggataygttttygtggtttagttyggaaataatgtttggtgggaatttgtaattttggttgtyggaattttyggggaggattaaygtyggygtatygtgyggtyggggyggggygtygtttaaatttaggttttgtgatagygattgtggyggtttggaaagygtgggtttc

SEQ ID NO: 9983 - DNA, 201 bp, Artificial Sequence
  Description of Artificial Sequence: Synthetic polynucleotide
aattatttttaaaataattttttyggggggtgagaggtaattataattttagygagtggagggygygggggatgggygtygggygggygggggyggggagygyggygygggtttttaggtggygagyggaggtgttttygtygyggggggaggggygggggygtaygyggtyggyggyggggggaggyggygygyggggga

SEQ ID NO: 9984 - DNA, 201 bp, Artificial Sequence
  Description of Artificial Sequence: Synthetic polynucleotide
aggttttygtatttatygygtgggtttttgttttggttttatttgttttygatatttttygttttygygatgtttaatttyggttygagaaggttggtygygatttygttyggtattygtygtttygatattattattygttttttygatttttttyggygtygttgtttattygtttttygtttygtttatyggggtygt

SEQ ID NO: 9985 - DNA, 201 bp, Artificial Sequence
  Description of Artificial Sequence: Synthetic polynucleotide
ggggaygttygtttttttttygggtagttttttttatttaggygggatttgggttttygttggatttagggtygttttttygtaggyggggtyggttyggygygtattttgtttyggatgttttggygtayggtttygygtttygtttttattttggygtatttggttttgygtttttttttygtttggygtagygttttt

SEQ ID NO: 9986 - DNA, 201 bp, Artificial Sequence
  Description of Artificial Sequence: Synthetic polynucleotide
tattttttttttgygygtttgtttttttttygtttgtaggatttygtttttggttygttttttttttttttgttgggtaggttttttyggagtttattttyggyggyggyggyggtagtygyggtygyggtygttggatttygagaggygyggggaatttttttattttttgttttggttttatttgtttttttttttttt

SEQ ID NO: 9987 - DNA, 201 bp, Artificial Sequence
  Description of Artificial Sequence: Synthetic polynucleotide
tagggaattataaaagayggtyggyggygagtaggttggggtgayggggatttygtggataaygggtttgaggaygtttagggttttagttttttttaggygtttttygtyggggtaaygtagagtagttgtygtttttttygygttttagtagatggtggtgttagttyggtttygtgttyggtygtygttgygttygyg

SEQ ID NO: 9988 - DNA, 201 bp, Artificial Sequence
  Description of Artificial Sequence: Synthetic polynucleotide
ttagataggtatggttaaggtagtttgtgatttattttataaaattagagatttttgttttttgtggagtaagatttttyggaggttagagtaggatgatygttaatttttttttttagagtyggtttagtttgataaagtaggggttatttyggagtttggaggggaagagagtttaggtataaggttatttttgggaaa

SEQ ID NO: 9989 - DNA, 201 bp, Artificial Sequence
  Description of Artificial Sequence: Synthetic polynucleotide
gggygygyggygttttttatttaygttyggtyggggygyggygyggyggygggtattyggayggtyggyggaggtaggtyggttygggtattagtttgggyggttygygggtyggggyggyggyggggtggyggtggyggyggtagtagygyggagtyggtgggygtagtygygygttaggtyggyggtyggggtttgggg

SEQ ID NO: 9990 - DNA, 201 bp, Artificial Sequence
  Description of Artificial Sequence: Synthetic polynucleotide
tttgttatagataagttttygaagtygttttggtgtaggttatttggttttttagtttttggtgtgtggttagtgtttggtgtttttggaaagttattttygggtagtttttgatagtgygattyggygtttaagtagtttgggattttgygyggatttgatttttttagatygtaggtagtttgggaggaggttyggtyg

SEQ ID NO: 9991 - DNA, 463 bp, Artificial Sequence
  Description of Artificial Sequence: Synthetic polynucleotide
aygtttgtgttgtatttggygttggtygayggygyggtgttgttgtttaygtygttttttgtggtttttttgattyggtaggtttggtygttgggttaggygggttgtaaggyggtgtattaygtgtgygygtttagtatgtaygttagygtgttgtttatyggtttgtttagtttgtagygttgtttygtagttattygtttttttttggygtttyggttgygtagttyggttttggttygtygtttgttgttggyggtttggttggtygttttgttgttygtygtttyggtygtygtttatygttatttgtggagggatygygtatgttagttgtgttattygtygtyggtttaygtygtygtttatttgagtttggagattttgatygttttygtgttttttttygggttgatgttyggttgttatagygtgaygttggtayggttgyggggygttygtt

SEQ ID NO: 9992 - DNA, 201 bp, Artificial Sequence
  Description of Artificial Sequence: Synthetic polynucleotide
atygggagtgtttagygattttaggttagttygggggaaagaagyggtygtygtygtygaggttttttggtttygggatttyggygttgtttttttttttygtatttgttggggtgggttggagtygtaatygaatttyggtygyggygtttgtaaagtttttttttygaagtttygyggttttagtttattggygttttt

SEQ ID NO: 9993 - DNA, 201 bp, Artificial Sequence
  Description of Artificial Sequence: Synthetic polynucleotide
gttttatagtttyggttagaatttggtgggggaygyggggggggggtgtttgayggggagggggtatagttttttygggttaatttttatatttttgtttygtttaggyggggggtgagtyggggtgagtagtyggttttaagttggtyggttttttggaaagggagggttagtaggagaattgtagatttttttagtttt

SEQ ID NO: 9994 - DNA, 201 bp, Artificial Sequence
  Description of Artificial Sequence: Synthetic polynucleotide
gggatygttttaagtagttygttaataaygtggyggtggtgaaggagttygayggygttaagttygtggtgttgaggaagaagtttyggttttyggagttygagttygtatttttyggtttttygggggtagyggtttagtygtygaaatttatttygayggttttgtygyggagygtttttgtttygggagtttygtttt

SEQ ID NO: 9995 - DNA, 201 bp, Artificial Sequence
  Description of Artificial Sequence: Synthetic polynucleotide
gtttttagaggtttagttttgttttttattatatatagttattattttattygtttttggggttyggttgtttttttyggtgttttttaaatttttttttygatttgggtgttaagtttatttatttttyggygtygttttyggtygaatagttttttgtttttttttygtttgggtyggagtttttygtagtttttttyg

SEQ ID NO: 9996 - DNA, 201 bp, Artificial Sequence
  Description of Artificial Sequence: Synthetic polynucleotide
ggttyggtttggggttgggttggggagygyggyggttgyggttggggtayggggyggtygggtgagttggtyggygttygttttttttatttagtgagtayggtagatatyggagaygyggggtttattttttyggttttttttygattaagaaaygttaatttygttttttattggttgygtygygygttatgtygatta

SEQ ID NO: 9997 - DNA, 201 bp, Artificial Sequence
  Description of Artificial Sequence: Synthetic polynucleotide
atygagtttaaaagtygtyggyggtatattttagyggttttttttttttygggttgggattygtttttgtaagaaaygttatgtttttttttttagatatygtttygggagttttagatgtaaaattagaggttttttatttggtattattgatttttgtgttaataaaatgttagtttttaagggaaaatttaaaaaaag

SEQ ID NO: 9998 - DNA, 201 bp, Artificial Sequence
  Description of Artificial Sequence: Synthetic polynucleotide
gtygygygggayggggtagggatttygagaatatyggggatttgygggtyggtggtttygggtaggttatttttgaygygggtgygaggtttttygygggygtgtayggttgggtyggagtygygtygggggtygggataygtttggggttagygttggygtygtygttygggtggggtgggtygggttygggtttagttt

SEQ ID NO: 9999 - DNA, 201 bp, Artificial Sequence
  Description of Artificial Sequence: Synthetic polynucleotide
ggyggygygyggtagagttgggtttttygttaggtggtygggggtgtgtttttagggtattttattygttattttygygtttttagtttyggyggtygygyggatttygtttttgttgatttyggygtaygttttygygtygygygtagtttttygtttttygtygatttygtygygtygtyggtagttttttttagtttt

SEQ ID NO: 10000 - DNA, 201 bp, Artificial Sequence
  Description of Artificial Sequence: Synthetic polynucleotide
ttttttttttgttgttttaaaatatttttygaygttagtaaaatataatgygtttyggtygtygtaaatagtygggagggagagtatatattyggygyggygyggtygtyggttyggtttttatttttttttygtttttagaaaatgttataaaagygggtagggygyggggagggyggttgygygttyggyggtyggggt

SEQ ID NO: 10001 - DNA, 201 bp, Artificial Sequence
  Description of Artificial Sequence: Synthetic polynucleotide
agttaggaaatgyggggtttggtggggtgaggagtayggggttttttttttattttygyggggattttgttatyggtttagtgtggaggttttatygtttygttyggattygtggggtttygatagtgtggtttttgygaggattttttttatttttttygttttggggttgttgygggagggygttygggtagtattagg

SEQ ID NO: 10002 - DNA, 258 bp, Artificial Sequence
  Description of Artificial Sequence: Synthetic polynucleotide
gyggyggtagyggyggtttggtttttttagagggttagagttagggatatgygggygttygggatttygygtttygygyggttyggygtttgagygttttygtttttygtttyggagttgtyggyggtatgattygataygtyggggygttygygygyggggattttayggggtaagttygggyggtygtttttttttttttygygatttttayggttygygttttggtygttttattttattttttgttttagagag

SEQ ID NO: 10003 - DNA, 201 bp, Artificial Sequence
  Description of Artificial Sequence: Synthetic polynucleotide
tygayggttaaggaaagtttattagtttttygtatygtgggygaygggttaagattyggttttaaayggttagatttagtttttagtyggttgtygttttygttttaygtaggygygtttyggggttttttttttttttatygygygttygyggggttygaygggggyggagygattttyggaaggggygtggygatyggg

SEQ ID NO: 10004 - DNA, 201 bp, Artificial Sequence
  Description of Artificial Sequence: Synthetic polynucleotide
agggggayggttagaygggatgtyggaagttaagggaygtagaggtyggygggtggyggygatggagaggatagattyggtttttagaggaggtygtgagygyggggtttgygtyggtyggaggagggattyggggggttgtaatatggttgttygggygtygttttttttttgttaagttagggttttggggagttgttg

SEQ ID NO: 10005 - DNA, 201 bp, Artificial Sequence
  Description of Artificial Sequence: Synthetic polynucleotide
ttygtygygtttyggtygggatggatttataygttygatgagtttygygtyggyggttgygagygtygagtttttttttgttgyggttttagtygtttttygygygttyggtttygyggattaggatttttgggtttttyggttgagggygyggtygtttyggagaggtygagyggggaygggttygagatggygygggga

SEQ ID NO: 10006 - DNA, 201 bp, Artificial Sequence
  Description of Artificial Sequence: Synthetic polynucleotide
tagttaggatagtataaaatttttttatygtttattttttgtaaaaaatygtggttttyggyggattttggagataggaggtgtaaagggygtttataygyggttygggttygyggtygagagttggggggatttggagyggggtygggtygtaagaagattttgattttgtttyggygttggggygygtgttaagggttc

SEQ ID NO: 10007 - DNA, 201 bp, Artificial Sequence
  Description of Artificial Sequence: Synthetic polynucleotide
tgtygggttygaygtgtatagtttagygtttttttttattagttattgtttaggtttttygattttgtattygtyggaatgagagaaagtagtttttygtygtttagttttygggtagttgtttyggtygggttttgygttggtgagaaagttttatttagaggyggtygygygtaattgtaggyggygttttaggttygg

SEQ ID NO: 10008 - DNA, 201 bp, Artificial Sequence
  Description of Artificial Sequence: Synthetic polynucleotide
ygygggtaaggaaagygygtaggttttgtagatttttttatttyggttttttggttyggttygttttttygtttyggggyggyggttttttgttttgtagygagygttygtaggagggaygttaggatttyggaygttatttttgaggtttttttgtatttgggtttttgatagtygggaataggtaggaggtggggygag

SEQ ID NO: 10009 - DNA, 201 bp, Artificial Sequence
  Description of Artificial Sequence: Synthetic polynucleotide
gtgggaggtyggtagygygggygtygygttttyggaggagttygygttttttgaggagygygygtgttyggaagagttygyggygtygtttttygaatygygygtttggtttgaggatttygygtttttygaggagttyggggagttygygttygtattttyggggttyggggyggtgtayggggagtyggatttggtgtt

SEQ ID NO: 10010 - DNA, 201 bp, Artificial Sequence
  Description of Artificial Sequence: Synthetic polynucleotide
agtgyggatttyggtygygtgyggttttgatygygtygttttatttttggyggggttaygtayggaygttatggttggygtygyggagtygggygatgygygyggattttttyggggttttgattgtttttgagttttttttgyggggggygtgygyggttygtttttygyggygttaygyggttttttttyggtygggga

SEQ ID NO: 10011 - DNA, 201 bp, Artificial Sequence
  Description of Artificial Sequence: Synthetic polynucleotide
gtttgyggagggtgggattttatagtttgtttatttgtttaggttgagatttygtgttttagttttggatgttttaygggtttttygtttygggtagyggygtaygggaggagaagattttyggtttgtagttagatttttttttgagattttttttagtttaggtttagagttttgggatttttttygattttttttagt

SEQ ID NO: 10012 - DNA, 201 bp, Artificial Sequence
  Description of Artificial Sequence: Synthetic polynucleotide
tyggttttttttttygyggggggtttygtttygygtttygttttttygggttgtagtyggtagtttaygtttagggagggtggagggaggaggagaggygyggagaggagggaggggagaggggagggaggaaggygagagaaagggagttgtttttatttyggattttttagagtttgtttggagygygtatttagyggt

SEQ ID NO: 10013 - DNA, 203 bp, Artificial Sequence
  Description of Artificial Sequence: Synthetic polynucleotide
gygagyggttayggggtggggagtaaggggygygygggyggtaggtatggaayggaygyggygtatttygtttatygygggaygttyggayggyggtyggygygygyggttygtttygagttygagagggyggggagataatgtttgttyggyggggtagtttaggtygtaygttttygttygyggataygggtygtttttat

SEQ ID NO: 10014 - DNA, 201 bp, Artificial Sequence
  Description of Artificial Sequence: Synthetic polynucleotide
tygtggagtygygttaggttayggggtttyggttagaygggagygttagtttttttttttgtttygatgtttttaaatttaggtttagttttttttttttygattygatgatatttttgggttttagaatgttgttgggggygggagatyggagaagaagtaggtgtayggggaggtgggtgttttgttttttgygaggag

SEQ ID NO: 10015 - DNA, 201 bp, Artificial Sequence
  Description of Artificial Sequence: Synthetic polynucleotide
tttgggggggygggtyggatttgaaggttataggtttttttttgygtttattttttttgtaatttttatagtttttttygtygatttttttatgttttttygtttttttgttyggygttttttttyggtygygggttaattggttgtgatagttggagttttgggtagttgagyggtgttattgtaaattaggtaggygtt

SEQ ID NO: 10016 - DNA, 201 bp, Artificial Sequence
  Description of Artificial Sequence: Synthetic polynucleotide
ttggaagggygggggyggtgatagyggtaggggygggattyggaggyggggygtttgtttaygtygtttagtagyggagggaggygyggttttagtttygygtttaggagtygtataggygttyggggtygtagtaggagtttttttagggygtttagygttgtatttaygagtygygygtygttttygtttagtgygttt

SEQ ID NO: 10017 - DNA, 201 bp, Artificial Sequence
  Description of Artificial Sequence: Synthetic polynucleotide
tygtatttygttygtttgttttttatyggttaggttttgtygggtygtygyggtttyggygttttattttttttygggttagyggggggttgggagggggygaggaggaagggggtttttttttttttttttyggagggggtygtagyggyggtttyggtttttttttttttttatattttttttygtttttttttatttg

SEQ ID NO: 10018 - DNA, 201 bp, Artificial Sequence
  Description of Artificial Sequence: Synthetic polynucleotide
tyggagggagggggtaaaggaagaaaaagaaagygygttyggaaagtyggtttgggttttgttaattattttgaaggtaaagtatttgtatttttttygtygaggttggttggyggygtygygttggaggggaggaggttygggaggaggaggagaaagagtagygggaggattygggttgggaggggagygtagggttgg

SEQ ID NO: 10019 - DNA, 201 bp, Artificial Sequence
  Description of Artificial Sequence: Synthetic polynucleotide
tygtyggggagtygtaaagtttgayggaagaggttgyggttttygygttttagtygtyggttttygagtygtagtygggygtttttttgaygtagtygygygttttgtyggttttattygtttygygtayggatggtttttaagtggttygtygttaggtyggtaaatygtttttttagttgttgtygggygtygttygyg

SEQ ID NO: 10020 - DNA, 201 bp, Artificial Sequence
  Description of Artificial Sequence: Synthetic polynucleotide
gyggygggaygttatttgygatygggattatgaggagttgttagattygtggggtyggtaaygagagtagtygyggtatttgttgagaggaaagagggagyggttyggygyggttggggygyggtagaggtttgttygattttyggttatgttattgttttgygtgygyggtgagtgygyggattgaggyggggaggyggg

SEQ ID NO: 10021 - DNA, 201 bp, Artificial Sequence
  Description of Artificial Sequence: Synthetic polynucleotide
gygttagatttttttattatatttttttattttaggygattygttttggtttygggtgtttttagtttgygygggtygtttttagttttyggtggatattygtttttagttygtygttttttgttyggttttgygttttttggaatttttgggtttttagttttygtygtttttagaattgygtttgygtaataatggtta

SEQ ID NO: 10022 - DNA, 201 bp, Artificial Sequence
  Description of Artificial Sequence: Synthetic polynucleotide
aattattagagaatttttttaaaaatatagattygatgaggagtggttttttygttttttttttgtgtygagaagggatttyggtygttaataataaagaygtttttygttttttttttttygtyggttygggttygtttttttygygttgyggttttyggtttagygtttttttttygagtygggttgyggygtttttaa

SEQ ID NO: 10023 - DNA, 201 bp, Artificial Sequence
  Description of Artificial Sequence: Synthetic polynucleotide
ggagggtygyggagaygtaggygtttygggtygttygygttgtttttgtttgtttygtgygggagtyggggtttttggttttttggttttttggtttttgyggttygggygaatttagagygtattygtaygtyggtttyggtyggtttttagygttygggttttaygggtygygtttttaygyggygttttttagagatt

SEQ ID NO: 10024 - DNA, 523 bp, Artificial Sequence
  Description of Artificial Sequence: Synthetic polynucleotide
ttgygttaagttttagaattatttagtttygtgtttgtygttyggggttyggtttygtttyggtyggygtttatttggyggtgtygttttyggaagattayggygaaggtttygtgttttaygagattttttttgttgtattygaagttatttattatttttatggtygygttttyggggtatatagyggaygggygggyggygtagtgyggygtaggtattagtatygyggtttygygggttyggagygygttagygtgyggygggtttggggtagtygtagtttygggttygggyggatttttatgtygagagatyggagyggaaattggggaagttgtygygyggagttagggttagygaggttyggttyggtttttgtygtttatggttyggtttgtygtyggtygttggttgtttggygaagyggtttyggygttgtygggttaggggtgtygttatygttattgtgygygtttagagtygtataygygttttgaggtagtgaggggttyggtatttt

SEQ ID NO: 10025 - DNA, 201 bp, Artificial Sequence
  Description of Artificial Sequence: Synthetic polynucleotide
yggttygtattttttygtygttagttttagttttaaattyggyggtttagygggygtattatggtattggagtagygyggggagygygttyggagtttygyggttygttgygtttygttygggatttygttgygtygygygtttttttygyggttygyggggtygtttttgtatttttattttttttttygtttgtygtyg

SEQ ID NO: 10026 - DNA, 201 bp, Artificial Sequence
  Description of Artificial Sequence: Synthetic polynucleotide
gttttygtttaagtgtggtttttttgggtttatattttattaggttagtaaggagggggatagyggggggyggggtaggtgttgggatttygggtaggtgyggggaaggtagggggyggggggggaaggggttgggygatgtaggtgttgggggtygggatagttgygggggtaggtaggtatygggaaggygggagggyg

SEQ ID NO: 10027 - DNA, 201 bp, Artificial Sequence
  Description of Artificial Sequence: Synthetic polynucleotide
ygtagattttgggtttyggttttgttatttagggggattttttttaaygatgggatyggtgttyggagtggagtatggggagtgygttttygggagtyggygttggtyggatatgtgataattgtgggtygttggaggttygtttgygttgggatagggtttggattttaygtgygtygtttgtgtttygttagatygggg

SEQ ID NO: 10028 - DNA, 201 bp, Artificial Sequence
  Description of Artificial Sequence: Synthetic polynucleotide
gggtyggtttygyggtygatttggggtatygygtyggggtgaggtttggygaggaggygaaggttgtaggygtgaggtgaaggtygtaggtyggtygggtygattttygttatgtaaatatyggtgagggggggggagggaygggggataagatggyggyggttyggygtttgttgtaggggaygatagagggggttgtyg

SEQ ID NO: 10029 - DNA, 201 bp, Artificial Sequence
  Description of Artificial Sequence: Synthetic polynucleotide
ttttygygtttttttygygttttatatttatygttyggyggagggggtttagttygtagtygtygtygttatygtygygtttyggtttyggtgtaggtagyggtygtygtygtygagatagttgygygggygagtatttttaygtagtaagttygtttttttttygtttgtgygygygtgtgtgtttttygttygtyggyg

SEQ ID NO: 10030 - DNA, 201 bp, Artificial Sequence
  Description of Artificial Sequence: Synthetic polynucleotide
gygggggttttttaygtggyggaggtttttyggtttgggggttaygggttyggaggaatttgtttggaagttttttattayggtagagttttttggagttygtttygtgttygataaggggagttttagatttgatttttttagtagtttygyggggyggggtygagaaggggygggygggyggaggaygttggygggaga

SEQ ID NO: 10031 - DNA, 201 bp, Artificial Sequence
  Description of Artificial Sequence: Synthetic polynucleotide
aatgtgattatagttaatatatgatttttttagygttttagttagtgttttttttgatttttgttttttggagaggaggatggaagggaggggttyggtaygttgttggtattttgttgtgttttgtagttttttttygggatatttgggtttatatagttttttagtttatataattggtgtagattttttgtgtggaga

SEQ ID NO: 10032 - DNA, 301 bp, Artificial Sequence
  Description of Artificial Sequence: Synthetic polynucleotide
tttttttttaatttttggyggygggyggttggggaagtagttttgtggtttttyggygggtgaggtygagatagagattaatttttaggyggygttttggygttgagttygygttgaataagattttttygtagttttgygtttygygtygggtgaaggggygtgtttttgtaggygttyggggttyggtttggagttggyggtyggtaygtygtttttggygttttttgttaattaagagaaatayggttaaatgagtgygttgggatagaaatttatagttaattaaggttttattygt

SEQ ID NO: 10033 - DNA, 223 bp, Artificial Sequence
  Description of Artificial Sequence: Synthetic polynucleotide
gygggggyggyggyggtygtgagtttygatgaggttygagygttttyggtygygyggtagygttttyggttygatggagatttygtygtgggatttagttygtaaygattygttgtygtttaygttgatttyggtygtgtttttttaygtgaagtttggttttatygtygtttatatygtgttttaygygttgtttttygtgtttatttaygtgtagttttgg

SEQ ID NO: 10034 - DNA, 720 bp, Artificial Sequence
  Description of Artificial Sequence: Synthetic polynucleotide
gatagtygtgttttattttygttttgtgttttttttttyggatagtgttttttttagggtttatttaggagggtgtagyggtggttttyggggyggtggtygtggtgggggtgttagttgtaggggtgttttyggtgggtgggagttggtggtttttygttggtgttatgggattygtatgttygttttgygtttttyggtttttgagtttataggtygggattttgtttgttagtygygtgygttgtygtttaatttttgtaggygtagagygygyggyggyggtgatagagaattttgtttggttgtttaaatatagttttttgtagaaggattttgygttyggggaaggggaggaatttttttttttttgggygttygtttttttygttatggttyggtttttatattygtttatatttggtygtagyggggygttyggggggaggggttgaggtygygtttttygtygttttttgggygygggttaggyggggaggaggggggygtttyggtygtgtgtttaggattgttttttagyggttattygggttttagttttttaggtttggttttgataggygggyggagtagttagtgygagatagggaggtyggtgygggtgygggaatttgattygttygggaggygggggyggggygggggygtagygygyggggaggggtyggygttygttttttttttttatttatttagttg

SEQ ID NO: 10035 - DNA, 1683 bp, Artificial Sequence
  Description of Artificial Sequence: Synthetic polynucleotide
tagtggtagtgttgagtttaggaataygygyggagttygyggygattttygyggtygtttagttttygyggyggatttyggygygtaggagttattgggtygtaagggygtyggggagygggaggggygttgggggyggtaaggggttttagattttaggttaygaattgtttttttttttttygggtaagagtttygttttttttaattgatagaaatttattggggtaggggggygagtggggagagaggtygtttagggttygttattggttgygtttttttyggttttggtttgggaagyggttttgggtttttygggygagtagtttgggygtyggygttttttgygaggaagatygyggggtgayggtyggtattygttyggttgggtygygttgtygtttygatttatttttttttygygttygygtttttttttttttttttattaggagttygggattyggagagggygygggaggtaggtataygggttygattttattttagygtttatyggggaygygggygggyggygaygggaygyggygggggygyggggygggygyggttatggagtagtagyggyggyggyggyggyggyggyggtaatattagygatygygggyggaygagygggygggtagggtygtygggtttagyggatygaattgtatagtttagtaaaagygttttygtttttygygygtygttttttgygagtttaaatttattaatattttttaaygttttaatttattttttgaagaaaagtaaaaaaaaaaaaaaaaaaaaaaaaaaaagtaaaaaaagaaaaagtattgatyggagagayggggatatatatatatatatatatatatatatatatataaaattttttttggtttttgttaaaattagtagggttygtygygygtttgtgtgttagtgtgtgygagtgtgtgtgygtgygggygtgtgtgtgtgaatgtgattattttaggatttttygggtttyggagaygttatttttttttttgatatttttttttataaatyggtggygyggyggaggyggtagagtygggygggaagygyggggtyggtyggggygttygtygttygtygtygttttygygygttygggggtttyggygtttttygagttagggyggttagttygyggttygtygtttgatagatgtttatygttatggagttgtygtagtagtatttttgggggttygggygagygaygggagtygggatttgagygagygtyggggttagyggagtyggagtygtygggatatgggtgagtaygygyggygattttggttygggagttygggygtttagttttttttygygtygygggttttygtattttyggaatygggggygaygtgtgtgttttgtatgtaaaagtttaygtygttttgttgggtttttgattttgtattyggygggaagggggagatygggtygagggggygggatgtyggttygggygaggttgtaggagatgggygygatttyggygggtyggygggtgggyggygatgttggtttaattggagtggttygttggtggyggygatggtggaagttttgggttggagggttgggagtttattgagtttygtttaatttgatttatttttttttygtttttygttttttgtattttttttyggt

SEQ ID NO: 10036 - DNA, 233 bp, Artificial Sequence
  Description of Artificial Sequence: Synthetic polynucleotide
tttygttygggtygttyggttyggttgtgttttgttyggttagggygggygggttygtttttttttyggtyggygttttttttttggtttttttttttttygygtygttygttttygtttttttygttttttyggygtyggygtagttttygtgaattygggygtattatttygggtgtttyggtttggggatygttgtygtttyggtygttgtttttttaatttttttgttt

SEQ ID NO: 10037 - DNA, 213 bp, Artificial Sequence
  Description of Artificial Sequence: Synthetic polynucleotide
gattgygygtgygtagagtaygtyggygyggtttygggattttygygataattgtattgagataaagtgtggtaattygagttggttggtgatttattttyggygaggggttygygtgtgggttaygtygtygtttttatygggaaagyggggattagtggggggggtttagttgtagggtagtgggaggatgttgtttgttttgggggaagg

SEQ ID NO: 10038 - DNA, 236 bp, Artificial Sequence
  Description of Artificial Sequence: Synthetic polynucleotide
ggtagygtygtttgygtygygtttagtaygaagagttygttttagtttaggygtagtagygttatttggtyggttatyggtagttyggggaagaagggygygtggygygtttattttayggtgttgaagagtagtygygtygttagttygtataygttgtygatgtttagtatygygttygtygygtygttttttgygtygaagygttyggtygtygtagggtagggtttagygyg

SEQ ID NO: 10039 - DNA, 233 bp, Artificial Sequence
  Description of Artificial Sequence: Synthetic polynucleotide
gagggtggggttttaaaygttatttaattagygaygttgggttgggaattgtttaattaggtaygtagtttgagyggagaggayggttttygggatgtggygggatttgttygtttttttgtttttggttgtygttggaatttygggtttygtttttattgttttgtgttttttgtttttagaggtttagtttttggttttgtgatttgtaggtattgggaatttatagttaa

SEQ ID NO: 10040 - DNA, 737 bp, Artificial Sequence
  Description of Artificial Sequence: Synthetic polynucleotide
aatgaygtygtaaataatagtattaattattatygttygtagttttygygtatagaggttttaggttttyggttttaygtggatygatttygttyggtagygyggggttattttatygygagtttttttygtagttyggttygggttatttygattygttaggtttaatttaataattataatatyggaaaaggaagtaaaggtygaagtttattygyggttttgaggtttgtgggaaaygtagtttaataaygaaagagttttgaagtttaagyggagttygttggtygtaggggtygtattaygttttagattttggagttttygggtgygtagatttttgttattagtagaggttgtygttgygygttttttaggygyggaagaggyggttggtggtttttgayggtaaggtgaagtygaggtagtaatygggaatttaggttgggaggatagaatggggaataggaagttggggygagggtggttttgggggaggtggggggtygyggaattttaggtggtttttgttttatttttggaaagaatyggaagttygggtyggggagggtgaagggagtygyggattyggttgtttagtygaggaggaaattyggattttaggttgagggaggtygaagaaggaattggagggtygggttgggaaggtttgaagygggtatagtttttaggttggggagggtygaggggagaattyggagtttgagtygggygag

SEQ ID NO: 10041 - DNA, 308 bp, Artificial Sequence
  Description of Artificial Sequence: Synthetic polynucleotide
tttataggtygagtttaygagtttttygaggggtgagyggttygggttttttggygttttggtyggttagttaagygttggattatattttttagaggtayggygttyggagygttggattatattttttagaggtatygttttyggagygtagttttattttygttagtttgygagatttggaggtttygygtggggagagggtygygtttgtggaggagtttggtttygtatttgttgggttggygaattygaaattgggtttggaattygggagttagattttggattttgaattgtatttttgt

SEQ ID NO: 10042 - DNA, 1100 bp, Artificial Sequence
  Description of Artificial Sequence: Synthetic polynucleotide
ttggttttaygtagygtttgtagattgtgagttygtagggtagygttatyggtttatgtagtagtygtyggtagygygggtagtygagtaggtygyggggygygyggggtttyggggtyggttttttttygtygggygtttygggttygtygttygggtttttygyggatagyggtyggtygygtaggtttayggygygtattaggtygttygttagtttttttagttttttyggtygtagygtttygagtygygyggygtygyggaaygygtttagggtttyggggaggyggtyggygygggttagygygttttttagttttaggtataggtygyggttyggttgygttagttyggttagtatggagygaaagagttyggttgttatttygtagtygttygygyggaaggtttygtygtttttttttaagygttgggygatyggtttygygyggtygtagttaggatattggggyggyggyggyggygggatyggttyggggtttattatygyggggttgygaygaygygggttyggagygaaggygyggagtagggaggatgygttgttgttgggaattggtyggygggagygyggttttagttttygttagtagttaygygygtttgggggyggygygttgygagyggttgagatygygggygggggygggygtttggtttgggtagygtttttagygyggtgtgggyggygagtttygtagggttgtaatygtttyggggtgggggtygggataggtatygygggygtaatttgagtttttgtttaygygtagyggttttttagtttygtyggtttaggtaatttaggtygttgyggtaaygtagtgatygygttttaggttygygttttttgygatgttttttttattygtttgagggtttttgygygattgygygygygttttttgtttgtygttttttygtagaggtgtyggggttttgggagtaggtggttttggtygygggttgttggygygtyggtatygyggtatttgtttttttttagaggtttggtygtttttataatttgtggtttygtttaagtaagaatttaggaaaagttattaaaygtatta

SEQ ID NO: 10043 - DNA, 214 bp, Artificial Sequence
  Description of Artificial Sequence: Synthetic polynucleotide
ggygagagtaaaaaaaaaaaaaaaaaaaaaaaaaaaaattttaattgtaaatattatttggaggtgggygagggygyggygtgygygyggyggygggtggygggyggygygggygtttttgyggggattttyggttttttagygygttttagtggaygttttgtttttygttggtttttygtgttygttataatttgtaatatattattttttt

SEQ ID NO: 10044 - DNA, 582 bp, Artificial Sequence
  Description of Artificial Sequence: Synthetic polynucleotide
ttttttygygtgygtttygtatttgtygggggttygtattygttttygtyggggttttagggggtaygayggtygtggttyggygtttttgggaggggagygggatattttygaaggyggygygttggaggyggggagyggtyggggygtayggagagggyggggagttygygggagggggaggagggggaggagggggaggaggygygaggtgggggggagygyggygggyggtagggagggagygggagggaggtaagaaagtagtagaaagtgaggttggtaggyggyggtaaaggagtyggygygyggyggyggtaggaagtttgtgttygagaatagtagaaataagagttagggagggatygyggtygyggyggyggyggygagagygaaagaggaaattgtagaggaggaagttgygtygtagttygagtygttyggtattttygtygtttttgygttygygtygygttttyggygttttttttttagygygttttyggtygttttttygygtygygttygtyggttatggttygggagaayggygagagtagttttttttggaaaaagtaagtt

SEQ ID NO: 10045 - DNA, 203 bp, Artificial Sequence
  Description of Artificial Sequence: Synthetic polynucleotide
ggygatattygygttagttttygggayggttgggttygggttggtygtygattttygattttttattagatgtttggtagagttyggygygttyggagttygygttttttagagggaaggggtygygygtygtygyggyggttttgaggttgayggtygggaggtgaaaggtyggagtgyggggttaggaygttttttggagg

SEQ ID NO: 10046 - DNA, 823 bp, Artificial Sequence
  Description of Artificial Sequence: Synthetic polynucleotide
ygagttattygtatttttttttaggagttatagttaggttagaagagtgyggagggayggggttygggaagagtagggaatttttagagttygtagttaaygyggaggtgggygagygggygtgygygtatttatttgtyggygygagggagtgtygggggggaagggagtggtttttaaaagggggaggggagaaggtagggggyggggagaagtyggttttttaggattyggttgyggyggygagggaggaggaagaagyggaggaggyggttttygygttygtagggtygtgttatttgttygttygttygttygttygttygttygttgygtygygttgtygatygttagtatgttgtygagagtgggttgtttygygttgtygttgtygtygtygtygttgttgtygttgttgttgttgttattgggygygagtggyggyggyggyggggygygygyggaggtgttgtttygttgttygttttgtatattygagygtttggtygtttgygggttttygtyggttgygtygttygtygyggtggtygtagtggtyggaggygttygtatgttatgygyggagttygttygggagtygggttgyggttgttgttyggtgtgygttyggttggagggygaggygtgyggygtttatatttygygttgyggttaggggttgygttgttatttttattygggtttygagttgtttttgtaggygttggttatgggygagggtatttgtgagaagygtygggaygtygagtatggygttagttyggagtaggttgtaggtaaygyggtttggaataagtagttg

SEQ ID NO: 10047 - DNA, 293 bp, Artificial Sequence
  Description of Artificial Sequence: Synthetic polynucleotide
tygygyggtttttataatgtagggatttttttgagtggtggtygttttygttttagttttyggttattygtagttttatatygggttattggtttattatygagatagttagygagtttaggyggtttttgtagygttgggagaggaatgtgygygaaattaattagagygaaattagtyggaggagtyggtygaggtgtaggtgtaggygtagtttygtttagaattttttygttatatttaagggagttggaagttygggagggtgttgttttttttttttaggaatagag

SEQ ID NO: 10048 - DNA, 262 bp, Artificial Sequence
  Description of Artificial Sequence: Synthetic polynucleotide
yggaygygttgattggttttaggggaagygggaggygagaataatggtttttttttttygttaaaagggagyggttgtygggttyggggatagggaygygygtgtagggygtagagttgggtygagtygtygtyggygttaygygagtttygtagtygtygygttygggtaatgggtygggggtattgagggtygtyggggtygagygyggaggggggatygagttagtgtygtgttttygggtygygttaatatgtttygc

SEQ ID NO: 10049 - DNA, 240 bp, Artificial Sequence
  Description of Artificial Sequence: Synthetic polynucleotide
tygttgyggggtggagggattygygttttttagtttttygggttygggtygyggggatygtgygygygtttttttttygggtaaggtygggyggygggygygtygyggtttttggggttttygtttttttgttygttatygtttgygggagtttttggtttggaggggttyggggygygttggygattgygggttyggygataggggyggttggtggygggaggatagtgggaggaaggt

SEQ ID NO: 10050 - DNA, 1240 bp, Artificial Sequence
  Description of Artificial Sequence: Synthetic polynucleotide
agygggtyggggtygtyggttaagtttttgtttggggaygyggyggygygtyggagagtttygaggttgtttgtatygttttagagttttgggttgtgttygygtagggatygggtygggtagagtygggyggggtggagaggtaagyggagygygyggtggggttgaggggaggygtggggygagtgttygttgttygttttttagtttttttgtttttaygttttttygttygtagtygttygtagttyggyggtgtagttgtgttggattyggyggygtygtagttttttatygttttttgatgttattggggtgygggggttygggyggttyggtgygygggttaatagttgtayggttttygyggtttagyggygtagggyggggygygtttgatagttttttygtttttygygttagttgattggyggttygagyggtttyggagyggyggaggtttggyggagygttggagyggagtgggayggttagtttgggtttattttygtattttgtaggtttyggtttaygtaygttygtttggagtgygygttttatttttaggttaaattatygttttttttttttygygtattttttttttttagttttttttgtattttatttttatttygtgttatttttaaggaggtttagaatgagygtygggataaygttttttgggttttttgtttttaagyggttttygtttagtgggygaygttttgtgtgttttygyggtttttggtygtgtgtgtygtgygtttttgtttttggagatttgygygtatttgtatgttggggagggygggttygaggtttygagagttgtgtttagatttaatttttaattttaggggattttttttaggttaagygagggttttttttggygggtgtagtygtagagttttgaggttygattttattggtttygtygtttttygygtttattttatygtataatgtttatagtgaaggygaygggaaaagtagtagtttaaaggttttgaatttttttttttygttataygtayggaattttgagttttyggagtttyggggtygaggtyggttygggayggtgtttygagtagttttttattgttggggagtyggttttgtttttgtttgaaygttttgtaaygattaagtagatttyggygttagttygtygyggagaggtttaaataggtataaagtgygattttaagtggttattgtgygtaaaggygtc

SEQ ID NO: 10051 - DNA, 222 bp, Artificial Sequence
  Description of Artificial Sequence: Synthetic polynucleotide
gggygatttgttgttttygagtgtttttgggttgygttttttttttttatttgggyggtygygttaagygtagaggtygygggygtttyggggttagaggygttttyggttygggttatggygttyggygtygggggygygaggagyggtttatttagttagattttttatttygttatygttattagatattattatygttgtgtagtgtgggtttttatt

SEQ ID NO: 10052 - DNA, 714 bp, Artificial Sequence
  Description of Artificial Sequence: Synthetic polynucleotide
tttagggaaagtttttgaaagtataattyggaaaatttagtaatttttaaaaaaaaatggtttttygttgttataagttttttttttaagatttagggttygtagtagaatattttgatttaaaataaaaatattatgataaaaatattttaggaggtagtyggttttatttygtttaaagtyggatttygtttagtttygtgaaagygaaggagtattagygttttttgatttygtatagttttttyggtagagayggttygttttttttaagaatyggaagtyggatagygttaggaygttttattttttttatttgggatttagagaggtagyggttaaggatagggttttygtygaggttatygggtagygtttaggtttyggtttttgggaggggagtagygggggaggggtayggggaggggygagggyggggygygtttgggtttyggygttgggttttttttttgttygtttygggggatatttataggatttttgtagatttttgtygaggtaggatggaggtttgtagggatgtatygygggttygygattygggyggtyggaatatagttttttttggtyggagatyggttyggtygtgagtygtgtttgtgttaggttttttaygttgtgttttagggttttagtgttyggygygtygggggttgtatygttagttatttggggtaggaaaaaggaattata

SEQ ID NO: 10053 - DNA, 1216 bp, Artificial Sequence
  Description of Artificial Sequence: Synthetic polynucleotide
aagttttagaaaygttttyggaaagttttttttaatgggaagygatttygtygttgagttaagygttygaattttttttttygyggtagggatatyggttygggttaggtttgyggaggaygttttygggygygtatatatagttygaggaygygttttgtattttaagaygtagggtyggattttatttygaaatttggtttttatagttttaggtygaattgtgtttggtttttagttttygagttygagttttaygtygtaaagagatggggttttattgtgtttagttggttttttagtayggaygtgtatttttttttggtttgttttttgttaaaaatyggtagtgygtttygtttttttgtttagtygtagtttgtygttttttagataaaaagyggygatygyggttyggttattygagtttygtygygttgygtttttgttgggyggtttatagatggtgtttagtayggggtygygtygagggygggggygggaggtygygaagagggtygggygggaggggaggagayggyggagtagttaattygygygyggtttattagttgatygtttttgtttatattaggtgtaygtyggttgyggggagtataaagyggggygtatygygggygtyggtaaygagtyggtgaaygaggygaggttygtgygttygyggttgtaagygttygtttggyggggagaggggtygayggygttagttygggyggyggtatttttaggygtttggggygttttttttyggatttggtygttygttgtttygttttttgtattttattttttygatttttttttttagttttgtttttttttgttttggtttttgagagtygattgagtttagtttygtgtagtagyggttgtttgtgtygtygtttagttttyggttttggtgttttttygggggtgttttaaggagttagtgygygttgygggttgggaaggaggygtygtttagttagttttttttttttttttygttttttttttttttttgttgttgttgtygtygtygtygtygtgggtgtygggttygygygtattttaatatttttattagttgggtttyggggtaagtttttggtyggtygygtygyggtaggaggtgtgggaggtagygaggggaagtygaggtaaatttggtggygtgggagattttayggggtttggggaattttagggtaag

SEQ ID NO: 10054 - DNA, 207 bp, Artificial Sequence
  Description of Artificial Sequence: Synthetic polynucleotide
agtttttygtaaatttygtttttttygtttggtayggtttttttgtatygttgtgtttygtttttaggtttttgttygttaagaatgtttgtttygggggygygttygttggttaggaatttgtyggtagttttygggaatttttgaggatgyggaggtgggttygagagttgyggtttygatgtyggggtgggagttaggtaggtc

SEQ ID NO: 10055 - DNA, 253 bp, Artificial Sequence
  Description of Artificial Sequence: Synthetic polynucleotide
aygtttagggataaattgggagtygtgattgttaggtygygyggaggttgttttggtygtttttgyggttaggtgaaggygtagaggtagggaggtygggygagygtaggygggyggagagtagattaygyggaagaggtygagagagaaagyggggtattyggtygggggggttatttataagggaygttgggtaygaaggaggttggggygaagatgagtttaggggttgggttgagagygttgygtagtc

SEQ ID NO: 10056 - DNA, 209 bp, Artificial Sequence
  Description of Artificial Sequence: Synthetic polynucleotide
ggayggtttgtgagggatgygtygtttattgtttygygtygtttgatygttttygtttygattygyggtgygttatagtygggttygyggtygttttygtygygttgtygttyggtygtygygttygyggggtygygttyggtayggttatgtggatttttayggaggaggagaaatayggygtaggtaggtgaggtttaggtttggtc

SEQ ID NO: 10057 - DNA, 225 bp, Artificial Sequence
  Description of Artificial Sequence: Synthetic polynucleotide
ygttyggtttygtttygtaggttgtaggyggttttggagggggygttttygtygagygygygtttygygtygtygtttyggattttttttyggygtygygygggtaggttygattaggyggtygygggtttyggttttyggttagttttttagggttygyggttygtttygtttygygygttygtttygttgygtaattygatttaagttggaagtygatygtag

SEQ ID NO: 10058 - DNA, 1133 bp, Artificial Sequence
  Description of Artificial Sequence: Synthetic polynucleotide
aaggagagttggaagggttygtgtagtaggatagygggyggaagyggggygggygagygyggggtygtyggtyggtagtyggagtagttgtygyggygttygaatttyggyggtygtygygttttttygtttygyggagatygaygtaggygttygttttygaggtygaagggtattgggyggygagggttgyggtagttggygatttygggggygtttgygyggygygygttagaygaggttgtttyggyggttatttygygatttygygtygtygggatttgygygyggagaaygtyggttttggagggagtaygtttttttaaagtgtagaggagggttyggyggygygttttygyggaaattttttttattgtagttatttyggatgtygatttagtagtttgtttttygagaaaagagaggggatttgggtagaagggtttygtttgttttaaaagaaggtgtaaggattagaagataaygaaaygtttattttttgaagggtgggaaaaaaagaaaaagaaaaaggagttatttaygttggagatgttygttttagatttttttatttttttttttttygtttyggttttttttttygaggtttatttaatttgttagagaaggaggaggagtagaagatgggggtygaggaggaggggaagagaaagagaagtttgttaagaataaagtttttgtyggtaagygyggggatttygtagtggagggtattgyggagtttyggggagttatagygggggtttygggtttaaatgtttttgttyggagttygagtygatatatatatttagttygatttttttttgttttyggttygagttttttagtttggttygtyggttygtygttttgtaygttttygtyggttagttttgttaaagtaaagagttgygttttttgagttygttyggtygaggggaggggaygtttygagtttggtygygtgygaggtttygggygygttttggtttttyggttygagagygygtagttygggtttttttttygygttttgtttygtaggtgagyggttgygtttttttattgtttttttttttttygygtttygtyggygttgaaaagttatttatttgygtygtttttttttt

SEQ ID NO: 10059 - DNA, 478 bp, Artificial Sequence
  Description of Artificial Sequence: Synthetic polynucleotide
yggttygggaggyggaaggtygyggatttgttygatagaagagtagatgaggggagatygaggaygttygggttyggggagtttaygaggaggttaggatygyggggtaaggaattygygggtagttattttygttaggggtagggttyggttagttaggygygagaaggttaggygaggtygattgygyggggtgaagaygttaggtygatagttgygggttttatygttagttttgaygygagtttgygttttggygayggyggagggygggtagggggygygggygttgttayggygtttgtttagaatyggtygggaaygtygygggygggttttttyggtttttygtttttttagttttgtttttaggttttygttygggttttttaagttgttagtygygttygttttygggtttttygttttttttttygygygtttttttttttagyggtygtyggatttttttagttta

SEQ ID NO: 10060 - DNA, 201 bp, Artificial Sequence
  Description of Artificial Sequence: Synthetic polynucleotide
tygtaygyggagtttataagttgtttgtgtygttattttttyggttttggtatygttagtattttttaggaattttttaaattygttttayggtgtagaayggtaattgtatygagtttttgtgttaattagtattttygtaatatygttagtyggttttttttttgttataatatattaaaaygtgttaaaatatattaa

SEQ ID NO: 10061 - DNA, 208 bp, Artificial Sequence
  Description of Artificial Sequence: Synthetic polynucleotide
gatgagygtygtgtagtatttttggttygygttgtttgttygtgtyggttataggttgtaggttagtagggygagygyggygagtygggtagggttygttygtttygygtagtttatygttttttyggtagtygtygttgttygyggatygggtttyggggtyggygtttagaggyggggygggygyggttygggyggyggygggagc

SEQ ID NO: 10062 - DNA, 210 bp, Artificial Sequence
  Description of Artificial Sequence: Synthetic polynucleotide
atttygtataygtgtataaggtgttgaaataggtttatttygatatyggtattttttttaaagttatggggattatgaatttttttgttaaygatattttygagygtatygtyggygaggtttttygtttggygtattataataagygttygattattatttttagggagatttagayggtygtgygtttgttgtttttyggggagttgg

SEQ ID NO: 10063 - DNA, 229 bp, Artificial Sequence
  Description of Artificial Sequence: Synthetic polynucleotide
tggtttatttgagtttaggggtttgagattaggatgattaatatggtgaaattttgtttttattaaaaaatataaaaattagtygggttatggtggttgaygtttgtaattttagttatttaggaggtygaggtaggagaattatttgaatttaggagyggaygttgtagygatyggagatygtattatygtattttagttygggygagagggagattttgttttaaaa

SEQ ID NO: 10064 - DNA, 209 bp, Artificial Sequence
  Description of Artificial Sequence: Synthetic polynucleotide
aggygggggagagagatgaygttggyggaygtggttagygygggggtygggyggtgygttgtaggttatttgtyggygttttgagatttaggagttttygygttttygygtgggttttatagggtyggtttatagttttaatatagtagttgaatttttttygttgygtttttttttttttggaggggaatgttagaagagagagagag

SEQ ID NO: 10065 - DNA, 255 bp, Artificial Sequence
  Description of Artificial Sequence: Synthetic polynucleotide
gaaggggtttggagttttttttttggggtattgtgttgggattttgaggattggggattyggagggagggtaggygtgtttttaattygttgygtyggaayggygtttgatgagyggygggttyggataygaggggayggggtygatttgtgggyggggttttggygtygtattaaaatygygtggggyggaggtyggtagaggtygygtagygggtttagggtagggagtggttttgattygttgyggaataat

SEQ ID NO: 10066 - DNA, 297 bp, Artificial Sequence
  Description of Artificial Sequence: Synthetic polynucleotide
aggtttygtttattygaygtaatttgttygtttttttttatttttygaagggtggagtttgaggtttygtttttaagyggttttttttyggagtgtttggyggttagtagggyggggtaggaggttgggagagggaygggtgygggggtgggggagaggaagggagyggttaygtgtgaggggyggttygaggttaygtgayggagygtyggagyggagggagtyggggttgggagtttttttgagggaagaggagtggagtaggggggaygyggyggyggygttgataatggtgag

SEQ ID NO: 10067 - DNA, 232 bp, Artificial Sequence
  Description of Artificial Sequence: Synthetic polynucleotide
gtgagttggttggaaagagggggyggagtgygyggagttagagtygttatygttgtygtagttgtygttattgyggygtttgggttgagtyggagggaggygggaggaygygtaggggyggtygtygtygtygttaggttatyggggygaaaatgyggtygttgtyggaggttygttaatttttyggggtggaagaggaggaggaggaggaggaaggggtttggagygatta

SEQ ID NO: 10068 - DNA, 247 bp, Artificial Sequence
  Description of Artificial Sequence: Synthetic polynucleotide
tygygttygtagtygygtttttgttttttygattttygtatttttatttggttyggttttttygtttttttttyggtttttttttttaggatatttgtgtygttttattttttttattatataygtattttttattttaattttttygtttttttgttttttttttttygtyggtttttttttttygttgttgtttygagagttygatgtgggagggaaggygygggggaggggaggtygygaaggg

SEQ ID NO: 10069 - DNA, 292 bp, Artificial Sequence
  Description of Artificial Sequence: Synthetic polynucleotide
gtttttygagttttttgyggygatttygatttattttygygggtgyggggygyggattygttyggtttagtttttgttttttaggygtttttttttttygygatttgtttyggtygtattygttttygttttagtaygygaygttgttyggygygatttttgttttttyggtttagttttatygttgttttygatttaattttagttgaaygttygtagttttagttttattttyggtttagttttagygtttttagttttattttyggttttagttttagttttagygttt

SEQ ID NO: 10070 - DNA, 201 bp, Artificial Sequence
  Description of Artificial Sequence: Synthetic polynucleotide
gtagttyggttaayggaygggttagttggttttttttaggggtagttttgttttttttttygtttygttttttttttttttattatatygggttgtaattygagtygtygagttattgtttttttttyggatttttttyggaggttttgyggttygggttttygygttttgttgttttatgtagttttgagttttatagta

SEQ ID NO: 10071 - DNA, 201 bp, Artificial Sequence
  Description of Artificial Sequence: Synthetic polynucleotide
ggttaygygtgtttttggygygagtgtgyggggttaggtygggagggygtgygyggatygggygtgtttaygygyggtagggaggggttaygagggtgygygygtttttggygygagtgggaagtgtggggattyggygggttyggtgtgaggggygtgtttttggggygagagtggggagtgagtgtgaggagtaagggt

SEQ ID NO: 10072 - DNA, 201 bp, Artificial Sequence
  Description of Artificial Sequence: Synthetic polynucleotide
gggygyggtygggtaggttggggggtaggtaggggtygttttygyggggygggaatttygygtttttttttttygagttttattttttatggtaaagyggygtggggyggyggggyggagggagtygagggggyggggagggyggaygggyggaggggaygggaggtttagyggtttygggtttygttggttygggygtyg

SEQ ID NO: 10073 - DNA, 201 bp, Artificial Sequence
  Description of Artificial Sequence: Synthetic polynucleotide
attttttttttttatttttttttttttttttttattgttttttttatttttttttttttttygtttttttttttggtttttttttttttygttygggattyggggggaggygygttgggtggttyggtagtygggggygggyggtagtttgtaggygtaattggtatgtaygtygttgtagttgagatygtttaataaagt

SEQ ID NO: 10074 - DNA, 201 bp, Artificial Sequence
  Description of Artificial Sequence: Synthetic polynucleotide
tygttttygttaaaggtttttttaaggggtygttttagggtttygtttygtgtttygtttyggygtttatttyggygttygtttttttttttttttgttgyggtttyggtaggggttgttgyggygatttaggttgttgyggttttagttttattagttgttgttgttttttaaggagaygtygtygatagyggagtagtg

SEQ ID NO: 10075 - DNA, 201 bp, Artificial Sequence
  Description of Artificial Sequence: Synthetic polynucleotide
gtgyggtyggggygttgttyggtagtgyggtgtttaygggattgataggtaggtaggtygygggttgggattyggatattaaagtaaaagtatygttgggygtyggaggagtygyggggtttttattttttttttgattgatttttaaattttaatttgtatttttttygtygtttygttttttttttttygatttygttt

SEQ ID NO: 10076 - DNA, 201 bp, Artificial Sequence
  Description of Artificial Sequence: Synthetic polynucleotide
tatygygtygtgygttygygttyggtygttaggtgttttagtagttygatygtygagatgtttagttygtyggggtttygggygttatggttttgygtygygttgtgygtttttyggagggtyggyggygttttttagttyggttyggggtttatygtttgttyggttttttgttattgttaggaggayggtattatgttg

SEQ ID NO: 10077 - DNA, 241 bp, Artificial Sequence
  Description of Artificial Sequence: Synthetic polynucleotide
ttgygygttttggyggtaggaggyggggtygggggyggggygtgagttggtyggggyggggtttatggaggggygggatygyggygttttataagtattgyggagygaggygygygttyggttagagagygagygygtaayggyggygayggyggygattttatygygtattttgttaggttttyggygtttagygttttaygygttttygygttttygygttttygygttttttttttyg

SEQ ID NO: 10078 - DNA, 201 bp, Artificial Sequence
  Description of Artificial Sequence: Synthetic polynucleotide
ggyggtaggyggygyggygggttgggygyggyggtggttaggtyggtgyggttgtagtttatgtatagygtgttagggttgttttgttygggtagtyggtygtagygtatgyggtygggttaggygaagtygtattggygtatgagyggygygtagtyggttttggygygttygtatatygagyggtagggyggtagyggt

SEQ ID NO: 10079 - DNA, 201 bp, Artificial Sequence
  Description of Artificial Sequence: Synthetic polynucleotide
aagtggggtgaaaatgattttagtgaatagtttagttttttgggatagtggtttggtatttttgaygtgggagtggygtttgttttgatttaatttggatyggtttagggataatatttttttyggagtagtygttttgtttygtttygagtagtttagttgygttttgtatgatygaattggatattttttatttttttt

SEQ ID NO: 10080 - DNA, 201 bp, Artificial Sequence
  Description of Artificial Sequence: Synthetic polynucleotide
ttygygtttgtttygtattayggagtygggtttttagagtagtaaggttattaggtggyggtgttggygtagtaggyggagygtygggtgygyggggtygygtttttggttttygaaggtgatgaagatgggtttgygggtgagttttagtagtyggtataggttttttttgyggggygggatygttaggggggtgggtgt

SEQ ID NO: 10081 - DNA, 201 bp, Artificial Sequence
  Description of Artificial Sequence: Synthetic polynucleotide
ayggttgggttttaggagatattyggaggggttygygggttyggttyggttttttygttggggggttattagtyggtyggtagygagatatttagaggttygtttttttatygygttgttatagtaayggtttggtyggttgygtttygggtygttygttttatttygygggttygttttgagttagtgattttagggatt

SEQ ID NO: 10082 - DNA, 201 bp, Artificial Sequence
  Description of Artificial Sequence: Synthetic polynucleotide
tttagatggttttaattattggaggaaaaaagyggtttttttggtatgygtgaaaagtyggagttgggagagtttgggaaaagttgtttgtatygttygtyggtttttaaataaatygatgagttttttttttttttttagttttygggtttygggggagttttataaaatttaaatgaaatttaaagaagttatttttgg

SEQ ID NO: 10083 - DNA, 201 bp, Artificial Sequence
  Description of Artificial Sequence: Synthetic polynucleotide
ttataaagtattagtggtgttttttygaggaatttaagatttttyggtyggttgttaagtygtyggaattttagtaggagaggaaggtttatttttttatygtatggygatgttygggagattggagaagtttaggtaggtttggaagttaattttyggtatatagtagttttygggaatgtagagttttagagtaagatt

SEQ ID NO: 10084 - DNA, 201 bp, Artificial Sequence
  Description of Artificial Sequence: Synthetic polynucleotide
tagtagagayggggttttaatatgttgtttagggtggtttygaatttttgagtttaggtaattygtttattttatttttttaaagtattgggattataggygtgagttatygygttyggtttgatagtttttttagaatgaagtttgtttyggaaaaaagagttttggttagtgttttttttggggattagyggaaagtat

SEQ ID NO: 10085 - DNA, 201 bp, Artificial Sequence
  Description of Artificial Sequence: Synthetic polynucleotide
aggggagttgaggggyggagttatyggggygygttttygyggttgygttttttttygtyggggagygygggtaygtaattyggagggtgttgggtyggttyggagtaygygagtagygggaggagggatyggggaatgattgayggaggygggtygtagaggtygttgtgtttygtyggttygtattyggtyggagtgtgc

SEQ ID NO: 10086 - DNA, 201 bp, Artificial Sequence
  Description of Artificial Sequence: Synthetic polynucleotide
ggttttygttttttttgtaggyggattygttygtttttaggtyggattygygttygggatagggattyggtygagtygagtygtygygttagygttgygtygtyggtyggtgygtttagyggatyggagttgygygyggaatygtgttgtttygtttygttttattygtgagggtgagtaygyggyggyggtgygyggggg

SEQ ID NO: 10087 - DNA, 201 bp, Artificial Sequence
  Description of Artificial Sequence: Synthetic polynucleotide
yggggagggaggttttyggaatttygagagagtattygtgtttygygggtttygtgtttygttttygggtttttttttttttaaygtaggggatttagttyggggtagtgtygggtattggygttggygtttygtttagttttgygattttttttygtttygttttttttygtttygtttygttttttttygtttygtttt

SEQ ID NO: 10088 - DNA, 239 bp, Artificial Sequence
  Description of Artificial Sequence: Synthetic polynucleotide
agagggygagygagagagagatatatatatataygtataygtataygtaggttatatgaatgggaggyggtagttaattttaygaggtyggygagtygygyggygtattggygttgggagtagggtygtatttyggygygggggggygttaygtaggtgatgggygttttttygggggttaygygyggtygtttttttattttagtttyggtttttttgtttttttttttttttttttt

SEQ ID NO: 10089 - DNA, 201 bp, Artificial Sequence
  Description of Artificial Sequence: Synthetic polynucleotide
tttttygtttttatttatttttttttattttttttttttttttttygttagtttygtatttattttttttatttygtaatttttttttgtttttatttatyggggttatggtygtagaagaggtattgtagayggtggattattataagattgagatagagaggttaattaaggagtttayggagattatttaygagaaga

SEQ ID NO: 10090 - DNA, 201 bp, Artificial Sequence
  Description of Artificial Sequence: Synthetic polynucleotide
ttgtyggggagaatatgtattaggtggttgatggttttgtggatgtggtggtttgtattttggtgttgtgttttgtgaagaattaggagyggatttttygygaggtgtgtagagtgttgagatyggtgagtgaaagggtgtgaggaggattagttagtagtagttattattatagagggtaggtttgttaattttaggtgg

SEQ ID NO: 10091 - DNA, 201 bp, Artificial Sequence
  Description of Artificial Sequence: Synthetic polynucleotide
gaggyggaatttaayggaagtgaagaaaagattaaygggaaagaaggaygagtaygyggtttygggatagatttttaaagtttttttttgygttttttggyggtyggagggggagtagygyggataygtttttyggttaatygttggttattaggttggagtggggtttttttttgttgttttttatgagattattgtttt

SEQ ID NO: 10092 - DNA, 201 bp, Artificial Sequence
  Description of Artificial Sequence: Synthetic polynucleotide
gygattaygggtttyggygaagatgygtygtttgagygttygygyggttttygttyggggygggygtgatttttgttgaayggagattttttttttttttygatttyggayggygtaggtyggygttaggatagtttttatygatagygtttttttttattyggagagaggtatygatttttaaggagggtttygttaggt

SEQ ID NO: 10093 - DNA, 201 bp, Artificial Sequence
  Description of Artificial Sequence: Synthetic polynucleotide
tygttttygtygttyggggtaggygygtygatggygtttttgaggtgaygtygtttatatygggttttttygggggyggaggaaatatttatgaatttttyggtagttttttttgtygggygttaggtaagtagyggtttygggygyggyggggygtygygggaayggtgtatattggtygaaatttattgttttttaaga

SEQ ID NO: 10094 - DNA, 201 bp, Artificial Sequence
  Description of Artificial Sequence: Synthetic polynucleotide
ttygttatttggggygtttggggggttttggggygggggaggygggggttttgtttaatttygttattgttattatyggttaggtygyggtttggtaattygtgaataggaggtagggttgtagggygtgagggatgatgataaggaagtyggaggagtagyggyggtagyggagagtttattttggatgtaaatggtagg

SEQ ID NO: 10095 - DNA, 201 bp, Artificial Sequence
  Description of Artificial Sequence: Synthetic polynucleotide
atttygygttttgygttttaattaggattgtttygygygtttttgagtttygggtttyggttyggatttgtagttttttaggtggttgggaaggtaggtgygtygttgttttyggygygyggygtttygygaggtttttagttttygttttggtggattttygttgggtgggagtygggagtggaggyggtygttttaggg

SEQ ID NO: 10096 - DNA, 201 bp, Artificial Sequence
  Description of Artificial Sequence: Synthetic polynucleotide
ygattyggtygtgagygtgtttygttgtagttygttgttygttaggttygggtggtagygtaggatgtttttttggtttgyggagaagtatagatatyggygggagygygttaatygygttygtttygtatygygtattygagggggygygtaggtygygttyggtttttttgtttygtttygtttygttyggttttaaag

SEQ ID NO: 10097 - DNA, 201 bp, Artificial Sequence
  Description of Artificial Sequence: Synthetic polynucleotide
yggtttgggaaggtttyggtttttyggttgyggttttagttyggayggygtygygtaattttgttatttttttggtttagtttyggttataggaggatttygygggtaaygygyggagtttttggtatttttyggyggtgttttttgttgtttgttyggggatygatttygtatgtttttaggttgatttgtttaagttyg

SEQ ID NO: 10098 - DNA, 201 bp, Artificial Sequence
  Description of Artificial Sequence: Synthetic polynucleotide
gtaatttyggyggagtyggygtttttgggtatttttggttttygygtttyggtygtayggtgattattygggaggggatttygggygtttygtaatttttyggttttygtgggttttygggtygtttygtttttygtygtygygtatttttygygtttttyggttttyggtgtyggttttygtttygygtagtttygagtt

SEQ ID NO: 10099 - DNA, 201 bp, Artificial Sequence
  Description of Artificial Sequence: Synthetic polynucleotide
aggaagttygaggtyggggygttattttaagggttttttygtttttttttygagggtagagaggygttygygttyggaygtattgygggaatatttggagygtyggyggagttyggttgttttygygggagggagttygaygygtatttttgggattyggattyggygttygygtttygggayggatttttgtttyggttg

SEQ ID NO: 10100 - DNA, 201 bp, Artificial Sequence
  Description of Artificial Sequence: Synthetic polynucleotide
tygtttgtaggttgtttygggtygagtyggagygaygttgtygygtatttgggtagttttygggggtygygttgtgttayggtyggggtygttgygattgyggygtttgtatttgttaygtgattgagtygggtatgtttttygggtttttgtgtgagtgttatgagtgggtgtgygagatttaygaygggagtatttgtg

SEQ ID NO: 10101 - DNA, 201 bp, Artificial Sequence
  Description of Artificial Sequence: Synthetic polynucleotide
taygtttggggyggtygggggyggggtttggttggaattgaygygtggagtttyggtggagggggyggggtttggttgggtygttgtttatagyggttttyggggtttggaggttayggggttyggaggttayggggttyggaggttayggggttggttgtgtggggggtttaggggygtagagtggttaagtagyggttt

SEQ ID NO: 10102 - DNA, 201 bp, Artificial Sequence
  Description of Artificial Sequence: Synthetic polynucleotide
ggttttgtagttttgtagygttyggggyggtgtaggagtttyggggtgtygyggygttygttyggttgtatygttggtttttyggttygggttttaggttyggygttttttatttttaggtygygygygtttygttttttygaygatttttagtttygggttttygttatttaygagttttygttttyggtgagttgttgt

SEQ ID NO: 10103 - DNA, 201 bp, Artificial Sequence
  Description of Artificial Sequence: Synthetic polynucleotide
gygttttygggggttgygtygtgtygtttgttgtgygygygtagaggtyggatagttyggttgygggaagggattygagygtagggtttgtttygygtttyggaaagtgtttagtttgyggagtyggaggttgagttggggtagatyggygttagaygggggtttgggtgagataygagttgggggtgyggtttgtagaat

SEQ ID NO: 10104 - DNA, 201 bp, Artificial Sequence
  Description of Artificial Sequence: Synthetic polynucleotide
ttttttttattattttttygtttttttattttttttttttttttgttttgtaggattgagtagttaggygygagygaaaataaatagttggggttgygagygttttygtttyggtttygagagtaygtyggtttagttttttatttggggygttygtttgtttattatgaggaagattygygttaatgttatygttatttt

SEQ ID NO: 10105 - DNA, 201 bp, Artificial Sequence
  Description of Artificial Sequence: Synthetic polynucleotide
gttygtgtygttgttgttggttttagygttygggttttyggtgagtgyggttttgtttyggttttyggaggaatttgtaggggagtygggggyggggaygygygggttygtaggtaaygtttttaggaaaggggygatgttagggaagttgggttgggaggaggygagttygtatygttgagtttttttagaaagggttgg

SEQ ID NO: 10106 - DNA, 201 bp, Artificial Sequence
  Description of Artificial Sequence: Synthetic polynucleotide
ygttgggygtygttygtyggtttaggygygygaatttggygtttttagtgaattattygyggttygggygttygggttygggatyggtttttttttttttygttgagtygyggtygagttggttttttgtattttatttagygtygtygggaygygattatatygagatggtatygagttttttttaaaggtttyggtttg

SEQ ID NO: 10107 - DNA, 201 bp, Artificial Sequence
  Description of Artificial Sequence: Synthetic polynucleotide
gttttagtttttgggtyggaagtttttttttttttttygtygtagtttttttttagttttttttttttygtygatgygggaaatttttttygtttygtttygttttttttttttagttgtattttygttyggttttttygtttagtttttaatttaggtttygtttttttttatttatttttygttttgggtygggttttc

SEQ ID NO: 10108 - DNA, 201 bp, Artificial Sequence
  Description of Artificial Sequence: Synthetic polynucleotide
gatggygaygyggatttgtatygtygttttgggttygggtygagttttttygtyggattgggttatggttygygggattgyggygtygtyggggtttttaygtygtaaggtttagttagtyggtyggtagygattgygaygagggggygggggyggtgygagygygtttgtygttyggtttaggggagggataggggtygc

SEQ ID NO: 10109 - DNA, 201 bp, Artificial Sequence
  Description of Artificial Sequence: Synthetic polynucleotide
gtttgtttygtygttygggttttgtggttggttattygygagttygtttygttttttttgtttyggttygttyggttygtttyggggttttygtygtaatygagyggagtttagygattygtygggtttatattagyggtygtttttttygaagygtttttyggtagygttygggttttygygtttyggaatatttatgaa

SEQ ID NO: 10110 - DNA, 241 bp, Artificial Sequence
  Description of Artificial Sequence: Synthetic polynucleotide
ygygttggttyggtttttagttttttyggtygtygtttttygttygtygygtygyggygttaggagggyggggtyggggygygygtygttttttagtaagygggygggyggygttyggtttgagggagyggggyggttttygtyggygtygygygygttgtgtgtgagyggggtygygygygygygyggtaggygagtgagggaaygaggagyggtygggtgtgagtgtgtgggagtgaga

SEQ ID NO: 10111 - DNA, 201 bp, Artificial Sequence
  Description of Artificial Sequence: Synthetic polynucleotide
ggtgttaagygtggggygygggttygyggygggagttgttygygaaatttagtgttgaagtaggygyggaygtgttyggtgtttggygygtggtagtaggygttyggtgtttyggtyggygaagattatggygtttatggtgaagattatggtgggyggttagttgaagaattttattgggagtttgggaggyggygagga

SEQ ID NO: 10112 - DNA, 201 bp, Artificial Sequence
  Description of Artificial Sequence: Synthetic polynucleotide
gygygggayggagttttatgaaagttggaagaagtgattataaatygggattygattttygtagttttggygttygtttttttaygtaggttygggatgtyggttttagtttttagatgtygggaagayggygtyggttagtttaaggaagagtttttaggaggttggggagtaagggtgtygggttttttatgtygggtt

SEQ ID NO: 10113 - DNA, 201 bp, Artificial Sequence
  Description of Artificial Sequence: Synthetic polynucleotide
ttttgttggttagagtygggtaygggtygggygggyggyggggatygtgatygyggttgygtgygttygygttygggygtttttgtgyggggttttggtaygtyggygggggygattygggtgtyggttygtgygggygataygygygtttttgyggggttgygyggggttyggagyggttgggggttttttgtygggygc

SEQ ID NO: 10114 - DNA, 201 bp, Artificial Sequence
  Description of Artificial Sequence: Synthetic polynucleotide
tagatttygtyggtyggygygttattygygttagtattatggatagyggtygttttagtygygygtttagggttaggttygggttggtttttatygyggayggttgyggggtyggggtagtttygtaattttaaatttyggtagttttygtttagtagggaggggtttygggggygaagagtgggggagaagtygggaagg

SEQ ID NO: 10115 - DNA, 201 bp, Artificial Sequence
  Description of Artificial Sequence: Synthetic polynucleotide
gtgtgagtttygggggttygggtyggyggttttgttagtygggtygtgyggttgygggggtggggyggyggygtygttgttatattagtttygggagyggygagagggaggttggggtgggggygygaggggggyggygygaggggggtygattttgygggtaggtgatattatatttygaaggttttagtgygygggygg

SEQ ID NO: 10116 - DNA, 201 bp, Artificial Sequence
  Description of Artificial Sequence: Synthetic polynucleotide
gtygygttatggtgagtygggyggggtaggtygygygttygggtygggygggggygtyggggttygggggygggaagggggaggttaggaygaggaggggygygygyggyggyggggtygggtyggggtttgygggygggggaggggyggttyggygggygyggttygggggagggttygttttaggggtygygttygygg

SEQ ID NO: 10117 - DNA, 201 bp, Artificial Sequence
  Description of Artificial Sequence: Synthetic polynucleotide
taatygggtattttygygygtataygttygtgtttaygtgtgtaygtttatatttttgtatatatttaggygygygttggtatatttattyggagaatttygtatatataygtattygtaaataygygggttttttgygttattaggaagtagtygttagaatygtygggtgttttttaattatttttgggagatttggtt

SEQ ID NO: 10118 - DNA, 201 bp, Artificial Sequence
  Description of Artificial Sequence: Synthetic polynucleotide
ataygatatggttaagygtygtygttygaatyggtygtygtygatatttygtttyggttyggggttgaggaggaagtygagaaggaggaggaggaggyggyggyggagggygggggaagaggayggtygtttygggtttygtttgagttygtagggtaggaygagggagyggygyggtgagagaggyggatgaaggygagg

SEQ ID NO: 10119 - DNA, 201 bp, Artificial Sequence
  Description of Artificial Sequence: Synthetic polynucleotide
ygygtatagyggyggygagtgggtygtgtaygyggatgyggggtgggagtgggggygtaygygygggygtgggygagygggtttyggtagtgtatatatayggtaggggygggygatagatgtagtgygtgygtyggagtttaagygtataaayggaaagagygggygyggtgygtaggggygggygtttagygggtttgg

SEQ ID NO: 10120 - DNA, 201 bp, Artificial Sequence
  Description of Artificial Sequence: Synthetic polynucleotide
ttttaggggagttaagtagttygtttgaagttttttatttggaaatgaygtgtttaattyggygtttttgtagtttyggtygtttttttttgtttaatttygygtttttttagtttyggtygtttttttygtygtttttttttygyggtygtttatttttgagatttttggttttattgagaygtttagttttattyggta

SEQ ID NO: 10121 - DNA, 219 bp, Artificial Sequence
  Description of Artificial Sequence: Synthetic polynucleotide
tttagggagggggcgggaggttttttttgtttagtttcgagtcggtggtgtagcgttcgttttcggtcgcgggcgtagattggcggtcgttttcgggttacgtggtgcgcgcggcgggcgcgttcgaggagtttgcggttgtttttggtttatagcgtttcgggcgaggagagcgggcggacgtcgggggttgggtcggtgcgggcggcgaggtaggcg

SEQ ID NO: 10122 - DNA, 315 bp, Artificial Sequence
  Description of Artificial Sequence: Synthetic polynucleotide
cgagtttcgagtttcgtttcgggggttttatttcgttttttcgcgttcgcggttcgtttttttttattgagcgtttagttttcgtagttttttcggtcgtcgagcgtcgtgggcggggttttagggcggcggcgtttcgcggggagggtttttcgtgttgggggcgaggttattcgaggtagtttttcgttcgtttttaatttcgtttcgttttcggagtttataaagggaggcgattcgcggttcgttcggttggtattttttagtcgtcgttagtttcgtcgaggggagttagcgtcgtttttgaggggcgtt

SEQ ID NO: 10123 - DNA, 201 bp, Artificial Sequence
  Description of Artificial Sequence: Synthetic polynucleotide
gtattcggtttagggttggagttggttgtagggttggttcgcggcgatttgggtagggtggcggttgttttttttttttttatttcgtttcgaggcgtagcgcgcggtagagcggttcggtgttcggcgggcgggcggttcgggcgggtttgcggtcgggatgaggacggcgttttcgttgtagagcgttggggcggcgcg

SEQ ID NO: 10124 - DNA, 201 bp, Artificial Sequence
  Description of Artificial Sequence: Synthetic polynucleotide
aataatagggacgttgagaataataattacgattagtacggcgaaggcgtttttttcgcgggttagaggtcggcgttttagtttcgtagaattcggcgttcggttagcgttttttggtagtttttttcggtagttttaggtttttaagatttgtaggttcgtttcgaagtttttcgttcgttttttacggtcgtttcgagt

SEQ ID NO: 10125 - DNA, 201 bp, Artificial Sequence
  Description of Artificial Sequence: Synthetic polynucleotide
cgcgtatttttttcgttcgtttgttcgcggttttttttttgttttcggagcgttagtcgttttatttcgtgatcggtttttcgttttgtttcgtaggattcgttcggacgggattacgtcgtcgtcgtcgtcgtcgtcgttcggagtcgcgtttcgggttttgtttgagtcgagtcgcgcgcggggtcgtagttatcgtcg

SEQ ID NO: 10126 - DNA, 201 bp, Artificial Sequence
  Description of Artificial Sequence: Synthetic polynucleotide
atagagttgttttttttttttttgggttttgtaagttttcgaattggaggcggaaatgggggaagggttggaagttgtgtgtgaaaaataattattgtaacgggttttttttaggagtttagttcggtttgtattttggtggaattgttgttatcggtttatagcgtttaggtcgagtcggtagggttgggcgggaggttt

SEQ ID NO: 10127 - DNA, 201 bp, Artificial Sequence
  Description of Artificial Sequence: Synthetic polynucleotide
tagttatcgcggcggttgcggcggcggtattttcgtttttattttcgttcgggattgttttttattgttttttcgtttttttcggatagtgagttcgcggcggggcgggggaaggagtcgtttttattttttttaagtttatttttaaagagatttttttttttttttttcgtcgtttggcgcggagtcgggacgatgttg

SEQ ID NO: 10128 - DNA, 201 bp, Artificial Sequence
  Description of Artificial Sequence: Synthetic polynucleotide
aataagtagttcgggagatattttttttttttttagttttcgtttttttattttgttattttttagttcgtgattagttgttttttttttttttcgcgggcgtttagggttgagtaaatatttcgggtcgttcgtttcgttattagttggtttcgatcggcgtatcgttggcgattttttaggtaattcggcgttatgaga

SEQ ID NO: 10129 - DNA, 201 bp, Artificial Sequence
  Description of Artificial Sequence: Synthetic polynucleotide
cgtggtttggtcgaggagttaatgggtcgggaggggcgcgcgggggaggagtttaggtgtagagtgtcgattggttagttcgtttttcggtatgtagatacggtgggagttacgtgttaggggtcgggacgattttttgttggaggttaacgcggggcggggaagggggcgcgagcgtttcgtttggttgaagcgggggga

SEQ ID NO: 10130 - DNA, 201 bp, Artificial Sequence
  Description of Artificial Sequence: Synthetic polynucleotide
ggaggaggggaggcgttgttcgacgcgtttttttaagttttcgcgttttttttcggcggcggttgttcgggggcggtggttcggcgtcgtttttttcgatcgttttttttagggtttttttttcgtgtcgcggttaggttgttcggtcggcggcgcgttggaaatatgaagagacgttgtagttgcggtggcggtggcggt

SEQ ID NO: 10131 - DNA, 201 bp, Artificial Sequence
  Description of Artificial Sequence: Synthetic polynucleotide
tttatttgggacgcgatttataggggcgttgtttcgttttgcgggaagaggaggcggcggtcgtcgtgattggggcgttcggttttattcgtttatagaacgtttttaatattaggggtttgaaagcgaaaatttcgggaaggtattttttgatcgtagattatattttgtagttgatttatatcgtttaggaggtagtga

SEQ ID NO: 10132 - DNA, 201 bp, Artificial Sequence
  Description of Artificial Sequence: Synthetic polynucleotide
ataaaagagtagttttcgcggagcgggtttagagtttgttcggattgttcgatggttttcggttttttgagcgtcgcggttgtcgggttttgtgttcgcgcggggggcgggaaggacggtcggggtttttagtgcgcgtttcgcggagcggcgcgcggcgttcgaattggaaagttgtcgtcggcgtttgtcgtttttacg

SEQ ID NO: 10133 - DNA, 243 bp, Artificial Sequence
  Description of Artificial Sequence: Synthetic polynucleotide
gttaaggttcggatcgttattttagtaatagttttagttatgtgatcggtaatggcggcgttgacgagaggtaggtgagttcggcgttttttatatttatcgcgcgtttttcgggtttcgttcgtattttttacgcgtttttcgttttttcggcgtttttttttttattttttttttttgcgcgcggtttcgggtttttcgtttcgtgttcggtcgattatttttttagtattttttagtttt

SEQ ID NO: 10134 - DNA, 201 bp, Artificial Sequence
  Description of Artificial Sequence: Synthetic polynucleotide
tagttcgtttatttttttttggagaagttcgacgtagcgttcgttattttttttttttcgtgtgtagtttttcggttttaaagtatttatttgtttaattcgatttttattttataagatcgtaatcggttattatttttgtttttcgttaggatatcgaggttagttgtgttattgtttcgaggggttgtaggtgtagag

SEQ ID NO: 10135 - DNA, 201 bp, Artificial Sequence
  Description of Artificial Sequence: Synthetic polynucleotide
tcgtagtatcggttattttattgttaagggtgttttttgtatttgttgcgatattttgggtcgtttttagtttagtttgtatagtatttttggttacgttcgtagtatcggtgattttattgtagatagtgtttttggtatcggttagtacggttttggtcgtgtttatatttatttggacggtttttttggttatattcg

SEQ ID NO: 10136 - DNA, 201 bp, Artificial Sequence
  Description of Artificial Sequence: Synthetic polynucleotide
tttcgggtcgaggggaattcgcgatcggatttgtgggggagaatgaggatgaaaacgtggagtttttattgtttagggtttgatcggtcgatagggatttcgacgggggatcggggatttggggagggggtcgtattttttcgtttttttcgcggtttttcggtttttgtttgtttttttgatcgtttttaggggcgcggc

SEQ ID NO: 10137 - DNA, 201 bp, Artificial Sequence
  Description of Artificial Sequence: Synthetic polynucleotide
agtcggggtagaaggaggagtttgaaggtttattatggggtggaggttgtttgttcgcgggttcgtttttagagttcggggtttattacgttgttttatgcgtttttgttggtttttgttaaatagttttttttttttgtgttttagttttttggttgtaaaaagggggtgtttatagagtttttttgaggagtcgttata

SEQ ID NO: 10138 - DNA, 201 bp, Artificial Sequence
  Description of Artificial Sequence: Synthetic polynucleotide
ttggtttttatttggtttgcgagaaattaaattttgggtataagttatgaagtcgataagttcgggagatatagtgttagaattataaggtgagattagtcgttcggttaagttattttttcgttagtaggtgaggttcgtgaatagttaagttttttttggtacggcggaatcgtagtggacgcgtggaggggtttcgta

SEQ ID NO: 10139 - DNA, 201 bp, Artificial Sequence
  Description of Artificial Sequence: Synthetic polynucleotide
aattttttatttattaacgtcggcgtcgttatgggtttagggggttgggtgaggtcgtgagagtcggcgaggaagtcggttttgcgggttcggtcgatttcgggtttcggttttgggttgcgagggattttagttttcgtcgtcgtgtaaaatgtatataaggttcgcggcgtcgtttttgcgcgtcgtgaggatataggg

SEQ ID NO: 10140 - DNA, 201 bp, Artificial Sequence
  Description of Artificial Sequence: Synthetic polynucleotide
gatagaaggggagagtggttaggaaggaggggaggatggatatagggcgtttgtagaattggtgggtagatggacggagggacgggtcgtgtagtgtagtcggcggggttagggttaggtcgagggcgcgaggtggtagtcggttcggggaggcggaggttgagcgagcggtggtgtttgtggagttgtcggttgcggtgg

SEQ ID NO: 10141 - DNA, 201 bp, Artificial Sequence
  Description of Artificial Sequence: Synthetic polynucleotide
ggggttgggacgtttcggcggagtaggcggcggcggtggcgagttggggagttttaggttcggcgttgtcggaggggttcgagtcgagtcgtttgcgtttcggtcgggtagcgtcgggttcgtttttcgcggggttacgttttgttaaattttgttgcggcggttagcgtagcgggttcgtaagcgggcgggaggggcgtc

SEQ ID NO: 10142 - DNA, 201 bp, Artificial Sequence
  Description of Artificial Sequence: Synthetic polynucleotide
ttattggtgagtttggtagggtatagagaggatggtattattagttggagggggataggttttaattatgagtttaggatgtagagagcggtagggattatcggagttttttcggttttggtgttttggttttttttgtatacggtttttatatgacgtttagtaagtcggattttaatttgtttatttattttttatttt

SEQ ID NO: 10143 - DNA, 201 bp, Artificial Sequence
  Description of Artificial Sequence: Synthetic polynucleotide
gaggttaaggcgggtagattattcgaggttaggagttagagattagttcggttaatagggcgaaatttcgttttttttaaaaatataaaaattagttaggcgtggcggcgttcgttcgtaattttaggtatttggtaggtcgaggtaggagaattacgggagttcggggtagggaggttgtagtgattcgagattacggta

SEQ ID NO: 10144 - DNA, 233 bp, Artificial Sequence
  Description of Artificial Sequence: Synthetic polynucleotide
ggagagagagagagagagagagagacggagtcggagagggagggagcgagagaaagcgagagtttttcgttatttttcgtcgtttttagaatttatcgggcgtttgttcggcggttttagaaggtcgggttgcgttgtgggttgcggggagtcggaggttttttgattggttttttgacgttttcggattaattgtgttgttgtataggcgtggtttttataggtcgagtgtt

SEQ ID NO: 10145 - DNA, 201 bp, Artificial Sequence
  Description of Artificial Sequence: Synthetic polynucleotide
cgcggtatagttatttttttcgtcgaggcggtattttaattttgtgtttttttaggatcgcgggttgtaggtattcggttttcgaagcggaggtcggagtcgcgcggagaagttaacggtaatgacgttttttgtcgatttttaggaggggataggttgagggtttggacgaggtcggaagcgtttttattgtagtttcgg

SEQ ID NO: 10146 - DNA, 201 bp, Artificial Sequence
  Description of Artificial Sequence: Synthetic polynucleotide
ttttgagaagtagtagtagttggtttgtttgttgtttcgttttcgtgtatggttgtttagcgttggttttagtgtttagcgttttcgtttagtattttttcggttttttttttttatttttcgttttcgagttgcggggagttttagtttgggatttttgttttatgtttttgggtttttgttttggttggttcgtttttt

SEQ ID NO: 10147 - DNA, 201 bp, Artificial Sequence
  Description of Artificial Sequence: Synthetic polynucleotide
ggtttcgtcgggtcggtcgttgcgagtttcgtttcggtttcggttatcgtcggggaggacgacgacgacgtggtgggggacgtgttggtattgttggtcgcgtttttggtttcggggtcgcgggcgtcgcgcgtggaggtcgtttttttttgtcgtttgcgtcgggacgcgttggtggagcggcgcgcgttgtacgagttt

SEQ ID NO: 10148 - DNA, 201 bp, Artificial Sequence
  Description of Artificial Sequence: Synthetic polynucleotide
ttttttttagtatattttatgtaaaagttagtaaaaatattttttttataagtttaaataaatgtttaaaaatatgtaagttaggaagttatttttaatacgtatattttttttatatgtagaagtaatggtgagaattttttatattttttgtagtagattttcggtttcggggttgggtttttagtaagtttatttttg

SEQ ID NO: 10149 - DNA, 201 bp, Artificial Sequence
  Description of Artificial Sequence: Synthetic polynucleotide
ttcggtcgtattttcgttttatttttacggtagggtttttagtgtttgattaagtttaagttcgagtttttcggcgcgttgtttatcggttgttttttcgcgttttttttttttttttattcgtatcgtttcgttttttattttttttttgttttttttttattatttagtttatatttttttcgttttttttttcgtttt

SEQ ID NO: 10150 - DNA, 201 bp, Artificial Sequence
  Description of Artificial Sequence: Synthetic polynucleotide
gggattgggaacgggatagggacgcgttttaatttatttagcggtggagttggggggcggcgcggttacgtgggatggcgggtagtttaggggattcgggcgacggggtttggcgggtagggttgttttagtcgtttttataaagtcggttttttcgatttttttttttttttgtagtttttttttttttttttgggggtt

SEQ ID NO: 10151 - DNA, 201 bp, Artificial Sequence
  Description of Artificial Sequence: Synthetic polynucleotide
tagttatttatttgttttttacgttttatttattagcgcgtacggtttcggtaattttattcggagcggggcgtcgtcgtcgtttttgtcgtagttcggtcgggtcgttgggcgtaggggatttcgcgtcgtcgttgtcgttgtcgtcgtcgtcgtcgtcgttgtcgttgttgtatttttcggcgagcgttgttgtttttt

SEQ ID NO: 10152 - DNA, 201 bp, Artificial Sequence
  Description of Artificial Sequence: Synthetic polynucleotide
tttgggggacgtcggacgttatgttgtggaaaataatcgataatgttaagtacgaagaggattgcgaggtgagttggggtttcggggtgtagtttcgtttcgtcgaggatagttcgggaggtaggggttattggatcgaggtcggggacgagggtataggagttttggtttttcggtgggacgggatttattttttcggat

SEQ ID NO: 10153 - DNA, 201 bp, Artificial Sequence
  Description of Artificial Sequence: Synthetic polynucleotide
gggagggaagaaggaggcggcgagcgggaagaggaagaagacgtaggtagcgttaggcgagtttaggggcgtcgggagcgcggagttcgggttacggattcgcgggagtttattgcgttttcgggttttggagggttgtttttgttcgtaggttcgggcgttttcgttaggaggcgatagcgttatgtttttttaggtttt

SEQ ID NO: 10154 - DNA, 201 bp, Artificial Sequence
  Description of Artificial Sequence: Synthetic polynucleotide
tttagtcggtttttcgtatgattggattatatgagggatttaagttcggttagttgttatttttcggattatatgcgtgtttagggatcgttttttaattcggtatggggatttggaaaaaaagattagggtagagggattggggtcgggttcggtgatcgtttttcggtaattaaaggatagtaaaggacggtttttgat

SEQ ID NO: 10155 - DNA, 410 bp, Artificial Sequence
  Description of Artificial Sequence: Synthetic polynucleotide
cgtatgcgtttaggtcggttcgtaggtttttttcgttttagtcggtagttagttcgttcgcgttggggttatcgcgagtcggttcgtagcggggttatcgcgattttcggcgtagatatagaggtcgtttttagtttcgtcgtttcgtggtttcgttttcgttgtacgtttttttatttttcggatttcgtagggtcgcggcggatacggttcgatcggggacgtgaacgcgtagaattatattttttagcgtttcgttcgcgttggaattatatttttcggggggttcggcggtgtattcgtcggggtcgcggattggaggttttcggttggaaaagttttttggcggttaattggggaggattggaagaaatttaggatggagttagtattgttggtttaatatgttt

SEQ ID NO: 10156 - DNA, 201 bp, Artificial Sequence
  Description of Artificial Sequence: Synthetic polynucleotide
aagtttttgggaaagattcgttttattttcggaagttagagggcgttagttgtcgggttgaaaaggggtgtggggaggggaagtagttttatttcgggttcggagtttgtaggagagagaagtggggagtaagaagtgaattttaggggtttatagggttttcgtagatgtttaggtcggttaggaatgtatttttggttt

SEQ ID NO: 10157 - DNA, 201 bp, Artificial Sequence
  Description of Artificial Sequence: Synthetic polynucleotide
tttattacgtcggggcgattcgttgtttgagcgagtacgtttcgtatttttttcgcgacgcgcgtatgttgttcggcgtttcggtcggggcgttgtattgcgtcggcgtttttttcggtatttcgttgggtgcgtttggggacgttgttcgggttttacgtgcggagtgggtgttttttaggtcggggagcgggggatttt

SEQ ID NO: 10158 - DNA, 201 bp, Artificial Sequence
  Description of Artificial Sequence: Synthetic polynucleotide
atttttggattaggaaatagtgtgtgtgtatacgagagagagggatagagagaggggggatatgtggagtgtattggaattattataatttttatgaaggcggtatcggagttattggtattatttgtgtaatttttttttatgtttgacgtcgttttaaaataaagagtgagttgagtaaattaattcggtagggtatat

SEQ ID NO: 10159 - DNA, 201 bp, Artificial Sequence
  Description of Artificial Sequence: Synthetic polynucleotide
gcggcggggttgggtttggggttggacgttgatttaggatttcgtttttgttcgttttgcgtcgcgtttttttcgggtcggttttgatcgagtagttttacgcgggttcggggttcgtttattcgataggagcggggggttgtagtttacgagtttacgagttcgtagcgacgtattcggagtgtaatttcgtagagttac

SEQ ID NO: 10160 - DNA, 201 bp, Artificial Sequence
  Description of Artificial Sequence: Synthetic polynucleotide
gtatcgcgcggcggcgtttggcgggtattgttgttcgcggagggacggtgggggggttttagtagttggcgggggtggagggggcgggagagggagtttgcgtcgggttgagtttggaggtgcggggcgggttcggggagcgtttttggggttttttttgttatagtcggggcggttggaatttttttttttttttttttt

SEQ ID NO: 10161 - DNA, 201 bp, Artificial Sequence
  Description of Artificial Sequence: Synthetic polynucleotide
gtcgcgtcgtcgggtttcggggatatttttcgtcgtttttttcgattcgcgtcgtcggggtcgtcgggtcgtagggtacggggtcggcgcggggggggagcggagaggggttggggagttttaggggttcggggttcgttcgcgggggatgggtagggatttcgggtcgcgtggggtgcgggggtcgttcgtattgaggac

SEQ ID NO: 10162 - DNA, 201 bp, Artificial Sequence
  Description of Artificial Sequence: Synthetic polynucleotide
tttttttttaaaaagagttttttagagttgtcgaaattttcgcggggtgaaagttaaatttttggagtcgttgtgtagtcgggtagaggatacggcggcgcgagtcggaaagataagtgtttaggcgaatgggaaaggaaagattttaatttttgtttttattgttagttgaatgtttataaaaattaaagggaatgcggg

SEQ ID NO: 10163 - DNA, 201 bp, Artificial Sequence
  Description of Artificial Sequence: Synthetic polynucleotide
atggtttattgcgtaagtttatatttagttttaggaagcgagttttacgtcgttttagttttgtatttatagtcgttaagcggtttcggaagtcgaatgtcggataggttaaagatagcgtcgttgtttcggtattgtcgttagagggcgcggagtcgtcgtgttggtttgtattttttttgttacgttagtcgaacggtt

SEQ ID NO: 10164 - DNA, 201 bp, Artificial Sequence
  Description of Artificial Sequence: Synthetic polynucleotide
gcggttcggaaatgagcgtttttcggggatagggggttttgcggggcggcgatagttggatttttagcgcgtataaagtttgcgggaggatttattgtagcggtcgttttttttcgtttagcgagggcgggcgtaggggcgggggatgtcgaagggttaggtttgtttaggtcgcgttattttcgttttagacgtttagtt

SEQ ID NO: 10165 - DNA, 201 bp, Artificial Sequence
  Description of Artificial Sequence: Synthetic polynucleotide
tttcgagggtcgcgcgggtttaggcgtttacggtttcgtagcgtcgcgtttttcgcgagaacgtagagattcgggttcgttttgagtcgtcgattgcgggcgggagtcggcgggtaaggcgcgcggtcggtagtcggagcggcgcgtaacgtagttgagtgaggtcgtcggtggaggtacggagtagtaggcgttcggggc

SEQ ID NO: 10166 - DNA, 294 bp, Artificial Sequence
  Description of Artificial Sequence: Synthetic polynucleotide
tttcgcgaaggtttcggttcggtcgggcggggtggggcggtttcggttttattaattagcggtttgttgtggatgtcggcggaggagatgttatttagggcgggaaaaggggcgcggaagaggggcggggcgggttacggcgcgtagggtttttttttttcgtttcggatttaattaattgggtttgagtttttgtcggggagggggcgtcgggcggggtcgcggttgggcggggcgggggatcgggatcggcggcgggggttgcggttttgtagtggaagtatgggcggcgag

SEQ ID NO: 10167 - DNA, 201 bp, Artificial Sequence
  Description of Artificial Sequence: Synthetic polynucleotide
gtgtggaggtttacgtagcgtttttggttggaacggggaagtttgtatttagttttgggagtgggtttgggagagggaggaggagtcgtcgggagtttggcgggagggcggtgttttcgtttgggtttttttttgttgttttagtttcggtagtttttatagtagtttcgaagggtgagaatttgtttttttatggatttg

SEQ ID NO: 10168 - DNA, 201 bp, Artificial Sequence
  Description of Artificial Sequence: Synthetic polynucleotide
ttttttagtttttagagtaagttaattagggatacgttttcgtggtttagttcggaaataatgtttggtgggaatttgtaattttggttgtcggaattttcggggaggattaacgtcggcgtatcgtgcggtcggggcggggcgtcgtttaaatttaggttttgtgatagcgattgtggcggtttggaaagcgtgggtttc

SEQ ID NO: 10169 - DNA, 201 bp, Artificial Sequence
  Description of Artificial Sequence: Synthetic polynucleotide
aattatttttaaaataattttttcggggggtgagaggtaattataattttagcgagtggagggcgcgggggatgggcgtcgggcgggcgggggcggggagcgcggcgcgggtttttaggtggcgagcggaggtgttttcgtcgcggggggaggggcgggggcgtacgcggtcggcggcggggggaggcggcgcgcggggga

SEQ ID NO: 10170 - DNA, 201 bp, Artificial Sequence
  Description of Artificial Sequence: Synthetic polynucleotide
aggttttcgtatttatcgcgtgggtttttgttttggttttatttgttttcgatatttttcgttttcgcgatgtttaatttcggttcgagaaggttggtcgcgatttcgttcggtattcgtcgtttcgatattattattcgttttttcgatttttttcggcgtcgttgtttattcgtttttcgtttcgtttatcggggtcgt

SEQ ID NO: 10171 - DNA, 201 bp, Artificial Sequence
  Description of Artificial Sequence: Synthetic polynucleotide
ggggacgttcgtttttttttcgggtagttttttttatttaggcgggatttgggttttcgttggatttagggtcgttttttcgtaggcggggtcggttcggcgcgtattttgtttcggatgttttggcgtacggtttcgcgtttcgtttttattttggcgtatttggttttgcgtttttttttcgtttggcgtagcgttttt

SEQ ID NO: 10172 - DNA, 201 bp, Artificial Sequence
  Description of Artificial Sequence: Synthetic polynucleotide
tattttttttttgcgcgtttgtttttttttcgtttgtaggatttcgtttttggttcgttttttttttttttgttgggtaggttttttcggagtttattttcggcggcggcggcggtagtcgcggtcgcggtcgttggatttcgagaggcgcggggaatttttttattttttgttttggttttatttgtttttttttttttt

SEQ ID NO: 10173 - DNA, 201 bp, Artificial Sequence
  Description of Artificial Sequence: Synthetic polynucleotide
tagggaattataaaagacggtcggcggcgagtaggttggggtgacggggatttcgtggataacgggtttgaggacgtttagggttttagttttttttaggcgtttttcgtcggggtaacgtagagtagttgtcgtttttttcgcgttttagtagatggtggtgttagttcggtttcgtgttcggtcgtcgttgcgttcgcg

SEQ ID NO: 10174 - DNA, 201 bp, Artificial Sequence
  Description of Artificial Sequence: Synthetic polynucleotide
ttagataggtatggttaaggtagtttgtgatttattttataaaattagagatttttgttttttgtggagtaagatttttcggaggttagagtaggatgatcgttaatttttttttttagagtcggtttagtttgataaagtaggggttatttcggagtttggaggggaagagagtttaggtataaggttatttttgggaaa

SEQ ID NO: 10175 - DNA, 201 bp, Artificial Sequence
  Description of Artificial Sequence: Synthetic polynucleotide
gggcgcgcggcgttttttatttacgttcggtcggggcgcggcgcggcggcgggtattcggacggtcggcggaggtaggtcggttcgggtattagtttgggcggttcgcgggtcggggcggcggcggggtggcggtggcggcggtagtagcgcggagtcggtgggcgtagtcgcgcgttaggtcggcggtcggggtttgggg

SEQ ID NO: 10176 - DNA, 201 bp, Artificial Sequence
  Description of Artificial Sequence: Synthetic polynucleotide
tttgttatagataagttttcgaagtcgttttggtgtaggttatttggttttttagtttttggtgtgtggttagtgtttggtgtttttggaaagttattttcgggtagtttttgatagtgcgattcggcgtttaagtagtttgggattttgcgcggatttgatttttttagatcgtaggtagtttgggaggaggttcggtcg

SEQ ID NO: 10177 - DNA, 463 bp, Artificial Sequence
  Description of Artificial Sequence: Synthetic polynucleotide
acgtttgtgttgtatttggcgttggtcgacggcgcggtgttgttgtttacgtcgttttttgtggtttttttgattcggtaggtttggtcgttgggttaggcgggttgtaaggcggtgtattacgtgtgcgcgtttagtatgtacgttagcgtgttgtttatcggtttgtttagtttgtagcgttgtttcgtagttattcgtttttttttggcgtttcggttgcgtagttcggttttggttcgtcgtttgttgttggcggtttggttggtcgttttgttgttcgtcgtttcggtcgtcgtttatcgttatttgtggagggatcgcgtatgttagttgtgttattcgtcgtcggtttacgtcgtcgtttatttgagtttggagattttgatcgttttcgtgttttttttcgggttgatgttcggttgttatagcgtgacgttggtacggttgcggggcgttcgtt

SEQ ID NO: 10178 - DNA, 201 bp, Artificial Sequence
  Description of Artificial Sequence: Synthetic polynucleotide
atcgggagtgtttagcgattttaggttagttcgggggaaagaagcggtcgtcgtcgtcgaggttttttggtttcgggatttcggcgttgtttttttttttcgtatttgttggggtgggttggagtcgtaatcgaatttcggtcgcggcgtttgtaaagtttttttttcgaagtttcgcggttttagtttattggcgttttt

SEQ ID NO: 10179 - DNA, 201 bp, Artificial Sequence
  Description of Artificial Sequence: Synthetic polynucleotide
gttttatagtttcggttagaatttggtgggggacgcggggggggggtgtttgacggggagggggtatagttttttcgggttaatttttatatttttgtttcgtttaggcggggggtgagtcggggtgagtagtcggttttaagttggtcggttttttggaaagggagggttagtaggagaattgtagatttttttagtttt

SEQ ID NO: 10180 - DNA, 201 bp, Artificial Sequence
  Description of Artificial Sequence: Synthetic polynucleotide
gggatcgttttaagtagttcgttaataacgtggcggtggtgaaggagttcgacggcgttaagttcgtggtgttgaggaagaagtttcggttttcggagttcgagttcgtatttttcggtttttcgggggtagcggtttagtcgtcgaaatttatttcgacggttttgtcgcggagcgtttttgtttcgggagtttcgtttt

SEQ ID NO: 10181 - DNA, 201 bp, Artificial Sequence
  Description of Artificial Sequence: Synthetic polynucleotide
gtttttagaggtttagttttgttttttattatatatagttattattttattcgtttttggggttcggttgtttttttcggtgttttttaaatttttttttcgatttgggtgttaagtttatttatttttcggcgtcgttttcggtcgaatagttttttgtttttttttcgtttgggtcggagtttttcgtagtttttttcg

SEQ ID NO: 10182 - DNA, 201 bp, Artificial Sequence
  Description of Artificial Sequence: Synthetic polynucleotide
ggttcggtttggggttgggttggggagcgcggcggttgcggttggggtacggggcggtcgggtgagttggtcggcgttcgttttttttatttagtgagtacggtagatatcggagacgcggggtttattttttcggttttttttcgattaagaaacgttaatttcgttttttattggttgcgtcgcgcgttatgtcgatta

SEQ ID NO: 10183 - DNA, 201 bp, Artificial Sequence
  Description of Artificial Sequence: Synthetic polynucleotide
atcgagtttaaaagtcgtcggcggtatattttagcggttttttttttttcgggttgggattcgtttttgtaagaaacgttatgtttttttttttagatatcgtttcgggagttttagatgtaaaattagaggttttttatttggtattattgatttttgtgttaataaaatgttagtttttaagggaaaatttaaaaaaag

SEQ ID NO: 10184 - DNA, 201 bp, Artificial Sequence
  Description of Artificial Sequence: Synthetic polynucleotide
gtcgcgcgggacggggtagggatttcgagaatatcggggatttgcgggtcggtggtttcgggtaggttatttttgacgcgggtgcgaggtttttcgcgggcgtgtacggttgggtcggagtcgcgtcgggggtcgggatacgtttggggttagcgttggcgtcgtcgttcgggtggggtgggtcgggttcgggtttagttt

SEQ ID NO: 10185 - DNA, 201 bp, Artificial Sequence
  Description of Artificial Sequence: Synthetic polynucleotide
ggcggcgcgcggtagagttgggtttttcgttaggtggtcgggggtgtgtttttagggtattttattcgttattttcgcgtttttagtttcggcggtcgcgcggatttcgtttttgttgatttcggcgtacgttttcgcgtcgcgcgtagtttttcgtttttcgtcgatttcgtcgcgtcgtcggtagttttttttagtttt

SEQ ID NO: 10186 - DNA, 201 bp, Artificial Sequence
  Description of Artificial Sequence: Synthetic polynucleotide
ttttttttttgttgttttaaaatatttttcgacgttagtaaaatataatgcgtttcggtcgtcgtaaatagtcgggagggagagtatatattcggcgcggcgcggtcgtcggttcggtttttatttttttttcgtttttagaaaatgttataaaagcgggtagggcgcggggagggcggttgcgcgttcggcggtcggggt

SEQ ID NO: 10187 - DNA, 201 bp, Artificial Sequence
  Description of Artificial Sequence: Synthetic polynucleotide
agttaggaaatgcggggtttggtggggtgaggagtacggggttttttttttattttcgcggggattttgttatcggtttagtgtggaggttttatcgtttcgttcggattcgtggggtttcgatagtgtggtttttgcgaggattttttttatttttttcgttttggggttgttgcgggagggcgttcgggtagtattagg

SEQ ID NO: 10188 - DNA, 258 bp, Artificial Sequence
  Description of Artificial Sequence: Synthetic polynucleotide
gcggcggtagcggcggtttggtttttttagagggttagagttagggatatgcgggcgttcgggatttcgcgtttcgcgcggttcggcgtttgagcgttttcgtttttcgtttcggagttgtcggcggtatgattcgatacgtcggggcgttcgcgcgcggggattttacggggtaagttcgggcggtcgtttttttttttttcgcgatttttacggttcgcgttttggtcgttttattttattttttgttttagagag

SEQ ID NO: 10189 - DNA, 201 bp, Artificial Sequence
  Description of Artificial Sequence: Synthetic polynucleotide
tcgacggttaaggaaagtttattagtttttcgtatcgtgggcgacgggttaagattcggttttaaacggttagatttagtttttagtcggttgtcgttttcgttttacgtaggcgcgtttcggggttttttttttttttatcgcgcgttcgcggggttcgacgggggcggagcgattttcggaaggggcgtggcgatcggg

SEQ ID NO: 10190 - DNA, 201 bp, Artificial Sequence
  Description of Artificial Sequence: Synthetic polynucleotide
agggggacggttagacgggatgtcggaagttaagggacgtagaggtcggcgggtggcggcgatggagaggatagattcggtttttagaggaggtcgtgagcgcggggtttgcgtcggtcggaggagggattcggggggttgtaatatggttgttcgggcgtcgttttttttttgttaagttagggttttggggagttgttg

SEQ ID NO: 10191 - DNA, 201 bp, Artificial Sequence
  Description of Artificial Sequence: Synthetic polynucleotide
ttcgtcgcgtttcggtcgggatggatttatacgttcgatgagtttcgcgtcggcggttgcgagcgtcgagtttttttttgttgcggttttagtcgtttttcgcgcgttcggtttcgcggattaggatttttgggtttttcggttgagggcgcggtcgtttcggagaggtcgagcggggacgggttcgagatggcgcgggga

SEQ ID NO: 10192 - DNA, 201 bp, Artificial Sequence
  Description of Artificial Sequence: Synthetic polynucleotide
tagttaggatagtataaaatttttttatcgtttattttttgtaaaaaatcgtggttttcggcggattttggagataggaggtgtaaagggcgtttatacgcggttcgggttcgcggtcgagagttggggggatttggagcggggtcgggtcgtaagaagattttgattttgtttcggcgttggggcgcgtgttaagggttc

SEQ ID NO: 10193 - DNA, 201 bp, Artificial Sequence
  Description of Artificial Sequence: Synthetic polynucleotide
tgtcgggttcgacgtgtatagtttagcgtttttttttattagttattgtttaggtttttcgattttgtattcgtcggaatgagagaaagtagtttttcgtcgtttagttttcgggtagttgtttcggtcgggttttgcgttggtgagaaagttttatttagaggcggtcgcgcgtaattgtaggcggcgttttaggttcgg

SEQ ID NO: 10194 - DNA, 201 bp, Artificial Sequence
  Description of Artificial Sequence: Synthetic polynucleotide
cgcgggtaaggaaagcgcgtaggttttgtagatttttttatttcggttttttggttcggttcgttttttcgtttcggggcggcggttttttgttttgtagcgagcgttcgtaggagggacgttaggatttcggacgttatttttgaggtttttttgtatttgggtttttgatagtcgggaataggtaggaggtggggcgag

SEQ ID NO: 10195 - DNA, 201 bp, Artificial Sequence
  Description of Artificial Sequence: Synthetic polynucleotide
gtgggaggtcggtagcgcgggcgtcgcgttttcggaggagttcgcgttttttgaggagcgcgcgtgttcggaagagttcgcggcgtcgtttttcgaatcgcgcgtttggtttgaggatttcgcgtttttcgaggagttcggggagttcgcgttcgtattttcggggttcggggcggtgtacggggagtcggatttggtgtt

SEQ ID NO: 10196 - DNA, 201 bp, Artificial Sequence
  Description of Artificial Sequence: Synthetic polynucleotide
agtgcggatttcggtcgcgtgcggttttgatcgcgtcgttttatttttggcggggttacgtacggacgttatggttggcgtcgcggagtcgggcgatgcgcgcggattttttcggggttttgattgtttttgagttttttttgcggggggcgtgcgcggttcgtttttcgcggcgttacgcggttttttttcggtcgggga

SEQ ID NO: 10197 - DNA, 201 bp, Artificial Sequence
  Description of Artificial Sequence: Synthetic polynucleotide
gtttgcggagggtgggattttatagtttgtttatttgtttaggttgagatttcgtgttttagttttggatgttttacgggtttttcgtttcgggtagcggcgtacgggaggagaagattttcggtttgtagttagatttttttttgagattttttttagtttaggtttagagttttgggatttttttcgattttttttagt

SEQ ID NO: 10198 - DNA, 201 bp, Artificial Sequence
  Description of Artificial Sequence: Synthetic polynucleotide
tcggttttttttttcgcggggggtttcgtttcgcgtttcgttttttcgggttgtagtcggtagtttacgtttagggagggtggagggaggaggagaggcgcggagaggagggaggggagaggggagggaggaaggcgagagaaagggagttgtttttatttcggattttttagagtttgtttggagcgcgtatttagcggt

SEQ ID NO: 10199 - DNA, 203 bp, Artificial Sequence
  Description of Artificial Sequence: Synthetic polynucleotide
gcgagcggttacggggtggggagtaaggggcgcgcgggcggtaggtatggaacggacgcggcgtatttcgtttatcgcgggacgttcggacggcggtcggcgcgcgcggttcgtttcgagttcgagagggcggggagataatgtttgttcggcggggtagtttaggtcgtacgttttcgttcgcggatacgggtcgtttttat

SEQ ID NO: 10200 - DNA, 201 bp, Artificial Sequence
  Description of Artificial Sequence: Synthetic polynucleotide
tcgtggagtcgcgttaggttacggggtttcggttagacgggagcgttagtttttttttttgtttcgatgtttttaaatttaggtttagttttttttttttcgattcgatgatatttttgggttttagaatgttgttgggggcgggagatcggagaagaagtaggtgtacggggaggtgggtgttttgttttttgcgaggag

SEQ ID NO: 10201 - DNA, 201 bp, Artificial Sequence
  Description of Artificial Sequence: Synthetic polynucleotide
tttgggggggcgggtcggatttgaaggttataggtttttttttgcgtttattttttttgtaatttttatagtttttttcgtcgatttttttatgttttttcgtttttttgttcggcgttttttttcggtcgcgggttaattggttgtgatagttggagttttgggtagttgagcggtgttattgtaaattaggtaggcgtt

SEQ ID NO: 10202 - DNA, 201 bp, Artificial Sequence
  Description of Artificial Sequence: Synthetic polynucleotide
ttggaagggcgggggcggtgatagcggtaggggcgggattcggaggcggggcgtttgtttacgtcgtttagtagcggagggaggcgcggttttagtttcgcgtttaggagtcgtataggcgttcggggtcgtagtaggagtttttttagggcgtttagcgttgtatttacgagtcgcgcgtcgttttcgtttagtgcgttt

SEQ ID NO: 10203 - DNA, 201 bp, Artificial Sequence
  Description of Artificial Sequence: Synthetic polynucleotide
tcgtatttcgttcgtttgttttttatcggttaggttttgtcgggtcgtcgcggtttcggcgttttattttttttcgggttagcggggggttgggagggggcgaggaggaagggggtttttttttttttttttcggagggggtcgtagcggcggtttcggtttttttttttttttatattttttttcgtttttttttatttg

SEQ ID NO: 10204 - DNA, 201 bp, Artificial Sequence
  Description of Artificial Sequence: Synthetic polynucleotide
tcggagggagggggtaaaggaagaaaaagaaagcgcgttcggaaagtcggtttgggttttgttaattattttgaaggtaaagtatttgtatttttttcgtcgaggttggttggcggcgtcgcgttggaggggaggaggttcgggaggaggaggagaaagagtagcgggaggattcgggttgggaggggagcgtagggttgg

SEQ ID NO: 10205 - DNA, 201 bp, Artificial Sequence
  Description of Artificial Sequence: Synthetic polynucleotide
tcgtcggggagtcgtaaagtttgacggaagaggttgcggttttcgcgttttagtcgtcggttttcgagtcgtagtcgggcgtttttttgacgtagtcgcgcgttttgtcggttttattcgtttcgcgtacggatggtttttaagtggttcgtcgttaggtcggtaaatcgtttttttagttgttgtcgggcgtcgttcgcg

SEQ ID NO: 10206 - DNA, 201 bp, Artificial Sequence
  Description of Artificial Sequence: Synthetic polynucleotide
gcggcgggacgttatttgcgatcgggattatgaggagttgttagattcgtggggtcggtaacgagagtagtcgcggtatttgttgagaggaaagagggagcggttcggcgcggttggggcgcggtagaggtttgttcgattttcggttatgttattgttttgcgtgcgcggtgagtgcgcggattgaggcggggaggcggg

SEQ ID NO: 10207 - DNA, 201 bp, Artificial Sequence
  Description of Artificial Sequence: Synthetic polynucleotide
gcgttagatttttttattatatttttttattttaggcgattcgttttggtttcgggtgtttttagtttgcgcgggtcgtttttagttttcggtggatattcgtttttagttcgtcgttttttgttcggttttgcgttttttggaatttttgggtttttagttttcgtcgtttttagaattgcgtttgcgtaataatggtta

SEQ ID NO: 10208 - DNA, 201 bp, Artificial Sequence
  Description of Artificial Sequence: Synthetic polynucleotide
aattattagagaatttttttaaaaatatagattcgatgaggagtggttttttcgttttttttttgtgtcgagaagggatttcggtcgttaataataaagacgtttttcgttttttttttttcgtcggttcgggttcgtttttttcgcgttgcggttttcggtttagcgtttttttttcgagtcgggttgcggcgtttttaa

SEQ ID NO: 10209 - DNA, 201 bp, Artificial Sequence
  Description of Artificial Sequence: Synthetic polynucleotide
ggagggtcgcggagacgtaggcgtttcgggtcgttcgcgttgtttttgtttgtttcgtgcgggagtcggggtttttggttttttggttttttggtttttgcggttcgggcgaatttagagcgtattcgtacgtcggtttcggtcggtttttagcgttcgggttttacgggtcgcgtttttacgcggcgttttttagagatt

SEQ ID NO: 10210 - DNA, 523 bp, Artificial Sequence
  Description of Artificial Sequence: Synthetic polynucleotide
ttgcgttaagttttagaattatttagtttcgtgtttgtcgttcggggttcggtttcgtttcggtcggcgtttatttggcggtgtcgttttcggaagattacggcgaaggtttcgtgttttacgagattttttttgttgtattcgaagttatttattatttttatggtcgcgttttcggggtatatagcggacgggcgggcggcgtagtgcggcgtaggtattagtatcgcggtttcgcgggttcggagcgcgttagcgtgcggcgggtttggggtagtcgtagtttcgggttcgggcggatttttatgtcgagagatcggagcggaaattggggaagttgtcgcgcggagttagggttagcgaggttcggttcggtttttgtcgtttatggttcggtttgtcgtcggtcgttggttgtttggcgaagcggtttcggcgttgtcgggttaggggtgtcgttatcgttattgtgcgcgtttagagtcgtatacgcgttttgaggtagtgaggggttcggtatttt

SEQ ID NO: 10211 - DNA, 201 bp, Artificial Sequence
  Description of Artificial Sequence: Synthetic polynucleotide
cggttcgtattttttcgtcgttagttttagttttaaattcggcggtttagcgggcgtattatggtattggagtagcgcggggagcgcgttcggagtttcgcggttcgttgcgtttcgttcgggatttcgttgcgtcgcgcgtttttttcgcggttcgcggggtcgtttttgtatttttattttttttttcgtttgtcgtcg

SEQ ID NO: 10212 - DNA, 201 bp, Artificial Sequence
  Description of Artificial Sequence: Synthetic polynucleotide
gttttcgtttaagtgtggtttttttgggtttatattttattaggttagtaaggagggggatagcggggggcggggtaggtgttgggatttcgggtaggtgcggggaaggtagggggcggggggggaaggggttgggcgatgtaggtgttgggggtcgggatagttgcgggggtaggtaggtatcgggaaggcgggagggcg

SEQ ID NO: 10213 - DNA, 201 bp, Artificial Sequence
  Description of Artificial Sequence: Synthetic polynucleotide
cgtagattttgggtttcggttttgttatttagggggattttttttaacgatgggatcggtgttcggagtggagtatggggagtgcgttttcgggagtcggcgttggtcggatatgtgataattgtgggtcgttggaggttcgtttgcgttgggatagggtttggattttacgtgcgtcgtttgtgtttcgttagatcgggg

SEQ ID NO: 10214 - DNA, 201 bp, Artificial Sequence
  Description of Artificial Sequence: Synthetic polynucleotide
gggtcggtttcgcggtcgatttggggtatcgcgtcggggtgaggtttggcgaggaggcgaaggttgtaggcgtgaggtgaaggtcgtaggtcggtcgggtcgattttcgttatgtaaatatcggtgagggggggggagggacgggggataagatggcggcggttcggcgtttgttgtaggggacgatagagggggttgtcg

SEQ ID NO: 10215 - DNA, 201 bp, Artificial Sequence
  Description of Artificial Sequence: Synthetic polynucleotide
ttttcgcgtttttttcgcgttttatatttatcgttcggcggagggggtttagttcgtagtcgtcgtcgttatcgtcgcgtttcggtttcggtgtaggtagcggtcgtcgtcgtcgagatagttgcgcgggcgagtatttttacgtagtaagttcgtttttttttcgtttgtgcgcgcgtgtgtgtttttcgttcgtcggcg

SEQ ID NO: 10216 - DNA, 201 bp, Artificial Sequence
  Description of Artificial Sequence: Synthetic polynucleotide
gcgggggttttttacgtggcggaggtttttcggtttgggggttacgggttcggaggaatttgtttggaagttttttattacggtagagttttttggagttcgtttcgtgttcgataaggggagttttagatttgatttttttagtagtttcgcggggcggggtcgagaaggggcgggcgggcggaggacgttggcgggaga

SEQ ID NO: 10217 - DNA, 201 bp, Artificial Sequence
  Description of Artificial Sequence: Synthetic polynucleotide
aatgtgattatagttaatatatgatttttttagcgttttagttagtgttttttttgatttttgttttttggagaggaggatggaagggaggggttcggtacgttgttggtattttgttgtgttttgtagttttttttcgggatatttgggtttatatagttttttagtttatataattggtgtagattttttgtgtggaga

SEQ ID NO: 10218 - DNA, 301 bp, Artificial Sequence
  Description of Artificial Sequence: Synthetic polynucleotide
tttttttttaatttttggcggcgggcggttggggaagtagttttgtggtttttcggcgggtgaggtcgagatagagattaatttttaggcggcgttttggcgttgagttcgcgttgaataagattttttcgtagttttgcgtttcgcgtcgggtgaaggggcgtgtttttgtaggcgttcggggttcggtttggagttggcggtcggtacgtcgtttttggcgttttttgttaattaagagaaatacggttaaatgagtgcgttgggatagaaatttatagttaattaaggttttattcgt

SEQ ID NO: 10219 - DNA, 223 bp, Artificial Sequence
  Description of Artificial Sequence: Synthetic polynucleotide
gcgggggcggcggcggtcgtgagtttcgatgaggttcgagcgttttcggtcgcgcggtagcgttttcggttcgatggagatttcgtcgtgggatttagttcgtaacgattcgttgtcgtttacgttgatttcggtcgtgtttttttacgtgaagtttggttttatcgtcgtttatatcgtgttttacgcgttgtttttcgtgtttatttacgtgtagttttgg

SEQ ID NO: 10220 - DNA, 720 bp, Artificial Sequence
  Description of Artificial Sequence: Synthetic polynucleotide
gatagtcgtgttttattttcgttttgtgttttttttttcggatagtgttttttttagggtttatttaggagggtgtagcggtggttttcggggcggtggtcgtggtgggggtgttagttgtaggggtgttttcggtgggtgggagttggtggtttttcgttggtgttatgggattcgtatgttcgttttgcgtttttcggtttttgagtttataggtcgggattttgtttgttagtcgcgtgcgttgtcgtttaatttttgtaggcgtagagcgcgcggcggcggtgatagagaattttgtttggttgtttaaatatagttttttgtagaaggattttgcgttcggggaaggggaggaatttttttttttttgggcgttcgtttttttcgttatggttcggtttttatattcgtttatatttggtcgtagcggggcgttcggggggaggggttgaggtcgcgtttttcgtcgttttttgggcgcgggttaggcggggaggaggggggcgtttcggtcgtgtgtttaggattgttttttagcggttattcgggttttagttttttaggtttggttttgataggcgggcggagtagttagtgcgagatagggaggtcggtgcgggtgcgggaatttgattcgttcgggaggcgggggcggggcgggggcgtagcgcgcggggaggggtcggcgttcgttttttttttttatttatttagttg

SEQ ID NO: 10221 - DNA, 1683 bp, Artificial Sequence
  Description of Artificial Sequence: Synthetic polynucleotide
tagtggtagtgttgagtttaggaatacgcgcggagttcgcggcgattttcgcggtcgtttagttttcgcggcggatttcggcgcgtaggagttattgggtcgtaagggcgtcggggagcgggaggggcgttgggggcggtaaggggttttagattttaggttacgaattgtttttttttttttcgggtaagagtttcgttttttttaattgatagaaatttattggggtaggggggcgagtggggagagaggtcgtttagggttcgttattggttgcgtttttttcggttttggtttgggaagcggttttgggtttttcgggcgagtagtttgggcgtcggcgttttttgcgaggaagatcgcggggtgacggtcggtattcgttcggttgggtcgcgttgtcgtttcgatttatttttttttcgcgttcgcgtttttttttttttttttattaggagttcgggattcggagagggcgcgggaggtaggtatacgggttcgattttattttagcgtttatcggggacgcgggcgggcggcgacgggacgcggcgggggcgcggggcgggcgcggttatggagtagtagcggcggcggcggcggcggcggcggtaatattagcgatcgcgggcggacgagcgggcgggtagggtcgtcgggtttagcggatcgaattgtatagtttagtaaaagcgttttcgtttttcgcgcgtcgttttttgcgagtttaaatttattaatattttttaacgttttaatttattttttgaagaaaagtaaaaaaaaaaaaaaaaaaaaaaaaaaaagtaaaaaaagaaaaagtattgatcggagagacggggatatatatatatatatatatatatatatatatataaaattttttttggtttttgttaaaattagtagggttcgtcgcgcgtttgtgtgttagtgtgtgcgagtgtgtgtgcgtgcgggcgtgtgtgtgtgaatgtgattattttaggatttttcgggtttcggagacgttatttttttttttgatatttttttttataaatcggtggcgcggcggaggcggtagagtcgggcgggaagcgcggggtcggtcggggcgttcgtcgttcgtcgtcgttttcgcgcgttcgggggtttcggcgtttttcgagttagggcggttagttcgcggttcgtcgtttgatagatgtttatcgttatggagttgtcgtagtagtatttttgggggttcgggcgagcgacgggagtcgggatttgagcgagcgtcggggttagcggagtcggagtcgtcgggatatgggtgagtacgcgcggcgattttggttcgggagttcgggcgtttagttttttttcgcgtcgcgggttttcgtattttcggaatcgggggcgacgtgtgtgttttgtatgtaaaagtttacgtcgttttgttgggtttttgattttgtattcggcgggaagggggagatcgggtcgagggggcgggatgtcggttcgggcgaggttgtaggagatgggcgcgatttcggcgggtcggcgggtgggcggcgatgttggtttaattggagtggttcgttggtggcggcgatggtggaagttttgggttggagggttgggagtttattgagtttcgtttaatttgatttatttttttttcgtttttcgttttttgtattttttttcggt

SEQ ID NO: 10222 - DNA, 233 bp, Artificial Sequence
  Description of Artificial Sequence: Synthetic polynucleotide
tttcgttcgggtcgttcggttcggttgtgttttgttcggttagggcgggcgggttcgtttttttttcggtcggcgttttttttttggtttttttttttttcgcgtcgttcgttttcgtttttttcgttttttcggcgtcggcgtagttttcgtgaattcgggcgtattatttcgggtgtttcggtttggggatcgttgtcgtttcggtcgttgtttttttaatttttttgttt

SEQ ID NO: 10223 - DNA, 213 bp, Artificial Sequence
  Description of Artificial Sequence: Synthetic polynucleotide
gattgcgcgtgcgtagagtacgtcggcgcggtttcgggattttcgcgataattgtattgagataaagtgtggtaattcgagttggttggtgatttattttcggcgaggggttcgcgtgtgggttacgtcgtcgtttttatcgggaaagcggggattagtggggggggtttagttgtagggtagtgggaggatgttgtttgttttgggggaagg

SEQ ID NO: 10224 - DNA, 236 bp, Artificial Sequence
  Description of Artificial Sequence: Synthetic polynucleotide
ggtagcgtcgtttgcgtcgcgtttagtacgaagagttcgttttagtttaggcgtagtagcgttatttggtcggttatcggtagttcggggaagaagggcgcgtggcgcgtttattttacggtgttgaagagtagtcgcgtcgttagttcgtatacgttgtcgatgtttagtatcgcgttcgtcgcgtcgttttttgcgtcgaagcgttcggtcgtcgtagggtagggtttagcgcg

SEQ ID NO: 10225 - DNA, 233 bp, Artificial Sequence
  Description of Artificial Sequence: Synthetic polynucleotide
gagggtggggttttaaacgttatttaattagcgacgttgggttgggaattgtttaattaggtacgtagtttgagcggagaggacggttttcgggatgtggcgggatttgttcgtttttttgtttttggttgtcgttggaatttcgggtttcgtttttattgttttgtgttttttgtttttagaggtttagtttttggttttgtgatttgtaggtattgggaatttatagttaa

SEQ ID NO: 10226 - DNA, 737 bp, Artificial Sequence
  Description of Artificial Sequence: Synthetic polynucleotide
aatgacgtcgtaaataatagtattaattattatcgttcgtagttttcgcgtatagaggttttaggttttcggttttacgtggatcgatttcgttcggtagcgcggggttattttatcgcgagtttttttcgtagttcggttcgggttatttcgattcgttaggtttaatttaataattataatatcggaaaaggaagtaaaggtcgaagtttattcgcggttttgaggtttgtgggaaacgtagtttaataacgaaagagttttgaagtttaagcggagttcgttggtcgtaggggtcgtattacgttttagattttggagttttcgggtgcgtagatttttgttattagtagaggttgtcgttgcgcgttttttaggcgcggaagaggcggttggtggtttttgacggtaaggtgaagtcgaggtagtaatcgggaatttaggttgggaggatagaatggggaataggaagttggggcgagggtggttttgggggaggtggggggtcgcggaattttaggtggtttttgttttatttttggaaagaatcggaagttcgggtcggggagggtgaagggagtcgcggattcggttgtttagtcgaggaggaaattcggattttaggttgagggaggtcgaagaaggaattggagggtcgggttgggaaggtttgaagcgggtatagtttttaggttggggagggtcgaggggagaattcggagtttgagtcgggcgag

SEQ ID NO: 10227 - DNA, 308 bp, Artificial Sequence
  Description of Artificial Sequence: Synthetic polynucleotide
tttataggtcgagtttacgagtttttcgaggggtgagcggttcgggttttttggcgttttggtcggttagttaagcgttggattatattttttagaggtacggcgttcggagcgttggattatattttttagaggtatcgttttcggagcgtagttttattttcgttagtttgcgagatttggaggtttcgcgtggggagagggtcgcgtttgtggaggagtttggtttcgtatttgttgggttggcgaattcgaaattgggtttggaattcgggagttagattttggattttgaattgtatttttgt

SEQ ID NO: 10228 - DNA, 1100 bp, Artificial Sequence
  Description of Artificial Sequence: Synthetic polynucleotide
ttggttttacgtagcgtttgtagattgtgagttcgtagggtagcgttatcggtttatgtagtagtcgtcggtagcgcgggtagtcgagtaggtcgcggggcgcgcggggtttcggggtcggttttttttcgtcgggcgtttcgggttcgtcgttcgggtttttcgcggatagcggtcggtcgcgtaggtttacggcgcgtattaggtcgttcgttagtttttttagttttttcggtcgtagcgtttcgagtcgcgcggcgtcgcggaacgcgtttagggtttcggggaggcggtcggcgcgggttagcgcgttttttagttttaggtataggtcgcggttcggttgcgttagttcggttagtatggagcgaaagagttcggttgttatttcgtagtcgttcgcgcggaaggtttcgtcgtttttttttaagcgttgggcgatcggtttcgcgcggtcgtagttaggatattggggcggcggcggcggcgggatcggttcggggtttattatcgcggggttgcgacgacgcgggttcggagcgaaggcgcggagtagggaggatgcgttgttgttgggaattggtcggcgggagcgcggttttagttttcgttagtagttacgcgcgtttgggggcggcgcgttgcgagcggttgagatcgcgggcgggggcgggcgtttggtttgggtagcgtttttagcgcggtgtgggcggcgagtttcgtagggttgtaatcgtttcggggtgggggtcgggataggtatcgcgggcgtaatttgagtttttgtttacgcgtagcggttttttagtttcgtcggtttaggtaatttaggtcgttgcggtaacgtagtgatcgcgttttaggttcgcgttttttgcgatgttttttttattcgtttgagggtttttgcgcgattgcgcgcgcgttttttgtttgtcgttttttcgtagaggtgtcggggttttgggagtaggtggttttggtcgcgggttgttggcgcgtcggtatcgcggtatttgtttttttttagaggtttggtcgtttttataatttgtggtttcgtttaagtaagaatttaggaaaagttattaaacgtatta

SEQ ID NO: 10229 - DNA, 214 bp, Artificial Sequence
  Description of Artificial Sequence: Synthetic polynucleotide
ggcgagagtaaaaaaaaaaaaaaaaaaaaaaaaaaaaattttaattgtaaatattatttggaggtgggcgagggcgcggcgtgcgcgcggcggcgggtggcgggcggcgcgggcgtttttgcggggattttcggttttttagcgcgttttagtggacgttttgtttttcgttggtttttcgtgttcgttataatttgtaatatattattttttt

SEQ ID NO: 10230 - DNA, 582 bp, Artificial Sequence
  Description of Artificial Sequence: Synthetic polynucleotide
ttttttcgcgtgcgtttcgtatttgtcgggggttcgtattcgttttcgtcggggttttagggggtacgacggtcgtggttcggcgtttttgggaggggagcgggatattttcgaaggcggcgcgttggaggcggggagcggtcggggcgtacggagagggcggggagttcgcgggagggggaggagggggaggagggggaggaggcgcgaggtgggggggagcgcggcgggcggtagggagggagcgggagggaggtaagaaagtagtagaaagtgaggttggtaggcggcggtaaaggagtcggcgcgcggcggcggtaggaagtttgtgttcgagaatagtagaaataagagttagggagggatcgcggtcgcggcggcggcggcgagagcgaaagaggaaattgtagaggaggaagttgcgtcgtagttcgagtcgttcggtattttcgtcgtttttgcgttcgcgtcgcgttttcggcgttttttttttagcgcgttttcggtcgttttttcgcgtcgcgttcgtcggttatggttcgggagaacggcgagagtagttttttttggaaaaagtaagtt

SEQ ID NO: 10231 - DNA, 203 bp, Artificial Sequence
  Description of Artificial Sequence: Synthetic polynucleotide
ggcgatattcgcgttagttttcgggacggttgggttcgggttggtcgtcgattttcgattttttattagatgtttggtagagttcggcgcgttcggagttcgcgttttttagagggaaggggtcgcgcgtcgtcgcggcggttttgaggttgacggtcgggaggtgaaaggtcggagtgcggggttaggacgttttttggagg

SEQ ID NO: 10232 - DNA, 823 bp, Artificial Sequence
  Description of Artificial Sequence: Synthetic polynucleotide
cgagttattcgtatttttttttaggagttatagttaggttagaagagtgcggagggacggggttcgggaagagtagggaatttttagagttcgtagttaacgcggaggtgggcgagcgggcgtgcgcgtatttatttgtcggcgcgagggagtgtcgggggggaagggagtggtttttaaaagggggaggggagaaggtagggggcggggagaagtcggttttttaggattcggttgcggcggcgagggaggaggaagaagcggaggaggcggttttcgcgttcgtagggtcgtgttatttgttcgttcgttcgttcgttcgttcgttcgttgcgtcgcgttgtcgatcgttagtatgttgtcgagagtgggttgtttcgcgttgtcgttgtcgtcgtcgtcgttgttgtcgttgttgttgttgttattgggcgcgagtggcggcggcggcggggcgcgcgcggaggtgttgtttcgttgttcgttttgtatattcgagcgtttggtcgtttgcgggttttcgtcggttgcgtcgttcgtcgcggtggtcgtagtggtcggaggcgttcgtatgttatgcgcggagttcgttcgggagtcgggttgcggttgttgttcggtgtgcgttcggttggagggcgaggcgtgcggcgtttatatttcgcgttgcggttaggggttgcgttgttatttttattcgggtttcgagttgtttttgtaggcgttggttatgggcgagggtatttgtgagaagcgtcgggacgtcgagtatggcgttagttcggagtaggttgtaggtaacgcggtttggaataagtagttg

SEQ ID NO: 10233 - DNA, 293 bp, Artificial Sequence
  Description of Artificial Sequence: Synthetic polynucleotide
tcgcgcggtttttataatgtagggatttttttgagtggtggtcgttttcgttttagttttcggttattcgtagttttatatcgggttattggtttattatcgagatagttagcgagtttaggcggtttttgtagcgttgggagaggaatgtgcgcgaaattaattagagcgaaattagtcggaggagtcggtcgaggtgtaggtgtaggcgtagtttcgtttagaattttttcgttatatttaagggagttggaagttcgggagggtgttgttttttttttttaggaatagag

SEQ ID NO: 10234 - DNA, 262 bp, Artificial Sequence
  Description of Artificial Sequence: Synthetic polynucleotide
cggacgcgttgattggttttaggggaagcgggaggcgagaataatggtttttttttttcgttaaaagggagcggttgtcgggttcggggatagggacgcgcgtgtagggcgtagagttgggtcgagtcgtcgtcggcgttacgcgagtttcgtagtcgtcgcgttcgggtaatgggtcgggggtattgagggtcgtcggggtcgagcgcggaggggggatcgagttagtgtcgtgttttcgggtcgcgttaatatgtttcgc

SEQ ID NO: 10235 - DNA, 240 bp, Artificial Sequence
  Description of Artificial Sequence: Synthetic polynucleotide
tcgttgcggggtggagggattcgcgttttttagtttttcgggttcgggtcgcggggatcgtgcgcgcgtttttttttcgggtaaggtcgggcggcgggcgcgtcgcggtttttggggttttcgtttttttgttcgttatcgtttgcgggagtttttggtttggaggggttcggggcgcgttggcgattgcgggttcggcgataggggcggttggtggcgggaggatagtgggaggaaggt

SEQ ID NO: 10236 - DNA, 1240 bp, Artificial Sequence
  Description of Artificial Sequence: Synthetic polynucleotide
agcgggtcggggtcgtcggttaagtttttgtttggggacgcggcggcgcgtcggagagtttcgaggttgtttgtatcgttttagagttttgggttgtgttcgcgtagggatcgggtcgggtagagtcgggcggggtggagaggtaagcggagcgcgcggtggggttgaggggaggcgtggggcgagtgttcgttgttcgttttttagtttttttgtttttacgttttttcgttcgtagtcgttcgtagttcggcggtgtagttgtgttggattcggcggcgtcgtagttttttatcgttttttgatgttattggggtgcgggggttcgggcggttcggtgcgcgggttaatagttgtacggttttcgcggtttagcggcgtagggcggggcgcgtttgatagttttttcgtttttcgcgttagttgattggcggttcgagcggtttcggagcggcggaggtttggcggagcgttggagcggagtgggacggttagtttgggtttattttcgtattttgtaggtttcggtttacgtacgttcgtttggagtgcgcgttttatttttaggttaaattatcgttttttttttttcgcgtattttttttttttagttttttttgtattttatttttatttcgtgttatttttaaggaggtttagaatgagcgtcgggataacgttttttgggttttttgtttttaagcggttttcgtttagtgggcgacgttttgtgtgttttcgcggtttttggtcgtgtgtgtcgtgcgtttttgtttttggagatttgcgcgtatttgtatgttggggagggcgggttcgaggtttcgagagttgtgtttagatttaatttttaattttaggggattttttttaggttaagcgagggttttttttggcgggtgtagtcgtagagttttgaggttcgattttattggtttcgtcgtttttcgcgtttattttatcgtataatgtttatagtgaaggcgacgggaaaagtagtagtttaaaggttttgaatttttttttttcgttatacgtacggaattttgagttttcggagtttcggggtcgaggtcggttcgggacggtgtttcgagtagttttttattgttggggagtcggttttgtttttgtttgaacgttttgtaacgattaagtagatttcggcgttagttcgtcgcggagaggtttaaataggtataaagtgcgattttaagtggttattgtgcgtaaaggcgtc

SEQ ID NO: 10237 - DNA, 222 bp, Artificial Sequence
  Description of Artificial Sequence: Synthetic polynucleotide
gggcgatttgttgttttcgagtgtttttgggttgcgttttttttttttatttgggcggtcgcgttaagcgtagaggtcgcgggcgtttcggggttagaggcgttttcggttcgggttatggcgttcggcgtcgggggcgcgaggagcggtttatttagttagattttttatttcgttatcgttattagatattattatcgttgtgtagtgtgggtttttatt

SEQ ID NO: 10238 - DNA, 714 bp, Artificial Sequence
  Description of Artificial Sequence: Synthetic polynucleotide
tttagggaaagtttttgaaagtataattcggaaaatttagtaatttttaaaaaaaaatggtttttcgttgttataagttttttttttaagatttagggttcgtagtagaatattttgatttaaaataaaaatattatgataaaaatattttaggaggtagtcggttttatttcgtttaaagtcggatttcgtttagtttcgtgaaagcgaaggagtattagcgttttttgatttcgtatagttttttcggtagagacggttcgttttttttaagaatcggaagtcggatagcgttaggacgttttattttttttatttgggatttagagaggtagcggttaaggatagggttttcgtcgaggttatcgggtagcgtttaggtttcggtttttgggaggggagtagcgggggaggggtacggggaggggcgagggcggggcgcgtttgggtttcggcgttgggttttttttttgttcgtttcgggggatatttataggatttttgtagatttttgtcgaggtaggatggaggtttgtagggatgtatcgcgggttcgcgattcgggcggtcggaatatagttttttttggtcggagatcggttcggtcgtgagtcgtgtttgtgttaggttttttacgttgtgttttagggttttagtgttcggcgcgtcgggggttgtatcgttagttatttggggtaggaaaaaggaattata

SEQ ID NO: 10239 - DNA, 1216 bp, Artificial Sequence
  Description of Artificial Sequence: Synthetic polynucleotide
aagttttagaaacgttttcggaaagttttttttaatgggaagcgatttcgtcgttgagttaagcgttcgaattttttttttcgcggtagggatatcggttcgggttaggtttgcggaggacgttttcgggcgcgtatatatagttcgaggacgcgttttgtattttaagacgtagggtcggattttatttcgaaatttggtttttatagttttaggtcgaattgtgtttggtttttagttttcgagttcgagttttacgtcgtaaagagatggggttttattgtgtttagttggttttttagtacggacgtgtatttttttttggtttgttttttgttaaaaatcggtagtgcgtttcgtttttttgtttagtcgtagtttgtcgttttttagataaaaagcggcgatcgcggttcggttattcgagtttcgtcgcgttgcgtttttgttgggcggtttatagatggtgtttagtacggggtcgcgtcgagggcgggggcgggaggtcgcgaagagggtcgggcgggaggggaggagacggcggagtagttaattcgcgcgcggtttattagttgatcgtttttgtttatattaggtgtacgtcggttgcggggagtataaagcggggcgtatcgcgggcgtcggtaacgagtcggtgaacgaggcgaggttcgtgcgttcgcggttgtaagcgttcgtttggcggggagaggggtcgacggcgttagttcgggcggcggtatttttaggcgtttggggcgttttttttcggatttggtcgttcgttgtttcgttttttgtattttattttttcgatttttttttttagttttgtttttttttgttttggtttttgagagtcgattgagtttagtttcgtgtagtagcggttgtttgtgtcgtcgtttagttttcggttttggtgttttttcgggggtgttttaaggagttagtgcgcgttgcgggttgggaaggaggcgtcgtttagttagttttttttttttttttcgttttttttttttttttgttgttgttgtcgtcgtcgtcgtcgtgggtgtcgggttcgcgcgtattttaatatttttattagttgggtttcggggtaagtttttggtcggtcgcgtcgcggtaggaggtgtgggaggtagcgaggggaagtcgaggtaaatttggtggcgtgggagattttacggggtttggggaattttagggtaag

SEQ ID NO: 10240 - DNA, 207 bp, Artificial Sequence
  Description of Artificial Sequence: Synthetic polynucleotide
agtttttcgtaaatttcgtttttttcgtttggtacggtttttttgtatcgttgtgtttcgtttttaggtttttgttcgttaagaatgtttgtttcgggggcgcgttcgttggttaggaatttgtcggtagttttcgggaatttttgaggatgcggaggtgggttcgagagttgcggtttcgatgtcggggtgggagttaggtaggtc

SEQ ID NO: 10241 - DNA, 253 bp, Artificial Sequence
  Description of Artificial Sequence: Synthetic polynucleotide
acgtttagggataaattgggagtcgtgattgttaggtcgcgcggaggttgttttggtcgtttttgcggttaggtgaaggcgtagaggtagggaggtcgggcgagcgtaggcgggcggagagtagattacgcggaagaggtcgagagagaaagcggggtattcggtcgggggggttatttataagggacgttgggtacgaaggaggttggggcgaagatgagtttaggggttgggttgagagcgttgcgtagtc

SEQ ID NO: 10242 - DNA, 209 bp, Artificial Sequence
  Description of Artificial Sequence: Synthetic polynucleotide
ggacggtttgtgagggatgcgtcgtttattgtttcgcgtcgtttgatcgttttcgtttcgattcgcggtgcgttatagtcgggttcgcggtcgttttcgtcgcgttgtcgttcggtcgtcgcgttcgcggggtcgcgttcggtacggttatgtggatttttacggaggaggagaaatacggcgtaggtaggtgaggtttaggtttggtc

SEQ ID NO: 10243 - DNA, 225 bp, Artificial Sequence
  Description of Artificial Sequence: Synthetic polynucleotide
cgttcggtttcgtttcgtaggttgtaggcggttttggagggggcgttttcgtcgagcgcgcgtttcgcgtcgtcgtttcggattttttttcggcgtcgcgcgggtaggttcgattaggcggtcgcgggtttcggttttcggttagttttttagggttcgcggttcgtttcgtttcgcgcgttcgtttcgttgcgtaattcgatttaagttggaagtcgatcgtag

SEQ ID NO: 10244 - DNA, 1133 bp, Artificial Sequence
  Description of Artificial Sequence: Synthetic polynucleotide
aaggagagttggaagggttcgtgtagtaggatagcgggcggaagcggggcgggcgagcgcggggtcgtcggtcggtagtcggagtagttgtcgcggcgttcgaatttcggcggtcgtcgcgttttttcgtttcgcggagatcgacgtaggcgttcgttttcgaggtcgaagggtattgggcggcgagggttgcggtagttggcgatttcgggggcgtttgcgcggcgcgcgttagacgaggttgtttcggcggttatttcgcgatttcgcgtcgtcgggatttgcgcgcggagaacgtcggttttggagggagtacgtttttttaaagtgtagaggagggttcggcggcgcgttttcgcggaaattttttttattgtagttatttcggatgtcgatttagtagtttgtttttcgagaaaagagaggggatttgggtagaagggtttcgtttgttttaaaagaaggtgtaaggattagaagataacgaaacgtttattttttgaagggtgggaaaaaaagaaaaagaaaaaggagttatttacgttggagatgttcgttttagatttttttatttttttttttttcgtttcggttttttttttcgaggtttatttaatttgttagagaaggaggaggagtagaagatgggggtcgaggaggaggggaagagaaagagaagtttgttaagaataaagtttttgtcggtaagcgcggggatttcgtagtggagggtattgcggagtttcggggagttatagcgggggtttcgggtttaaatgtttttgttcggagttcgagtcgatatatatatttagttcgatttttttttgttttcggttcgagttttttagtttggttcgtcggttcgtcgttttgtacgttttcgtcggttagttttgttaaagtaaagagttgcgttttttgagttcgttcggtcgaggggaggggacgtttcgagtttggtcgcgtgcgaggtttcgggcgcgttttggtttttcggttcgagagcgcgtagttcgggtttttttttcgcgttttgtttcgtaggtgagcggttgcgtttttttattgtttttttttttttcgcgtttcgtcggcgttgaaaagttatttatttgcgtcgtttttttttt

SEQ ID NO: 10245 - DNA, 478 bp, Artificial Sequence
  Description of Artificial Sequence: Synthetic polynucleotide
cggttcgggaggcggaaggtcgcggatttgttcgatagaagagtagatgaggggagatcgaggacgttcgggttcggggagtttacgaggaggttaggatcgcggggtaaggaattcgcgggtagttattttcgttaggggtagggttcggttagttaggcgcgagaaggttaggcgaggtcgattgcgcggggtgaagacgttaggtcgatagttgcgggttttatcgttagttttgacgcgagtttgcgttttggcgacggcggagggcgggtagggggcgcgggcgttgttacggcgtttgtttagaatcggtcgggaacgtcgcgggcgggttttttcggtttttcgtttttttagttttgtttttaggttttcgttcgggttttttaagttgttagtcgcgttcgttttcgggtttttcgttttttttttcgcgcgtttttttttttagcggtcgtcggatttttttagttta

SEQ ID NO: 10246 - DNA, 201 bp, Artificial Sequence
  Description of Artificial Sequence: Synthetic polynucleotide
tcgtacgcggagtttataagttgtttgtgtcgttattttttcggttttggtatcgttagtattttttaggaattttttaaattcgttttacggtgtagaacggtaattgtatcgagtttttgtgttaattagtattttcgtaatatcgttagtcggttttttttttgttataatatattaaaacgtgttaaaatatattaa

SEQ ID NO: 10247 - DNA, 208 bp, Artificial Sequence
  Description of Artificial Sequence: Synthetic polynucleotide
gatgagcgtcgtgtagtatttttggttcgcgttgtttgttcgtgtcggttataggttgtaggttagtagggcgagcgcggcgagtcgggtagggttcgttcgtttcgcgtagtttatcgttttttcggtagtcgtcgttgttcgcggatcgggtttcggggtcggcgtttagaggcggggcgggcgcggttcgggcggcggcgggagc

SEQ ID NO: 10248 - DNA, 210 bp, Artificial Sequence
  Description of Artificial Sequence: Synthetic polynucleotide
atttcgtatacgtgtataaggtgttgaaataggtttatttcgatatcggtattttttttaaagttatggggattatgaatttttttgttaacgatattttcgagcgtatcgtcggcgaggtttttcgtttggcgtattataataagcgttcgattattatttttagggagatttagacggtcgtgcgtttgttgtttttcggggagttgg

SEQ ID NO: 10249 - DNA, 229 bp, Artificial Sequence
  Description of Artificial Sequence: Synthetic polynucleotide
tggtttatttgagtttaggggtttgagattaggatgattaatatggtgaaattttgtttttattaaaaaatataaaaattagtcgggttatggtggttgacgtttgtaattttagttatttaggaggtcgaggtaggagaattatttgaatttaggagcggacgttgtagcgatcggagatcgtattatcgtattttagttcgggcgagagggagattttgttttaaaa

SEQ ID NO: 10250 - DNA, 209 bp, Artificial Sequence
  Description of Artificial Sequence: Synthetic polynucleotide
aggcgggggagagagatgacgttggcggacgtggttagcgcgggggtcgggcggtgcgttgtaggttatttgtcggcgttttgagatttaggagttttcgcgttttcgcgtgggttttatagggtcggtttatagttttaatatagtagttgaatttttttcgttgcgtttttttttttttggaggggaatgttagaagagagagagag

SEQ ID NO: 10251 - DNA, 255 bp, Artificial Sequence
  Description of Artificial Sequence: Synthetic polynucleotide
gaaggggtttggagttttttttttggggtattgtgttgggattttgaggattggggattcggagggagggtaggcgtgtttttaattcgttgcgtcggaacggcgtttgatgagcggcgggttcggatacgaggggacggggtcgatttgtgggcggggttttggcgtcgtattaaaatcgcgtggggcggaggtcggtagaggtcgcgtagcgggtttagggtagggagtggttttgattcgttgcggaataat

SEQ ID NO: 10252 - DNA, 297 bp, Artificial Sequence
  Description of Artificial Sequence: Synthetic polynucleotide
aggtttcgtttattcgacgtaatttgttcgtttttttttatttttcgaagggtggagtttgaggtttcgtttttaagcggttttttttcggagtgtttggcggttagtagggcggggtaggaggttgggagagggacgggtgcgggggtgggggagaggaagggagcggttacgtgtgaggggcggttcgaggttacgtgacggagcgtcggagcggagggagtcggggttgggagtttttttgagggaagaggagtggagtaggggggacgcggcggcggcgttgataatggtgag

SEQ ID NO: 10253 - DNA, 232 bp, Artificial Sequence
  Description of Artificial Sequence: Synthetic polynucleotide
gtgagttggttggaaagagggggcggagtgcgcggagttagagtcgttatcgttgtcgtagttgtcgttattgcggcgtttgggttgagtcggagggaggcgggaggacgcgtaggggcggtcgtcgtcgtcgttaggttatcggggcgaaaatgcggtcgttgtcggaggttcgttaatttttcggggtggaagaggaggaggaggaggaggaaggggtttggagcgatta

SEQ ID NO: 10254 - DNA, 247 bp, Artificial Sequence
  Description of Artificial Sequence: Synthetic polynucleotide
tcgcgttcgtagtcgcgtttttgttttttcgattttcgtatttttatttggttcggttttttcgtttttttttcggtttttttttttaggatatttgtgtcgttttattttttttattatatacgtattttttattttaattttttcgtttttttgttttttttttttcgtcggtttttttttttcgttgttgtttcgagagttcgatgtgggagggaaggcgcgggggaggggaggtcgcgaaggg

SEQ ID NO: 10255 - DNA, 292 bp, Artificial Sequence
  Description of Artificial Sequence: Synthetic polynucleotide
gtttttcgagttttttgcggcgatttcgatttattttcgcgggtgcggggcgcggattcgttcggtttagtttttgttttttaggcgtttttttttttcgcgatttgtttcggtcgtattcgttttcgttttagtacgcgacgttgttcggcgcgatttttgttttttcggtttagttttatcgttgttttcgatttaattttagttgaacgttcgtagttttagttttattttcggtttagttttagcgtttttagttttattttcggttttagttttagttttagcgttt

SEQ ID NO: 10256 - DNA, 201 bp, Artificial Sequence
  Description of Artificial Sequence: Synthetic polynucleotide
gtagttcggttaacggacgggttagttggttttttttaggggtagttttgttttttttttcgtttcgttttttttttttttattatatcgggttgtaattcgagtcgtcgagttattgtttttttttcggatttttttcggaggttttgcggttcgggttttcgcgttttgttgttttatgtagttttgagttttatagta

SEQ ID NO: 10257 - DNA, 201 bp, Artificial Sequence
  Description of Artificial Sequence: Synthetic polynucleotide
ggttacgcgtgtttttggcgcgagtgtgcggggttaggtcgggagggcgtgcgcggatcgggcgtgtttacgcgcggtagggaggggttacgagggtgcgcgcgtttttggcgcgagtgggaagtgtggggattcggcgggttcggtgtgaggggcgtgtttttggggcgagagtggggagtgagtgtgaggagtaagggt

SEQ ID NO: 10258 - DNA, 201 bp, Artificial Sequence
  Description of Artificial Sequence: Synthetic polynucleotide
gggcgcggtcgggtaggttggggggtaggtaggggtcgttttcgcggggcgggaatttcgcgtttttttttttcgagttttattttttatggtaaagcggcgtggggcggcggggcggagggagtcgagggggcggggagggcggacgggcggaggggacgggaggtttagcggtttcgggtttcgttggttcgggcgtcg

SEQ ID NO: 10259 - DNA, 201 bp, Artificial Sequence
  Description of Artificial Sequence: Synthetic polynucleotide
attttttttttttatttttttttttttttttttattgttttttttatttttttttttttttcgtttttttttttggtttttttttttttcgttcgggattcggggggaggcgcgttgggtggttcggtagtcgggggcgggcggtagtttgtaggcgtaattggtatgtacgtcgttgtagttgagatcgtttaataaagt

SEQ ID NO: 10260 - DNA, 201 bp, Artificial Sequence
  Description of Artificial Sequence: Synthetic polynucleotide
tcgttttcgttaaaggtttttttaaggggtcgttttagggtttcgtttcgtgtttcgtttcggcgtttatttcggcgttcgtttttttttttttttgttgcggtttcggtaggggttgttgcggcgatttaggttgttgcggttttagttttattagttgttgttgttttttaaggagacgtcgtcgatagcggagtagtg

SEQ ID NO: 10261 - DNA, 201 bp, Artificial Sequence
  Description of Artificial Sequence: Synthetic polynucleotide
gtgcggtcggggcgttgttcggtagtgcggtgtttacgggattgataggtaggtaggtcgcgggttgggattcggatattaaagtaaaagtatcgttgggcgtcggaggagtcgcggggtttttattttttttttgattgatttttaaattttaatttgtatttttttcgtcgtttcgttttttttttttcgatttcgttt

SEQ ID NO: 10262 - DNA, 201 bp, Artificial Sequence
  Description of Artificial Sequence: Synthetic polynucleotide
tatcgcgtcgtgcgttcgcgttcggtcgttaggtgttttagtagttcgatcgtcgagatgtttagttcgtcggggtttcgggcgttatggttttgcgtcgcgttgtgcgtttttcggagggtcggcggcgttttttagttcggttcggggtttatcgtttgttcggttttttgttattgttaggaggacggtattatgttg

SEQ ID NO: 10263 - DNA, 241 bp, Artificial Sequence
  Description of Artificial Sequence: Synthetic polynucleotide
ttgcgcgttttggcggtaggaggcggggtcgggggcggggcgtgagttggtcggggcggggtttatggaggggcgggatcgcggcgttttataagtattgcggagcgaggcgcgcgttcggttagagagcgagcgcgtaacggcggcgacggcggcgattttatcgcgtattttgttaggttttcggcgtttagcgttttacgcgttttcgcgttttcgcgttttcgcgttttttttttcg

SEQ ID NO: 10264 - DNA, 201 bp, Artificial Sequence
  Description of Artificial Sequence: Synthetic polynucleotide
ggcggtaggcggcgcggcgggttgggcgcggcggtggttaggtcggtgcggttgtagtttatgtatagcgtgttagggttgttttgttcgggtagtcggtcgtagcgtatgcggtcgggttaggcgaagtcgtattggcgtatgagcggcgcgtagtcggttttggcgcgttcgtatatcgagcggtagggcggtagcggt

SEQ ID NO: 10265 - DNA, 201 bp, Artificial Sequence
  Description of Artificial Sequence: Synthetic polynucleotide
aagtggggtgaaaatgattttagtgaatagtttagttttttgggatagtggtttggtatttttgacgtgggagtggcgtttgttttgatttaatttggatcggtttagggataatatttttttcggagtagtcgttttgtttcgtttcgagtagtttagttgcgttttgtatgatcgaattggatattttttatttttttt

SEQ ID NO: 10266 - DNA, 201 bp, Artificial Sequence
  Description of Artificial Sequence: Synthetic polynucleotide
ttcgcgtttgtttcgtattacggagtcgggtttttagagtagtaaggttattaggtggcggtgttggcgtagtaggcggagcgtcgggtgcgcggggtcgcgtttttggttttcgaaggtgatgaagatgggtttgcgggtgagttttagtagtcggtataggttttttttgcggggcgggatcgttaggggggtgggtgt

SEQ ID NO: 10267 - DNA, 201 bp, Artificial Sequence
  Description of Artificial Sequence: Synthetic polynucleotide
acggttgggttttaggagatattcggaggggttcgcgggttcggttcggttttttcgttggggggttattagtcggtcggtagcgagatatttagaggttcgtttttttatcgcgttgttatagtaacggtttggtcggttgcgtttcgggtcgttcgttttatttcgcgggttcgttttgagttagtgattttagggatt

SEQ ID NO: 10268 - DNA, 201 bp, Artificial Sequence
  Description of Artificial Sequence: Synthetic polynucleotide
tttagatggttttaattattggaggaaaaaagcggtttttttggtatgcgtgaaaagtcggagttgggagagtttgggaaaagttgtttgtatcgttcgtcggtttttaaataaatcgatgagttttttttttttttttagttttcgggtttcgggggagttttataaaatttaaatgaaatttaaagaagttatttttgg

SEQ ID NO: 10269 - DNA, 201 bp, Artificial Sequence
  Description of Artificial Sequence: Synthetic polynucleotide
ttataaagtattagtggtgttttttcgaggaatttaagatttttcggtcggttgttaagtcgtcggaattttagtaggagaggaaggtttatttttttatcgtatggcgatgttcgggagattggagaagtttaggtaggtttggaagttaattttcggtatatagtagttttcgggaatgtagagttttagagtaagatt

SEQ ID NO: 10270 - DNA, 201 bp, Artificial Sequence
  Description of Artificial Sequence: Synthetic polynucleotide
tagtagagacggggttttaatatgttgtttagggtggtttcgaatttttgagtttaggtaattcgtttattttatttttttaaagtattgggattataggcgtgagttatcgcgttcggtttgatagtttttttagaatgaagtttgtttcggaaaaaagagttttggttagtgttttttttggggattagcggaaagtat

SEQ ID NO: 10271 - DNA, 201 bp, Artificial Sequence
  Description of Artificial Sequence: Synthetic polynucleotide
aggggagttgaggggcggagttatcggggcgcgttttcgcggttgcgttttttttcgtcggggagcgcgggtacgtaattcggagggtgttgggtcggttcggagtacgcgagtagcgggaggagggatcggggaatgattgacggaggcgggtcgtagaggtcgttgtgtttcgtcggttcgtattcggtcggagtgtgc

SEQ ID NO: 10272 - DNA, 201 bp, Artificial Sequence
  Description of Artificial Sequence: Synthetic polynucleotide
ggttttcgttttttttgtaggcggattcgttcgtttttaggtcggattcgcgttcgggatagggattcggtcgagtcgagtcgtcgcgttagcgttgcgtcgtcggtcggtgcgtttagcggatcggagttgcgcgcggaatcgtgttgtttcgtttcgttttattcgtgagggtgagtacgcggcggcggtgcgcggggg

SEQ ID NO: 10273 - DNA, 201 bp, Artificial Sequence
  Description of Artificial Sequence: Synthetic polynucleotide
cggggagggaggttttcggaatttcgagagagtattcgtgtttcgcgggtttcgtgtttcgttttcgggtttttttttttttaacgtaggggatttagttcggggtagtgtcgggtattggcgttggcgtttcgtttagttttgcgattttttttcgtttcgttttttttcgtttcgtttcgttttttttcgtttcgtttt

SEQ ID NO: 10274 - DNA, 239 bp, Artificial Sequence
  Description of Artificial Sequence: Synthetic polynucleotide
agagggcgagcgagagagagatatatatatatacgtatacgtatacgtaggttatatgaatgggaggcggtagttaattttacgaggtcggcgagtcgcgcggcgtattggcgttgggagtagggtcgtatttcggcgcgggggggcgttacgtaggtgatgggcgttttttcgggggttacgcgcggtcgtttttttattttagtttcggtttttttgtttttttttttttttttttt

SEQ ID NO: 10275 - DNA, 201 bp, Artificial Sequence
  Description of Artificial Sequence: Synthetic polynucleotide
tttttcgtttttatttatttttttttattttttttttttttttttcgttagtttcgtatttattttttttatttcgtaatttttttttgtttttatttatcggggttatggtcgtagaagaggtattgtagacggtggattattataagattgagatagagaggttaattaaggagtttacggagattatttacgagaaga
